United States Patent 8,664,475 (PLANTS WITH INCREASED YIELD) - sequence listing, part 5

SEQ ID NO: 10142 - DNA, 1167 bp, Glycine max
  CDS (1)..(1167)
atgaaagatgacaaacaggctccagttcctgcttctacaaccgaaggacaacctatacgatgtaaagcggcggtttctagaagagctggtgagccgttggttattgaggacatcattgtggcgccgccaaagcctcgtgaggctcggattcgtattatttgttcctctctctgccacagcgacatcacacttcggaaccttcaggaccctcctgccattttcccaaggattctaggtcatgaggcaactggggttgtggaaagtgttgggaaggatgtaactgaagttacaaaaggtgatgtggtaattccagttatcctaccagaatgtggggagtgcatagattgcaaatcaaccaagagcaaccggtgcactaattttcctttcaaggtgtctccttggatgcctcgagatggcaccacaagattcactggccaaaatggagagatcatataccatttcttgtttatttcaagtttcagtgagtacactgtggtggacattgctaatctgataaagattgatccagaaattcctcctgacagagcatgccttctcggatgtggtgtttcaacaggggtaggtgctgcttggagaactgcaggtgtggaacccgggtcaacagtagctatttttgggttgggatctattggattagctgttgcaaagggagctagactttgtggagcaactaggattataggtgtggacatcaacccagaaaagtttgaaattggaaagaagtttggagtcacagactttgtcaatgctggagaatgtgggggcaaacctgttggccaggttatcatagagataactgatggaggagcagattattgctttgaatgtgttggtaatgcatcattgatgcatgaagcatatgcttcttgtagaaagggttggggaaaaacaatagttttgggatcggacaagccaagctccaagttgagccttatctgtagtgagatcctcgttagtgggaaaagcctcgtgggatacatgtttagaggactcaaacccaagtctcatatgcctattctcattaaacactacttggacaaagaactaaatttagatgggtttgtcacacataaagtgaagttcaaacatatcaacaaagcttgtaatttaataattaaaggacagtgtcttcgatatgtaatttag

SEQ ID NO: 10143 - protein, 388 aa, Glycine max
MKDDKQAPVPASTTEGQPIRCKAAVSRRAGEPLVIEDIIVAPPKPREARIRIICSSLCHSDITLRNLQDPPAIFPRILGHEATGVVESVGKDVTEVTKGDVVIPVILPECGECIDCKSTKSNRCTNFPFKVSPWMPRDGTTRFTGQNGEIIYHFLFISSFSEYTVVDIANLIKIDPEIPPDRACLLGCGVSTGVGAAWRTAGVEPGSTVAIFGLGSIGLAVAKGARLCGATRIIGVDINPEKFEIGKKFGVTDFVNAGECGGKPVGQVIIEITDGGADYCFECVGNASLMHEAYASCRKGWGKTIVLGSDKPSSKLSLICSEILVSGKSLVGYMFRGLKPKSHMPILIKHYLDKELNLDGFVTHKVKFKHINKACNLIIKGQCLRYVI

SEQ ID NO: 10144 - DNA, 1089 bp, Glycine max
  CDS (1)..(1089)
atggcgtcgtcacaaccagagatggagcatccaaagaaggtttttggttgggctgctcgggactcatctgggcttctctccccattcaacttctccagaagagaaacgggggagaaagatttggtattcaaagtgcaatactgtggaatatgccactcagatctacatatgttaaagaacgagtggggcaacacaacctatcctctggttcctgggcacgagattgctggtgtggtaacagaagttggaagcaaggtgcaaaagttcaaagttggagaccgggtaggtgtggggtgcatgattggatcctgtcgttcatgtgaaagctgtgatgaaaatcttgagaattactgccccaaaatgattctcacatacggtgtcaagtattttgatggcaccataacacatggaggctactctgacttgatggttgcggatgaacactttgtggttagaattccggataacctaccacttgatgctgctgctcctctcctctgtgctgggatcactgtgtatagccctttgagatactatggacttgacaagcctggtctgaatcttggtgtggttggtcttggtggacttggtcacatggctgtcaagtttgccaaagctcttggagctaatgtcacagtgattagcacatctcctaacaaaaagaaggaagccattgagaacataggagctgactcatttgtggttagccgtgaacaagatcagatgcaggctgtaatgggaaccatggatggtatcattgacacagtttctgctgtccatcctcttgtgcctttgattggcctgttgaagcctcatggtaaactagtcatggttggtgcaccagagaagcctttggagttgccagtattttctttacttatggggaggaaaatggttggtggcagtagcatcggagggatgaaagagacgcaagaaatgattgattttgctgctaagcatggagtgaagcctgatattgaggttattcccatagattatgtgaacactgcaatagagcgcctcgccaaagcagatgtgaaatatcgatttgtaattgacattggaaacacgttgaagccaagctcttga

SEQ ID NO: 10145 - protein, 362 aa, Glycine max
MASSQPEMEHPKKVFGWAARDSSGLLSPFNFSRRETGEKDLVFKVQYCGICHSDLHMLKNEWGNTTYPLVPGHEIAGVVTEVGSKVQKFKVGDRVGVGCMIGSCRSCESCDENLENYCPKMILTYGVKYFDGTITHGGYSDLMVADEHFVVRIPDNLPLDAAAPLLCAGITVYSPLRYYGLDKPGLNLGVVGLGGLGHMAVKFAKALGANVTVISTSPNKKKEAIENIGADSFVVSREQDQMQAVMGTMDGIIDTVSAVHPLVPLIGLLKPHGKLVMVGAPEKPLELPVFSLLMGRKMVGGSSIGGMKETQEMIDFAAKHGVKPDIEVIPIDYVNTAIERLAKADVKYRFVIDIGNTLKPSS

SEQ ID NO: 10146 - DNA, 1161 bp, Glycine max
  CDS (1)..(1161)
atggaacataaattagcaacaactgaaggacaacccataagatgtaaagcggcggtttgtcgcaaagctggtgagccactgggtattgaggagatcatggtggcgccaccaatgcctggtgaagctcgcattcgtattatatgctcctctctctgtcgaactgatatcagtttccggaacatgcaggggcctccggccaatttcccaacaattctgggtcatgaggcaataggggttgtggagagcgtaggagaggatgtaactgaagttgcaaaaggagatatggttgtcccaattttcatagctgaatgtggggagtgtatagattgcaaatcaagcaagagcaacctttgttcaaagtttcctttcaagctgtctccttggatgcctagacatgccacttctagattcgtggatttaaaaggagagatcatacaccacttcttgtctgtttctagttttagcgagtacaccgtggtcgacatcgcccatctaaccaagattgatccggaagttcctcccagcaaggcatgcctcctcagttgtggtgtatcaaccggggtaggtgctgcttggagaacagcaggtgtggagccagggtctacagtagctattttcgggctgggaagtattggattagctgttgctgagggagctagactttgtggagcaacaaggattataggtgtggatatcaactcagaaaaatatgaaatcggaaagaagtttggaatcacggattttgttcattctggagaatgtgaaaacaaatctgcgagccaggttatcatagagatgactgatggaggagcagattattgttttgaatgtgttggtaatgcatcattgatgcatgaggcatatgcttcttgtagaaagggttggggaaaaacaatagttttgggatcggacaagccaggctccaagttgagccttagctgtagtgagatcctcgttagtgggaagagcctcgtgggatgcatgtttggaggactcaaacccaagtctcatgtgcctattctcattaaacgctacttggacaaggaactgaatttggatgggtttgtcacacatgaagtggagttcaaagatatcaacaaagcttttgatttaatgattaaaggacagtgtcttcgatgtgtgatttggatggacaaatga

SEQ ID NO: 10147 - protein, 386 aa, Glycine max
MEHKLATTEGQPIRCKAAVCRKAGEPLGIEEIMVAPPMPGEARIRIICSSLCRTDISFRNMQGPPANFPTILGHEAIGVVESVGEDVTEVAKGDMVVPIFIAECGECIDCKSSKSNLCSKFPFKLSPWMPRHATSRFVDLKGEIIHHFLSVSSFSEYTVVDIAHLTKIDPEVPPSKACLLSCGVSTGVGAAWRTAGVEPGSTVAIFGLGSIGLAVAEGARLCGATRIIGVDINSEKYEIGKKFGITDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 10148 - DNA, 1140 bp, Glycine max
  CDS (1)..(1140)
atgtctacagctggtcaggtcatcaagtgcagagctgcggtggcatgggaagcagggaagccactatcgatagaaaccatagaagtggcaccaccccagaaaggtgaagtgcgtttgaagatcctcttcaactccctttgccgtacagatgtttactggtgggatgctaagggccagactccgctgtttcctcgtatcttaggccacgaagcttcggggattgtggagagcgtgggcaagggtgtgacacatctgaaaccaggtgaccatgctctcccaatattcactggggagtgtggtgaatgcacctattgcaagtctgaagagagcaacctgtgtgagcttctcaggatcaacactgacagaggagtgatgctcagtgatggcaaaacaaggttctccaaaaatggacaacctatttaccacttcgttggaacctccactttcagtgaatacactgttctccatgaaggatgtgtcgccaagatcaaccctgctgcccctcttgacaaagttgctgttgtcagttgtggattctgcacaggttttggggctactgtgaatgttgcaaagccaaagcctaataatactgttgctgtatttggattaggagctgttggtcttgctgcctgtgaaggggcaagggtttctggtgcatctagaatcatcggggttgatttacttaccaatcgatttgaacaagccaaacaatttggggtcactgattttgtgaacccgaaagatcacaacaaaccagttcaagaggtcattgctgaaatgactaatggaggagtagatcgtgctattgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcactctgtcccattctcagagatcaacactgcatttgatcttatgctgaaaggggagggaataaggtgcctcatctgcatggaagagtaa

SEQ ID NO: 10149 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPAAPLDKVAVVSCGFCTGFGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKELELDKFITHSVPFSEINTAFDLMLKGEGIRCLICMEE

SEQ ID NO: 10150 - DNA, 1143 bp, Glycine max
  CDS (1)..(1143)
atgtcgagcacagctggccaagtcatcaaatgcaaagctgcggtttcatgggaggcagggaagccacttgtgattgaagaagtagaggttgcgccaccacaagctggtgaagtgcgtttgaagatcctctacacctctctttgccacactgatgtttacttctgggaagctaagggccaaactccattgtttcctcgtatatttggtcatgaagctggagggattgtggagagcgtaggtgagggtgtgactcatctgaaaccaggggaccatgccctccctgtgtttaccggggagtgtggggactgccctcattgcaagtcagaggagagcaacatgtgtgatcttctcaggatcaacactgataggggtgtcatgatccatgatagccaaacaaggttttctataaagggacaacctatttaccattttgttggtacctccacattcagtgaatacactgttgttcatgccggatgtgttgccaaagtcaaccctgctgccccacttgacaaaatttgtgttctcagttgtggaatttgcacaggtcttggggctactatcaatgttgcaaaaccaaaacctggttcttctgttgccatttttggacttggagctgttggccttgctgctgctgaaggggcaaggatttctggtgcatcaagaattattggggttgatttagtttctagcagatttgaagaagctaagaagtttggggtcaatgaatttgtgaacccaaaagaccatgacaagcctgtacaagaggtgattgctgcaatgacgaatgggggtgtggatcgtgctgttgaatgtactggcagcatccaagccatgatctcggcattcgaatgcgtccacgatggttggggtgttgctgtacttgttggagtgccaaacaaagatgatgcattcaaaactcatccagtgaatttcttgaacgagagaactctaaagggtaccttctacggaaactacaaaccccgcactgatcttccttctgttgtggagaagtacatgaatggggaattggaactggagaaattcatcactcacacagttccattctcagagattaacaaggcttttgattacatgctgaaaggggagtccatcagatgcatcattcgaatgggggagtaa

SEQ ID NO: 10151 - protein, 380 aa, Glycine max
MSSTAGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 10152 - DNA, 1083 bp, Glycine max
  CDS (1)..(1083)
atggctaaatctccagaaactgaacttcccgtcgaagctttcggttgggctgcttcagacacttctggcacccttgcaccttttcatttctccagaagagaaaatggcgttgatgacgtcactctcaagattctcttctgcggggtttgccactcggatctccacactctcaaaaacgactggggtttcaccacttaccctgtcgttcctgggcatgaaattgttggtgttgtgacaaaagttggcaacaatgtgaaaaacttcaaagtgggtgataaagttggagttggtgtgatagtggagtcttgcaaggaatgtgaaagttgccaacaagatctggagagttactgtccccgccctgtttttacctataactctccttattatgatgggacacgaaccaaacgtggttattctaacatcatggttgtgcaccagcgttatgtgctccgatttcctgagaacttgcctcttgatgctggtgctcctctgctgtgtgctgggataactgtgtatagcccgatgaaatattatgggatgacagagccaggcaaacatttgggagtggcagggcttggtgggttaggtcatgttgcaatcaaacttgctaaggcgtttgggctgaaagttactgtcatcagtagctctcctaacaagcaagctgaggccattgaccgactcggggctgattctttccttgtttcatcagaccctgcaaaaatgaaggtggctttgggaaccatggactatatcatagacacaatttctgctgttcattccctgattccactgcttggtctgctgaagctgaatgggaagctagttactgtagggttgcctaacaagccccttgagcttcctatctttccattagttgcaggacggaaacttataggggggagcaactttggagggatcaaagaaactcaggaaatgcttgatttctgcgcaaagcacaacataactgcagatattgagctgattaagatggatcagatcaacacagccatggaaaggcttagcaaagctgatgtgaaatatcgctttgtgattgatgtggcgaactctttcgcaagtttgtag

SEQ ID NO: 10153 - protein, 360 aa, Glycine max
MAKSPETELPVEAFGWAASDTSGTLAPFHFSRRENGVDDVTLKILFCGVCHSDLHTLKNDWGFTTYPVVPGHEIVGVVTKVGNNVKNFKVGDKVGVGVIVESCKECESCQQDLESYCPRPVFTYNSPYYDGTRTKRGYSNIMVVHQRYVLRFPENLPLDAGAPLLCAGITVYSPMKYYGMTEPGKHLGVAGLGGLGHVAIKLAKAFGLKVTVISSSPNKQAEAIDRLGADSFLVSSDPAKMKVALGTMDYIIDTISAVHSLIPLLGLLKLNGKLVTVGLPNKPLELPIFPLVAGRKLIGGSNFGGIKETQEMLDFCAKHNITADIELIKMDQINTAMERLSKADVKYRFVIDVANSFASL

SEQ ID NO: 10154 - DNA, 1095 bp, Glycine max
  CDS (1)..(1095)
atgggtaaggggggaatgtcaattgatgaacatggagaaggcaaagaagagaatatggctgcttggcttgttggaatgaacactctcaagattcagcctttcaagcttcctactttgggaccccatgatgtcagagttagaatgaaggctgttggtatctgtgggagtgatgttcactacctcaagacactgaggtgtgctcactttatagttaaagaaccaatggttattggtcatgagtgtgctgggatcatagaagaagttggtagtcaggtaaagagtttggtgcctggtgaccgtgtggcaattgagcctgggatcagttgttggcattgcaaccattgcaaacacggtcgatataacttatgcgatgatatgaagttttttgctactccaccagttcatggttccctggctaatcagatagtgcatcctgcagacctatgttttaagctgccagacaacgtgagcctagaggagggagcaatgtgtgaacccttaagtgttggtgttcatgcttgtaggagagctaatattggaccagaaacatatgtgttaatcatgggagcaggacctataggacttgttacaatgcttgcagctcgtgcttttggggcacccaggactgtcattgtggatgtagatgactatcgtttatctgttgcaaaatcacttggtgccgatgacattgttaaagtctcaacaaacattcaggatgtggctgaagaagttgtgcagatacagaaggttatgggagctgatatagatgttacctttgattgtgctggttttgacaaaaccatgtctacagcactgagtgctactcagccaggtggcaaagtttgtctagtgggaatgggacattctgaaatgactgtcccactcaccccagctgcagcaagggaagttgatgtgcttggagtttttcgctatatgaacacatggcctctttgccttgagtttctaaggagtggaaaaatcgatgtaaaaccccttataactcataggtttgggttttctcaaaaggaagtggaagaagcctttgaaacaagtgctcgtggtggtaacgccatcaaggttatgttcaatctttag

SEQ ID NO: 10155 - protein, 364 aa, Glycine max
MGKGGMSIDEHGEGKEENMAAWLVGMNTLKIQPFKLPTLGPHDVRVRMKAVGICGSDVHYLKTLRCAHFIVKEPMVIGHECAGIIEEVGSQVKSLVPGDRVAIEPGISCWHCNHCKHGRYNLCDDMKFFATPPVHGSLANQIVHPADLCFKLPDNVSLEEGAMCEPLSVGVHACRRANIGPETYVLIMGAGPIGLVTMLAARAFGAPRTVIVDVDDYRLSVAKSLGADDIVKVSTNIQDVAEEVVQIQKVMGADIDVTFDCAGFDKTMSTALSATQPGGKVCLVGMGHSEMTVPLTPAAAREVDVLGVFRYMNTWPLCLEFLRSGKIDVKPLITHRFGFSQKEVEEAFETSARGGNAIKVMFNL

SEQ ID NO: 10156 - DNA, 1095 bp, Glycine max
  CDS (1)..(1095)
atgggtaaggggggaatgtcaattgatgaacatggagaaggcaaagaagagaatatggctgcttggcttgttggaatgaacactctcaagattcagcctttcaagcttcctactttgggaccccatgatgtcagagttagaatgaaggctgttggtatctgtgggagtgatgttcactacctcaagacactgaggtgtgctcactttatagttaaagaaccaatggttattggtcatgagtgtgctgggatcatagaagaagttggtagtcaggtaaagagtttggtgcctggtgaccgtgtggcaattgagcctgggatcagttgttggcattgcaaccattgcaaacacggtcgatataacttatgcgatgatatgaagttttttgctactccaccagttcatggttccctggctaatcagatagtgcatcctgcagacctatgttttaagctgccagacaacgtgagcctagaggagggagcaatgtgtgaacccttaagtgttggtgttcatgcttgtagaagagctaatattggaccagaaacatatgtgttgatcatgggagcagggcccataggacttgttacaatgctggcagctcgtgcgtttggggcacccaaaacagtcattgtggatgttgatgaccatcgtttatctgttgcaaaatctcttggtgcagatgatattattaaagtctcaacaaacattaaggatgtggctgaagaagttgtgcagatacagaaggttatgggagctgatatagatgttacctttgattgtgctggttttgacaaaaccatgtctacagcactgagtgctactcagccaggtggcaaagtttgtctagtgggaatgggacattctgaaatgactgtcccactcaccccagctgcagcaagggaagttgatgtgcttggagtttttcgctatatgaacacatggcctctttgccttgagtttctaaggagtggaaaaatcgatgtaaaaccccttataactcataggtttgggttttctcaaaaggaagtggaagaagcctttgaaacaagtgctcgtggtggtaacgccatcaaggttatgttcaatctttag

SEQ ID NO: 10157 - protein, 364 aa, Glycine max
MGKGGMSIDEHGEGKEENMAAWLVGMNTLKIQPFKLPTLGPHDVRVRMKAVGICGSDVHYLKTLRCAHFIVKEPMVIGHECAGIIEEVGSQVKSLVPGDRVAIEPGISCWHCNHCKHGRYNLCDDMKFFATPPVHGSLANQIVHPADLCFKLPDNVSLEEGAMCEPLSVGVHACRRANIGPETYVLIMGAGPIGLVTMLAARAFGAPKTVIVDVDDHRLSVAKSLGADDIIKVSTNIKDVAEEVVQIQKVMGADIDVTFDCAGFDKTMSTALSATQPGGKVCLVGMGHSEMTVPLTPAAAREVDVLGVFRYMNTWPLCLEFLRSGKIDVKPLITHRFGFSQKEVEEAFETSARGGNAIKVMFNL

SEQ ID NO: 10158 - DNA, 1140 bp, Glycine max
  CDS (1)..(1140)
atgtctacagctggtcaggtcatcaagtgcagagctgcggtggcatgggaagcagggaagccactatcgatagaaaccatagaagtggcaccaccccagaaaggtgaagtgcgtttgaagatcctcttcaactccctttgccgtacagatgtttactggtgggatgctaagggccagactccgctgtttcctcgtatcttaggccacgaagcttcggggattgtggagagcgtgggcaagggtgtgacacatctgaaaccaggtgaccatgctctcccaatattcactggggagtgtggtgaatgcacctattgcaagtctgaagagagcaacctgtgtgagcttctcaggatcaacactgacagaggagtgatgctcagtgatggcaaaacaaggttctccaaaaatggacaacctatttaccacttcgttggaacctccactttcagtgaatacactgttctccatgaaggatgtgtagccaagatcaaccctgatgccccacttgacaaagttgctattgtcagctgtggattctgcacaggttttggggctactgtgaatgttgcaaaaccaaagcctagtaatactgttgctgtctttggcttaggagctgttggtcttgctgcctgtgaaggggcaagggtttctggtgcatctagaatcatcggggttgatttacttaccaatcgatttgaacaagccaaacaatttggggtcactgattttgtgaacccgaaagatcacaacaaaccagttcaagaggtcattgctgaaatgactaatggaggagtagatcgtgctattgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcactctgtcccattctcagagatcaacactgcatttgatcttatgctgaaaggggagggaataaggtgcctcatctgcatggaagagtaa

SEQ ID NO: 10159 - protein, 379 aa, Glycine max
MSTAGQVIKCRAAVAWEAGKPLSIETIEVAPPQKGEVRLKILFNSLCRTDVYWWDAKGQTPLFPRILGHEASGIVESVGKGVTHLKPGDHALPIFTGECGECTYCKSEESNLCELLRINTDRGVMLSDGKTRFSKNGQPIYHFVGTSTFSEYTVLHEGCVAKINPDAPLDKVAIVSCGFCTGFGATVNVAKPKPSNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKELELDKFITHSVPFSEINTAFDLMLKGEGIRCLICMEE

SEQ ID NO: 10160 - DNA, 1146 bp, Glycine max
  CDS (1)..(1146)
atgtcgtcgagcacagttggtcaagtcatcaaatgcaaagctgcggtttcatgggaggcagggaagccacttgtgattgaagaagtagaggttgcgccaccacaagctggtgaagtgcgtttgaagatcctctacacctctctttgccacactgatgtttacttctgggaagccaagggccaaactccattgtttcctcgtatatttggtcatgaagctggagggattgtggagagcgtaggtgagggtgtgactcatctcaaaccaggggaccatgccctcccagtgtttaccggggagtgtggagaatgccctcattgcaagtcagaggagagcaacatgtgtgatcttctcaggatcaacactgataggggtgtcatgatccatgacagccaaacaagattttctattaagggacaacctatttaccattttgttggtacctccacattcagtgaatacactgttgttcatgccggatgtgttgccaaagtcaaccctgctgccccacttgacaaaatttgtgttctcagttgtggaatttgcacaggtcttggggctactatcaatgttgcaaaaccaaaacctggttcttctgttgccatttttggacttggagctgttggccttgctgctgctgaaggggcaaggatttctggtgcatcaagaattattggggttgatttagtttctagcagatttgaagaagctaagaagtttggggtcaatgaatttgtgaacccaaaagaccatgacaagcctgtacaagaggtgattgctgcaatgacgaatgggggtgtggatcgtgctgttgaatgtactggcagcatccaagccatgatctcggcattcgaatgcgtccacgatggttggggtgttgctgtacttgttggagtgccaaacaaagatgatgcattcaaaactcatccagtgaatttcttgaacgagagaactctaaagggtaccttctacggaaactacaaaccccgcactgatcttccttctgttgtggagaagtacatgaatggggaattggaactggagaaattcatcactcacacagttccattctcagagattaacaaggcttttgattacatgctgaaaggggagtccatcagatgcatcattcgaatgggggagtaa

SEQ ID NO: 10161 - protein, 381 aa, Glycine max
MSSSTVGQVIKCKAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 10162 - DNA, 1140 bp, Glycine max
  CDS (1)..(1140)
atggcaactcaaggtcaagtcattacctgcaaagctgcggtggcctgggaacccaacaagcccttaaccgtccaagacgttcaggttgctccgcctcaggccggcgaggtccgtgtccaaatcctcttcaccgctctctgccacaccgatgcttacacttggggcggcaaggatcccgaaggtctcttcccctgtattctcggccacgaagctgcagggattgtggagagtgttggagaaggtgttactaatgttcagcctggggatcatgtcattccctgttaccaggctgagtgtggggagtgcaagacttgcaaatcggggaagacaaacctctgtggcaaggttcgttccgccactggagttggggtcatgctcaatgatggaaagagccggttctccattaatgggaagcccatttatcatttcatgggaacatccacttttagtcaatacactgttgttcatgacgttagtgtagctaagattgacccggtagctcccttggagaaagtttgccttcttggatgtggtgtttcaactggacttggagctgtctggaacactgcaaaagtggagtcagggtcaattgttgctatttttggccttggaactgttgggcttgctgttgcagagggtgcaaaaactgctggtgcatcccgggttattggcatagatattgacagcaagaagtttgatatagcgaaaaactttggagtcaccgagtttataaatccaaacgaacatgataaaccaatccagcaggtcatcattgatcgcacagatggtggagttgattatagctttgagtgcattggaaatgtctctgtgatgagagctgctttggaatgctgccacaagggctgggggacgtcagttattgtgggtgttgcagcatcagggcaggaaatatctacccgtcctttccagttggtgagtggacgtgtctggaaaggaacagcttttggtggcttcaagagcaggtcacaggtgccttggcttgtagacaagtacttgaagaaagaaatcaaggttgatgagtatattacccatactttgaccctttcggagatcaacaaggcttttgatcttttgcatgaagggagatgtcttcgttgcgtgctgtcaacacaagaatga

SEQ ID NO: 10163 - protein, 379 aa, Glycine max
MATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPVAPLEKVCLLGCGVSTGLGAVWNTAKVESGSIVAIFGLGTVGLAVAEGAKTAGASRVIGIDIDSKKFDIAKNFGVTEFINPNEHDKPIQQVIIDRTDGGVDYSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGRCLRCVLSTQE

SEQ ID NO: 10164 - DNA, 1152 bp, Zea mays
  CDS (1)..(1152)
atggcggaggaccggagccccaagcccatccactgcaaagcggcggtgtgccgagccgccggcgagccactcaccatcgaggagatcgtcgtcgacccgccgaaagcgtacgagatccgcatccgggtcatctgcacctcactctgccacaccgatatcaccttctggaaagctaaggtggcaccggtgtttccaagaatactagggcatgaggcgtacggggtagtggagagcgtgggggagcacgtggagggcttcgcggcgggggacaccgtggtgccgacgttcctggggcagtgcgagcgctgcgccagctgcgcgtcggagcacagcaacgtgtgcgacgcggtgccgttcgtcatcggccccgggatgcggcgcgacggcaccacccggttccgggacgcgcgggggagcccgctgcacgacctcctcgccgtctccagcttcagcgagtacaccgtcgtggacgtgaaccaggtggtcaaggtcgaccccgccgtgccgcccaagctcgcctgcctcctcagctgcggcgccggcaccggggtaggagcagcgtggaggtctgccaaggtggagccaggatccactgttgcaatctttggcctcggatctgtcggtttggcggtggtccaaggcgcgaaaatgtgtggcgcatccaagatcatcggcgttgatctcaaccctgacaaggaggaagtagggagatcgttcggcgtcacagacttcgtcaatccatcgcagctggacaagcgttccgtcgtagaggtgatcgttgagatgaccggcggcggcgtggactacagcttcgagtgcatcggcgtgccgtcggtgatgaccgacgccttcagatgcaccaagatggggaagggcaagacgatcgtgctggggctggggagggacagcgacgaggtgtgcctgccgtcgctggagctgctgttcgggaggtgcgtcatggggtcgctcttcggcgggctgaagcccaagacccacatccccgtcctcgccaagaaatgcatggacaaggagctgcagctggacgcgctggtcacgcatgagcttggactgcaggacatcaacaaggccttcgacctgctcctgcaggggaaaagtctgcgctgcatcctctggatggacaaggacaagtaa

SEQ ID NO: 10165 - protein, 383 aa, Zea mays
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 10166 - DNA, 1164 bp, Glycine max
  CDS (1)..(1164)
atggaagataaactagcaacaacaagtgaaggacaacccataagatgtaaagctgcgatttgtcgcaagccaggttctccattgagtattgaggagatcattgtggcaccaccaatgcctcgtgaagctcggattcgtgttatatgcacttctctttgtcacagcgatgttactttttggaaaatggaggtccctcctgcaatttgtccaagaattttgggtcatgaggctgttggggttgtggaaagcgtaggagaggatgtaaccgaagtcacaaaaggagatgtggttgttccaattttcttacctgattgtggggagtgtatagattgcaaatcaagcaagagcaacctttgttcaaagtttccttttgaggtgtctccttggatgcctagacatgccacctctagattcacggatttaaaaggagatatcatacaccatttcttgtttgtgtctagttttagcgagtataccgtggttgacattgctcatctaaccaagattgatccagcaataccacccaacagggcatgcctacttagttgtggtgtatcaaccggggtaggtgctgcttggagaacagcaggtgtggagccagggtctacagtagtcatttttgggttgggaagtattggattagcagttgccgagggagctagactttgtggagcaactaggattataggtgtggatgtcaacccagaaaaatatgaaactggaaaaaagtttggactcactgactttgtccatgctggagaaagtgaaaacaaatctgtgagccaggttatcataaagatgactggtgggggagcagattattgctttgaatgtgttggaatggcaacattggtgcaggaagcatatgcttcttgtagaaagggttggggaaaagcaatagttttaggagtggagaagccgggatccatgttgagccttagctgtaatgaggtcctccatagtgggaagagcctcgtggggtgcttatttggaggactcaaacccaagtctgatgtacctattctccttaaacgctacatggacaaggaactgaatttggatgagtttgtcacacatgaggtggagttcaaggatatcaacaaagcttttgatttattgattgaaggacagtgccttcggtgtgtgatttggatggacagatga

SEQ ID NO: 10167 - protein, 387 aa, Glycine max
MEDKLATTSEGQPIRCKAAICRKPGSPLSIEEIIVAPPMPREARIRVICTSLCHSDVTFWKMEVPPAICPRILGHEAVGVVESVGEDVTEVTKGDVVVPIFLPDCGECIDCKSSKSNLCSKFPFEVSPWMPRHATSRFTDLKGDIIHHFLFVSSFSEYTVVDIAHLTKIDPAIPPNRACLLSCGVSTGVGAAWRTAGVEPGSTVVIFGLGSIGLAVAEGARLCGATRIIGVDVNPEKYETGKKFGLTDFVHAGESENKSVSQVIIKMTGGGADYCFECVGMATLVQEAYASCRKGWGKAIVLGVEKPGSMLSLSCNEVLHSGKSLVGCLFGGLKPKSDVPILLKRYMDKELNLDEFVTHEVEFKDINKAFDLLIEGQCLRCVIWMDR

SEQ ID NO: 10168 - DNA, 1140 bp, Zea mays
  CDS (1)..(1140)
atggcgacagcagggaaggtgatcaagtgcagagctgccgtggcgtgggaggccggcaagccgctgtccatcgaggaggtggaggtagcgccgccgcaggccatggaggtgcgtgtcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggcaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattag

SEQ ID NO: 10169 - protein, 379 aa, Zea mays
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 10170 - DNA, 1146 bp, Zea mays
  CDS (1)..(1146)
atggcttcccccacccagggccaggtcatcacctgcaaagcggcggtggcgtacgagccgaacaagccactcgtgatcgaggacgtgcaggtggcgccgccgcaggccggcgaggtccgcgtcaagatcctattcaccgcgctctgccacaccgaccactacacctggagcggcaaggatcctgagggtcttttcccttgcattcttggccacgaagctgccggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccggagtgccacaggcgtaggtgtcatgatgaatgatatgaagagcaggttctctgtaaatggaaagcccatttaccatttcatggggacatcaacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcgattatgagggctgcactggaatgctgccacaagggctggggaacctccgtcatcgtcggcgtcgccgcctctggccaggagatcgccacacgaccattccagctcgtgactggtcgtgtctggaagggaaccgctttcggtggcttcaagagccggacccaggtcccatggcttgttgacaagtacatgaagaaggaaattaaggtggacgagtacattacgcacaacatgaacctggctgacatcaatgacgccttccacctgctccacgaaggtggctgtctgcgttgtgtgctggcgatgcagatctga

SEQ ID NO: 10171 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 10172 - DNA, 1086 bp, Zea mays
  CDS (1)..(1086)
atggaggtgacaccaaaccacaccctgaccgtgaccgggtgggcggccatgaacgagtccgccggcaaggtggagcccttcgtcttcaagagaagggagaacggccctgacgacgtgacgatcaaggtgcagtactgcggcatgtgccacacggacctgcacttcatcaacaacgactggggcatcaccacgtacccgctggtcccggggcacgagatcacgggcgtggtcaccaaggccgggcgcaacgtcacgggcttccgcgtcggcgaccgcgtcggcgtgggctgcatcgccgcctcctgcctggactgcgaccactgccgccgctccgaggagaactactgcgaccgtgtggcgctcacctacaacggcgtcttctgggacggcagcgtcacgtacggcggctactcgcgcgcgctggtggcggacaagcgcttcgtggtgcgcgtccccgacgcgctgccgctggacgccgccgcgccgctgctgtgcgcgggcgtcacggtgtacagccccatgaagcaccacggcatgctggggcaccccggcgccagcctcggcgtcgtcgggctcggcggcctcggccacgtcgccgtcaagctcgccaaggcgttcggcctccgcgtcaccgtcgtcagcacgtcgccggccaaggaggccgaggccagggcccggctcggcgccgaccgcttcgtcgtcagcaccgacgacgcgcagatgcgggacgcggccaggtccctcgactacgtcatcgacaccgtctccgccaagcactcgctcggacccatcctggacctgctcaaggtcagcggcaagctcgtgctcgtcgccgcgccggaacagcccgtcaagctcccctccttcccgctcatcttcgggaagaggaccgtcagcgggagcatgacgggagggatcagggagacgcaggagatgctcgacctctgcgcccgccacaacatcacctgcgacatcgagctcgtctccacggacgggatcaacgccgcgctcgcgcgcctcgcgcgcaacgacgtccgataccgcttcgtcatcgacatcgccggcgactccacctcaaaactatag

SEQ ID NO: 10173 - protein, 361 aa, Zea mays
MEVTPNHTLTVTGWAAMNESAGKVEPFVFKRRENGPDDVTIKVQYCGMCHTDLHFINNDWGITTYPLVPGHEITGVVTKAGRNVTGFRVGDRVGVGCIAASCLDCDHCRRSEENYCDRVALTYNGVFWDGSVTYGGYSRALVADKRFVVRVPDALPLDAAAPLLCAGVTVYSPMKHHGMLGHPGASLGVVGLGGLGHVAVKLAKAFGLRVTVVSTSPAKEAEARARLGADRFVVSTDDAQMRDAARSLDYVIDTVSAKHSLGPILDLLKVSGKLVLVAAPEQPVKLPSFPLIFGKRTVSGSMTGGIRETQEMLDLCARHNITCDIELVSTDGINAALARLARNDVRYRFVIDIAGDSTSKL

SEQ ID NO: 10174 - DNA, 1140 bp, Zea mays
  CDS (1)..(1140)
atggcgacagcagggaaggtgatcaagtgcagagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgccttcgaatgtgtccacgacggctggggtgtcgccgtgctggtgggtgtcccgcacaaggacgaccagttcaagacccaccccatgaacttcctcagtgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattag

SEQ ID NO: 10175 - protein, 379 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 10176 - DNA, 1149 bp, Zea mays
  CDS (1)..(1149)
atggagaaccagggacccaaacccatccgatgcaaagcggccgtgtgcagggccgccggcgagccgctggccatcgaggaggtcgtcgttgacacgcccaaggcgcacgaggtcaggatacggatcatctgcacgtcgctctgccacagcgacgtcacgttctggcgcatgaaggatctccctgacaatatccccagaatatttggccacgaagccttcggggtggtggagagcgtgggtgaacaggtggacgagttcgcggcgggcgacgcggtggtgccgacgttcctggggcagtgcagcgagtgcgtggactgcaggtcggcgcgaagcaacatgtgctccaagtaccggttcgcggtgcgcccggggatgccgcgcgacggcaccacccggttcaccgacggccaggggcgcccgctgcaccacttcttcggcgtgtccagcttcgccgagtacaccgtggtggacgtgaaccaggtcgtcaagctcaaccccgccgtgccgccggcactcgcctgcctgctcagctgcggcgcctccacgggggtcggagccgcatggaagcaggcgaaagttgagcctggatcttcggtcgctatcttcggcctcggcgctgtaggattggcggtggctgaaggagccaggatttgtggggcgtcgaagataatcggcgtggatataaaccctgagaaatgcgagcttggaaagaagttcggcgtgacacatttcatcaatcccaaagagctcggtgaggagaaacctgtccaccaggcgatcgccgagatgaccgacggtggcgcggactactgcttcgagtgcattggactggcggcgctgatgaacgacgcgttccggagctcccgagacgggtggggcaagacgatcattcttggggtggaaatgcacggtgcccccctctgcatctctcctcacgagatcctccacgggaagtctgtcatcgggtccatgttcggcggggtgaagcctaagcaggatatccccattctcgccgacaagtacatgaacaaggagctggagcttgacaagttcataacccatgaagttggcctcaaggacatcaaccaagcttttgacctcctgctgcaagggaagagtctcaggtgcaccatatggatggacaagtga

SEQ ID NO: 10177 - protein, 382 aa, Zea mays
MENQGPKPIRCKAAVCRAAGEPLAIEEVVVDTPKAHEVRIRIICTSLCHSDVTFWRMKDLPDNIPRIFGHEAFGVVESVGEQVDEFAAGDAVVPTFLGQCSECVDCRSARSNMCSKYRFAVRPGMPRDGTTRFTDGQGRPLHHFFGVSSFAEYTVVDVNQVVKLNPAVPPALACLLSCGASTGVGAAWKQAKVEPGSSVAIFGLGAVGLAVAEGARICGASKIIGVDINPEKCELGKKFGVTHFINPKELGEEKPVHQAIAEMTDGGADYCFECIGLAALMNDAFRSSRDGWGKTIILGVEMHGAPLCISPHEILHGKSVIGSMFGGVKPKQDIPILADKYMNKELELDKFITHEVGLKDINQAFDLLLQGKSLRCTIWMDK

SEQ ID NO: 10178 - DNA, 25 bp, Artificial sequence
  primer
atgactgacttaactacacaagaag

SEQ ID NO: 10179 - DNA, 22 bp, Artificial sequence
  primer
tcattccgggccctcaatgatc

SEQ ID NO: 10180 - protein, 385 aa, Artificial sequence
  consensus sequence
  Variant (2)..(8): Xaa in position 2 to 8 is any amino acid
  Variant (10)..(10): Xaa in position 10 is any amino acid
  Variant (12)..(13): Xaa in position 12 to 13 is any amino acid
  Variant (15)..(28): Xaa in position 15 to 28 is any amino acid
  Variant (29)..(59): Xaa in position 29 to 59 is any or no amino acid
  Variant (63)..(64): Xaa in position 63 to 64 is any amino acid
  Variant (66)..(70): Xaa in position 66 to 70 is any amino acid
  Variant (72)..(72): Xaa in position 72 is any amino acid
  Variant (73)..(73): Xaa in position 73 is any or no amino acid
  Variant (75)..(78): Xaa in position 75 to 78 is any amino acid
  Variant (79)..(84): Xaa in position 79 to 84 is any or no amino acid
  Variant (87)..(87): Xaa in position 87 is any amino acid
  Variant (89)..(97): Xaa in position 89 to 97 is any amino acid
  Variant (98)..(112): Xaa in position 98 to 112 is any or no amino acid
  Variant (114)..(117): Xaa in position 114 to 117 is any amino acid
  Variant (118)..(122): Xaa in position 118 to 122 is any or no amino acid
  Variant (124)..(185): Xaa in position 124 to 185 is any amino acid
  Variant (186)..(212): Xaa in position 186 to 212 is any or no amino acid
  Variant (214)..(214): Xaa in position 214 is any amino acid
  Variant (216)..(217): Xaa in position 216 to 217 is any amino acid
  Variant (219)..(227): Xaa in position 219 to 227 is any amino acid
  Variant (228)..(229): Xaa in position 228 to 229 is any or no amino acid
  Variant (231)..(246): Xaa in position 231 to 246 is any amino acid
  Variant (247)..(253): Xaa in position 247 to 253 is any or no amino acid
  Variant (255)..(275): Xaa in position 255 to 275 is any amino acid
  Variant (276)..(337): Xaa in position 276 to 337 is any or no amino acid
  Variant (339)..(380): Xaa in position 339 to 380 is any amino acid
  Variant (381)..(384): Xaa in position 381 to 384 is any or no amino acid
VXXXXXXXGXCXXDXXXXXXXXXXXXXXXXXXXXXXXXXXXXXXXXXXXXXXXXXXXXXGHEXXGXXXXXGXXVXXXXXXXXXXGDXVXXXXXXXXXXXXXXXXXXXXXXXXCXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXGXXGXXXXXXXXXXXGXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXG

SEQ ID NO: 10181 - protein, 14 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is any amino acid
  Variant (5)..(5): Xaa in position 5 is Ile, Met or Val
  Variant (6)..(7): Xaa in position 6 to 7 is any amino acid
  Variant (8)..(8): Xaa in position 8 is Ala, Cys, Gly, Asn, Ser, Thr or Val
  Variant (9)..(9): Xaa in position 9 is Ala, Gly, Ser or Val
  Variant (10)..(10): Xaa in position 10 is Ile, Leu, Met or Val
  Variant (12)..(12): Xaa in position 12 is any amino acid
  Variant (13)..(13): Xaa in position 13 is Asn, Ser or Thr
VXXXXXXXXXCXXD

SEQ ID NO: 10182 - DNA, 1044 bp, Saccharomyces cerevisiae
  CDS (1)..(1044)
atgaacaggaaagtagctatcgtaacgggtactaatagtaatcttggtctgaacattgtgttccgtctgattgaaactgaggacaccaatgtcagattgaccattgtggtgacttctagaacgcttcctcgagtgcaggaggtgattaaccagattaaagatttttacaacaaatcaggccgtgtagaggatttggaaatagactttgattatctgttggtggacttcaccaacatggtgagtgtcttgaacgcatattacgacatcaacaaaaagtacagggcgataaactaccttttcgtgaatgctgcgcaaggtatctttgacggtatagattggatcggagcggtcaaggaggttttcaccaatccattggaggcagtgacaaatccgacatacaagatacaactggtgggcgtcaagtctaaagatgacatggggcttattttccaggccaatgtgtttggtccgtactactttatcagtaaaattctgcctcaattgaccaggggaaaggcttatattgtttggatttcgagtattatgtccgatcctaagtatctttcgttgaacgatattgaactactaaagacaaatgcctcttatgagggctccaagcgtttagttgatttactgcatttggccacctacaaagacttgaaaaagctgggcataaatcagtatgtagttcaaccgggcatatttacaagccattccttctccgaatatttgaattttttcacctatttcggcatgctatgcttgttctatttggccaggctgttggggtctccatggcacaatattgatggttataaagctgccaatgccccagtatacgtaactagattggccaatccaaactttgagaaacaagacgtaaaatacggttctgctacctctagggatggtatgccatatatcaagacgcaggaaatagaccctactggaatgtctgatgtcttcgcttatatacagaagaagaaactggaatgggacgagaaactgaaagatcaaattgttgaaactagaacccccatttaa

SEQ ID NO: 10183 - protein, 347 aa, Saccharomyces cerevisiae
MNRKVAIVTGTNSNLGLNIVFRLIETEDTNVRLTIVVTSRTLPRVQEVINQIKDFYNKSGRVEDLEIDFDYLLVDFTNMVSVLNAYYDINKKYRAINYLFVNAAQGIFDGIDWIGAVKEVFTNPLEAVTNPTYKIQLVGVKSKDDMGLIFQANVFGPYYFISKILPQLTRGKAYIVWISSIMSDPKYLSLNDIELLKTNASYEGSKRLVDLLHLATYKDLKKLGINQYVVQPGIFTSHSFSEYLNFFTYFGMLCLFYLARLLGSPWHNIDGYKAANAPVYVTRLANPNFEKQDVKYGSATSRDGMPYIKTQEIDPTGMSDVFAYIQKKKLEWDEKLKDQIVETRTPI

SEQ ID NO: 10184 - DNA, 1017 bp, Schizosaccharomyces pombe 972h-
  CDS (1)..(1017)
atgagttttcgtaaatatgccttaattaccggctccaacagtggtcttggttttggaatagctacgcgtcttttgcagttctaccaaccgcgtttgcaagatgaacccgaagtattcacggtaattcttacatgcaggagtcgtgaaaaggcagaagatgcctgtagaagattgaaagaattctttcccgataggaaaatacggttggaatacgttttgttagacttgtcgaatatggcatcagtggaagctgcggtgcaagatatcgctactagattccctaaattagattttgtttacctaaatgctggtgcttgggacctggaaggtattcaatggctaaaggctatcttttctactttgatcaaccctatccaggcactgacgcatccaaccttttacaaagagactgctggacgtgtgagcaatgactccctcggttacatatttgaaagtaatgtttttggtcatttttatttgaaaaatcgcctggccgaactaaaagtgctccgttcgtcaacaaaggtagtccttacaagcagtttagtagcagaaaaaaaatcccttgattttgaagacctacaatgttttcacggcgagcaaccctatcaatcttcaaagcgtttgttagatgtgttacactatgcagaacttgaaaagggactcccttttgaacaataccttgtccatcccggactatgtactactaacatgtatgaaactttcctcggtcctatattggttatgtgtgcaaagctcggtttctatatttgtcgcttacttggaagtccttggcatacaatttctccatacgttgctgcttttgcttttctttggactgctttacatgctaccaaagaagatcaatctatcaagtggggagcagccgtgactcgttttggtcatgaaagagtcctctctactcctgtggaattaattttgccttcagagcaagagaaagctttagaatatatgacaaaactttaccaggaatggaaaaagaagctggtttcgtaa

SEQ ID NO: 10185 - protein, 338 aa, Schizosaccharomyces pombe 972h-
MSFRKYALITGSNSGLGFGIATRLLQFYQPRLQDEPEVFTVILTCRSREKAEDACRRLKEFFPDRKIRLEYVLLDLSNMASVEAAVQDIATRFPKLDFVYLNAGAWDLEGIQWLKAIFSTLINPIQALTHPTFYKETAGRVSNDSLGYIFESNVFGHFYLKNRLAELKVLRSSTKVVLTSSLVAEKKSLDFEDLQCFHGEQPYQSSKRLLDVLHYAELEKGLPFEQYLVHPGLCTTNMYETFLGPILVMCAKLGFYICRLLGSPWHTISPYVAAFAFLWTALHATKEDQSIKWGAAVTRFGHERVLSTPVELILPSEQEKALEYMTKLYQEWKKKLVS

SEQ ID NO: 10186 - DNA, 1041 bp, Candida albicans SC5314
  CDS (1)..(1041): transl_table=12
atgtcacttttaaaggattctacagttgcagtcattaccgggacatcttcaaatttaggattcaatatagctgttcgtttgttggaggggcttcctgacaacaaagaaattactcttgttgttacttccagaacattaccaaaagtaaaggaagtgatttctgatattaaaaaatatattgtggcaaaaatcccaactaaagtaaacaaggtggaatttgactatttattggtggatttcactgatatggtatcaattttatcagcatattatgaattgaataaacgatacaaacatattgattacttgtttattaatgcggcccaaggagtatacggaggcatagattggactggcgcagttctcgaagttttgcaaagcccaattgaggcagtcactaatccaacttataaattacaaaaagttggagtagaaagtggcgataaattgggattagtctttcaagcaaatgtgtttggaccatattattttatccacagaatcaaacacttgttggaaaatggtgggaaaatagtgtgggtcagctcattaatgtcaagtccaaaatatttgtctttcaatgatttacaattattgagatcaccagcaagctatgaaggctcaaaaagattggttgacttgatgcattttggaacttacaacaagctagaaagagaacatggaatcaaacagtatttagttcatcctgggatattcacaagtttctcgtttttccaatatttgaacgttttcacatactatggtatgttatttttattctaccttgcaagatttttagggtcaccatatcacaatatttctgggtatattgctgcgaacgctcctgttgctgctgctttaggtcaaactaaacaaaactgcaaaactgcctcggcttgtactagatctggtaaagagtatttattagaagaagagattgacagcactggtctggacgacgttgtcctgtatttggacacacttactaaagagtgggacgaaaagttgaaggatcaaatagtaaatacacgtcaaccttga

SEQ ID NO: 10187 - protein, 346 aa, Candida albicans SC5314
MSLLKDSTVAVITGTSSNLGFNIAVRLLEGLPDNKEITLVVTSRTLPKVKEVISDIKKYIVAKIPTKVNKVEFDYLLVDFTDMVSILSAYYELNKRYKHIDYLFINAAQGVYGGIDWTGAVLEVLQSPIEAVTNPTYKLQKVGVESGDKLGLVFQANVFGPYYFIHRIKHLLENGGKIVWVSSLMSSPKYLSFNDLQLLRSPASYEGSKRLVDLMHFGTYNKLEREHGIKQYLVHPGIFTSFSFFQYLNVFTYYGMLFLFYLARFLGSPYHNISGYIAANAPVAAALGQTKQNCKTASACTRSGKEYLLEEEIDSTGSDDVVSYLDTLTKEWDEKLKDQIVNTRQP

SEQ ID NO: 10188 - DNA, 1311 bp, Phaeosphaeria nodorum
  CDS (1)..(1311)
atgtcacctgcagcagacgtgccgcagccccaaaatgggttctatgtcctcgttacaggcgcaaacagcggcttgggactgggtattagtacacgcctgatcgacgaatttctccagacgcgtccgcaatccgagtccctcgtcctcatcattacgacacgcgaccaacagaaaggcgacgcgacaatcgaaaaattgcaacgtcacctgcgacaggtgtgcgagaagcatgaacagacgctgccaggcatctcccagctgctgctgcaccgcgtatattttaggcaggagcgactcgacctcctgagcttggtctcagtgcaaaagctgtccaagagaatacgggatactacacccaaacttgatgcattgatctgcaatgctggcattgggggatggaccggcatcaattggcctgtggccattttctccatccttacaacatggacgaaggcattgacctaccctaccttcaaactggcagccattggccgggtgacgaagccgcaatcatccacgactgaaaagggcgaggaactcggcgaagtcttctgtgccaatgtctttggacattacctcttagggcactacctcgcaccactcctagcgagacactccaagagcgaagataccagaggccgtatcatatgggtgagcagtatagaggcatacgacttcacattcgacatcaacgacatacagggcctcgggtccgaggtgccgtacgaatcctccaagagattgacggacgtattggcaataagttcgaccctgccctccacgtcgaaccacgtaaaccaatatctcgagtactcagactcgtctgagaagaccacgaagccccgcatctacgtctcccaccctggcatctgcggcacctcgatcgtccccctaccactagtcctcgagtatcttatgttcgccgcattctatctcgcccgcttcctcggcagtcagtggcacccggtcactgtggaaaagggtgcaaccgccatggtctggctcgccctcgcaaaccaaagcacactggacagcatggagaagcaggaaggagcaggcaagtggggcagtgccacaaatttctggggccaagaacgagtggagcgcacggaggttgggggatggggatggggtggcaaaatgggggaacacaagcgaaagggacgcaatccatatgcacgagaccttaccaaggagagtgcggaagagtttagacaaacaggcgagaagtgttgggcaaaaatggaggaactgcgcatcgaatgggaagaccgacttcggacagctggggttgctgtcgatatggactga

SEQ ID NO: 10189 - protein, 436 aa, Phaeosphaeria nodorum
MSPAADVPQPQNGFYVLVTGANSGLGLGISTRLIDEFLQTRPQSESLVLIITTRDQQKGDATIEKLQRHLRQVCEKHEQTLPGISQLLLHRVYFRQERLDLLSLVSVQKLSKRIRDTTPKLDALICNAGIGGWTGINWPVAIFSILTTWTKALTYPTFKLAAIGRVTKPQSSTTEKGEELGEVFCANVFGHYLLGHYLAPLLARHSKSEDTRGRIIWVSSIEAYDFTFDINDIQGLGSEVPYESSKRLTDVLAISSTLPSTSNHVNQYLEYSDSSEKTTKPRIYVSHPGICGTSIVPLPLVLEYLMFAAFYLARFLGSQWHPVTVEKGATAMVWLALANQSTLDSMEKQEGAGKWGSATNFWGQERVERTEVGGWGWGGKMGEHKRKGRNPYARDLTKESAEEFRQTGEKCWAKMEELRIEWEDRLRTAGVAVDMD

SEQ ID NO: 10190 - DNA, 1368 bp, Aspergillus oryzae
  CDS (1)..(1368)
atgttcaattacggaaccgacgaggatctccaggacaaggtctatatcctcgtcactggtgcaaacagtggtctcggattctcgatatgctgccgtctagtcgatgaattcctcaactctcctcagcgcacaaaccaatccttgaccgtcattttcaccacccgaagtcccaagaaaggaaacgacaccctccaacgcctccaggaccatctccgcaaaacctccgcaacacactcccccaccagacgggtaaccttcgtcccagagagcgtagacctaaacaacctcgtctccgtccgcgccctctcccgccgcctgaacgatgaataccccaaactcgacgccatcatgctcaacgccggcattggcggctggtcaaccctgaactggccgcgagccatctggggcgtcctcaccgacctcgtccacgaagtctcctggccctcgtacaagatcgcccccgccggcatggtaacagactaccagaccacaacgctagcagcccaagagccccgcctaggctccgtcttctgcgcaaacgtcttcggccactacatgctagcgcacaatgttatgcccctgctgcgacggtcaggacagcccaacggccccggccgcgtcatctgggtctcaagcttggaagccacggtgaagatgttcgacgtcgacgatatccagggtctccggaccacggcgccctacgaatcctccaaggcgttgaccgacgtcttagcgctaacggccgatctccccagtaccaagcccttcgtgaagagtttctactccgtcgacgataacagaacctataatagtggattcggaagacctagaatcaccaatgacgataacttagctccgaatatgtacctctctcaccccggaatctgtggcacgggtatcatcccgctctcctggccgctcttttactcaatgcttgccatctgcctttttgcccggttgcttgggtccccctggcatacggtgtcgacttatctgggtgcctgtgctcctgtgtggctggcgttgtccgctcagtctgtgttggatacggccgaatcgctgtatcggcagaatggtgggggtagagccaaatggggttcctctaccaactgggtcggcaaggatactccggcatctacggaaactgacgggtgggggtatggtggtgttgttggccccgctattgtggatgaggatcggttgcgtcggcgcaaaagaggcgcggtggacctcacggcggaagacaaggagaacttcgaagagctggggagaaagtgctggcagaaaatggaggagttgagaatcgagtgggataaaattcttgatctggatgaagtaagccctgatgattttggtctgggattctaa

SEQ ID NO: 10191 - protein, 455 aa, Aspergillus oryzae
MFNYGTDEDLQDKVYILVTGANSGLGFSICCRLVDEFLNSPQRTNQSLTVIFTTRSPKKGNDTLQRLQDHLRKTSATHSPTRRVTFVPESVDLNNLVSVRALSRRLNDEYPKLDAIMLNAGIGGWSTLNWPRAIWGVLTDLVHEVSWPSYKIAPAGMVTDYQTTTLAAQEPRLGSVFCANVFGHYMLAHNVMPLLRRSGQPNGPGRVIWVSSLEATVKMFDVDDIQGLRTTAPYESSKALTDVLALTADLPSTKPFVKSFYSVDDNRTYNSGFGRPRITNDDNLAPNMYLSHPGICGTGIIPLSWPLFYSMLAICLFARLLGSPWHTVSTYLGACAPVWLALSAQSVLDTAESLYRQNGGGRAKWGSSTNWVGKDTPASTETDGWGYGGVVGPAIVDEDRLRRRKRGAVDLTAEDKENFEELGRKCWQKMEELRIEWDKILDLDEVSPDDFGLGF

SEQ ID NO: 10192 - DNA, 1449 bp, Epichloe festucae
  CDS (1)..(1449)
atgggcgtcatggtgactaaaaggtgctccccaaacccggcaccaagcccagcaccgtgggagtctgtcgctgcacacgagcagctcttcgtccttgtcactggggctggcagtggaatcggtctcagcaccgttcaacacctcatcgacgacttcctgagctcccgctccctcaactcacatctcatcgctatccctacgacccgatctagccgcaattctctcgcaacgatccgagtattgcgcgaatatgccatcaaagcagcacagagctccgcagccctggcgtcccgcgctgggccagactacaagtggcaggatgctgtggccaggattcacatcttgagcttgatagtagatctgtgcgacctacgtgccatcaaaaagctcgcatatacgcttcgttatggtactgtcagcaaccccgagggcctggacggcgagtacctacgcaacgtccggattcctcggcttgacagcattgtttgcaacgccgcgtatggcggctggtcgggaatgagctacccccaggccattcggtccttactcttcaagggcatcatccaaacggccacttggccggaattcaaactcgctctaccgacgcgtattttgaatgagcgcccgagttacaactaccctgcgaagccgctactaggagaagtcttctccgcctgtgtcttcggtcactacatgctagggcattacctcctgcctctgctgagcaggccatccaccaacgaagcaccaggtcggattatctggtccagcagcgtcgaagcagtcagaaaagtctttgatgtcaacgatatccagtgcttcacacgacccgaagcatacgagtcggcaaagcgccttaccgacctcctctcccttacgtatgcccttcctgcggctcgtccctactcgtctcggttcctcaccattgacgacgatgacgaagctgctgccaaacaggtcgtcaaaccaaagctgtacctgactcatcctggtgtcgtagctagcacacttttcccattgccctggttcctcttttgggcctataaactcgccctcattatatgtcgctggctcggctccccctggcacaatgtcgacgggtaccgcggcgccaaggccgctgtatgggtagttctccaagaccaagaggctctcgatgacgtgggtggcgatcgcataaaatgggggagcagcacagatgcaagtctgcaagttgatgtgaagaagacggaagttgaggattggggctgggacggaaaccccgagacggccgacactgttgccgctgacacggtcttaggcgtgctgaggaaatctgttggacgcaagattgggacctgcgatgccactgctgagagtatcgctgactttgaagaggtaggtgctcagtgttggcaacagctggagcagttgagagcgcagtgggacgacatcataggggaggattaa

SEQ ID NO: 10193 - protein, 482 aa, Epichloe festucae
MGVMVTKRCSPNPAPSPAPWESVAAHEQLFVLVTGAGSGIGLSTVQHLIDDFLSSRSLNSHLIAIPTTRSSRNSLATIRVLREYAIKAAQSSAALASRAGPDYKWQDAVARIHILSLIVDLCDLRAIKKLAYTLRYGTVSNPEGLDGEYLRNVRIPRLDSIVCNAAYGGWSGMSYPQAIRSLLFKGIIQTATWPEFKLALPTRILNERPSYNYPAKPLLGEVFSACVFGHYMLGHYLLPLLSRPSTNEAPGRIIWSSSVEAVRKVFDVNDIQCFTRPEAYESAKRLTDLLSLTYALPAARPYSSRFLTIDDDDEAAAKQVVKPKLYLTHPGVVASTLFPLPWFLFWAYKLALIICRWLGSPWHNVDGYRGAKAAVWVVLQDQEALDDVGGDRIKWGSSTDASLQVDVKKTEVEDWGWDGNPETADTVAADTVLGVLRKSVGRKIGTCDATAESIADFEEVGAQCWQQLEQLRAQWDDIIGED

SEQ ID NO: 10194 - DNA, 1047 bp, Ashbya gossypii
  CDS (1)..(1047)
atgttaatatgccatcagtgtctgagctcacgactgacatatattagcaatcttggcctgaatatcgcatacaggttgattgagcagtttactgatgacagcaagttggttatcgtggtaacatcgcgtacgctgccaagagtaagggaggtggtagacctaatcaaaacatacgccgagaaatgtggcaagtctggagcagtagatttcgactacctgctggtggatttcaccgacatggttagtgtgctgggcgcggcatacgaattagaaaaacgatatgacgctatacattacttctacgctaacgctgcgcagggtgtgtattccggaattgactggctgggtgccaccaaggctgttttacgggatcctttggatgctgtgactaatcccacgtataagatccagcgggtgggagtcaagtccagggatgggctagggctagtatttcaagccaatgtctttggtccgtactatttgattagaaggatcatcccgctcttagctaaaggcaaggcgaaggttgtgtggctttcttcgctgatgtcggatgtgaagtatctatcgctggaagatgtcgagctcttgagaacggacagttcgtacgaggggtcgaagagactggttgaccttctacacttggccacttacaaagagttgaaatctctgggtattcatcagtatgttacacaccctggcatatttactagtcactccttctaccaatatttgaacttcttcacctattatggcatgctgttcttgttttacctagctcggtggctcggctcaccatggcataacattcagggttacaagggtgctaatgcaccaatatacgttgctacacttgcaaatcctacgtttgaacaccaggctttgaagtacggctctgcaacgtatagagatgggatggaatacattgccaaacacgaaattgatcctaccgggatgcacgacgcatacaagtatatcagggaccttgccgaggaatgggacataaaattgaaggaccagatcacaattggtcgttccttatcatag

SEQ ID NO: 10195 - protein, 348 aa, Ashbya gossypii
MLICHQCLSSRLTYISNLGLNIAYRLIEQFTDDSKLVIVVTSRTLPRVREVVDLIKTYAEKCGKSGAVDFDYLLVDFTDMVSVLGAAYELEKRYDAIHYFYANAAQGVYSGIDWLGATKAVLRDPLDAVTNPTYKIQRVGVKSRDGLGLVFQANVFGPYYLIRRIIPLLAKGKAKVVWLSSLMSDVKYLSLEDVELLRTDSSYEGSKRLVDLLHLATYKELKSLGIHQYVTHPGIFTSHSFYQYLNFFTYYGMLFLFYLARWLGSPWHNIQGYKGANAPIYVATLANPTFEHQALKYGSATYRDGMEYIAKHEIDPTGMHDAYKYIRDLAEEWDIKLKDQITIGRSLS

SEQ ID NO: 10196 - DNA, 1047 bp, Candida glabrata
  CDS (1)..(1047)
atgacatccaagaccaggaaagtagccgttatcactggtgccaatagtaaccttgggttgaacattgcttatagattaatcgaaagacagtctgctgacgtcagattgacccttgtggtcacttcgaggacgttgcctcgtgtaagagaggttgttgagttgatcaagaagtttgttgcaactcaggaggatccatgctctgtggattttgactatttacttgtggatttcaccaacatggtgagtgttttgaacgcgtactatgacttgaaccagaaatacgagagcatcaattacttctttgtgaatgctgcacagggtgtctatgatggtattgactggattggtgctgtaaagcaggtgctatctgatccacttgaagctgttaccaaccccacttataggaaacagctagtgggtgtcaaatcaaaggatgaaatgggactggtctttcaggccaatgtatttggaccatattatttgatccagaaaattctacctcaattgtcgaaggggaaagctactgtggtttggatttccagtattatggctgacccaaaacacttatctctacaggatatcgaaatgatcaaatcagatgttacttatgaaggttctaagagagttgtagacttattacatttggccacttataagcaaatgaaatctcaaggtattcaccagtacgtggttcaacccggtattttcaccagttattcattcgccaagtacttgaacttcttcaccacttttggtatgttgttcttgttctatttggccagactacttggatccaaatggcacaacattgacggttacaaagcagctaatgctccagtatacgttgccactctaataaatccacattttgaacaccaagaagttaagtatggatctgcaagttcaagagatggtatggagtatattgaaactacagacatcgataagaccggatcaagtgacgttcttgcatacattgagaagaagaaattagaatgggatgacaagttaaaagaccaaataacgaactcaagaattccaatttaa

SEQ ID NO: 10197 - protein, 348 aa, Candida glabrata
MTSKTRKVAVITGANSNLGLNIAYRLIERQSADVRLTLVVTSRTLPRVREVVELIKKFVATQEDPCSVDFDYLLVDFTNMVSVLNAYYDLNQKYESINYFFVNAAQGVYDGIDWIGAVKQVLSDPLEAVTNPTYRKQLVGVKSKDEMGLVFQANVFGPYYLIQKILPQLSKGKATVVWISSIMADPKHLSLQDIEMIKSDVTYEGSKRVVDLLHLATYKQMKSQGIHQYVVQPGIFTSYSFAKYLNFFTTFGMLFLFYLARLLGSKWHNIDGYKAANAPVYVATLINPHFEHQEVKYGSASSRDGMEYIETTDIDKTGSSDVLAYIEKKKLEWDDKLKDQITNSRIPI

SEQ ID NO: 10198 - DNA, 1041 bp, Debaryomyces hansenii
  CDS (1)..(1041)
atgattaaagataatgataatagtaaggtggcccttataacaggtacctcttctaatcttggtatcaatatagcgtaccgtttattggaacaattgccatcttccactaatgttacgttaattgtcacttcacgtacattacctaaggttaaagaagtcataacaaatattaatcaatattccaaaactaaattaaatagaacaggtcaattagaatttgactatcttttggttgatttcacagacatggtatctgttttatcggcatattacgatttgaacaagaaatttaagaagattgactatttgtttgttaatgctgcgcaaggtgtttattcgggtatagattgggtagcagcgactaaggaaatttgcagaaatccaatggaaggggtcaccaatcctacttataaaactcaaagagttggggttaaatcaaatgataatatggggttagttttccaagcaaatgttttcggtccttattacttgatccataagataaagcatttattgcaaaaaggtggtcgtattatttggatatcatctttgatgtcgaatccaaaatacttatcgttcaatgatttacaattgttgaaatctccagagtcatatgaaggttcgaaaagattggtcgatttaatgcattttggaacgttcaaacaattgcaaagcgaatacggaatagagcaatatttggttcaacctggaatttttaccagtttctcgttcttcaaatttttaaatgtcttcacttactacagcatgctaatgcttttttatttagctaggctttttggctccccatcgcataatatatccggttttattgcagccaatgcaccagttacatgtgcacttgggaatgaaagtcaatctgttaaagtttgctcggtgagtaatagaacaggtaaagagtatttaagttatcaagaggtggacaccacaggatcagccgatatttctgcgtatctagaaaagctttgtcatgagtgggacttgactttgaaggatcagatcgttaacactcgtcaaccgtag

SEQ ID NO: 10199 - protein, 346 aa, Debaryomyces hansenii
MIKDNDNSKVALITGTSSNLGINIAYRLLEQLPSSTNVTLIVTSRTLPKVKEVITNINQYSKTKLNRTGQLEFDYLLVDFTDMVSVLSAYYDLNKKFKKIDYLFVNAAQGVYSGIDWVAATKEICRNPMEGVTNPTYKTQRVGVKSNDNMGLVFQANVFGPYYLIHKIKHLLQKGGRIIWISSLMSNPKYLSFNDLQLLKSPESYEGSKRLVDLMHFGTFKQLQSEYGIEQYLVQPGIFTSFSFFKFLNVFTYYSMLMLFYLARLFGSPSHNISGFIAANAPVTCALGNESQSVKVCSVSNRTGKEYLSYQEVDTTGSADISAYLEKLCHEWDLTLKDQIVNTRQP

SEQ ID NO: 10200 - DNA, 1041 bp, Kluyveromyces lactis
  CDS (1)..(1041)
atgtcttcgtcaaaggtagcagtggtcactggtacaaacagtaatttaggtttgaatatcgtatatcggttgattgagagaagcgagccagaggacaacctcacgatagttgtgacatcaagaacattacctagggttcgtgaatgcattgatttaattaaggcttttgtcaataccattaataggactggctctgtagattatgattacctgctggttgattttaccaacatgatcagcattcttgatgcccactacagcttgtcaaaaagatacgatcacatcaattacttctttgtgaatgcagctcaaggagtttactcagggattgactggttgggtgcagtgaaagaggtcttctccagtccactggaggccgtcacaaacccaacatataaaattcaacgagtgggagtcaaatcaaaggacgggatggggcttgtgttccaggcaaacgtgtttggaccatattatctaattcaaaaactgcttccgttactccaggctggacaaggtactgtcgtttgggtctctagtatcatgtccgctcctaaatatttgtctttacaagatattcagctattggaatccgatgtttcttatgaaggttcaaaaagattagttgatttgttacattctgcaacatataaagagatgaaaaagctcggaatccgccaatatctcacccatcctggtatttttaccagtctctcatttttccaatatttgaatgttttcacctactatggtatgctcttcttattctatctggccagatggattggttcaccttggcacaacatacaaggatacaaagcagccaatgctcctgtatatgtagcaacaatggctaatccgcactttgagaaggagcaaatgaaatacggatcggcaacttttagagacggtttagaatatattaaaactgatgaagttgatacaaccggctgtgaagatgtgtataaatacatctccaatttgaaactgcaatgggatgaaaagttaaaagaccagattaagcctacaaggataccattataa

SEQ ID NO: 10201 - protein, 346 aa, Kluyveromyces lactis
MSSSKVAVVTGTNSNLGLNIVYRLIERSEPEDNLTIVVTSRTLPRVRECIDLIKAFVNTINRTGSVDYDYLLVDFTNMISILDAHYSLSKRYDHINYFFVNAAQGVYSGIDWLGAVKEVFSSPLEAVTNPTYKIQRVGVKSKDGMGLVFQANVFGPYYLIQKLLPLLQAGQGTVVWVSSIMSAPKYLSLQDIQLLESDVSYEGSKRLVDLLHSATYKEMKKLGIRQYLTHPGIFTSLSFFQYLNVFTYYGMLFLFYLARWIGSPWHNIQGYKAANAPVYVATMANPHFEKEQMKYGSATFRDGLEYIKTDEVDTTGCEDVYKYISNLKLQWDEKLKDQIKPTRIPL

SEQ ID NO: 10202 - DNA, 1032 bp, Yarrowia lipolytica
  CDS (1)..(1032)
atgatccacaacagaaaaacgcagacggttgtgatcacaggcgcgtcatccaaccttggcattgctattggtaagcgtctgatcgacgagaaaaaagaagacgcccatctcactattgtggtcacttcgcgaacccttcgaaacgtccgtgtcgccatcaagaccctcaaggcacatgccgtagccaaggaggtcggtcccgaggtcgactttgactaccttctgtttgatctggcagacatgacgtctatcaacggcgctctggtggagctcaagctgcggttctctcgaatcgacactctcatcttcaactccaacgcagccaactacattggaatcaactggcctctggccatgtggcgattcaccacgcaattcaagagcgaaatcgagaatcccagttgcatgatccaggctgtgggagtcaagtccgacgacggtatgggctctgcgtaccaatccaacgtgtttggaccatggtacatggtgctggagctcaccgagcagctcaagaacggcggaaaggtcatctggatcagttccatcacgtcttctgaaaagtacgtggatctggaagacattgagctgattcacaacaaggagccatacaagggctcgaagcgtcttattgacgtggcccacaactactactcgccgaaactggaagaggagcatggtatctactcgtacctgaccgaccccggtatcttcacctcctcctcggcctccgagtacctcaacatcttctctgccttcggcatgtatctcatgttctactttgcccggctcattggactgaccaccatgaacattgacccttataagggagccaacgtgcctgtgtgggtgaccttgagcgaggacccttcagctcttaagcgagagtatcgtttgggctcgagaacaggaagatggggtacggagatgatggacgctacaaagctgcaatatgagggaagcgaagaagtcggagcatacattgataagggtgtgggagagtggagagagaagttgaaggatcagattaactaa

SEQ ID NO: 10203 - protein, 343 aa, Yarrowia lipolytica
MIHNRKTQTVVITGASSNLGIAIGKRLIDEKKEDAHLTIVVTSRTLRNVRVAIKTLKAHAVAKEVGPEVDFDYLLFDLADMTSINGALVELKLRFSRIDTLIFNSNAANYIGINWPLAMWRFTTQFKSEIENPSCMIQAVGVKSDDGMGSAYQSNVFGPWYMVLELTEQLKNGGKVIWISSITSSEKYVDLEDIELIHNKEPYKGSKRLIDVAHNYYSPKLEEEHGIYSYLTDPGIFTSSSASEYLNIFSAFGMYLMFYFARLIGLTTMNIDPYKGANVPVWVTLSEDPSALKREYRLGSRTGRWGTEMMDATKLQYEGSEEVGAYIDKGVGEWREKLKDQIN

SEQ ID NO: 10204 - DNA, 25 bp, Artificial sequence
  primer
atgaacaggaaagtagctatcgtaa

SEQ ID NO: 10205 - DNA, 25 bp, Artificial sequence
  primer
ttaaatgggggttctagtttcaaca

SEQ ID NO: 10206 - protein, 466 aa, Artificial sequence
  consensus sequence
  Variant (3)..(4): Xaa in position 3 to 4 is any amino acid
  Variant (6)..(6): Xaa in position 6 is any amino acid
  Variant (9)..(10): Xaa in position 9 to 10 is any amino acid
  Variant (12)..(13): Xaa in position 12 to 13 is any amino acid
  Variant (16)..(29): Xaa in position 16 to 29 is any amino acid
  Variant (30)..(34): Xaa in position 30 to 34 is any or no amino acid
  Variant (36)..(36): Xaa in position 36 is any amino acid
  Variant (38)..(65): Xaa in position 38 to 65 is any amino acid
  Variant (66)..(87): Xaa in position 66 to 87 is any or no amino acid
  Variant (89)..(93): Xaa in position 89 to 93 is any amino acid
  Variant (95)..(114): Xaa in position 95 to 114 is any amino acid
  Variant (115)..(131): Xaa in position 115 to 131 is any or no amino acid
  Variant (134)..(135): Xaa in position 134 to 135 is any amino acid
  Variant (137)..(139): Xaa in position 137 to 139 is any amino acid
  Variant (142)..(142): Xaa in position 142 is any amino acid
  Variant (144)..(145): Xaa in position 144 to 145 is any amino acid
  Variant (147)..(158): Xaa in position 147 to 158 is any amino acid
  Variant (159)..(159): Xaa in position 159 is any or no amino acid
  Variant (161)..(161): Xaa in position 161 is any amino acid
  Variant (163)..(169): Xaa in position 163 to 169 is any amino acid
  Variant (171)..(177): Xaa in position 171 to 177 is any amino acid
  Variant (178)..(187): Xaa in position 178 to 187 is any or no amino acid
  Variant (189)..(190): Xaa in position 189 to 190 is any amino acid
  Variant (192)..(192): Xaa in position 192 is any amino acid
  Variant (198)..(198): Xaa in position 198 is any amino acid
  Variant (200)..(216): Xaa in position 200 to 216 is any amino acid
  Variant (217)..(223): Xaa in position 217 to 223 is any or no amino acid
  Variant (225)..(225): Xaa in position 225 is any amino acid
  Variant (228)..(232): Xaa in position 228 to 232 is any amino acid
  Variant (234)..(238): Xaa in position 234 to 238 is any amino acid
  Variant (240)..(248): Xaa in position 240 to 248 is any amino acid
  Variant (251)..(251): Xaa in position 251 is any amino acid
  Variant (256)..(256): Xaa in position 256 is any amino acid
  Variant (258)..(272): Xaa in position 258 to 272 is any amino acid
  Variant (273)..(303): Xaa in position 273 to 303 is any or no amino acid
  Variant (305)..(307): Xaa in position 305 to 307 is any amino acid
  Variant (311)..(317): Xaa in position 311 to 317 is any amino acid
  Variant (318)..(319): Xaa in position 318 to 319 is any or no amino acid
  Variant (321)..(327): Xaa in position 321 to 327 is any amino acid
  Variant (329)..(331): Xaa in position 329 to 331 is any amino acid
  Variant (334)..(334): Xaa in position 334 is any amino acid
  Variant (337)..(338): Xaa in position 337 to 338 is any amino acid
  Variant (341)..(342): Xaa in position 341 to 342 is any amino acid
  Variant (344)..(347): Xaa in position 344 to 347 is any amino acid
  Variant (349)..(350): Xaa in position 349 to 350 is any amino acid
  Variant (352)..(352): Xaa in position 352 is any amino acid
  Variant (354)..(354): Xaa in position 354 is any amino acid
  Variant (356)..(366): Xaa in position 356 to 366 is any amino acid
  Variant (367)..(380): Xaa in position 367 to 380 is any or no amino acid
  Variant (382)..(382): Xaa in position 382 is any amino acid
  Variant (385)..(389): Xaa in position 385 to 389 is any amino acid
  Variant (391)..(402): Xaa in position 391 to 402 is any amino acid
  Variant (404)..(416): Xaa in position 404 to 416 is any amino acid
  Variant (417)..(460): Xaa in position 417 to 460 is any or no amino acid
  Variant (463)..(465): Xaa in position 463 to 465 is any amino acid
TGXXSXLGXXIXXRLXXXXXXXXXXXXXXXXXXXTXRXXXXXXXXXXXXXXXXXXXXXXXXXXXXXXXXXXXXXXXXXXXXXXXXXXDXXXXXSXXXXXXXXXXXXXXXXXXXXXXXXXXXXXXXXXXXXXNAXXGXXXGIXWXXAXXXXXXXXXXXXXTXPXXXXXXXGXXXXXXXXXXXXXXXXXGXXFXANVFGXYXXXXXXXXXXXXXXXXXXXXXXXXWXSSXXXXXKXXXXXDXXXXXXXXXYEXSKRLXDXXXXXXXXXXXXXXXXXXXXXXXXXXXXXXXXXXXXXXXXXXXXXXYXXXPGIXXXXXXXXXLXXXXXXXMXXXFYXARXXGSXXHXXXXYXXAXAXVXXXXXXXXXXXXXXXXXXXXXXXXXKXGSXXXXXGXXXXXXXXXXXXGXXXXXXXXXXXXXXXXXXXXXXXXXXXXXXXXXXXXXXXXXXXXXXXXXXXXXXXXXEWXXXL

SEQ ID NO: 10207 - protein, 27 aa, Artificial sequence
  protein pattern
  Variant (3)..(7): Xaa in position 3 to 7 is any or no amino acid
  Variant (9)..(9): Xaa in position 9 is any amino acid
  Variant (10)..(10): Xaa in position 10 is Phe, Ile or Leu
  Variant (13)..(14): Xaa in position 13 to 14 is any amino acid
  Variant (16)..(16): Xaa in position 16 is Asn, Pro or Thr
  Variant (17)..(17): Xaa in position 17 is Ile or Val
  Variant (18)..(18): Xaa in position 18 is Asp, Gln, Ser or Thr
  Variant (19)..(19): Xaa in position 19 is Gly, Thr or Val
  Variant (20)..(21): Xaa in position 20 to 21 is any amino acid
  Variant (22)..(22): Xaa in position 22 is Ala or Gly
  Variant (24)..(24): Xaa in position 24 is any amino acid
  Variant (26)..(26): Xaa in position 26 is any amino acid
  Variant (27)..(27): Xaa in position 27 is Ile or Val
LAXXXXXRXXGSXXHXXXXXXXAXAXX

SEQ ID NO: 10208 - protein, 37 aa, Artificial sequence
  protein pattern
  Variant (2)..(2): Xaa in position 2 is any amino acid
  Variant (5)..(5): Xaa in position 5 is Ile, Leu or Val
  Variant (6)..(6): Xaa in position 6 is any amino acid
  Variant (7)..(7): Xaa in position 7 is Ala or Ser
  Variant (8)..(11): Xaa in position 8 to 11 is any amino acid
  Variant (12)..(12): Xaa in position 12 is Phe or Leu
  Variant (13)..(13): Xaa in position 13 is Asp or Ser
  Variant (14)..(14): Xaa in position 14 is Phe, Ile, Leu or Val
  Variant (15)..(15): Xaa in position 15 is Asp, Glu, Asn or Gln
  Variant (17)..(17): Xaa in position 17 is Ile, Leu or Val
  Variant (18)..(18): Xaa in position 18 is Glu or Gln
  Variant (19)..(19): Xaa in position 19 is any amino acid
  Variant (20)..(20): Xaa in position 20 is Phe, Ile or Leu
  Variant (21)..(22): Xaa in position 21 to 22 is any amino acid
  Variant (23)..(23): Xaa in position 23 is Asp, Glu, Asn, Pro or Thr
  Variant (24)..(24): Xaa in position 24 is any amino acid
  Variant (25)..(25): Xaa in position 25 is Ala, Pro, Ser or Thr
  Variant (28)..(28): Xaa in position 28 is any or no amino acid
  Variant (30)..(30): Xaa in position 30 is any or no amino acid
  Variant (32)..(32): Xaa in position 32 is any amino acid
  Variant (33)..(33): Xaa in position 33 is Leu or Val
  Variant (34)..(34): Xaa in position 34 is Thr or Val
  Variant (36)..(36): Xaa in position 36 is any or no amino acid
WXSSXXXXXXXXXXXDXXXXXXXXXYEXSXKXXXDXL

SEQ ID NO: 10209 - protein, 24 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is any amino acid
  Variant (9)..(9): Xaa in position 9 is Cys or Asn
  Variant (13)..(13): Xaa in position 13 is any amino acid
  Variant (15)..(15): Xaa in position 15 is any amino acid
  Variant (16)..(16): Xaa in position 16 is Phe or Leu
  Variant (17)..(17): Xaa in position 17 is Ala, Gly or Ile
  Variant (18)..(19): Xaa in position 18 to 19 is any amino acid
  Variant (20)..(20): Xaa in position 20 is Ile, Leu or Val
  Variant (21)..(23): Xaa in position 21 to 23 is any amino acid
LXXXXFXAXVFGXYXXXXXXXXXL

SEQ ID NO: 10210 - protein, 21 aa, Artificial sequence
  protein pattern
  Variant (2)..(6): Xaa in position 2 to 6 is any or no amino acid
  Variant (9)..(9): Xaa in position 9 is Ala or Gly
  Variant (10)..(10): Xaa in position 10 is any amino acid
  Variant (12)..(12): Xaa in position 12 is Gly, Ile or Val
  Variant (13)..(13): Xaa in position 13 is Phe, Trp or Tyr
  Variant (14)..(14): Xaa in position 14 is Asp, Gly, Ser or Thr
  Variant (15)..(15): Xaa in position 15 is Gly or Thr
  Variant (16)..(16): Xaa in position 16 is Ile, Leu or Met
  Variant (17)..(17): Xaa in position 17 is Asp, Asn or Ser
  Variant (18)..(18): Xaa in position 18 is Trp or Tyr
  Variant (19)..(20): Xaa in position 19 to 20 is any amino acid
IXXXXXNAXXGXXXXXXXXXA

SEQ ID NO: 10211 - protein, 11 aa, Artificial sequence
  protein pattern
  Variant (2)..(2): Xaa in position 2 is Leu or Val
  Variant (3)..(3): Xaa in position 3 is Ser, Thr or Val
  Variant (4)..(4): Xaa in position 4 is any amino acid
  Variant (8)..(8): Xaa in position 8 is any amino acid
  Variant (9)..(9): Xaa in position 9 is any or no amino acid
  Variant (11)..(11): Xaa in position 11 is Gly or Ser
YXXXPGIXXTX

SEQ ID NO: 10212 - protein, 21 aa, Artificial sequence
  protein pattern
  Variant (2)..(4): Xaa in position 2 to 4 is any or no amino acid
  Variant (7)..(7): Xaa in position 7 is Ala or Thr
  Variant (8)..(8): Xaa in position 8 is Gly, Asn or Ser
  Variant (10)..(10): Xaa in position 10 is Gly or Asn
  Variant (11)..(11): Xaa in position 11 is Ile or Leu
  Variant (13)..(13): Xaa in position 13 is Phe, Ile or Leu
  Variant (14)..(14): Xaa in position 14 is Ala, Gly, Asn or Ser
  Variant (15)..(15): Xaa in position 15 is any amino acid
  Variant (16)..(16): Xaa in position 16 is Ala, Cys, Gly, Ser or Val
  Variant (17)..(17): Xaa in position 17 is any amino acid
  Variant (18)..(18): Xaa in position 18 is His or Arg
  Variant (20)..(20): Xaa in position 20 is Ile, Leu or Val
  Variant (21)..(21): Xaa in position 21 is Asp or Glu
VXXXTGXXSXXGXXXXXXLXX

SEQ ID NO: 10213 - protein, 19 aa, Artificial sequence
  protein pattern
  Variant (2)..(2): Xaa in position 2 is any amino acid
  Variant (3)..(6): Xaa in position 3 to 6 is any or no amino acid
  Variant (8)..(8): Xaa in position 8 is any or no amino acid
  Variant (10)..(10): Xaa in position 10 is Phe or Leu
  Variant (11)..(11): Xaa in position 11 is any amino acid
  Variant (12)..(12): Xaa in position 12 is Asp, Asn or Ser
  Variant (13)..(13): Xaa in position 13 is Leu or Met
  Variant (14)..(14): Xaa in position 14 is any amino acid
  Variant (16)..(16): Xaa in position 16 is Ile or Val
  Variant (17)..(18): Xaa in position 17 to 18 is any amino acid
  Variant (19)..(19): Xaa in position 19 is Ala or Leu
YXXXXXLXDXXXXXSXXXX

SEQ ID NO: 10214 - DNA, 531 bp, Saccharomyces cerevisiae
  CDS (1)..(531)
atgtctgacttagttaacaagaaattcccagctggcgactacaaattccaatacattgctatcagccaaagtgatgctgacagtgaatcttgtaagatgccacaaacagttgaatggtccaaattaatttctgaaaacaagaaggttatcattaccggtgctccagctgctttctccccaacctgtactgtcagccatattccaggttacatcaactacttggatgaattagttaaggaaaaggaagttgaccaagtgatcgttgttactgttgacaacccgttcgctaaccaagcgtgggctaagagtttaggtgttaaggacaccacacacatcaagtttgcctccgacccaggctgtgctttcaccaaatccattggtttcgaattagccgtcggtgacggtgtttactggagtggtagatgggccatggttgttgaaaacggtatcgttacttacgctgccaaggaaaccaacccaggtaccgatgtgaccgtttcctcagtcgaaagtgtcttggctcatttgtag

SEQ ID NO: 10215 - protein, 176 aa, Saccharomyces cerevisiae
MSDLVNKKFPAGDYKFQYIAISQSDADSESCKMPQTVEWSKLISENKKVIITGAPAAFSPTCTVSHIPGYINYLDELVKEKEVDQVIVVTVDNPFANQAWAKSLGVKDTTHIKFASDPGCAFTKSIGFELAVGDGVYWSGRWAMVVENGIVTYAAKETNPGTDVTVSSVESVLAHL

SEQ ID NO: 10216 - DNA, 483 bp, Mesorhizobium loti MAFF303099
  CDS (1)..(483): transl_table=11
atgaccatttccgttggcgacaagctgcctgaagcgaccttcaagacgatgaccgccgacggcgccaaggcgatcacctcggccgagattttcccgggcaagaaggtggttctgttcggtgttcccggcgccttcacgccgacctgcagcaacaaccatctgcccggctatctcgaaaaccatgacgccatcctggcccgcggcgtcgacaccatcgccgtcgtttcggtcaacgacgttcacgtcatgggcgcctgggcacgtttcaccggcggtgaggacaagatcctgtttctcgccgacggcagtgctgatttcgccaaggcggtcggcctcgacaacgacctttccgcaggcggcatggggctacgctcgaagcggttttcgatgatcgtcgacgacggcaaggtcaccgcgctcaatatcgagaccaagcccggcgtcgacgagtccggcgcggcccatattctcgggcagctctaa

SEQ ID NO: 10217 - protein, 160 aa, Mesorhizobium loti MAFF303099
MTISVGDKLPEATFKTMTADGAKAITSAEIFPGKKVVLFGVPGAFTPTCSNNHLPGYLENHDAILARGVDTIAVVSVNDVHVMGAWARFTGGEDKILFLADGSADFAKAVGLDNDLSAGGMGLRSKRFSMIVDDGKVTALNIETKPGVDESGAAHILGQL

SEQ ID NO: 10218 - DNA, 474 bp, Vibrio cholerae O1 biovar eltor str. N16961
  CDS (1)..(474): transl_table=11
atgattcaaatcggacaaaccttaccagatgttcaactgagccaaagaaccagtgagggtacactgactcactctgtaaccactttgtttgctaacaaaaaagtcgtactgtttgccgttccgggtgccttcaccccgacttgctcagaagcacatctacctggctatgtcgtcttagcagacaaattcaaagagaaaggcgtcgatatgatcgcttgcgtttcagttaacgatgcttttgtaatgaaagcgtggggcgaagcgcaaaatgcgagcgaaattgccatgctggctgatggcgatgcgagctttactaaagccttaggtctcgaaatggatacaggtaactttggtggcgtgcgctcgcaacgctacgccatggtgattgaaaataacgtagtcactctgctcaatgttgagccaccaaaaacctttgaactgagcaaagcagaaactgtgctagccagtttgtaa

SEQ ID NO: 10219 - protein, 157 aa, Vibrio cholerae O1 biovar eltor str. N16961
MIQIGQTLPDVQLSQRTSEGTLTHSVTTLFANKKVVLFAVPGAFTPTCSEAHLPGYVVLADKFKEKGVDMIACVSVNDAFVMKAWGEAQNASEIAMLADGDASFTKALGLEMDTGNFGGVRSQRYAMVIENNVVTLLNVEPPKTFELSKAETVLASL

SEQ ID NO: 10220 - DNA, 726 bp, Pasteurella multocida subsp. multocida str. Pm70
  CDS (1)..(726): transl_table=11
atgacattaatggaaggaaaaaaagtacctcaagtgacatttcatactcgtcagggcgatcaatgggtagatgtaaccagtgcggaattatttgataataaaactgttgtacttttctcattaccgggagcatttacacccacttgttcttccactcatttgcctcgctataatgaattagcttgtgaatttaaagcattaggggtagacagtatcatttgtatgtcagtgaatgatacgttcgtcatgaatgcgtggaaagcggatcaggaatgtgaaaatgtgattgtcattccggatggtaatggtgaatttaccgaaggtatggggatgctcgtcggtaaggaagatttaggctttggtaaacgctcttggcgttattcgatgttagtgcgcaatggtattgtggagaaaatgtttgttgagccacaagaacccggtgatccatttaaagtctctgatgcagacacgatgattaaatatcttaaaccagaatggcaagctaagccttctgtttcagtgatcactaaacctggttgcccatattgtgccaaagcaaaagcgttgttaaaagcgaaagactatacctttgaagaaattgtgttaggacgtgatgccagtacgatttctgttcgtgcgattacagggaaaacaagcgtacctcaagtctttatcggtggaaaatacatcggtggcagtgaagagttagaaaagtattttgcttaa

SEQ ID NO: 10221 - protein, 241 aa, Pasteurella multocida subsp. multocida str. Pm70
MTLMEGKKVPQVTFHTRQGDQWVDVTSAELFDNKTVVLFSLPGAFTPTCSSTHLPRYNELACEFKALGVDSIICMSVNDTFVMNAWKADQECENVIVIPDGNGEFTEGMGMLVGKEDLGFGKRSWRYSMLVRNGIVEKMFVEPQEPGDPFKVSDADTMIKYLKPEWQAKPSVSVITKPGCPYCAKAKALLKAKDYTFEEIVLGRDASTISVRAITGKTSVPQVFIGGKYIGGSEELEKYFA

SEQ ID NO: 10222 - DNA, 486 bp, Agrobacterium tumefaciens str. C58
  CDS (1)..(486): transl_table=11
atgaccatcaagatcggcgaaaaactaccttccgcaacttttaaggaaaagacggccgatggcccggtggaaaccaccaccgacgcgcttttcggcggcaagaaggtggtcctctttgccgttcccggcgccttcacccccacctgctcgctgaaccatctgccgggctatctcgaaaatcgcgacgccattctcgccaagggcgtggatgatatcgcggtcgtctccgtcaatgactggcatgtaatgggcgcctgggcgcaatcgtcgggcggccagggcaaaatccacttcctcgccgactgggacgcttccttcaccaaggcgctcggcctcgatgccgatctttccggcggtggtcttggtgtgcgctctaagcgttattccatgctggtggaagacggcgtggtgaagtctctgaacgtcgaagagaaccccggccaggcgaccgtttcggcagccgcggcaatgattgagcagctttaa

SEQ ID NO: 10223 - protein, 161 aa, Agrobacterium tumefaciens str. C58
MTIKIGEKLPSATFKEKTADGPVETTTDALFGGKKVVLFAVPGAFTPTCSLNHLPGYLENRDAILAKGVDDIAVVSVNDWHVMGAWAQSSGGQGKIHFLADWDASFTKALGLDADLSGGGLGVRSKRYSMLVEDGVVKSLNVEENPGQATVSAAAAMIEQL

SEQ ID NO: 10224 - DNA, 639 bp, Agrobacterium tumefaciens str. C58
  CDS (1)..(639): transl_table=11
atgctgcactgcaatgcatcttgcgctatggaaacgataaaagaattccgcgcggatcgatcccaagcgagccgcgtaaaatgccagaacaggagacaagacatgctcggcaaaaaagtgcccgccgtaactttccgcacgcgcgttcgtgacgaggccgttggcggcccgaaccccttccgttggcaggacatgacctccgacgactatttcaagggcaaaaaggtcgtgctgttttcgctgcccggcgctttcaccccgacctgctcgacctatcagcttcccgatttcgaaaagctggcaggcgagtttcgcgcgctcggcgtcgatgagatctattgcctttcggtcaacgacgccttcgtgatgaatgcctgggcaaagggtcagaacctcgaaaacgtcaaggtcattcctgacggttcgggcgagttcacccgcaagatgggcatgctggtcgccaaggacaatctcggtttcggcatgcgctcctggcgttacgccgccgtcatcaatgacggtctggtggagcagtggttcgaggaagagggttattccgacaattgcgaatccgacccttatggcgtttcttcgccgcagaacattctggaaaacctgaaaagccgcgctgcggcctga

SEQ ID NO: 10225 - protein, 212 aa, Agrobacterium tumefaciens str. C58
MLHCNASCAMETIKEFRADRSQASRVKCQNRRQDMLGKKVPAVTFRTRVRDEAVGGPNPFRWQDMTSDDYFKGKKVVLFSLPGAFTPTCSTYQLPDFEKLAGEFRALGVDEIYCLSVNDAFVMNAWAKGQNLENVKVIPDGSGEFTRKMGMLVAKDNLGFGMRSWRYAAVINDGLVEQWFEEEGYSDNCESDPYGVSSPQNILENLKSRAAA

SEQ ID NO: 10226 - DNA, 486 bp, Sinorhizobium meliloti 1021
  CDS (1)..(486): transl_table=11
gtgaccattgccgtcggagacaagctgcccaacgccaccttcaaggagaagaccgcagacggcccggtcgaggtaacgaccgagctgctcttcaagggcaaacgcgtggttcttttcgcggtgccgggtgcttttaccccgacctgctcgctcaaccacctgcccggctatctggaaaatcgcgatgccattcttgcgcgcggggtcgacgacatcgccgttgtcgcggtcaacgacctgcatgtgatgggcgcctgggcgacccattccggcggcatgggcaagatccatttcctctcggactggaatgccgcctttaccaaggcgatcgggatggagatcgatctttcggccggcacgctcggcatccgctcgaaacgctattcgatgctggtcgaggacggcgtcgtcaaggcgctgaacatcgaggaaagcccgggacaggcgaccgcttccggtgcggccgcgatgcttgagctgctttga

SEQ ID NO: 10227 - protein, 161 aa, Sinorhizobium meliloti 1021
MTIAVGDKLPNATFKEKTADGPVEVTTELLFKGKRVVLFAVPGAFTPTCSLNHLPGYLENRDAILARGVDDIAVVAVNDLHVMGAWATHSGGMGKIHFLSDWNAAFTKAIGMEIDLSAGTLGIRSKRYSMLVEDGVVKALNIEESPGQATASGAAAMLELL

SEQ ID NO: 10228 - DNA, 543 bp, Sinorhizobium meliloti 1021
  CDS (1)..(543): transl_table=11
atgatgctcggcagaaaagttcccgctgtaaccttccgcacccgcgtccgcgacgagtccgtcggcggttccaatccgttccgctggcaggacgttacctcggacgactatttcgccggcaagcgcgtcgtgctgttttcgctgccgggtgctttcaccccgacctgctcgacctaccagctgccggacttcgaaaagctcacctccgaattccggactctcgggatcgacgagatctactgcgtctccgtcaacgacgccttcgtgatgaacgcctggggcaaatcgcagggcctcgagaacgtcaagctcattccggacggttcgggcgagttcacccgcaagatgggcatgctcgtcgccaaggacaatctcggcttcggcatgcgctcctggcgctatgccgccgtcatcaacaacggcgttgtcgagcagtggttcgaagaggaaggctactccgacaactgcgacagcgatccctacggcgtctcctcgccgcagaacatcctcgcggcgctgaagtccaagaagctcgccgcctga

SEQ ID NO: 10229 - protein, 180 aa, Sinorhizobium meliloti 1021
MMLGRKVPAVTFRTRVRDESVGGSNPFRWQDVTSDDYFAGKRVVLFSLPGAFTPTCSTYQLPDFEKLTSEFRTLGIDEIYCVSVNDAFVMNAWGKSQGLENVKLIPDGSGEFTRKMGMLVAKDNLGFGMRSWRYAAVINNGVVEQWFEEEGYSDNCDSDPYGVSSPQNILAALKSKKLAA

SEQ ID NO: 10230 - DNA, 483 bp, Caulobacter crescentus CB15
  CDS (1)..(483): transl_table=11
atggcgatcaaggttggcgacacgctcccggcggcgactttcatgaccagcacggctgaagggcccgcgccgatcagcaccgacgacatcttcaagggcaagaccgtcgccctgttcgccgtgcccggcgccttcaccccgacctgctcggccaagcacctgccgggcttcaaggaaaaggccgacgagctgaaggccaagggcgtggactcgatcgtctgcgtctcggtcaacgacgtcttcgtgatgaaggcctggggcaaggaccagggcattgacggcgaggtcctgctgatcgccgacggcaatggcgacttcaccaaggccatcggcctggatttcgacggcagcaagttcggcatgggcgcgcgctcgcagcgctattcgctggtcgccaaggacggcgtcgtcacccagctgcacgtcgaagacgccggccagttcaaggtctcgtcggccgagtatctgctggaacagctgtaa

SEQ ID NO: 10231 - protein, 160 aa, Caulobacter crescentus CB15
MAIKVGDTLPAATFMTSTAEGPAPISTDDIFKGKTVALFAVPGAFTPTCSAKHLPGFKEKADELKAKGVDSIVCVSVNDVFVMKAWGKDQGIDGEVLLIADGNGDFTKAIGLDFDGSKFGMGARSQRYSLVAKDGVVTQLHVEDAGQFKVSSAEYLLEQL

SEQ ID NO: 10232 - DNA, 501 bp, Ralstonia solanacearum GMI1000
  CDS (1)..(501): transl_table=11
atgatccagcccggccagccgctgcccgacgcgacgctctacgaatacttcgaagtggaaaaggacggctgcgcgctcgggcccaatgccttctcggcagcggatctggcccagggcaagacgatcctcatcttcggcctgcctggcgccttcacgccgacctgctcggcgcgccacgtgcccggctatctcgcccactacgatgcgctgcgcaccaagggtgtcgacgagatctggtgcgtgtcggtcaacgacgccttcgtgatgggagcctgggcgcgcgcgcagggcactgacggcagggttcgcatgctggcggacggcagcgccgaattcacgcgcaggctcggtctcgagcaagacctgtccaagcgcggcatgggcgtgcgttcgcagcgctacgccatgatcgtcaaaaacggtgtggtaaccgtgctacaggtggaggccccggggcagttcgccgtcagcaatgcggaatcgatgctggcgcgtctctga

SEQ ID NO: 10233 - protein, 166 aa, Ralstonia solanacearum GMI1000
MIQPGQPLPDATLYEYFEVEKDGCALGPNAFSAADLAQGKTILIFGLPGAFTPTCSARHVPGYLAHYDALRTKGVDEIWCVSVNDAFVMGAWARAQGTDGRVRMLADGSAEFTRRLGLEQDLSKRGMGVRSQRYAMIVKNGVVTVLQVEAPGQFAVSNAESMLARL

SEQ ID NO: 10234 - DNA, 537 bp, Agrobacterium tumefaciens str. C58
  CDS (1)..(537): transl_table=11
atgctcggcaaaaaagtgcccgccgtaactttccgcacgcgcgttcgtgacgaggccgttggcggcccgaaccccttccgttggcaggacatgacctccgacgactatttcaagggcaaaaaggtcgtgctgttttcgctgcccggcgctttcaccccgacctgctcgacctatcagcttcccgatttcgaaaagctggcaggcgagtttcgcgcgctcggcgtcgatgagatctattgcctttcggtcaacgacgccttcgtgatgaatgcctgggcaaagggtcagaacctcgaaaacgtcaaggtcattcctgacggttcgggcgagttcacccgcaagatgggcatgctggtcgccaaggacaatctcggtttcggcatgcgctcctggcgttacgccgccgtcatcaatgacggtctggtggagcagtggttcgaggaagagggttattccgacaattgcgaatccgacccttatggcgtttcttcgccgcagaacattctggaaaacctgaaaagccgcgctgcggcctga

SEQ ID NO: 10235 - protein, 178 aa, Agrobacterium tumefaciens str. C58
MLGKKVPAVTFRTRVRDEAVGGPNPFRWQDMTSDDYFKGKKVVLFSLPGAFTPTCSTYQLPDFEKLAGEFRALGVDEIYCLSVNDAFVMNAWAKGQNLENVKVIPDGSGEFTRKMGMLVAKDNLGFGMRSWRYAAVINDGLVEQWFEEEGYSDNCESDPYGVSSPQNILENLKSRAAA

SEQ ID NO: 10236 - DNA, 576 bp, Brucella melitensis 16M
  CDS (1)..(576): transl_table=11
gtgcttcggcacggcaaatcaaaagtttcgcacaaacagcaggcggaccagacggcaatttccatccgccctgcccttaggagaaaatcgatgacgatcaaagttggcgacaggctgcccgcagcgactttcaaggtaaagaccgcagacggcgtcacggaaatgacgaccgacgatgtcttcaaaggcaggaaggtggttctctttgcggtgccgggtgcatttacgccgacctgtagcctgaaccacctgccgggctatcttgaaaaccgcgatgcaattctcgccaagggcgtggaccagattgcagtcgttgcggtgaacgacccgtttgtcatgggcgcctgggcgcagagcaccggcggcgagggcaagattctcttcctcgccgatggaagcgcaaccttcaccaaagcagccggtctcgatatcgatctttccggtggcggcctcggtgtacgttccaagcgctattccgccatcgtcgaagacggcgtggtgaaatctctcaatatcgaagaacagccgggccaggcggtcacgtctgccgcctcagcccttctcgcacagctttaa

SEQ ID NO: 10237 - protein, 191 aa, Brucella melitensis 16M
MLRHGKSKVSHKQQADQTAISIRPALRRKSMTIKVGDRLPAATFKVKTADGVTEMTTDDVFKGRKVVLFAVPGAFTPTCSLNHLPGYLENRDAILAKGVDQIAVVAVNDPFVMGAWAQSTGGEGKILFLADGSATFTKAAGLDIDLSGGGLGVRSKRYSAIVEDGVVKSLNIEEQPGQAVTSAASALLAQL

SEQ ID NO: 10238 - DNA, 483 bp, Xanthomonas campestris pv. campestris str. ATCC 33913
  CDS (1)..(483): transl_table=11
atgaccatccaagttggtgaccgtattcccgaggtggtgctcaagcacctgcgcgagggcatcgaagcggtcgacacccatacgttgttcaccgggcgcaaggtggtgctgttcgcggtaccgggcgcctttacgccgacctgctcggccaagcacctgcccggctacgtggagcagtttgaagcgttccgcaaacgcggcatcgaggtgctgtgcaccgcggtgaacgaccccttcgtgatgcaggcctggggccgcagccagctggtgcccgacggcctgcacctggtgccggatggaaacgccgaactggcccgtgcactggggctggagatcgacgccagcggctcgggcatgggcctgcgctcgcgccgctatgcgctgtatgccgacgatggcgtggtgaaggcgttgttcgtcgaagagcccggcgagttcaaggtgtctgccgctgactacgtgctgcagcatctccccgattga

SEQ ID NO: 10239 - protein, 160 aa, Xanthomonas campestris pv. campestris str. ATCC 33913
MTIQVGDRIPEVVLKHLREGIEAVDTHTLFTGRKVVLFAVPGAFTPTCSAKHLPGYVEQFEAFRKRGIEVLCTAVNDPFVMQAWGRSQLVPDGLHLVPDGNAELARALGLEIDASGSGMGLRSRRYALYADDGVVKALFVEEPGEFKVSAADYVLQHLPD

SEQ ID NO: 10240 - DNA, 732 bp, Yersinia pestis KIM
  CDS (1)..(732): transl_table=11
atgtttactagccaagaaggtaaaaaagtcccgcaggtaactttccatacccgtcagggcgaccagtggattgacgtaacaaccgacgatttattcagtaataaaaccgtgattgtattttcactaccgggtgcctttaccccaacctgttcttccagtcatctgccacgttataacgaattagcgggtgtatttaaacaacacggtgttgatagcattctgtgtgtgtcggtcaatgataccttcgtaatgaacgcttggaaatcagatcaacacgctgaaaatattacatttgttccagatggtaacggtgagtttaccaaagggatgaatatgttggttgagaaagcagatctgggcttcggtccacgttcatggcgttactccatgctggtacgtaatggcgtggtagaaaaaatgtttgtcgagccaaacaaaccgggcgacccgtttgaagtatctgatgccgacaccatgttgaaatatctggcacctgattttaaagtgcaggaatccgtggctgtctttaccaaaccgggctgcccattctgtgccaaagcgaaacaaatgctgcaagatcatggccttcaatatgaagaaattgtattgggtaaagatgcaacgaccgtcagcttgcgtgctgtaagcggccgctccacggtgccacagatctttatcggaggccgtcacattggtggcagcgacgatctggaaaagtacctaccagcctaa

SEQ ID NO: 10241 - protein, 243 aa, Yersinia pestis KIM
MFTSQEGKKVPQVTFHTRQGDQWIDVTTDDLFSNKTVIVFSLPGAFTPTCSSSHLPRYNELAGVFKQHGVDSILCVSVNDTFVMNAWKSDQHAENITFVPDGNGEFTKGMNMLVEKADLGFGPRSWRYSMLVRNGVVEKMFVEPNKPGDPFEVSDADTMLKYLAPDFKVQESVAVFTKPGCPFCAKAKQMLQDHGLQYEEIVLGKDATTVSLRAVSGRSTVPQIFIGGRHIGGSDDLEKYLPA

SEQ ID NO: 10242 - DNA, 486 bp, Brucella suis 1330
  CDS (1)..(486): transl_table=11
atgacgatcaaagttggcgacaggctgcccgcagcgactttcaaggtaaagaccgcagacggcgtcacggaaatgacgaccgacgatgtcttcaaaggcaggaaggtggttctctttgcggtgccgggtgcatttacgccgacctgtagcctgaaccacctgccgggctatcttgaaaaccgcgatgcaattctcgccaagggcgtggaccagattgcagtcgttgcggtgaacgacccgtttgtcatgggcgcctgggcgcagagcaccggcggcgagggcaagattctcttcctcgccgatggaagcgcaaccttcaccaaagcagccggtctcgatatcgatctttccggtggcggcctcggtgtacgttccaagcgctattccgccatcgtcgaagatggcgtggtgaaatctctcaatatcgaagaacagccgggccaggcggtcacgtctgccgcctcagcccttctcgcacagctttaa

SEQ ID NO: 10243 - protein, 161 aa, Brucella suis 1330
MTIKVGDRLPAATFKVKTADGVTEMTTDDVFKGRKVVLFAVPGAFTPTCSLNHLPGYLENRDAILAKGVDQIAVVAVNDPFVMGAWAQSTGGEGKILFLADGSATFTKAAGLDIDLSGGGLGVRSKRYSAIVEDGVVKSLNIEEQPGQAVTSAASALLAQL

SEQ ID NO: 10244 - DNA, 477 bp, Shewanella oneidensis MR-1
  CDS (1)..(477): transl_table=11
atgattgctcaaggtcaaaaattaccagcggcgacgctaagccaattaacaaaagatggcatggtaaatcatcaagttaccgagctgtttgcgggtaagaaagtggtattatttgcagtgccaggtgctttcacaccaacctgttctgaagcgcatttgcccggttatgtggtgctggccgatgagttaaaagccaaaggcgttgatttaattgcctgtgtatcggtaaacgatgccttcgtgatgaaagcctggggcgaagcgcaaaatgcgtctgagttactgatgcttgccgatggcgatgcgagctttactaaggcgctcggattagagatggataccgcaggctttggcggtgtgcgttcacaacgttatgcgatgatcatcgataacggcgtggtgacgttactgaatgttgaagcacctaagtcatttgaggtgagcaaggccgaagtggtgttggcggctttaagttaa

SEQ ID NO: 10245 - protein, 158 aa, Shewanella oneidensis MR-1
MIAQGQKLPAATLSQLTKDGMVNHQVTELFAGKKVVLFAVPGAFTPTCSEAHLPGYVVLADELKAKGVDLIACVSVNDAFVMKAWGEAQNASELLMLADGDASFTKALGLEMDTAGFGGVRSQRYAMIIDNGVVTLLNVEAPKSFEVSKAEVVLAALS

SEQ ID NO: 10246 - DNA, 501 bp, Pseudomonas putida KT2440
  CDS (1)..(501): transl_table=11
atgatcaaaaccggcgatcaattgcccgacgttaccctttatcaatacaacaacgacgcaggcgcctgcgcgatcggccccaaggccttttccattcgcgagcgttgcaagcacaagaaggtgctgatcttcgcgttgccgggcgcgttcacgccgacttgctctgaacgtcatgttcccggttatgtcgcggcggcccctgcgttgttcgcggctggcattgacgaaatcctgtgcgtctcggtgaacgatgcctttgtcatgaacgcctggggcaacagcttgcaggttggggatgcggtcaagatgatcggcgatggcaatggcgaattcagcgaggcgctgggcctgacccaggacctttcggcacgcggtttggggcggcgctcgcagcggtatgcgatgttggtcgacgaccaggtagtccagtacattgcggttgaaagccccggcaagttcgaggtcagcgatgcggccagcctgctggctgtgttgcgctag

SEQ ID NO: 10247 - protein, 166 aa, Pseudomonas putida KT2440
MIKTGDQLPDVTLYQYNNDAGACAIGPKAFSIRERCKHKKVLIFALPGAFTPTCSERHVPGYVAAAPALFAAGIDEILCVSVNDAFVMNAWGNSLQVGDAVKMIGDGNGEFSEALGLTQDLSARGLGRRSQRYAMLVDDQVVQYIAVESPGKFEVSDAASLLAVLR

SEQ ID NO: 10248 - DNA, 486 bp, Bradyrhizobium japonicum USDA 110
  CDS (1)..(486): transl_table=11
atggcgatccagactggcgacaagctgcccgaggcgaaattccgcgtgatgacggcggaaggcccgcaggtgaagaccaccgacgacatcttcaagggcaagaaggtggcgctgttcgcggtgcccggcgcctacaccggcacctgccacaagatgcatctgccgagcatcttcctcaacgcctacgccatcaaggacaagggcgtcgacaccatcgccatcatctccgtcaacgacgccttcgtcatgaacgcctggaagcgcgacaccgaccagcgcgacgaggccgtattcctcgccgacggcaatgccgacttcaccaaggcgatcggcatggagctcgacgcctccgccaacggcctcggcatccgctccaagcgctattcgatgctggtcgaggacggcgtggtgaagaagctgaacctcgaggcgatgcccggcaaggtcgaggtgtcaggcggcgatacgctgctcgggcagctctga

SEQ ID NO: 10249 - protein, 161 aa, Bradyrhizobium japonicum USDA 110
MAIQTGDKLPEAKFRVMTAEGPQVKTTDDIFKGKKVALFAVPGAYTGTCHKMHLPSIFLNAYAIKDKGVDTIAIISVNDAFVMNAWKRDTDQRDEAVFLADGNADFTKAIGMELDASANGLGIRSKRYSMLVEDGVVKKLNLEAMPGKVEVSGGDTLLGQL

SEQ ID NO: 10250 - DNA, 474 bp, Vibrio parahaemolyticus RIMD 2210633
  CDS (1)..(474): transl_table=11
atgattcaacaaggccaagcactaccttctgcaaccgtaagtgaactgactgccgatggcatggtcaaccacgatgtgaccgaactgttcgcgaacaagaaagtggtgctattcgcggttcctggcgcattcactccaacttgctcagaagctcacctaccaggctacgtagtactcgcagatcaattaaaagccaaaggcgttgatttaattgcttgtgtggcagtgaacgatgcattcgtaatgaacgcatggggtgaagctcaaaacgcttctgagattttgatgctaggtgacggtgatgctagctttactaaagcgctaggcttggaaatggatactggcggctttggcggcgttcgctcacaacgttacgcgatgatcattgaaaacggcgtagtaacaacacttaacgttgaaaagccaagtgaatttgaagtaagtaatgcagaaactattcttgcagcactttaa

SEQ ID NO: 10251 - protein, 157 aa, Vibrio parahaemolyticus RIMD 2210633
MIQQGQALPSATVSELTADGMVNHDVTELFANKKVVLFAVPGAFTPTCSEAHLPGYVVLADQLKAKGVDLIACVAVNDAFVMNAWGEAQNASEILMLGDGDASFTKALGLEMDTGGFGGVRSQRYAMIIENGVVTTLNVEKPSEFEVSNAETILAAL

SEQ ID NO: 10252 - DNA, 573 bp, Prochlorococcus marinus str. MIT 9313
  CDS (1)..(573): transl_table=11
atgcctttccctcaaaacgttccagatgtcaccttcaagactcgcgtgcgcgatgaatctgtgcccgggtctaatccattccgctggcaagacctgactagtgctgaaatctttaaggggcgcaaggtggtggtgttagccctgccaggagcttttacgcctacgtgctcatccaatcatttgccacgttatgaggagttgcatgcagaacttgttgcccaaggtgttgatcagattgtctgtctttcagtgaatgatgcttttgtaatgttccagtggagcaaacatttgggtaccaagaatatctttatgctccctgatgggaatggagagttcactcgtaaaatgggcatgcttgttgagaaatccaacctaggttttggtttgcgttcctggcgctattcgatgctagtgaatgattgtaatattgaaaagatgtttgttgagcctggctttagtgataatgctgatggtgacccgtttgaggtctcagatgctgatacgatgcttgcttacatgaagggtgtgcaatcggctggtgttagttccccgtgccgtgagtttcagggttaa

SEQ ID NO: 10253 - protein, 190 aa, Prochlorococcus marinus str. MIT 9313
MPFPQNVPDVTFKTRVRDESVPGSNPFRWQDLTSAEIFKGRKVVVLALPGAFTPTCSSNHLPRYEELHAELVAQGVDQIVCLSVNDAFVMFQWSKHLGTKNIFMLPDGNGEFTRKMGMLVEKSNLGFGLRSWRYSMLVNDCNIEKMFVEPGFSDNADGDPFEVSDADTMLAYMKGVQSAGVSSPCREFQG

SEQ ID NO: 10254 - DNA, 474 bp, Vibrio vulnificus YJ016
  CDS (1)..(474): transl_table=11
atgatcgctcaaggccaaactttacctaacgctacactgagccaactgaccaaagagggaatggtccaccaccctgttttagagctgtttgctggcaaaaaagtcgtgcttttcgccgtacctggggcgttcaccccaacctgttcagaagcacatttaccgggttatatcgtattggccgatcaacttaaggcgaaaggcgtcgatctgattgcctgcgtttctgtcaacgatgcgtttgtgatgaaagcctggggtgaagcacaaaatgcggaagaaattctaatgttggcggatggcgacgcgagctttaccaaagcactcggcttggaaatggataccgctggttttggtggccttcgctctcaacgctacgcgatgattatcgacaatggcgtggtcacaaccctcaatgtggaagcgcctaaatcatttgaagtgagtaacgctgaaacaattcttgcagcgctttaa

SEQ ID NO: 10255 - protein, 157 aa, Vibrio vulnificus YJ016
MIAQGQTLPNATLSQLTKEGMVHHPVLELFAGKKVVLFAVPGAFTPTCSEAHLPGYIVLADQLKAKGVDLIACVSVNDAFVMKAWGEAQNAEEILMLADGDASFTKALGLEMDTAGFGGLRSQRYAMIIDNGVVTTLNVEAPKSFEVSNAETILAAL

SEQ ID NO: 10256 - DNA, 486 bp, Rhodopseudomonas palustris CGA009
  CDS (1)..(486): transl_table=11
atgaccatcaaggttggcgaccgcctgcccgacgcgcagtttcgggtaatgaccgaagacggtgtgcaggtgaagaccaccgacgatatcttcaagggcaagaaggtggcgctgttcgccgttccgggcgcttacaccggaacctgccacaagatgcatctgccgagcatcttcctcaacgcctatgcgatgaaggacaagggcgtcgacaccatcgcgatcgtctcggtcaacgacgccttcgtgatgagcgcctggaagcgcgacaccgaccagcgcaacgaagcgatcttcctcggcgacggcaatgccgacttcaccaaggcgatcggcatggaaatggacggctcgggcttcggcctcggcacccgttcgctgcgctattcgatggtggtcgaagacggcgtggtgaagaccctcaacctcgagccgaatcccggcaaggtcgaagtctccggcggcgacacgctgctcgggcagctgtga

SEQ ID NO: 10257 - protein, 161 aa, Rhodopseudomonas palustris CGA009
MTIKVGDRLPDAQFRVMTEDGVQVKTTDDIFKGKKVALFAVPGAYTGTCHKMHLPSIFLNAYAMKDKGVDTIAIVSVNDAFVMSAWKRDTDQRNEAIFLGDGNADFTKAIGMEMDGSGFGLGTRSLRYSMVVEDGVVKTLNLEPNPGKVEVSGGDTLLGQL

SEQ ID NO: 10258 - DNA, 507 bp, Magnaporthe grisea 70-15
  CDS (1)..(507)
atggctgccctcaaggttggtgacgctttccccgacggtgtctcgttcacctacgttcctacggggggcaagaaggaggatgttaccgcttgcggcaacggtatcaagtacaacgccagcaccgaggccaaggacaagaaaattgtcatcgtcagtgttccgggtgctttcacccctacgtgccaggagcagcacctcaagagctacgtcgagaagaaggacgagctcaaggccaagggcgttgacaaggtcgtcttcattgcatacaacgaccactgggtaatgagcgcctggggcaaggccaacgacatctacgatgacttcatcatctttgcctctgacgacggcatcagcttttccaagagcatcggctggaacctcggtgacagcggccgtactgccaggtacgccatcgtcgtcgaccacggaaaggttacctacgccgagaaggaggaggccggcggcatcgccgtctcgggcgctgaggccgtcttggccaagctgtag

SEQ ID NO: 10259 - protein, 168 aa, Magnaporthe grisea 70-15
MAALKVGDAFPDGVSFTYVPTGGKKEDVTACGNGIKYNASTEAKDKKIVIVSVPGAFTPTCQEQHLKSYVEKKDELKAKGVDKVVFIAYNDHWVMSAWGKANDIYDDFIIFASDDGISFSKSIGWNLGDSGRTARYAIVVDHGKVTYAEKEEAGGIAVSGAEAVLAKL

SEQ ID NO: 10260 - DNA, 501 bp, Gibberella zeae PH-1
  CDS (1)..(501)
atgcctgaactcaaggtcggcgccgacttccccgagggtgtcttctttagctacgtccagcccactcccgagatcgctgagttctctacctgtggtgctcccaccaactacaacgccagccaggagttcaagagcaagaaggtcgtcctcatctctgtccccggtgctttcactcctacttgcagtgcctctcacgttccttcttacgtcgagaacattgagcagatcaaggccaagggcgttgaccaggtcatcgtcgttgctgtcaacgacgcatttgtcatgcacggttgggccaaggctaatggcatcaccgatgacaagattctcttcatgtccgaccacaacgccaagttctccaccagcatcggctggaacctgggcgagcgaactggtcgtttcgccgtggttatcgaccacggcaagatcacctatgcctctagtgatgagcctggaagcatcgagaagtctggtgcccttggtgtccttcctcacttgtaa

SEQ ID NO: 10261 - protein, 166 aa, Gibberella zeae PH-1
MPELKVGADFPEGVFFSYVQPTPEIAEFSTCGAPTNYNASQEFKSKKVVLISVPGAFTPTCSASHVPSYVENIEQIKAKGVDQVIVVAVNDAFVMHGWAKANGITDDKILFMSDHNAKFSTSIGWNLGERTGRFAVVIDHGKITYASSDEPGSIEKSGALGVLPHL

SEQ ID NO: 10262 - DNA, 528 bp, Candida glabrata CBS 138
  CDS (1)..(528)
atggctgctcctcaagttaacgaaaagttcgatgtcaaggacatcaagttccaatacattgatttcgatcaatctgtgtcccacgatgcctgtgctatgccaagcaccacttcctggtccgacttcttggccaagaacaagactgtcgtcatcactggtgccccagctgctttctccccaacttgttccatcagccacatcccaggctacatctccaagctgagcgacctggaagccaagggcgttgaccaagttgttgttgtcaccgttgacaacccattcgccaacgaggcctgggccaagaacttgggtgtgcaaaacaccaagcacatcaagttcgccaccgacgccggtgccgagctggtcagacacttgggctacgagttgaaggtcggcgaaggtgtctactggagtggtagatggaccgtcattgtcaaggacggtgttgttgtctacgccggcaacgagtccaacccagcctccgatgtcaccgtctcctctgttgaagaagctttgaagcatttgtaa

SEQ ID NO: 10263 - protein, 175 aa, Candida glabrata CBS 138
MAAPQVNEKFDVKDIKFQYIDFDQSVSHDACAMPSTTSWSDFLAKNKTVVITGAPAAFSPTCSISHIPGYISKLSDLEAKGVDQVVVVTVDNPFANEAWAKNLGVQNTKHIKFATDAGAELVRHLGYELKVGEGVYWSGRWTVIVKDGVVVYAGNESNPASDVTVSSVEEALKHL

SEQ ID NO: 10264 - DNA, 516 bp, Kluyveromyces lactis NRRL Y-1140
  CDS (1)..(516)
atgtcctctgatactctaccaaacacaagattccaatacatcagaattattccatctcaggaaggtactgaagcatgctctgctccagttgagacctcattcactgaatataagggtactgttgtgattactggtgctccagcagccttttctccaacctgttctgtttctcacattccaggttacgttcaaaagttgaaccaattggtcgatgccggtgcatctcaagtcttcgttgttactgctgacaatccatttgctaaccaacaatgggccaagactctaggtgtcaaggataccgacaagatcaagttcatcactgatgccggtgccaagttttcccaatctttgggctttgccttgccaattgagtccggcgttttctgggccagcagatacttggtaattgccaaggatgggaagattgtttaccaagccgttgaagaaaacccagctactgatgttacagtttcttccgttgataatgccttggaacaattgaacaagattaaatag

SEQ ID NO: 10265 - protein, 171 aa, Kluyveromyces lactis NRRL Y-1140
MSSDTLPNTRFQYIRIIPSQEGTEACSAPVETSFTEYKGTVVITGAPAAFSPTCSVSHIPGYVQKLNQLVDAGASQVFVVTADNPFANQQWAKTLGVKDTDKIKFITDAGAKFSQSLGFALPIESGVFWASRYLVIAKDGKIVYQAVEENPATDVTVSSVDNALEQLNKIK

SEQ ID NO: 10266 - DNA, 537 bp, Debaryomyces hansenii CBS767
  CDS (1)..(537)
atgacatataaggttaacgataaatttccagtcagtgtctcattacaatatgttccatactccaaagagaagggtgaaattattgcctgttccaatccaacaaccttcaacttagagaaggagcttcccggaaaaaaaattgtcctaacttcggcaatcggagcattcactccaccatgcaccgaagatcatttgccaacgtatttgaataacatcaagaatttcaagtctaagggagttgataaaatcattgttcttaccgataatgatccgtttgtcaatagtgcatggggaaaggcattgggatacaaggacgaagaaaactacgtcattttcgcaactgatccaaatgctgctttgtcaaaaaatttgggcaaaaagtttattgcagacatgaccgacgatggctttggtgtcaggacaagtagatatgccgcgatcattgataatggtgttatcaagtatttggagagcgaagacggtggtgggtttacctctacaaccaatgccaatgacttgttaaagaagcttgattga

SEQ ID NO: 10267 - protein, 178 aa, Debaryomyces hansenii CBS767
MTYKVNDKFPVSVSLQYVPYSKEKGEIIACSNPTTFNLEKELPGKKIVLTSAIGAFTPPCTEDHLPTYLNNIKNFKSKGVDKIIVLTDNDPFVNSAWGKALGYKDEENYVIFATDPNAALSKNLGKKFIADMTDDGFGVRTSRYAAIIDNGVIKYLESEDGGGFTSTTNANDLLKKLD

SEQ ID NO: 10268 - DNA, 558 bp, Debaryomyces hansenii CBS767
  CDS (1)..(558)
atggggttgaaacaggacgataagttcccaactgatgttacatttaagtacattccaatcgagttaaataatacccaggatcctttgacatgcgagcagccaattttgcttaaacttgataagcatttggaagaaacggatgggaatactttaattgtttctgtccctggagcatttactcccacatgtaccgcaaatcacattcccccatttttgaccaatttgtcaaagttaaagaaggaaaagaacattggatcaattatagttattagtgctaatgatgcatttgttttaaatgcttggggaaaattgttactatccacagtaaaagtgacagaaccagcacctaagattttctttgcttcagatggaaatgctgctttcagtaaggagtatgatttatcggttgatgcttctgccaatggcatgggtatcagaactgctaggtatgctattgtcgttgaagacaaaacaagaaagatatcatatttgggcaaagaagttgaaagaggtgtcaagttcagtggaattgacgctattttacaagcaaaattgtaa

SEQ ID NO: 10269 - protein, 185 aa, Debaryomyces hansenii CBS767
MGLKQDDKFPTDVTFKYIPIELNNTQDPLTCEQPILLKLDKHLEETDGNTLIVSVPGAFTPTCTANHIPPFLTNLSKLKKEKNIGSIIVISANDAFVLNAWGKLLLSTVKVTEPAPKIFFASDGNAAFSKEYDLSVDASANGMGIRTARYAIVVEDKTRKISYLGKEVERGVKFSGIDAILQAKL

SEQ ID NO: 10270 - DNA, 522 bp, Debaryomyces hansenii CBS767
  CDS (1)..(522)
atgtccgaattatttccaactgacgtcaaattgaaatacgtcccatacacaaagtctaatgatgccgttgcatcttgtggtaacccaattgacttcgacttagccaaggaattgccaggaaagaagatcgttttaactgctgctccaggtgcgttcaccccaacttgtacagaagaacatattccaaattacttaaaaaacttggaaaaatttaagagcaagggggttgacagagtggttgtggttaccgcaaacgacccatttgtcaatgcagcatggggcaaggccttaggaagcaaagatgaatctaattacgttatctttgcatctgatccaaatgctgctttatccaaagaattgggtgataactttgtggctgatttaaccaaggctggtcttggtatcagaactgccagatatacatctatcattgatgatggtaaagtttctttcttggaaagtgaagaagggttgggttttagtgaaatctcaagtgcttccactgtcttagaaagactttag

SEQ ID NO: 10271 - protein, 173 aa, Debaryomyces hansenii CBS767
MSELFPTDVKLKYVPYTKSNDAVASCGNPIDFDLAKELPGKKIVLTAAPGAFTPTCTEEHIPNYLKNLEKFKSKGVDRVVVVTANDPFVNAAWGKALGSKDESNYVIFASDPNAALSKELGDNFVADLTKAGLGIRTARYTSIIDDGKVSFLESEEGLGFSEISSASTVLERL

SEQ ID NO: 10272 - DNA, 591 bp, Yarrowia lipolytica CLIB122
  CDS (1)..(591)
atggaccagaatgacctagcactcactcaattgagatgccttctcaacttacacccgcacccaccactaccgtactcagctaacacagattccttcccttctgccactttcaactacgttcccgagacccccgagatcgagggcaacgtggctgcctgcggtatcccccagcctttccactccgataaggagcttgctggaaagaaggtcgttttcgtgtccgtccccggcgccttcacccccacctgcaccgccaaccacattcctccttacatcgagaacgtggacaagctcaaggccaagggcgtcgacaaggtcgtcgttatctctgccaatgaccccttcgtgctgtccgcctggggacgagctctcaaggctcccaaggacaactttttcatctttgcctccgacggaaacgccgccttctccaagtccattggccaggctgtcgatctcgcttctgtgggcttcggagagcgaactgcccgatacgccatcatcgtggacgatggcaaggttacctacaacgagcaggagcctggcaaggaagtcactgtctccggctttgacgctgtctacgccaagctctaa

SEQ ID NO: 10273 - protein, 196 aa, Yarrowia lipolytica CLIB122
MDQNDLALTQLRCLLNLHPHPPLPYSANTDSFPSATFNYVPETPEIEGNVAACGIPQPFHSDKELAGKKVVFVSVPGAFTPTCTANHIPPYIENVDKLKAKGVDKVVVISANDPFVLSAWGRALKAPKDNFFIFASDGNAAFSKSIGQAVDLASVGFGERTARYAIIVDDGKVTYNEQEPGKEVTVSGFDAVYAKL

SEQ ID NO: 10274 - DNA, 507 bp, Aspergillus nidulans FGSC A4
  CDS (1)..(507)
atgtctggacttaaggccggtgacagcttccccgctgacgttgtcttctcctacattccctggactgaggagaagggcgagatcacctcttgcggtatccccattaactactacgcttccaaggagtgggccgacaagaaggtcatcctcttcgccctccccggtgccttcacccccgtctgctctgctcgccacgtccctgagtacatcgagcgcctccccgagatccgcgccaagggtgtcgatgttgttgccgtccttgcctacaacgatgctttcgtcatgagtgcctggggtaaggccaacggtgttaagaacgacgacattctcttcctttccgaccccgaggccaagttctccaagagcatcggctgggccgacgaggagggccgtaccaagcgttatgccatcgtcctcgaccacggcaaggtcacctacgctgctctggagcccgccaagaaccaccttgagttctccagcgccgagactgtcatcaagcacctgtaa

SEQ ID NO: 10275 - protein, 168 aa, Aspergillus nidulans FGSC A4
MSGLKAGDSFPADVVFSYIPWTEEKGEITSCGIPINYYASKEWADKKVILFALPGAFTPVCSARHVPEYIERLPEIRAKGVDVVAVLAYNDAFVMSAWGKANGVKNDDILFLSDPEAKFSKSIGWADEEGRTKRYAIVLDHGKVTYAALEPAKNHLEFSSAETVIKHL

SEQ ID NO: 10276 - DNA, 531 bp, Candida albicans SC5314
  CDS (1)..(531): transl_table=12
atgactgacggtaaattcccaactaacattgaaccaaaatacattccttattctaaagatcatgcaagtttaactgcttgtgctaatccaataccattggatttaaaatctttatttccaaataatactgttgttgtcactgctgtgcctggtgcttttaccccaacttgtactgaacaacatatccctgattatttgaaacatttgaaagatttcaaagacaagggcgtcaaaaaaatcattgttttatctgccaatgatccatttgtaatggcagcttgggctaaagctttgggttatactgatgaagaaaattatgttatttttgctactgatcctaatgcttctatttctaaagaattgggtgatggatttgttgctgatttgactctggcaggtatgggattaagattacaaagatatgctagtattgttgttaatggagaaatcacttatttggaaactgaagatagtttgggattcctggaaatttctagtgctgaaaccattttaaagagaatccacaattaa

SEQ ID NO: 10277 - protein, 176 aa, Candida albicans SC5314
MTDGKFPTNIEPKYIPYSKDHASLTACANPIPLDLKSLFPNNTVVVTAVPGAFTPTCTEQHIPDYLKHLKDFKDKGVKKIIVLSANDPFVMAAWAKALGYTDEENYVIFATDPNASISKELGDGFVADLTSAGMGLRLQRYASIVVNGEITYLETEDSLGFSEISSAETILKRIHN

SEQ ID NO: 10278 - DNA, 762 bp, Ustilago maydis 521
  CDS (1)..(762)
atggtaagcaagcaactgatcacctcaacgcttccagctttgcgagtcggtttgcgaccctctcctgcggctactaggcgactcaccacctgcgctgcctcctctgttgccccctccttgtttgtggcttttccttgccgtacgctcgtccgaccgtcttcaatcgcacctctggcgttgcacttggctgcaaatactggatcgatggctgcgtcgatgcgttcgtttgcaacaacgtcggttcaaaaggctatttcaaagggcgagcagattcccaacaccacctttacgtacgtcccctgggcacctgagctcgctgacggtaccgcttgtggtgctcccaccaagatccagacacacgaagctttcaagggcaagaaggtcgtcattgtcgccgttcccggtgcctacactcctacgtgccacgtgaaccacatcccaccctacatcaagcagatcgacagcttcaagtccaagggtgtcgatcaggtcatcgttctggctcaaaacgacccgttcgtcatgtccgcctggggcgtccagaacaaggccgaggacaaggtcatctttgccaccgacctcaacctcgagttctctaaagccatcggctctatcgccgatctcagcgccatgggcttcggtcaacgtaccggccgttacgccctcattgtggatgaccttaaggtcgtcgatttctctcctgaacctaaccccggcgctgtcgaggttagcggcgctgaccacgtcctcgccaagctctaa

SEQ ID NO: 10279 - protein, 253 aa, Ustilago maydis 521
MVSKQLITSTLPALRVGLRPSPAATRRLTTCAASSVAPSLFVAFPCRTLVRPSSIAPLALHLAANTGSMAASMRSFATTSVQKAISKGEQIPNTTFTYVPWAPELADGTACGAPTKIQTHEAFKGKKVVIVAVPGAYTPTCHVNHIPPYIKQIDSFKSKGVDQVIVLAQNDPFVMSAWGVQNKAEDKVIFATDLNLEFSKAIGSIADLSAMGFGQRTGRYALIVDDLKVVDFSPEPNPGAVEVSGADHVLAKL

SEQ ID NO: 10280 - DNA, 504 bp, Herminiimonas arsenicoxydans
  CDS (1)..(504): transl_table=11
atgacaatcaaaattggtgatcagctgccagaagcgcggctcgcagagtacatcgacgtagcaagcgaagcttgttccgttggcccaagcaaagtcatggtgcatgaagcaaccaaaggcaagaaaatcgcaattttcgcagttccaggcgcattcacgccaacctgctccgaaacacacgcgcctggctacatcaaggcagcggatcagttcaaagccaaaggcgttgatgaaatctggtgcatttcggttaacgatccgttcgtcatgggtgcatggggccgcgaccaaaaagcagccggtaaagtacgtttcatcgctgacggcagcggcacattcaccaaggcactgggtatggaattcgatctgaccaaaggcggcctgggcgtacgttcgcaacgttactcgatgctggtggaagatggcgtcgtcaagcaattgaacgtggaagatagcggtcatctggaagtatcgacagcagaaaaactgctggaacagatctaa

SEQ ID NO: 10281 - protein, 167 aa, Herminiimonas arsenicoxydans
MTIKIGDQLPEARLAEYIDVASEACSVGPSKVMVHEATKGKKIAIFAVPGAFTPTCSETHAPGYIKAADQFKAKGVDEIWCISVNDPFVMGAWGRDQKAAGKVRFIADGSGTFTKALGMEFDLTKGGLGVRSQRYSMLVEDGVVKQLNVEDSGHLEVSTAEKLLEQI

SEQ ID NO: 10282 - DNA, 507 bp, Burkholderia vietnamiensis G4
  CDS (1)..(507): transl_table=11
atgattcaagtgggcgaagcgctgcccgacgcgcaattgttcgaatacgtcgacgacgcgcgcgaaggctgcacgctggggccgaacgccgtcagcgtgcgcgagcaggtggcgggaaaacgcgtggtgatcttcggattgccgggtgctttcacgccgacctgttcggcgcagcatgtgccgggctacgtcgagcatgccgagcagttgcgcgcggccggcatcgacgagctctggtgcgtgtccgtcaacgacgcattcgtgatgggcgcatggggacgtgatctgcacaccgcgggcaaggtgcgcatgatcgcggacggcagcgctgctttcactcatgcgctggggctgacgcaggatttgtccgcgcgtggcatgggaatccgttccctgcgctacgcgatggtggtcgacgacggtgtggtcaagacgctggccgtcgaagcgccgggcaaattcgaagtgagcgatgcagcgagtgtgctcgcgacactaaggccctga

SEQ ID NO: 10283 - protein, 168 aa, Burkholderia vietnamiensis G4
MIQVGEALPDAQLFEYVDDAREGCTLGPNAVSVREQVAGKRVVIFGLPGAFTPTCSAQHVPGYVEHAEQLRAAGIDELWCVSVNDAFVMGAWGRDLHTAGKVRMIADGSAAFTHALGLTQDLSARGMGIRSLRYAMVVDDGVVKTLAVEAPGKFEVSDAASVLATLRP

SEQ ID NO: 10284 - DNA, 525 bp, Bartonella henselae str. Houston-1
  CDS (1)..(525): transl_table=11
atgataagaaaaacagttcccaacaccactttccatacacgtgtacgcgatgaatcaattggtggagataatccttatcgatggcaagaggtgaacagcgatgcatattttaaagggaaacgagttattcttttttctcttcctggagcttttacccctacttgctcaacctttcagcttcctgattttgaaaaactctatgatgaatttaaaaaagttggcattgatgaaatttattgcctttccgtcaatgatgcttttgtcatgaacgcttggggaaaagcacaaggtattaaaaacgtaaaattaatccctgatggctcaggtgaattcacacgaaaaatgggtatgctggttgctaaagacaatgttggttttggaatgcgctcatggcgctatgctgctgtgatcaatgatggtgtcattgaacattggtttgaagaacaaggtttttcagataattgcgcaacagatccttatgaagtctcctcaccacaaaacgttttaaaaaccctaaaaggctaa

SEQ ID NO: 10285 - protein, 174 aa, Bartonella henselae str. Houston-1
MIRKTVPNTTFHTRVRDESIGGDNPYRWQEVNSDAYFKGKRVILFSLPGAFTPTCSTFQLPDFEKLYDEFKKVGIDEIYCLSVNDAFVMNAWGKAQGIKNVKLIPDGSGEFTRKMGMLVAKDNVGFGMRSWRYAAVINDGVIEHWFEEQGFSDNCATDPYEVSSPQNVLKTLKG

SEQ ID NO: 10286 - DNA, 732 bp, Mannheimia succiniciproducens MBEL55E
  CDS (1)..(732): transl_table=11
atgtcaaatatggaaggtaaaaaagtccctcaagttacatttcacacccgtcaaggcgatgcttgggtcgatgtaacttcagctcaactttttgataataaaaccgttgtggtattttcattacctggcgcttatacgccgacttgttcgtcaagccatttaccgcgttacaacgaattaacgccggaatttaaaaaattaggtgttgatgatgtgatttgcgtatcggtaaacgatacattcgttatgaacgcatggaaatgtgatgaagatgccgataatatcaccgttctgccggacggcaacggcgaattcaccgaaggcatgggcatgttggtggataaagaagagctgggtttcggtaaacgttcgtggcgctattctatgctggtaaaaaacggcgtaatcgaaaaaatgtttattgaaccgaacgaaccgggcgatccgttcaaagtttccgatgcggacaccatgatcaaattcatcaaaccggattgggagccaaaaccgtcagtcgcgttatttactaaaccgggttgcccgttctgcgcgaaagcgaaagcgctgttaacggaaaaaggctatccgtttgaagaaattgtgttaggcaaagacgctaccgttacttcggtacgtgctatgagtggtcgtgccacattccctcaagtgtttatcggcggtaaacatattggcggcagcgatgatttagaagcttatttcgctaataaataa

SEQ ID NO: 10287 - protein, 243 aa, Mannheimia succiniciproducens MBEL55E
MSNMEGKKVPQVTFHTRQGDAWVDVTSAQLFDNKTVVVFSLPGAYTPTCSSSHLPRYNELTPEFKKLGVDDVICVSVNDTFVMNAWKCDEDADNITVLPDGNGEFTEGMGMLVDKEELGFGKRSWRYSMLVKNGVIEKMFIEPNEPGDPFKVSDADTMIKFIKPDWEPKPSVALFTKPGCPFCAKAKALLTEKGYPFEEIVLGKDATVTSVRAMSGRATFPQVFIGGKHIGGSDDLEAYFANK

SEQ ID NO: 10288 - DNA, 507 bp, Methylococcus capsulatus str. Bath
  CDS (1)..(507): transl_table=11
atgaccatccgagtcggagaccgtctgcctgcgggcagcctcaccgaatgcaccgagttcgatccggccaccgcctgtcccatgaatcccagggcggtcgacgtcggtgaacaggcccgaggcaagaagctcgtgatcttcggcgtgcccggcgccttcacccctacctgttcggtcaagcacctgcctggcttcgttgcgaatcacgatcggctcagggccaagggcgtggacgaaatctggtgcatggccgtgaacgacggcttcgtgatggcggcttggggccgcgagcaaaaggccggcggcaaggtgcgcatgatggccgatggcagcgccgaatatgcgaagaaactcggcctggagcgcgacctgaccgccaacggcatgggcatccgctgccaccgcttcgccatgatcgtcgacgacggcgtggtcaaatacctcggcgtcgaagcctccggcaagttcgaagtctcgaatgccgaggccgtgctggcgcatctctga

SEQ ID NO: 10289 - protein, 168 aa, Methylococcus capsulatus str. Bath
MTIRVGDRLPAGSLTECTEFDPATACPMNPRAVDVGEQARGKKLVIFGVPGAFTPTCSVKHLPGFVANHDRLRAKGVDEIWCMAVNDGFVMAAWGREQKAGGKVRMMADGSAEYAKKLGLERDLTANGMGIRCHRFAMIVDDGVVKYLGVEASGKFEVSNAEAVLAHL

SEQ ID NO: 10290 - DNA, 486 bp, Silicibacter pomeroyi DSS-3
  CDS (1)..(486): transl_table=11
atgatttcagtcggagatacgctgccggacgccacattcatggtcttcagtgacaagggccccgagacggtcgatcttgagcccaagctgaagggccgcaaggtggtgatgttcggcctgccgggcgcctttacccgtggctgttccatgacccacctgcccagcttcatccgcacccgccaggccttggccgacaagggcgtggacgaggtgatctgcgtctcggtgaacgatccgttcgtgatgacggcctggggccagcaaagcggcgcggccgaggccgggatcaccatgctggccgacccgaccgccgagttcaccaaggcaatcgggctggcgttcagcgcaccggtggtgggcctctacgatcgctgccagcgctttgccctgatggccgaggacggggtggtcaaggtcctgaacctcgaaacagaggcgggcgcctgcaagctgaccgttggcgaagaactgctggagcagatctga

SEQ ID NO: 10291 - protein, 161 aa, Silicibacter pomeroyi DSS-3
MISVGDTLPDATFMVFSDKGPETVDLEPKLKGRKVVMFGLPGAFTRGCSMTHLPSFIRTRQALADKGVDEVICVSVNDPFVMTAWGQQSGAAEAGITMLADPTAEFTKAIGLAFSAPVVGLYDRCQRFALMAEDGVVKVLNLETEAGACKLTVGEELLEQI

SEQ ID NO: 10292 - DNA, 726 bp, Haemophilus influenzae 86-028NP
  CDS (1)..(726): transl_table=11
atgtctagtatggaaggaaaaaaagtccctcaagtgacattccgcactcgtcagggtgataaatgggttgatgtaactacctcagagttatttgataacaaaacagtgatcgtgttctcattaccgggcgcattcactccaacttgctcatcatcacacttaccacgttacaacgaattagcgccagtattcaaaaaatacggtgtagacgatattcttgttgtatctgtaaatgatactttcgtaatgaacgcatggaaagaagatgaaaaatctgaaaacatcactttcattccagatggtaatggtgaatttaccgaaggcatgggtatgttagttggtaaagaagatttaggcttcggtaaacgttcatggcgttattctatgcttgtgaaaaacggcgtagttgaaaaaatgtttatcgaaccaaacgaaccaggcgatccgttcaaagtatccgatgctgacactatgttgaaataccttgcaccacaacaccaagtgcaagagtctatttcaatctttacaaaacctggctgtcctttctgtgcaaaagcaaaacaacttttacacgataaaggcttaagctttgaagaaatcatattaggtcacgatgcaacaatcgtgagcgtacgtgcagtttcaggtcgtgctactgttccacaagtgtttatcggtggtaaacacattggcggtagcgacgatttggaaaaatactttgcataa

SEQ ID NO: 10293 - protein, 241 aa, Haemophilus influenzae 86-028NP
MSSMEGKKVPQVTFRTRQGDKWVDVTTSELFDNKTVIVFSLPGAFTPTCSSSHLPRYNELAPVFKKYGVDDILVVSVNDTFVMNAWKEDEKSENITFIPDGNGEFTEGMGMLVGKEDLGFGKRSWRYSMLVKNGVVEKMFIEPNEPGDPFKVSDADTMLKYLAPQHQVQESISIFTKPGCPFCAKAKQLLHDKGLSFEEIILGHDATIVSVRAVSGRATVPQVFIGGKHIGGSDDLEKYFA

SEQ ID NO: 10294 - DNA, 729 bp, Colwellia psychrerythraea 34H
  CDS (1)..(729): transl_table=11
atgtttactgatattaccggccaaaaagtcccttcagttacctttccaattatagctgatgacacatggagtactcgcaattcagaggaaatttttgccaacaaaaccgtagtagttttttcattacctggtgcatttacaccaacgtgttcatcatctcacctgccacgatataacgaattagcgactaaattctcagccaacggcgttgatgaaattatttgtatttctgtaaatgatacctttgtaatgaatgcttgggcaaaagatcaagacgccgataacattagtttcattcctgatggtaatggtgaatttacacaaggcatgggtttattagttgataaagcggcaataggattcggcaaacgcagctggcgctatgctatgttagttaaaaatggtgttattgaaaaaatgtttattgaacctgatttaccaggagacccatttgaagtatctgatgctgataccatgcttaacttcatcaaccctgaagcagttcaaagcactgaagtggcgattttcaccaaacatggttgttctcactgcactaaagctaaagcattattagctgagcaaggtttacagtatgaagaattagtattaggtgaagacacaacaatcacggcaatgcgtgctatttcaaatgctgatactacaccacagatatttatcgatggtaaacatattggcggtaatgatgaattagtaaagcactttagctag

SEQ ID NO: 10295 - protein, 242 aa, Colwellia psychrerythraea 34H
MFTDITGQKVPSVTFPIIADDTWSTRNSEEIFANKTVVVFSLPGAFTPTCSSSHLPRYNELATKFSANGVDEIICISVNDTFVMNAWAKDQDADNISFIPDGNGEFTQGMGLLVDKAAIGFGKRSWRYAMLVKNGVIEKMFIEPDLPGDPFEVSDADTMLNFINPEAVQSTEVAIFTKHGCSHCTKAKALLAEQGLQYEELVLGEDTTITAMRAISNADTTPQIFIDGKHIGGNDELVKHFS

SEQ ID NO: 10296 - DNA, 507 bp, Ralstonia eutropha JMP134
  CDS (1)..(507): transl_table=11
atgatcgctgtcggacaacgcgtgccggacgccacgctgcaggaattcttcgatacccagagcgaaggttgctcgctcggtcccaatgccttcagcgtctcggacctcgtcaagggtcgcaagatcgtggtcttcgccttgcctggcgcgttcacgccgacttgctcggccaagcatgtgcccggctacgtggccgaagcacaggcgctgcgcgacgcgggcgtggacgaagtctggtgtgtttcggtcaacgacgcgttcgtgatgggcgcctggggccgcgaacagcacactgaaggcaaggtgcgcatgatggccgacggaagcgcagaatggacgcgtgcgctgggtcttgaccaggatttgtcggcgcgcggcatgggcgtccgctccaagcggtacgccatggtgctggacgatggcgtcgtgacccaccttcaagtcgaggcgcccggcgagttcaaggccagcagcgccgaagcgatgctagaggcgttgcgcggctga

SEQ ID NO: 10297 - protein, 168 aa, Ralstonia eutropha JMP134
MIAVGQRVPDATLQEFFDTQSEGCSLGPNAFSVSDLVKGRKIVVFALPGAFTPTCSAKHVPGYVAEAQALRDAGVDEVWCVSVNDAFVMGAWGREQHTEGKVRMMADGSAEWTRALGLDQDLSARGMGVRSKRYAMVLDDGVVTHLQVEAPGEFKASSAEAMLEALRG

SEQ ID NO: 10298 - DNA, 489 bp, Rhodobacter sphaeroides 2.4.1
  CDS (1)..(489): transl_table=11
atggtgatttcggtaggcgaccggctgcccgaagcgactttggtgcggatcggggccgaggggcccgagcaggtgcagctgtcggagcggctgaagggccggaacgtggtgatcttcgccgtgccgggggccttcacgcccacctgccactcggcccatgtgccctccttcatccgcaccaaggaccagttcgcgggcaagggcgtggacgagatcatctgcgtctcggtcaacgatcccttcgtgatgaaggcctggggcgaatccaccggcgcttcgggggcgggcatcaccatgctcgccgatgcggatggcgccttcaccaaggctctgggtctggccttcgacgcgccgcccgtggggctgatcggccgctcgcgccgctatgcgctgcaggccaaggacggggtggtcgccgtgatccatctcgaggagagccccggcgtctgcgaaacctcgggcggcgaggcgctgctggccgcgatctga

SEQ ID NO: 10299 - protein, 162 aa, Rhodobacter sphaeroides 2.4.1
MVISVGDRLPEATLVRIGAEGPEQVQLSERLKGRNVVIFAVPGAFTPTCHSAHVPSFIRTKDQFAGKGVDEIICVSVNDPFVMKAWGESTGASGAGITMLADADGAFTKALGLAFDAPPVGLIGRSRRYALQAKDGVVAVIHLEESPGVCETSGGEALLAAI

SEQ ID NO: 10300 - DNA, 507 bp, Burkholderia sp. 383
  CDS (1)..(507): transl_table=11
atgattcaagtgggcgacgcgctgcccgacgcgcaattgttcgagtacatcgacgacgcgcgcgaagggtgcacgctggggccgaacgcctacagcgtgcgcgaccaggttgcgggaaagcgggtggtgatcttcggattgccgggcgctttcacgccgacctgctcggcgcagcatgtgccgggctacgtcgaacacgccgagcaattgcgcgcggcgggtatcgacgagatctggtgcgtgtccgtcaacgacgcattcgtgatgggcgcatggggacgtgatctgcacaccgcgggcaaggtgcgcatgatggcggacggcagcgcggctttcactcatgcgctggggctgacgcaggatttgtccgcgcgtggcatgggaattcgttccctgcgctacgcgatggtgattgacggcggtgtggtcaagacgctggccgtcgaggcgccgggcaaattcgaagtgagcgatgcggcgagtgttctcgcgacgttgacgtcctga

SEQ ID NO: 10301 - protein, 168 aa, Burkholderia sp. 383
MIQVGDALPDAQLFEYIDDAREGCTLGPNAYSVRDQVAGKRVVIFGLPGAFTPTCSAQHVPGYVEHAEQLRAAGIDEIWCVSVNDAFVMGAWGRDLHTAGKVRMMADGSAAFTHALGLTQDLSARGMGIRSLRYAMVIDGGVVKTLAVEAPGKFEVSDAASVLATLTS

SEQ ID NO: 10302 - DNA, 480 bp, Rhodospirillum rubrum ATCC 11170
  CDS (1)..(480): transl_table=11
atgatcgccgttggagacgctttgccttcgggcaccctgcaccacaagaccgcggccggtatcgaggccgtcgatcccgccgaattcctcggcgcgggcaaggcggtgctgttcgccgtgcccggggccttcacccccacctgttcggacagccatgtgccgggctatatcgcccaggcccaggccctgcgcgacaagggggtgaccaaggtcgcctgcgtcgccgtcaatgacgcttttgttctcgccgcctggagcaaggcgcttggcgccgaaggcacggtcgagatgctggccgatggcaatggcgattacgcccgtgcccttggcctggagcttgatctgaccgccaagggcctgggtaagcgcttccagcgctgcgccctggttctggacaacggcaaggtcacgcatcttgccgtcgatgaaggcggcgcgctggatgtctcgtcggccgaggcggttctcgccctgctataa

SEQ ID NO: 10303 - protein, 159 aa, Rhodospirillum rubrum ATCC 11170
MIAVGDALPSGTLHHKTAAGIEAVDPAEFLGAGKAVLFAVPGAFTPTCSDSHVPGYIAQAQALRDKGVTKVACVAVNDAFVLAAWSKALGAEGTVEMLADGNGDYARALGLELDLTAKGLGKRFQRCALVLDNGKVTHLAVDEGGALDVSSAEAVLALL

SEQ ID NO: 10304 - DNA, 558 bp, Burkholderia thailandensis E264
  CDS (1)..(558): transl_table=11
ttgggccgtgtcgtctgttgcggacgtacgtatcgctatgaaggaccaggcatgattcaagtgggcgacacgctgcccgacgtgcagatcttcgagtatctcgacgacgcacgcgcgggctgcacgctggggccgaacgcctttggcgtgcgcgagcagacggcgggcaagcgcgtggtgatcttcggattgccgggcgcgttcacgccgacctgctcggcgcagcatgtgccgggctacgtcgcgcaggccgagcggttgcgctcggcgggcatcgacgagatctggtgcgttgccgtcaacgacgcattcgtgatgggcgcttggggacgcgatctgcacaccgcgggcaaggtgcgcatgatggcggacggcggcgcggctttcactcatgcgctgggactgacgcaggacctgtccgcgcgtggcatggggattcgctcccggcgctacgcgatggtggtcgacgacggcgtggtcaagacgctgctcgtcgaagcgccgggcaagttcgaagtgagcgatgcggccagcgtgctggccagtttgacgcgctga

SEQ ID NO: 10305 - protein, 185 aa, Burkholderia thailandensis E264
MGRVVCCGRTYRYEGPGMIQVGDTLPDVQIFEYLDDARAGCTLGPNAFGVREQTAGKRVVIFGLPGAFTPTCSAQHVPGYVAQAERLRSAGIDEIWCVAVNDAFVMGAWGRDLHTAGKVRMMADGGAAFTHALGLTQDLSARGMGIRSRRYAMVVDDGVVKTLLVEAPGKFEVSDAASVLASLTR

SEQ ID NO: 10306 - DNA, 480 bp, Novosphingobium aromaticivorans DSM 12444
  CDS (1)..(480): transl_table=11
atgacaatcgctgttggtgacaagctgcccgacgtgaagatcgtcaaggcaactgccgaaggtccggaagcggtccagtcggccgaatacttcaagggcaagaaggtcgccctgttctccgtccccggcgcgttcaccccgacctgctcggccaagcacctgccgggctacgtcgagaaggccgcggatctcaaggccaagggcatcgacgaagtggcgtgcaccgccgtcaacgacccgttcgtgatgaaggcttggggcgccgccaacggctcgtccgatgtgaccatgctggccgacggcaacggcgacctcgccgaagcgctcggccttacgatggacggctcgggattcggcctcggcaagcgcggccagcgcttctcgatggtcgtgaacgatggcgtcgtcgagcagctcttcgtcgaagctccgggcgacttcaaggtcagctcggccgagcacatgctcgaaaacctctga

SEQ ID NO: 10307 - protein, 159 aa, Novosphingobium aromaticivorans DSM 12444
MTIAVGDKLPDVKIVKATAEGPEAVQSAEYFKGKKVALFSVPGAFTPTCSAKHLPGYVEKAADLKAKGIDEVACTAVNDPFVMKAWGAANGSSDVTMLADGNGDLAEALGLTMDGSGFGLGKRGQRFSMVVNDGVVEQLFVEAPGDFKVSSAEHMLENL

SEQ ID NO: 10308 - DNA, 525 bp, Francisella tularensis subsp. holarctica
  CDS (1)..(525): transl_table=11
atgactaaaaaagtacctaatgtaacttttaaaacaagagtaagagatgagggtattggcggttcaaatccatttagatggcaagatgtaacatcagctgatatttttgataataaaagagtaattgtattctcattaccaggagcatttacaccaacttgttcaacttatcaattaccaggttttgaaaataacgcagctagattcaaagagctaggtatagatgagatttatgttttatcggtaaacgatagctttgttatgaacaagtggattcaggttcagggaattcaaaatattaaaccgattccagatggtaatggtgaatttactgaagctttagatatgcttgttgataaatcaaatattggttttggcaaaagatcttggcgctatgcaatgattgtaaataatggtgaaatcgagaaaatgtttgttgagcctggaaagcgtgataatgcagataatgatccgtatggtgagtcttctccagaaaacttattgaagtatttagagtctaagtaa

SEQ ID NO: 10309 - protein, 174 aa, Francisella tularensis subsp. holarctica
MTKKVPNVTFKTRVRDEGIGGSNPFRWQDVTSADIFDNKRVIVFSLPGAFTPTCSTYQLPGFENNAARFKELGIDEIYVLSVNDSFVMNKWIQVQGIQNIKPIPDGNGEFTEALDMLVDKSNIGFGKRSWRYAMIVNNGEIEKMFVEPGKRDNADNDPYGESSPENLLKYLESK

SEQ ID NO: 10310 - DNA, 504 bp, Burkholderia xenovorans LB400
  CDS (1)..(504): transl_table=11
atgattcagacaggtgacaagctgcccgacgcaacgctcttcgagttgatcgaagacgagcgggcgggctgcacgatcgggcctaacagcttcgacgtgcgcgagcagacggcgggcaagcgtgtggtgatcttcggattgccgggcgcgttcacgccgacctgttcagccaaacatgtaccgggttatgtcgagcatgccgggcagttgcgcgctctcggcatcgacgaaatctggtgcgtgtccgtcaacgacgcgttcgtaatgggcgcgtggggacgcgatcagcacgcctcgggcaaggtgcgcatgatggcggacggcagtgcggctttcacgcgagcgctcggtctcgagcaggatttgtcggcgcgcggcatgggaatccgttcccagcgctacgcgatggtggtcgacgacggcgtggtcaagacgttgaacgtcgaggctgccggcaaattcgaagtcagcgatgcagggagtattctcgccacgttgagctag

SEQ ID NO: 10311 - protein, 167 aa, Burkholderia xenovorans LB400
MIQTGDKLPDATLFELIEDERAGCTIGPNSFDVREQTAGKRVVIFGLPGAFTPTCSAKHVPGYVEHAGQLRALGIDEIWCVSVNDAFVMGAWGRDQHASGKVRMMADGSAAFTRALGLEQDLSARGMGIRSQRYAMVVDDGVVKTLNVEAAGKFEVSDAGSILATLS

SEQ ID NO: 10312 - DNA, 507 bp, Ralstonia metallidurans CH34
  CDS (1)..(507): transl_table=11
atgatcgccattgggcaacgcgtccctgacgccacgctgtacgaatttttcgaaaccgaatccgaaggctgcgtgctcgggccgaatgcgttttcggtggccgaactggtcaagggccgcaagatcgtggtcttcggcctgcccggcgcctttactccgacttgctccgcgaagcatgtgcccagctatctcaaggagtacgatgcgttgcgtgccgccggtgtcgacgaaatctggtgccactcggtcaacgacgcctttgtgatgggtgcctggggacgcgagcagaaggccacaggcaaggtccggatgatgggtgacggcgccgcgcaatgggccagggccctggggctggatcaggacctgagccagcgcggcttgggtgtgcgcgccaaacgctatgcgatggtcgtcgatgacggtgtggtgacccacctgttcatcgaggagccgggcgagttcaaggtcagcagtgccgaatgggtgctgcaggcgttgcgcgcttga

SEQ ID NO: 10313 - protein, 168 aa, Ralstonia metallidurans CH34
MIAIGQRVPDATLYEFFETESEGCVLGPNAFSVAELVKGRKIVVFGLPGAFTPTCSAKHVPSYLKEYDALRAAGVDEIWCHSVNDAFVMGAWGREQKATGKVRMMGDGAAQWARALGLDQDLSQRGLGVRAKRYAMVVDDGVVTHLFIEEPGEFKVSSAEWVLQALRA

SEQ ID NO: 10314 - DNA, 546 bp, Silicibacter sp. TM1040
  CDS (1)..(546): transl_table=11
atgtttgctggacaaaaactcccccaggtgaccttccgtacccgtgttcgcgacgacagcatcgagggcccaaacccgttccgctggcaggacatgaccactgcagattacttcgcgggcaagcgcgtgatcctgttctcgctgccgggcgcgttcaccccgacttgctcgacctaccagctgcccggttttgagaacgggtttgaggatttcaaggctgaaggcatcgacgaaatctactgcatgtccgtcaacgacagctttgtgatgaacaaatgggccgaagcgcagggcatcaagaacgtcaaagtgatccccgacggctctggcgaattcacccgtaaagtgggcatgctggtcgccaaggacaacctcggctttggcatgcgttcctggcgctatgcagccatcatcaacgatggggttgtagaagcgtggttcgaagagccgggccgcgatgacaaccacgcagaagatccgtatggcgaatccgcgcccgagaacctgctgaagcacctcaaggaaaaagtctccgaagcggcctga

SEQ ID NO: 10315 - protein, 181 aa, Silicibacter sp. TM1040
MFAGQKLPQVTFRTRVRDDSIEGPNPFRWQDMTTADYFAGKRVILFSLPGAFTPTCSTYQLPGFENGFEDFKAEGIDEIYCMSVNDSFVMNKWAEAQGIKNVKVIPDGSGEFTRKVGMLVAKDNLGFGMRSWRYAAIINDGVVEAWFEEPGRDDNHAEDPYGESAPENLLKHLKEKVSEAA

SEQ ID NO: 10316 - DNA, 486 bp, Silicibacter sp. TM1040
  CDS (1)..(486): transl_table=11
atgatatctgttggagacaaactccccgaggccaccttgacccgactgggcgccgaaggccccgaagcggttgcgatccaagacctcgccaaggggcgcaagctggccattttcgctgtgccgggcgcctttactcccacttgccactctgcgcatgtgccgagtttcattcgtaccaaggaccagtttgcggccaaaggcgttgacgaaatcatctgtatctcaggcaacgatcccttcgtcatgaaagcctggggcgaggccaccggggcaaccgaggcgggaatcaccatgctggcagatgcggagtgcagctttaccgatgcaatcgggatgcgttttgacgcgccaccagccgggctcatcgggcgttccaaacgctacgcaatgatcgtcgaggatggtgaggtaaaaatcctgcacctcgaagaaagtccgggaacatgtgaagtgtctgctggtgaagggctgctggatgcgttgtaa

SEQ ID NO: 10317 - protein, 161 aa, Silicibacter sp. TM1040
MISVGDKLPEATLTRLGAEGPEAVAIQDLAKGRKLAIFAVPGAFTPTCHSAHVPSFIRTKDQFAAKGVDEIICISGNDPFVMKAWGEATGATEAGITMLADAECSFTDAIGMRFDAPPAGLIGRSKRYAMIVEDGEVKILHLEESPGTCEVSAGEGLLDAL

SEQ ID NO: 10318 - DNA, 486 bp, Mesorhizobium sp. BNC1
  CDS (1)..(486): transl_table=11
atgaccatttccgttggcgaacggctgccgaacgtcaccatcaaaaaggccacgcccaatggcgccgaggagacgaccacgagagacttctttgccggccgcaaggtggtgctattcggagtgccgggcgcattcacgcccacctgcagcaacagtcatctgcccggcttcatcgaaaattacgatgcgatagtatcgcgcggcatcgacgcggtggcggtcgtttcggtcaacgatgcattcgtgatgggtgcgtgggcaaggttcacaggcgccgaggacaagctggttttcctggcggacgggagcggcgatttcgcgcgcgcggtcggcctcgatctcgatctttccgcgagaggcatgggcctgcgttcgcagcgctattcgatgatcgtcgaggatggcatcgtgaaggcgatcaacgtcgaggaagttcccggccaggcggtgacgagcggcgcggcccgcattctggagcagctttga

SEQ ID NO: 10319 - protein, 161 aa, Mesorhizobium sp. BNC1
MTISVGERLPNVTIKKATPNGAEETTTRDFFAGRKVVLFGVPGAFTPTCSNSHLPGFIENYDAIVSRGIDAVAVVSVNDAFVMGAWARFTGAEDKLVFLADGSGDFARAVGLDLDLSARGMGLRSQRYSMIVEDGIVKAINVEEVPGQAVTSGAARILEQL

SEQ ID NO: 10320 - DNA, 570 bp, Trichodesmium erythraeum IMS101
  CDS (1)..(570): transl_table=11
atggttattgacaaagttcctgacgtagtattcaagacccgtgtccgtgatgagtcagttgatgggccaaatcctttccggtggcaagacaaaactactcaagaaatttttggtggcaagcgtgttgtcttatttgcattacccggtgcttttacaccaacctgctcatctactcacctaccccgctatgaagaactatacaatgaatttaaaggacaaggaatagatgaaattatctgtctatcagtaaatgatgcttttgtgatgtttcaatggggtaaacagcaaggttctaaaaacgtattcctactaccagatggtaatggagaattctctcgcaaaatgggaatgttagtagaaaagtccaatctaggttttggtatgcgttcttggcgctatgcaatggttgtgaatgactgcacaattgaaaagatgtttgttgaggaaggttttgctgacaactatggtgatgacccatttgaggtatctgatgcagatacagtattagcttttctcaaaggtcaagaagcaccaaaagacaaaccagctagattagattttgtgggatag

SEQ ID NO: 10321 - protein, 189 aa, Trichodesmium erythraeum IMS101
MVIDKVPDVVFKTRVRDESVDGPNPFRWQDKTTQEIFGGKRVVLFALPGAFTPTCSSTHLPRYEELYNEFKGQGIDEIICLSVNDAFVMFQWGKQQGSKNVFLLPDGNGEFSRKMGMLVEKSNLGFGMRSWRYAMVVNDCTIEKMFVEEGFADNYGDDPFEVSDADTVLAFLKGQEAPKDKPARLDFVG

SEQ ID NO: 10322 - DNA, 579 bp, Synechococcus sp. CC9311
  CDS (1)..(579): transl_table=11
ttgattcaaatgaaaagcttcgatcaagtgccagatgttgtattccatactcgtgttcgtgatgaaagcgtaggtggaaccaatccttttgtttggaaagatcgtagctcggcagaaatcttccacaacaaaaaagttgttcttttttctctccccggagcttttactccaacctgttcttctaatcatttgccacgatacgaagagctttatgatgagttccgttcccagggcgtggatcaggtgatttgcctttctgttaatgatgctttcgtcatgtttcaatgggggaagcatattggtgtaaaaaatatatttttactgcctgatggcaatggtgaatttactcgtaaaatgggaatgctggttagcaaagacaaccttgggtttggcatgcgttcttggcgatattcaatgctggtagataatgggactatcgaaaagatttttattgaacctggtttcgctgactgctgccctgatgatccgtttgaggtctctgatgccgatacgatgattgcatatctcaagggatctacttcgtcgggaattgccaagccaaatgattttgtgggataa

SEQ ID NO: 10323 - protein, 192 aa, Synechococcus sp. CC9311
MIQMKSFDQVPDVVFHTRVRDESVGGTNPFVWKDRSSAEIFHNKKVVLFSLPGAFTPTCSSNHLPRYEELYDEFRSQGVDQVICLSVNDAFVMFQWGKHIGVKNIFLLPDGNGEFTRKMGMLVSKDNLGFGMRSWRYSMLVDNGTIEKIFIEPGFADCCPDDPFEVSDADTMIAYLKGSTSSGIAKPNDFVG

SEQ ID NO: 10324 - DNA, 483 bp, Hyphomonas neptunium ATCC 15444
  CDS (1)..(483): transl_table=11
atggcgatcaaagtgggcgacaagctgccggaagcgacttttatggaaatgaccgtggatgggccaaagcccgtcaccaccgcgcaggtgttcggcggcaagacggtcgcgctgttcgccgtgccgggcgcctatacgccgacctgttcggcgcgccacctgccgggctatgtcgacaaggcgggcgatttcaaagccaagggcgtggacgagatcgtctgcacctcggtcaatgacgtgttcgtcatgggcgcctggggcaaatcctccaaagccgaggaagccgtgcggatgctggcagatggcaatggcgcgtttgcccagtcgcttggcctggaactcgacgcatcgggctttggcatgggcaagcgctcgcagcgctattccatgctggtgaaggacggcgttgtggccgaactcaacgttgagcagggcggcgaattcaaggtgtcggccgccgactaccttctcggccaactctga

SEQ ID NO: 10325 - protein, 160 aa, Hyphomonas neptunium ATCC 15444
MAIKVGDKLPEATFMEMTVDGPKPVTTAQVFGGKTVALFAVPGAYTPTCSARHLPGYVDKAGDFKAKGVDEIVCTSVNDVFVMGAWGKSSKAEEAVRMLADGNGAFAQSLGLELDASGFGMGKRSQRYSMLVKDGVVAELNVEQGGEFKVSAADYLLGQL

SEQ ID NO: 10326 - DNA, 486 bp, Rhizobium leguminosarum bv. viciae 3841
  CDS (1)..(486): transl_table=11
atgaccatcgcgatcggcgacaagcttcctgccgccaccttcaaggaaaagacggctgacggcccggtcgaaatcaccaccgatcagctcttcgccggcaagcgcgtcgtgctctttgccgtgccgggcgcctttacgccgacctgctcgctgaaccacctgccgggttatctcgaaaaccgcgacaccatccttggcaagggcgtcgacgacatcgccgtggtcgccgtcaacgactggcacgtgatgggcgcctgggcgcaatcctccggcggcatgggcaagatccacttcctcgccgattgggatgccggcttcaccaaggccgtcggtctcgacgccgacctctccgccggcggcctcggcctccgctccaagcgctattcgatgctggtggaagacggcgtcgtcaaggccctcaacgtcgaggaaagccccggccaggcaaccgtctcgggcgccgccgcgatgctggaacagctctga

SEQ ID NO: 10327 - protein, 161 aa, Rhizobium leguminosarum bv. viciae 3841
MTIAIGDKLPAATFKEKTADGPVEITTDQLFAGKRVVLFAVPGAFTPTCSLNHLPGYLENRDTILGKGVDDIAVVAVNDWHVMGAWAQSSGGMGKIHFLADWDAGFTKAVGLDADLSAGGLGLRSKRYSMLVEDGVVKALNVEESPGQATVSGAAAMLEQL

SEQ ID NO: 10328 - DNA, 474 bp, Shewanella sp. ANA-3
  CDS (1)..(474): transl_table=11
atgattgctcaaggtcaaacattaccagcggcgacgctaagccaactgactaaagatggcatggtaaatcatcaagttaccgagctgttcgcgggtaaaaaagtcgtgttatttgcagtgcctggtgctttcacgccaacctgttctgaagcgcatttgccaggttatgtcgtactggccgatcaatttaaagctaaaggcgtggatttaattgcctgtgtatcggtaaacgatgcctttgtaatgaaagcctggggcgaagcgcaaaatgcatctgagttactgatgcttgccgatggcgatgcgagctttactaaggcgctgggactcgagatggataccgctggctttggcggtgtgcgttcacaacgttatgcgatgatcatcgataacggtgtggtgactttactgaatgtagaagcacctaagtcatttgaggtgagcaaagccgaagtggtattagcggcactttaa

SEQ ID NO: 10329 - protein, 157 aa, Shewanella sp. ANA-3
MIAQGQTLPAATLSQLTKDGMVNHQVTELFAGKKVVLFAVPGAFTPTCSEAHLPGYVVLADQFKAKGVDLIACVSVNDAFVMKAWGEAQNASELLMLADGDASFTKALGLEMDTAGFGGVRSQRYAMIIDNGVVTLLNVEAPKSFEVSKAEVVLAAL

SEQ ID NO: 10330 - DNA, 573 bp, Crocosphaera watsonii WH 8501
  CDS (1)..(573): transl_table=11
atggctgttatcgaaactgtacccagcgttgtctttaaaacccgtgttcgtgatgagtctgtgccagggcctaacccttttcgttggcaagatgtaaccaccgaagaaatttttaaaggaaaaaaagtgattgttttttccttgcctggtgcttttactcccacttgttcatctaaccacttacctcgctacgaagagttatatgaggagttcaaggggttaggagttgaccaaattatttgtgtgtctgtgaatgatgcttttgtgatgttccaatggggcaaacaacaagaagccaaaaacgtctccttattacccgatggcaacggcgaatttacccgtaaaatggggatgttagtcgagaagtctaacctcggttttggtatgcgttcttggcgttactctatgttagtgaacgactgcaaggtagagaaaatgttcgtcgaacctgacttcagcgataactgtcctaccgatccctttgaagtatccgacgctgacaccatgttagcttacctcaaaggcactgagtctgctggtgtttctgaaccccgcaaagcttttgtaggttaa

SEQ ID NO: 10331 - protein, 190 aa, Crocosphaera watsonii WH 8501
MAVIETVPSVVFKTRVRDESVPGPNPFRWQDVTTEEIFKGKKVIVFSLPGAFTPTCSSNHLPRYEELYEEFKGLGVDQIICVSVNDAFVMFQWGKQQEAKNVSLLPDGNGEFTRKMGMLVEKSNLGFGMRSWRYSMLVNDCKVEKMFVEPDFSDNCPTDPFEVSDADTMLAYLKGTESAGVSEPRKAFVG

SEQ ID NO: 10332 - DNA, 489 bp, Sulfitobacter sp. EE-36
  CDS (1)..(489): transl_table=11
atgacgatttctcaaggcgacacgctgcccgatgcaacgctggtgcaaatggggccggacggcccgcagcctgtgcagatggctgacaagctaaagggccgcaaggtcgtcgtctttgccgtgcccggtgcctatacgcccacctgcgattccgcccatgtgcccagcttcgtgcgcaccaaggaccagttcgacgccaaaggcgtggacgagatcatctgcgtgtcctgcaatgacccctttgttatggccgcttggggtgaatcgacaggcgcgacggcggctggcatcaccatgcttgccgatgccaacagcgcctttaccaaagccatcggcatggaattctcggccgagcccgcggggctgatttcgcgctccaaacgctatgcgatgctggtggatgacggcaaggtcacgctattccaggccgaggtacagcccggcgtctgcgatatgtcgggcggcgaggcgctgctggacaacatgtaa

SEQ ID NO: 10333 - protein, 162 aa, Sulfitobacter sp. EE-36
MTISQGDTLPDATLVQMGPDGPQPVQMADKLKGRKVVVFAVPGAYTPTCDSAHVPSFVRTKDQFDAKGVDEIICVSCNDPFVMAAWGESTGATAAGITMLADANSAFTKAIGMEFSAEPAGLISRSKRYAMLVDDGKVTLFQAEVQPGVCDMSGGEALLDNM

SEQ ID NO: 10334 - DNA, 489 bp, Roseovarius nubinhibens ISM
  CDS (1)..(489): transl_table=11
atgactattaccaccggcgacaaaatcccctcggcgacgctgttgcagatgggcgcggacggcccagagcaagtgtcgctcgacgacaaggcgaagggccgcaagctggcgatctttgccctgcccggcgcctataccggcgtctgccacaacgcccatgtgccgagcttcgtgcgcaacatggaggcgctcaaggccaagggcgtggacgaggtgatctgcatctcggtgaacgatcccttcgtgatgggtgcctggggcgagagcaccggcgcgaaagaagcgggcattgcgatgctgggcgacgcggatgcgagctttaccaaggcgatggggatggagttttcggccccgcccgccgggctgatcgaccgctcgaaacgctatgcgatggtggtcgaggatggcgtggtgacgctgcttcaggccgaagagagccccggcgtctgcgacgtctcgggcgcggaatcgctgctcgacgcgatgtaa

SEQ ID NO: 10335 - protein, 162 aa, Roseovarius nubinhibens ISM
MTITTGDKIPSATLLQMGADGPEQVSLDDKAKGRKLAIFALPGAYTGVCHNAHVPSFVRNMEALKAKGVDEVICISVNDPFVMGAWGESTGAKEAGIAMLGDADASFTKAMGMEFSAPPAGLIDRSKRYAMVVEDGVVTLLQAEESPGVCDVSGAESLLDAM

SEQ ID NO: 10336 - DNA, 489 bp, Oceanicola batsensis HTCC2597
  CDS (1)..(489): transl_table=11
atggcaatttccaaaggcgacacgttgccggacgccacattggtagaatttacggccgaggggccgaaggaagtttcgctttccgagcggctggccggacggaatgtcgtgatctttgccttgccgggggcctatacgggcacctgcaccaccgcgcatgtccccagcttcatccgcacagtcgaccagttccgggacaagggcgtggacgaggtcatctgcctgtcggtcaacgatcccttcgtcatggccgcctggggcaaggacacgggcgccgccgatgccggcatcgcgatgctgggtgatccgcgggccgagtttaccaaggccgtcggcatggatttcaccgcgccaccggtcggattgatcgaccggtcgaaacgctacgccatgtacgttaaggacggcgtcgtgacggtcctgcatgccgaggaaaatccgggccagtgcgacgtatccggtggcgagtcgatgctcgaggcgatctga

SEQ ID NO: 10337 - protein, 162 aa, Oceanicola batsensis HTCC2597
MAISKGDTLPDATLVEFTAEGPKEVSLSERLAGRNVVIFALPGAYTGTCTTAHVPSFIRTVDQFRDKGVDEVICLSVNDPFVMAAWGKDTGAADAGIAMLGDPRAEFTKAVGMDFTAPPVGLIDRSKRYAMYVKDGVVTVLHAEENPGQCDVSGGESMLEAI

SEQ ID NO: 10338 - DNA, 480 bp, Erythrobacter sp. NAP1
  CDS (1)..(480): transl_table=11
atgacgatttcggttggcgacaagatccctgaggtcaccatggtcaaggcgaccgccgaagggcctcagcaggtctcctcttccgagtatttcgcaggcaagaaagttgccctgttctcggtgcccggtgccttcaccccgacctgttcggccaagcaccttcccggcttcgttgagaaagccgatgatctcaaagcaaagggcgtcgacgaaatcgtcggcactgcagtcaacgacgcttttgtgatgggcgcgtggaacagcgcggctggttctgacgacatcacgatgctcgccgatggcaacgctgattttgccgaagcggttggcctgacaatggacggatcaggtttcggcatgggcaagcgcggtcagcgcttctcgatggtgatcgaagacggcaccgtcacccagctcaacatcgaagagcccggcgacttcaaggtttcaagcgccgaacacatgctcggccaactctga

SEQ ID NO: 10339 - protein, 159 aa, Erythrobacter sp. NAP1
MTISVGDKIPEVTMVKATAEGPQQVSSSEYFAGKKVALFSVPGAFTPTCSAKHLPGFVEKADDLKAKGVDEIVGTAVNDAFVMGAWNSAAGSDDITMLADGNADFAEAVGLTMDGSGFGMGKRGQRFSMVIEDGTVTQLNIEEPGDFKVSSAEHMLGQL

SEQ ID NO: 10340 - DNA, 474 bp, Pseudoalteromonas tunicata D2
  CDS (1)..(474): transl_table=11
atgattacagtaggccaatctttaccgactcatgtatttaatgtcttaacagccgatggtatgagcaacccaaccactgctgacttatttgcgggtaaaaaagtagtgatgtttgcattaccaggcgcatttacgccaacgtgttctgcagcacatttgcctgggtatgtagttctagccgatgagttaaaagccaaaggtgttgatagcattatttgtttatcagttaacgatgcgtttgtaatgaaagcgtggggccaaagccaaaatgctgagcagttaattatgctggctgatggtgatgcaagttttagccaagcacttggtttagcacaagaaacaggtgcttttggcggtactcgcgccctgcgttatgccatgatcgttgacgatggcgtagtgagttatttagcggttgaagagggcaaagaatttgaagtatcgaaagctgagcacattctagcccagatttaa

SEQ ID NO: 10341 - protein, 157 aa, Pseudoalteromonas tunicata D2
MITVGQSLPTHVFNVLTADGMSNPTTADLFAGKKVVMFALPGAFTPTCSAAHLPGYVVLADELKAKGVDSIICLSVNDAFVMKAWGQSQNAEQLIMLADGDASFSQALGLAQETGAFGGTRALRYAMIVDDGVVSYLAVEEGKEFEVSKAEHILAQI

SEQ ID NO: 10342 - DNA, 729 bp, Photobacterium sp. SKA34
  CDS (1)..(729): transl_table=11
atgttcgcatctaaagaaggtcaggctgtaccacaagttactttccacacacgtaaaggtgatcagtgggttgacgtaacaactgaagatttattcgctaataagaccgttgtcgtatttagtctacctggcgcatttacaccaacatgttcttcaagccacttacctcgttacaacgagttagcatcagtatttgctgaaaatggcgtggatgacatcttatgtgtatctgtaaacgatacgttcgtaatgaatgcatggaaagccgatcaagacgctgaaaacatcactttcattcccgatggtaatggtgagttcactaaaggtatggacatgcttgttgagaaagatgatctaggttttggtgctcgttcatggcgttacagcatgctggttaaaaatggcgtagttgaaaaaatgttcgttgaaaatgaagaaccaggcgacccattcaaagtttctgacgcagacactatgctgaagtacatcgcaccagagcaaaagttacaagaatcgattaccgtattctctaaacctggttgccctttctgtgtgaaagcaaaacaaaacttgatcgacaaaggtctacagtatgaagaaattattctaggaaaagatgcgactaccgtttctttacgtgctattacgggtcgtagtacggttcctcaagtattcatcggtggtaagcacatcggtggtagcgaagagttagaaacttacctaggctaa

SEQ ID NO: 10343 - protein, 242 aa, Photobacterium sp. SKA34
MFASKEGQAVPQVTFHTRKGDQWVDVTTEDLFANKTVVVFSLPGAFTPTCSSSHLPRYNELASVFAENGVDDILCVSVNDTFVMNAWKADQDAENITFIPDGNGEFTKGMDMLVEKDDLGFGARSWRYSMLVKNGVVEKMFVENEEPGDPFKVSDADTMLKYIAPEQKLQESITVFSKPGCPFCVKAKQNLIDKGLQYEEIILGKDATTVSLRAITGRSTVPQVFIGGKHIGGSEELETYLG

SEQ ID NO: 10344 - DNA, 735 bp, Oceanospirillum sp. MED92
  CDS (1)..(735): transl_table=11
atgttgcagaattcagaaggcaagaacattccacaggtaactttccatactcgccagggtaatgattgggtggatgtgacaagtgagcagctgtttaaaggtaaaactgtcattgtttttgccctgcctggcgcatttaccccgacatgttcgagtacgcacctgccacgttacaacgaattagcgccagtatttgccgctaacggtgtggacgagattatttgtctatctgttaatgatacttttgtgatgaatgcctgggctgaagatcagaaagcggaaaacgtcactttcctgcctgatggtaatggcgagttcagtgaagcgatgggtatgctggtggataaggatgagctgggcttcgggaagcgtagctggcgttactctatgctggttaaggatggtgtcatcgataaaatgtatatcgaaccagatctgccaggcgacccgttccaggtttctgatgcggataccatgctagattacatcaatccgcaagcagaacagccaaagcgtgtcactattatcagtaagcctggctgcccgcactgtacacgtgccaagaatgtgctgacagagaacggctacaaatatgaagagattgaactgggcacgaatggtgttagcttcagttcattacaggcggttactggccgtggtactacccctcagatttttgtagacggtgagctagtcggtagtgcggatgagctggaggcatgggtagcgaaataa

SEQ ID NO: 10345 - protein, 244 aa, Oceanospirillum sp. MED92
MLQNSEGKNIPQVTFHTRQGNDWVDVTSEQLFKGKTVIVFALPGAFTPTCSSTHLPRYNELAPVFAANGVDEIICLSVNDTFVMNAWAEDQKAENVTFLPDGNGEFSEAMGMLVDKDELGFGKRSWRYSMLVKDGVIDKMYIEPDLPGDPFQVSDADTMLDYINPQAEQPKRVTIISKPGCPHCTRAKNVLTENGYKYEEIELGTNGVSFSSLQAVTGRGTTPQIFVDGELVGSADELEAWVAK

SEQ ID NO: 10346 - DNA, 474 bp, Oceanospirillum sp. MED92
  CDS (1)..(474): transl_table=11
atgattaaggttggcgataaaattccatcagtaggtatcagtacggtgttggggggcgatacaaaaacgatctctaccgatgatttctttgctggaaaaaaagttgtgatgtttgcgttgccaggggcgtttactccgacctgctcggcttctcaccttcctggttatgttgtgaaagcagatgagatctatgcacatggggttgatgtcattgcttgtttatcggtgaacgattcatttgttatgaaagcctgggctgaagttcagaacgccgatcgtattaccatggtggctgatggtggagctgagctgagcaaggcgattgggctgcatatggaaaccggcgcttttggcggtacgcgttcgcaacgctatgcaatgattgtcgaagatggtgtggtgacagcactgaatgtcgaacagccaaaaacattcgaagtgagtagtgctgagacaatactgcaactgctataa

SEQ ID NO: 10347 - protein, 157 aa, Oceanospirillum sp. MED92
MIKVGDKIPSVGISTVLGGDTKTISTDDFFAGKKVVMFALPGAFTPTCSASHLPGYVVKADEIYAHGVDVIACLSVNDSFVMKAWAEVQNADRITMVADGGAELSKAIGLHMETGAFGGTRSQRYAMIVEDGVVTALNVEQPKTFEVSSAETILQLL

SEQ ID NO: 10348 - DNA, 486 bp, Xanthobacter autotrophicus Py2
  CDS (1)..(486): transl_table=11
atgcccatttcggtcggcgataaactgcccaacgccaccttccgcgttcccaccgaagacggcccggtgccgaagaccaccgacgagatcttcaagggcaagaaggtggtgctgttcgcggtgccgggcgccttcacgcccacctgccacaagaaccacctgccgggctacgtgcacgaggccgacgccatcaaggccaagggcgtggatgccatcgccgtggtctcggtgaacgatcccttcgtcatgggcgcctgggagaaggcttccggcgcggatggcaagatcgtgttcctggccgatccggacgccgccttttccaccgccctcgacctcaccttcgacggctcggccgccggcctcggcgtgcgctccaagcgctattccatggtggtggaggacggcgtggtgaccagcctgaatgtggaggacgtgccctcgaaggccgacatctccggcgcgcccgcccttttggcgcagctctga

SEQ ID NO: 10349 - protein, 161 aa, Xanthobacter autotrophicus Py2
MPISVGDKLPNATFRVPTEDGPVPKTTDEIFKGKKVVLFAVPGAFTPTCHKNHLPGYVHEADAIKAKGVDAIAVVSVNDPFVMGAWEKASGADGKIVFLADPDAAFSTALDLTFDGSAAGLGVRSKRYSMVVEDGVVTSLNVEDVPSKADISGAPALLAQL

SEQ ID NO: 10350 - DNA, 477 bp, marine gamma proteobacterium HTCC2207
  CDS (1)..(477): transl_table=11
atgacgattcaagttggcgataaaattcctgaaggcatgttcactgtaatgggcgcagaaggccctactggtgtaagcactgctgatattttcagcggcaaaaaagttgtactgtttgccgtccccggtgctttcactcctacctgttccgctgcacatctgccgggttttgttgtccatgttgacgacattaaagccaagggcgttgatacagtcgcctgcatgtcagtaaacgatgtgtttgtaatgcacgcttggggccagtcggctaatgctgagcatctgatgatgttggctgatggcaatgcaacgtttactgaagctctgggtctggttttggacggcagtggttttggtatgggtactcgcagtcagcgcttcgctatgatcgttgatgacggtgtggtgagcttgctgaatgttgatgctggcgcgctggaagcttcaagtgcagaggcgattttagcggcgttgtaa

SEQ ID NO: 10351 - protein, 158 aa, marine gamma proteobacterium HTCC2207
MTIQVGDKIPEGMFTVMGAEGPTGVSTADIFSGKKVVLFAVPGAFTPTCSAAHLPGFVVHVDDIKAKGVDTVACMSVNDVFVMHAWGQSANAEHLMMLADGNATFTEALGLVLDGSGFGMGTRSQRFAMIVDDGVVSLLNVDAGALEASSAEAILAAL

SEQ ID NO: 10352 - DNA, 474 bp, Vibrio sp. Ex25
  CDS (1)..(474): transl_table=11
atgattcaacaaggccaagctctaccagttgcgactctaagcgaattgactgccgatggtatggttaaccacgacgttactgagctgtttgcaaacaagaaagtcgtactcttcgctgtacctggcgcattcaccccaacgtgctcggaagctcacctaccaggctatgtggtattagccgacgagttgaaggcaaaaggtgttgatttaattgcgtgtgtttctgtaaacgatgcatttgtgatgcaagcttggggcgaagctcaaaacgcttcagaaatcctgatgttgggtgatggcgacgcaagctttactaaagcattgggtcttgaaatggataccggcggctttggtggtattcgctcacaacgctacgccatgatcattgaaaacggcattgtgaccaaacttaacgttgaagaaccaaaagagtttgaagcaagcaaagcagaaacgattttagcggcgctttaa

SEQ ID NO: 10353 - protein, 157 aa, Vibrio sp. Ex25
MIQQGQALPVATLSELTADGMVNHDVTELFANKKVVLFAVPGAFTPTCSEAHLPGYVVLADELKAKGVDLIACVSVNDAFVMQAWGEAQNASEILMLGDGDASFTKALGLEMDTGGFGGIRSQRYAMIIENGIVTKLNVEEPKEFEASKAETILAAL

SEQ ID NO: 10354 - DNA, 579 bp, Vibrio sp. Ex25
  CDS (1)..(579): transl_table=11
atgtttgtatctaaagaaggtcaacaagtccctcaagttacttttccagttcgtcaaggtgactcttggatgaatgtaacgactgatgagctatttaaaggtaagaccgttatcgtatttagcttaccgggtgcatttactccaacctgttcatcaagccatctacctcgttacaacgaattgttccctgtatttaaagagcacggagtggatgagattatttgtgtctcagtcaatgatacgttcgtgatgaatgcatggaaacaagaccaagaagcagaaaacattaccttcatcccggatggtaatggtgaattcaccgatggcatgggtatgttagtggataaaaacgacatcggctttggcaaacgttcatggcgttacagcatgctagtaaaagatggcgtagtggaaaaaatgttcattgagccaaacgaaccaggcgacccattcaaagtgtcagacgcagacaccatgctgaactacattgcgccagactacaaaacgcaagagtccatcacggtattcactaaagccaggctgccctttctgtatgaaagcgaaacaaaacctgattga

SEQ ID NO: 10355 - protein, 192 aa, Vibrio sp. Ex25
MFVSKEGQQVPQVTFPVRQGDSWMNVTTDELFKGKTVIVFSLPGAFTPTCSSSHLPRYNELFPVFKEHGVDEIICVSVNDTFVMNAWKQDQEAENITFIPDGNGEFTDGMGMLVDKNDIGFGKRSWRYSMLVKDGVVEKMFIEPNEPGDPFKVSDADTMLNYIAPDYKTQESITVFTKARLPFLYESETKPD

SEQ ID NO: 10356 - DNA, 474 bp, Alteromonadales bacterium TW-7
  CDS (1)..(474): transl_table=11
atgattgaacaaggccaaaacgtaccagaggttacacttacgcagttaacaagcgaaggtatgcaaacactgactaacaaagaattatttgatggtaaaaaagtggtgttatttgctgtgccgggggcgtttacgccaacgtgttcaaatgcacatttacctgaatttattacgcttgctgataaaattaaagcaaaaggtgttgatgctatttattgtgtttcggtaaacgatgcctttgtaatgaaagcatggggcgactcgcaaaacgctgaagaaattttaatgctagccgatggtgatgcaagctttaccaaagcactcgggcttgaaaaagacaccgctggctttggtggtattcgttcatctcgctacgcgatgattgtaaataacgcggttgttactgggttatttgtagaagaaggtaaagagttcacagtaagccgcgcagaacatgttctagaaaagctctaa

SEQ ID NO: 10357 - protein, 157 aa, Alteromonadales bacterium TW-7
MIEQGQNVPEVTLTQLTSEGMQTLTNKELFDGKKVVLFAVPGAFTPTCSNAHLPEFITLADKIKAKGVDAIYCVSVNDAFVMKAWGDSQNAEEILMLADGDASFTKALGLEKDTAGFGGIRSSRYAMIVNNAVVTGLFVEEGKEFTVSRAEHVLEKL

SEQ ID NO: 10358 - DNA, 477 bp, marine gamma proteobacterium HTCC2143
  CDS (1)..(477): transl_table=11
atgacagttaaagtaggtgacaaattaccagctggtagcttaaaagtcatgggggctgagggtcctcaagagtttactatcagcgacttgttcgacggcaaaaaagtcgtcatgctagccgtaccgggcgcatttacgccaggctgctcaatgacgcacttgccgggctttgtcgttagcgccgacaagatcaaagctaatggtatagatagtattatttgtctatcggtcaatgatgcatttgttatgggtgcttggggcacagctcagaatgccgatgaaatcatcatggccgctgacggaagtgcagattatacaaaagctttgggcctggagatggacgcctctggtttcggcatgggcctgcgaagcaaacgctacgcaatgatcgttgatgatggcgtcattacctacctcggagttgatgctaaagctattgaagccagtgcagcagaagccgttttagagcagctgtaa

SEQ ID NO: 10359 - protein, 158 aa, marine gamma proteobacterium HTCC2143
MTVKVGDKLPAGSLKVMGAEGPQEFTISDLFDGKKVVMLAVPGAFTPGCSMTHLPGFVVSADKIKANGIDSIICLSVNDAFVMGAWGTAQNADEIIMAADGSADYTKALGLEMDASGFGMGLRSKRYAMIVDDGVITYLGVDAKAIEASAAEAVLEQL

SEQ ID NO: 10360 - DNA, 480 bp, marine gamma proteobacterium HTCC2080
  CDS (1)..(480): transl_table=11
atgacaattgcaatcggcgacacaatccctgcagccaaccttatggtaatgggtgaaaatggccctggcggcgtatccaccagcgaactgtttgatggaaaaaaagtactcctttttgccgtacccggcgcattcacacccggctgctccatgacacacctaccaggctatgtagcccatgccgatcaaattaaagccgcgggcatagatagcatcatctgtctatctgtcaacgatgcctttgtcatgggcgcatggggccaggcacataacgccgaccacataacaatgctagctgacggcaacggtgagcttaccggtaagcttggtttggagcttgatggtagcgggttcgggctaggtacacgatcgcaacgctacgccatggttgtagataacggtaccgtgacgcacctcaacattgaagaagggcccggtgtggacgtgagctccgctgagaccatgttagcgcagctgtaa

SEQ ID NO: 10361 - protein, 159 aa, marine gamma proteobacterium HTCC2080
MTIAIGDTIPAANLMVMGENGPGGVSTSELFDGKKVLLFAVPGAFTPGCSMTHLPGYVAHADQIKAAGIDSIICLSVNDAFVMGAWGQAHNADHITMLADGNGELTGKLGLELDGSGFGLGTRSQRYAMVVDNGTVTHLNIEEGPGVDVSSAETMLAQL

SEQ ID NO: 10362 - DNA, 501 bp, Pseudomonas putida GB-1
  CDS (1)..(501): transl_table=11
atgatcaaaattggcgatcaactgcccgacgttaccctttaccaatacaacactgacgcaggcgcctgcgcgatcggcccgaatgccttttccattcgcgagcgttgcaagcagaaaaaggtactgatcttcgcattgccgggcgcgttcacaccgacctgttctgaacgtcatgttcccggttatgtcgctgaagcacctgcgctgttcgcggctggcatcgacgaaattctctgtgtctcggtgaacgatgcctttgtcatgaatgcctggggcaatagcctgcaggtgggtgacgcggtcaagatgatcggcgatggcaatggcgaattcagcgaggcgctgggcctgatccaggacctttcggcgcgcggtatggggcgtcgctcccagcgctatgccatgttggtcgacgacctggtggtcaagcacatcgcggtggaagcccccggcaagttcgaagtcagtgatgccgccagcatgctggctgcgctgcgctag

SEQ ID NO: 10363 - protein, 166 aa, Pseudomonas putida GB-1
MIKIGDQLPDVTLYQYNTDAGACAIGPNAFSIRERCKQKKVLIFALPGAFTPTCSERHVPGYVAEAPALFAAGIDEILCVSVNDAFVMNAWGNSLQVGDAVKMIGDGNGEFSEALGLIQDLSARGMGRRSQRYAMLVDDLVVKHIAVEAPGKFEVSDAASMLAALR

SEQ ID NO: 10364 - DNA, 599 bp, Arachis hypogaea
  CDS (15)..(503)
cctctgttcctcaaatggctccgattgcagttggagatgtcatcccagacggcaccttggccttcttggacaacgataacaagccacagtctgtgtccattcactctcttgccaagggtaaaaaggtcattatctttggtgttcccggcgccttcactcccacttgcagcttgaagcatgtgcctggcttcattgagagagcagaggagctgaaaggaaagggtgtggatgaaatcatctgtatcagtgtgaatgatccctttgtgatgaagtcatgggccaacactttccctgagaacaagcatgtgacatttcttgctgatgggtcagccaaatacacacatgatcttgggctagagcttgatctctccgagaaggggcttgggatccggtccaagaggtttgcgctgctcgttgaagacctcaaggtgaaggttgctaacattgagagtggtggagagttcactgtgtccagtgctgaagagatcatcaaggctctttaatttcctgaagaagctcttttgatgagagtgtgtgtctgttatctttactagaacatgttggagacattttgattcatagaatatgtgatgtgtgct

SEQ ID NO: 10365 - protein, 162 aa, Arachis hypogaea
MAPIAVGDVIPDGTLAFLDNDNKPQSVSIHSLAKGKKVIIFGVPGAFTPTCSLKHVPGFIERAEELKGKGVDEIICISVNDPFVMKSWANTFPENKHVTFLADGSAKYTHDLGLELDLSEKGLGIRSKRFALLVEDLKVKVANIESGGEFTVSSAEEIIKAL

SEQ ID NO: 10366 - DNA, 504 bp, Phaeosphaeria nodorum
  CDS (1)..(504)
atggctcctctcaaagtcggtgactctctgcctgagggcgtcaagttcgaatatgctcccatcaccgattccgacccgactgcctgcggccgtccccaagaatacgacgccagcaaagagtgggcgaacaagaaagtcgtcctcttctccgtccccggcgccttcactcccggttgccaagccttccacctgcccccatacatcaagaaccgcaaggccttcaccgacaagggcgtcgacattgtcgcgaccattgcgtctaacgacagctgggtgatgaatgcgtggggcaaggtcaatggcgtcaagggcgatgaggtcttgttcctcagcgacactaagacgttctttagcaagaactatggctgggatgcgggtatgggagatcgcaatgggcgctgggctatggtgtttgataacggtaaggttatctacgccgagaacgagaagagccctggtgaggtcagcgtttcgggtgctgaggctgtactgtcgaaattgtag

SEQ ID NO: 10367 - protein, 167 aa, Phaeosphaeria nodorum
MAPLKVGDSLPEGVKFEYAPITDSDPTACGRPQEYDASKEWANKKVVLFSVPGAFTPGCQAFHLPPYIKNRKAFTDKGVDIVATIASNDSWVMNAWGKVNGVKGDEVLFLSDTKTFFSKNYGWDAGMGDRNGRWAMVFDNGKVIYAENEKSPGEVSVSGAEAVLSKL

SEQ ID NO: 10368 - DNA, 770 bp, Aspergillus oryzae
  CDS (104)..(610)
gcattatggcggggaccacatcacataaataaacacctttttccatccacaaccaactattcttttcactcccaacccaacctaacataccaattcaatcaaaatgtctggaatcaaggccggtgacagcttcccctccgacgttgtcttctcatacatcccctacaccgaggaggctgacaagttcaacgtttgcggtatccccatcaactacaacgcctccaaggagtgggccgacaagaaggttatcctcttcgctcttcccggtgccttcactcccgtctgctctgcaaaccacgtccccgagtacaaggagaagctccctgagatccgtgagaagggtgtcgacgttgttgctgtccttgcttacaacgatgcctacgtcatgagcgcctgggccaaggccaacggtgtcaagaacgacgacattctcttcctttccgaccccgatgctaagttctccaagagcctcggctgggccgatgaggagggccgcaccaagcgctacgccatcgtcattgaccacggcaaggtcacctacgctgctcttgagcccgccaagaaccacctcgagttctcgcgcgctgagaccgtcatcaagcacctgtaaatacgtcaacaggaagaaggactatgacatgggaccaatagaggatgctggcactccagcagtggggataatgttttagaattagacagcccactttagagatacaataaataacgaagctatgaaattgtgaacattcttaaaaaaaaaaacaaaaaaa

SEQ ID NO: 10369 - protein, 168 aa, Aspergillus oryzae
MSGIKAGDSFPSDVVFSYIPYTEEADKFNVCGIPINYNASKEWADKKVILFALPGAFTPVCSANHVPEYKEKLPEIREKGVDVVAVLAYNDAYVMSAWAKANGVKNDDILFLSDPDAKFSKSLGWADEEGRTKRYAIVIDHGKVTYAALEPAKNHLEFSRAETVIKHL

SEQ ID NO: 10370 - DNA, 623 bp, Aspergillus oryzae
  CDS (67)..(567)
aattcggcagaggctcactctcacctctcaccactactcagaccatcaccatacccatcagtcaccatggcccttaaacccggagattccttccccgagaacgtcgtcttccagtacgtcccctggaccgaggagaagggcgacatcaccgcctgcggcatccccatcccctacaacgcctccaaagaatgggccgataagaaggtggtcctgttctccgttcctggcgctttcacccccacctgctccgtcaaccacgttcccggatacatccagaacctgccccagctgaaggaaaagggcgtccaggttgtcgctgtcgtcgcatctaatgaccccttcgtcatgagcgcctggggaaaggccaataaggtggaaaataacgatattctgttcctctccgaccccgacgccaagttctcggacagcatcggctgggccaacaacggtcgcaccggtcgctatgccattgtcatcgatcatggcaaggtgacctatgctcagatcgagaccgagaggggtgtggttaaggtctcgggtgccgaggctgtcttggctcacctgtgattattctcggaacctcgttttccgaagtgatgattatctagagtgaagcactttct

SEQ ID NO: 10371 - protein, 166 aa, Aspergillus oryzae
MALKPGDSFPENVVFQYVPWTEEKGDITACGIPIPYNASKEWADKKVVLFSVPGAFTPTCSVNHVPGYIQNLPQLKEKGVQVVAVVASNDPFVMSAWGKANKVENNDILFLSDPDAKFSDSIGWANNGRTGRYAIVIDHGKVTYAQIETERGVVKVSGAEAVLAHL

SEQ ID NO: 10372 - DNA, 549 bp, Aspergillus oryzae
  CDS (1)..(549)
atgttcgctgcccgccgtctcaccgctggtgttccccgcgtcttctcccagagggctttgttccacaacactgctcctgctttcgtccaaaagggcgactccattcccaaccttgatgttctggttgaggactctcccggcaacaaggtcaacctcgccagcgagctgaagggcaagggcgtcattgtcggcgttcccgcagctttcagccctgcctgctccagctcccacgtccccggatatatcaaccaccccaaactcaaggaagccggtcaggtcttcgttgtctcggtcaatgatcctttcgtcatgaaggcgtgggccacctctctcgacccctccggcaagagcggtatccgcttcctgggcgaccccaccggcaagttctccgaggcgctcgatgtcaccttcgatagctcctccatcttcggaaaccaccgcagcaagcgctacgccctgctggtcgagaacggcaaggttaaggaggctttcgtggagcccgacaacaccggtctcgacgtgtccgccgccgagaaggtccttgcttaa

SEQ ID NO: 10373 - protein, 182 aa, Aspergillus oryzae
MFAARRLTAGVPRVFSQRALFHNTAPAFVQKGDSIPNLDVLVEDSPGNKVNLASELKGKGVIVGVPAAFSPACSSSHVPGYINHPKLKEAGQVFVVSVNDPFVMKAWATSLDPSGKSGIRFLGDPTGKFSEALDVTFDSSSIFGNHRSKRYALLVENGKVKEAFVEPDNTGLDVSAAEKVLA

SEQ ID NO: 10374 - DNA, 674 bp, Coccidioides posadasii
  CDS (110)..(610)
gtctgccaacgctcgattcaccaccagcctccctttctcccagcgacagcttccccgcagctatccgacccactgtagacacctaacctcacctcgctactacgcaacaatggcctctctcaaagctggagacagcttcctttctgacgttgtcttctcttacattccatggacacctgacaataaagacatcaaagcgtgtggcatgccacagaactacgaggcttccaagctctgggctgacaagaaggttgtcctcttctctcttcccggtgcctttactcctacctgctccgccagccatctccccggatacatccagaagcttcctcaattgaaggaaaagggcgttgacgtcgttgctgtcctcgcattcaacgatgcctgggtcatgagcgcctggggcaaggccaatggcgttaccggagatgatatcctcttcctcagcgacccggaagctaagttctcaaagagcattggctggaacgccggcgagcgaactggccgatatgctatgattatcgatcatggccaggttacttatgctgaaatagagcctggtcgtgaagttaccgtctcgggcgctgacgccgtcatttccaagttgtaaatgatgaacaaaccgatgagaaacccgaaaaatattatcttatggagaatcaagggaaacggcc

SEQ ID NO: 10375 - protein, 166 aa, Coccidioides posadasii
MASLKAGDSFLSDVVFSYIPWTPDNKDIKACGMPQNYEASKLWADKKVVLFSLPGAFTPTCSASHLPGYIQKLPQLKEKGVDVVAVLAFNDAWVMSAWGKANGVTGDDILFLSDPEAKFSKSIGWNAGERTGRYAMIIDHGQVTYAEIEPGREVTVSGADAVISKL

SEQ ID NO: 10376 - DNA, 600 bp, Pisum sativum
  CDS (1)..(600)
atggcaacctctgtaatcaaccgacttcgttcttcctcaaccacaaaatcactgtcttccgttcttcatggaatcaggtcttacgcaaaggttgcaactggaactgatatactctctgctgcatccaatgtttctctacagaaagctcgcacttgggatgaaggtgttgaatccaaattctccactacccctgtcaacgacatcttcaaggataaaaaagttgtgatctttggtctcccaggtgcatatacaggagtttgttcaagcaaacatgttcctccttataagcataatattgacaagtttaaagctaaaggggttgattctgttatttgtgtggctattaatgatccatatactgtgaatgcttgggctgagaagattcaagccaaagatgctattgagttctatggggactttgatgggagctttcacaaaagcttggaattaactactgatctctctgctggtttgcttggaattcgatcggaaagatggtcagcatatgtggtagatggaaaagtgaaggctcttaatgttgaagaatctccatctgatgtcaaagtttctggagcagagaccattttgggacaaatttga

SEQ ID NO: 10377 - protein, 199 aa, Pisum sativum
MATSVINRLRSSSTTKSLSSVLHGIRSYAKVATGTDILSAASNVSLQKARTWDEGVESKFSTTPVNDIFKDKKVVIFGLPGAYTGVCSSKHVPPYKHNIDKFKAKGVDSVICVAINDPYTVNAWAEKIQAKDAIEFYGDFDGSFHKSLELTTDLSAGLLGIRSERWSAYVVDGKVKALNVEESPSDVKVSGAETILGQI

SEQ ID NO: 10378 - DNA, 501 bp, Neurospora crassa
  CDS (1)..(501)
atgtctgctcttaaggccggtgactctttccccgaaggtgttactttcacctacgtcgcgcccagcggtgacacagaccttaccgtctgcggtcttcccatccagtatgatgccagcaaagcgttcgcgaacaagaaggtcgtcctcgtcgccgtccccggtgccttcacccccacctgccagcagcagcacgtcccctcgtatctggccaagctcgaggagttcaagtccaagggcgtcgaccaaatcatcttcattgccagcaacgatgcgtgggtgatggccgcttggggcaaggccaacggtgttaaagatgagtctattctctttatgtccgatgccgactgcaagttcagcaagagcatcggctggacccagggtgaccgcaccaagcgctatgctattgtcatcgaccacggcaaggttacctacgccgagttggatgaggtgcctaagagcatcgccaacactggtgccgacggtgtcctggctaagctctaa

SEQ ID NO: 10379 - protein, 166 aa, Neurospora crassa
MSALKAGDSFPEGVTFTYVAPSGDTDLTVCGLPIQYDASKAFANKKVVLVAVPGAFTPTCQQQHVPSYLAKLEEFKSKGVDQIIFIASNDAWVMAAWGKANGVKDESILFMSDADCKFSKSIGWTQGDRTKRYAIVIDHGKVTYAELDEVPKSIANTGADGVLAKL

SEQ ID NO: 10380 - DNA, 747 bp, Chaetomium globosum
  CDS (79)..(579)
attccaacttgtcacttcaatcaatgtcaattaacagccatactagcagcccacacctcaatccatcactcactcaaaatggccaccctccagtccggctcctctttccccgagggcgtctccttcagctacatcccccccacgggtgatctcgacctaacagtctgcggcatcccgaccacgtacgacgccagcaaggaattccaaaccaaaaaagtggtcctcgtcgccgtccccggcgccttcacgcccacatgccaggagcagcacatcgtgtcctacctgtcgcacctcgccgagctcaaggccaagggcgtcgacaaggtgatcttcatcgcgtccaacgacgccttcgtcatgtcggcgtggggcaaggcgaacgggatcaaggatgagtcgattctcttcatgtcggacgccggcgcggcgttcagcaggagcattggttgggctagtgccgaccggaccgggcggtatgccgttgtcgtggaccacggcaaggttacctacgccgaggccgacactacgagggggagcatcgagcactctggcgcggggggagtcttggcgaagctttaagtgcaatttgccagtgtgaagtcttggggaagaggtcatagattggcttggtaggtggtttcggagtcggggtaggtagataaaccgcactcgctccatcatacattcatagaggaagaagctcatccctgctcagaaaaaaaaaaaaaaaaaaaaaaaaaaaaaaaa

SEQ ID NO: 10381 - protein, 166 aa, Chaetomium globosum
MATLQSGSSFPEGVSFSYIPPTGDLDLTVCGIPTTYDASKEFQTKKVVLVAVPGAFTPTCQEQHIVSYLSHLAELKAKGVDKVIFIASNDAFVMSAWGKANGIKDESILFMSDAGAAFSRSIGWASADRTGRYAVVVDHGKVTYAEADTTRGSIEHSGAGGVLAKL

SEQ ID NO: 10382 - DNA, 847 bp, Paracoccidioides brasiliensis
  CDS (111)..(611)
ggcacgaggccggagtctgccgggtaaagtatctaatagttacctagtgcagcaatccgtcaagaatacagccgtgcttggaacaattcactcgaatcaactgattcgcaatggctcctctcagggctggggacagtttccctgccgatgtcaaattctcatacgttccgtggaccgaagagaagggagagatcaccgcctgtggcctaccgcagccatatgatgcttccaaggaatgggcagataagaaagtggttctattctctgttccaggcgcattcacacccagctgctccatcagccatcttcccggatacatcaagcacctgaataacttcaaggccaacggtgtcgacatcgtcgctgtcattgcatataacgacccgttcgtcatgagcgcgtgggggaaggccaataatgtcaaaggagatgacattctcttcctgagcgatacggacactgcgttctccaagagcattggctggactatgggcgagcgaactgctcgatatgctatcatcattgaccacggtacggtgacctatgctgagaaagagcctgcgaagggagttacggtttcgagtgccgaaactgtactgtccaagctatagaaattagactacgggactctttcgcttttcgacagattgagagaagtgtgggaaacttgagttacctcagtcatggacggcgctcgacaggatggttatatccgacatgctcatttaagatgaaaaaaaacccgaaaaaccaaacaaaactgtagcaaggccgcaaaaatcaagtgtctaataatagaagtcaaatgaactgcttgtcctggccaaaaaaaaaaaaaaaaaaaaaa

SEQ ID NO: 10383 - protein, 166 aa, Paracoccidioides brasiliensis
MAPLRAGDSFPADVKFSYVPWTEEKGEITACGLPQPYDASKEWADKKVVLFSVPGAFTPSCSISHLPGYIKHLNNFKANGVDIVAVIAYNDPFVMSAWGKANNVKGDDILFLSDTDTAFSKSIGWTMGERTARYAIIIDHGTVTYAEKEPAKGVTVSSAETVLSKL

SEQ ID NO: 10384 - DNA, 762 bp, Actinobacillus actinomycetemcomitans
  CDS (1)..(762): transl_table=11
atgtgttctgcaaattttaataggagaaaaatcatgtctaatatggaaggtaaaaaagttcctcaagtgacattccgtacgcgtcaaggcgaccaatggattgatgtcactacatccgaattatttgataataaaaccgttatcgttttctctttaccgggtgcattcaccccgacttgttcttcttcccatttaccacgttataacgaattagcgccggtattcaaaaaatacggtgttgatgatattcttgtgatttccgtgaatgatacattcgtgatgaatgcatggaaagaagatgaaaaatccgacaacattactttcattcctgacggtaatggcgagttcaccgaaggcatgggcatgttggtagggaaagaagatttaggttttggcaaacgttcatggcgttattctatgctggtgaaaaatggcgtagtagaaaaaatgtttatcgaaccaaacgaaccgggtgatccgtttaaagtgtccgatgccgataccatgttgaagtatcttgcaccgcaacaccaagttcaagaatctattacgatcttcactaaaccgggttgtccattctgtgcaaaagcaaaacaaatgttacacgaaaaaggcttgagctttgaggaaatcgtgttaggtcacgatgcgactatcgtgagcgtacgtgcggtttccggtcgtgcgactgtgccgcaagtattcatcggtggtaaacacatcggtggtagtgatgatttagaagcgtattttgcgaaataa

SEQ ID NO: 10385 - protein, 253 aa, Actinobacillus actinomycetemcomitans
MCSANFNRRKIMSNMEGKKVPQVTFRTRQGDQWIDVTTSELFDNKTVIVFSLPGAFTPTCSSSHLPRYNELAPVFKKYGVDDILVISVNDTFVMNAWKEDEKSDNITFIPDGNGEFTEGMGMLVGKEDLGFGKRSWRYSMLVKNGVVEKMFIEPNEPGDPFKVSDADTMLKYLAPQHQVQESITIFTKPGCPFCAKAKQMLHEKGLSFEEIVLGHDATIVSVRAVSGRATVPQVFIGGKHIGGSDDLEAYFAK

SEQ ID NO: 10386 - DNA, 725 bp, Solanum lycopersicum
  CDS (74)..(562)
ttcaccttcgcaggaagctcaacacaaatctgtcatcactgtgcaatctcgtgtcaacctaagtagcagaaaaatggctccaatcgccgttggtgacgtcatccccgatggtaccgtatcttacttcgacgagcaagatcagatgcagaccgtctcagtatactcacttgctaagggcaagaaggtcatcatcttcgccgttcccggagctttcactcccacttgcagcatgaagcatgtgcctggctttattgaaaaggctgctgagttgaagtcaaagggtgtcgatgaaatcctctgcatcagtgtcaatgacccctttgtgatgaaggcctgggcaaaaacttaccctgagaacaaacatgtaaaatttcttgctgatggagctggaaaatacacccatgcccttgggctggagcttgatctgtcggataaggggcttggtgttcgatcacgaaggtatgctcttttggttgatgaccttgaggtgaaagtagctaacattgaatctggaggggagttcacggtctccggtgctgatgaaatcgtcaatgctctttaagcttatcactactgcctcccaagtgttctggctctacaatgagcttctagaatctatgccaataatgtttttgatatatctgtagtcgctaatatcaaactttgtatgaagaatgctttgtggaaataagaatttcttgctttaaaaaaaaaaaaaaaaaaaa

SEQ ID NO: 10387 - protein, 162 aa, Solanum lycopersicum
MAPIAVGDVIPDGTVSYFDEQDQMQTVSVYSLAKGKKVIIFAVPGAFTPTCSMKHVPGFIEKAAELKSKGVDEILCISVNDPFVMKAWAKTYPENKHVKFLADGAGKYTHALGLELDLSDKGLGVRSRRYALLVDDLEVKVANIESGGEFTVSGADEIVNAL

SEQ ID NO: 10388 - DNA, 549 bp, Rhizobium loti
  CDS (1)..(549): transl_table=11
atgacggtcaaaaaaaaggttccttttgtcacctttcgcacgcgtgttcgcgatgagtccatcgaggggccaaacccgtaccgctgggaagacaagacatccgacgactatttcagcggcaagcgcatcatcctgttctcgctgcccggtgccttcaccccgacctgctcgaccttgcagttgcccgatttcgaaatgctctacgacgagttcgagaaggagggaattgacgcgatctactgcgtttccgtcaacgatgcgttcgtcatgaatgcgtggggcaaggccctggggctgaagaaagtccagctcataccagacggctcgggcgaattcacccgcaagatgggcatgctggttgccaaggacaatctcggcttcggcatgcgctcctggcgctacgctgccgtgatcaacaatggcgtagtggagcagtgcttcgaggagaacggtttctgcgacaacagcgaggccgacccctatggcgtatcgtcgccgcagaacgtccttgaaacgctgagagccgccaaagccgtgacggctgcatga

SEQ ID NO: 10389 - protein, 182 aa, Rhizobium loti
MTVKKKVPFVTFRTRVRDESIEGPNPYRWEDKTSDDYFSGKRIILFSLPGAFTPTCSTLQLPDFEMLYDEFEKEGIDAIYCVSVNDAFVMNAWGKALGLKKVQLIPDGSGEFTRKMGMLVAKDNLGFGMRSWRYAAVINNGVVEQCFEENGFCDNSEADPYGVSSPQNVLETLRAAKAVTAA

SEQ ID NO: 10390 - DNA, 727 bp, Arabidopsis thaliana
  CDS (54)..(542)
aagtccaaacactttcatttgtctcctttcgtcaactccacagagatctcctcatggctccaattgctgtcggcgatgtcgttccagacggaaccatttccttcttcgatgagaatgatcaacttcagactgtctccgttcactctctcgccgccggtaaaaaagtcatcctctttggtgttcctggtgctttcactcccacctgcagcatgaagcatgttcctggtttcattgagaaagcagaggagctgaagtcaaagggtgttgatgacatcatttgctttagtgtgaacgatccttttttgatgaaagcatggggaaagacatacccagagaacaagcatgtgaagtttgtagctgatgggtctggagaatacacacaccttcttggacttgagcttgaccttaaggacaagggtcttggtattaggtcaaggagattcgctttgttgcttgataaccttaaggtgactgtagccaatctcgaatctggtggcgggttcacagtttccagcgccgatgatatcctcgaggctctctaagaaacgtaccacttgtgttgtctatgtaaaccgctgtatgtgaagtagaggattctatagcctgttctcagacattaagcaaggttgtaataaagcggtgtcattgtgacttgtttggcataacaaagtatttgcttttggtgtttttgtgcgttgattaatgaaagatgtgactcattgacgtg

SEQ ID NO: 10391 - protein, 162 aa, Arabidopsis thaliana
MAPIAVGDVVPDGTISFFDENDQLQTVSVHSLAAGKKVILFGVPGAFTPTCSMKHVPGFIEKAEELKSKGVDDIICFSVNDPFLMKAWGKTYPENKHVKFVADGSGEYTHLLGLELDLKDKGLGIRSRRFALLLDNLKVTVANLESGGGFTVSSADDILEAL

SEQ ID NO: 10392 - DNA, 723 bp, Capsicum annuum
  CDS (52)..(540)
gcacgaggttccttttcccattttctgaatatccagcaacttactccaaaaatggctccgatcgccgttggtgacgtcatccccgatggtaccgtgtcttacttcgacgagcaagatcagcttcagagcgtgtccgtacactcacttgctaagggcaaaaaggtaattatgttcgccgttcctggagctttcactccgacatgcagcacgaagcatgtccctgggttcattgaaaaggctgacttgctgaaatcaaagggcgttgaagaaatcctctgtgttagcgtcaatgatccttttgtcatgaaggcatgggcgaaaaccttccctgagaacaaacatgtgaagttccttgctgatggagctggaaaatatacacatgctcttggtctggagctggatctgtcggaaaagggacttggtgttcgatccagaagatatgcccttttggttgatgaccttaaggtgaaagtagctaatgttgaatctggaggggagtttaccgtctctggtgctgatgaaatactcaaggctctttaagtttattattgctaagtggagtgttttgaattgagctgagcttctgaaatgtatataccaataatgttttcttgatatatgtcatgtactagctcgcttctgttgcatcgtagaatgctttgtggaattttctctttgactttcaatttggagtttctttaatatcaaaaaaaaaaaaaaaaa

SEQ ID NO: 10393 - protein, 162 aa, Capsicum annuum
MAPIAVGDVIPDGTVSYFDEQDQLQSVSVHSLAKGKKVIMFAVPGAFTPTCSTKHVPGFIEKADLLKSKGVEEILCVSVNDPFVMKAWAKTFPENKHVKFLADGAGKYTHALGLELDLSEKGLGVRSRRYALLVDDLKVKVANVESGGEFTVSGADEILKAL

SEQ ID NO: 10394 - DNA, 504 bp, Candida boidinii
  CDS (1)..(504)
atggcgccaattaaaaggggtgatcgtttcccaaccactgacgatgtttattatattccacctgaaggtggtgaaccaggagcatttgaattgagtaaatttgtcaagactaagaaatttgttgttgtttcagttccaggtgcatttacaccaccatgtactgaacaacatttaccaggatatattaagaatcttccaagaattttatccaagggagttgattttgtcttagttattactcaaaatgatccatttgttttaaaaggttggaaaaaagagcttggtgcagctgatgctaggaaattaatctttgttagtgatccaaatttaaaattaactaagaaactaggatctactattgatttatcttctattggtttaggtactagatcaggaagattagcattgattgtcaatagaagcggtattgttgaatacgcagctattgaaaacggtggtgaagttgatgtttctactgctcaaaagattattgctaaattatag

SEQ ID NO: 10395 - protein, 167 aa, Candida boidinii
MAPIKRGDRFPTTDDVYYIPPEGGEPGAFELSKFVKTKKFVVVSVPGAFTPPCTEQHLPGYIKNLPRILSKGVDFVLVITQNDPFVLKGWKKELGAADARKLIFVSDPNLKLTKKLGSTIDLSSIGLGTRSGRLALIVNRSGIVEYAAIENGGEVDVSTAQKIIAKL

SEQ ID NO: 10396 - DNA, 489 bp, Brassica rapa subsp
  CDS (1)..(489)
atggctccgattgctgttggcgatgttgtacctgacggatctatctccttcttcgacgagaacgatcagctccagactgtctccgttcactccctcgccgccggtaagaaggtcatcctcttcggtgtccctggtgctttcacccccacctgcagcatgaagcatgtgcctggattcatcgagaaagcagaggagctgaagtcaaagggtgttgacgagatcatttgctttagtgtgaatgatccgtttgtaatgaaggcatgggggaagacgtacccagagaacaagcatgtgaagtttgtggcagacggttcaggagaatacacgaagcttcttggactcgagcttgacctcaaggacaagggtcttggtgttaggtcaaggagatttgctctgttgattgataacctcaaggtcactgttgcaaacgttgaatctggcggcgagttcacagtttccagcgccgatgatatcctcaaggctctctaa

SEQ ID NO: 10397 - protein, 162 aa, Brassica rapa subsp
MAPIAVGDVVPDGSISFFDENDQLQTVSVHSLAAGKKVILFGVPGAFTPTCSMKHVPGFIEKAEELKSKGVDEIICFSVNDPFVMKAWGKTYPENKHVKFVADGSGEYTKLLGLELDLKDKGLGVRSRRFALLIDNLKVTVANVESGGEFTVSSADDILKAL

SEQ ID NO: 10398 - DNA, 504 bp, Penicillium citrinum
  CDS (1)..(504)
atgtctcttaaggccggcgacagcttccccgagggtgttaccttctcctacatcccctgggctgaggatgctagcgagatcacctcttgtggtatccccatcaactacaacgcctccaaggagttcgccaacaagaaggtcgttctcttcgctctgcccggtgctttcacccccgtctgctccgccaaccacgtccccgagtacatccagaagctccctgagctccgcgccaagggtgtcgaccaggtcgccgttctggcctacaacgatgcctacgtcatgagcgcctggggtaaggccaacggtgtcaccggcgacgacattctcttcctgtctgaccccgaggctaagttctccaagtccatcggctgggctgatgaggagggccgtacctaccgttacgtcctggtcatcgacaacggcaagatcatctacgccgccaaggaggctgctaagaactctctggagctctcccgcgccgaccacgtccttaagcagctgtaa

SEQ ID NO: 10399 - protein, 167 aa, Penicillium citrinum
MSLKAGDSFPEGVTFSYIPWAEDASEITSCGIPINYNASKEFANKKVVLFALPGAFTPVCSANHVPEYIQKLPELRAKGVDQVAVLAYNDAYVMSAWGKANGVTGDDILFLSDPEAKFSKSIGWADEEGRTYRYVLVIDNGKIIYAAKEAAKNSLELSRADHVLKQL

SEQ ID NO: 10400 - DNA, 507 bp, Aspergillus fumigatus
  CDS (1)..(507)
atgtctggactcaaggccggtgacagcttcccctctgacgttgtcttctcttacatcccctggtccgaggacaagggtgagatcactgcttgcggtatccccatcaactacaacgcctccaaggagtgggccgacaagaaggtcattctcttcgctcttcccggtgccttcactcccgtctgctctgctcgccacgttcccgagtacatcgagaagctccccgagatccgtgccaagggtgttgacgttgttgccgtcctcgcctacaacgatgcctatgtcatgagcgcctggggcaaggccaaccaggtcactggggacgacattctcttcctctccgaccccgatgctcgcttctccaagagcattggttgggccgatgaggagggccgcaccaagcgttacgccctcgtcattgaccacggcaagattacctacgccgctctcgagcccgctaagaaccacctcgagttctcgagcgccgagaccgtcctcaagcacctgtaa

SEQ ID NO: 10401 - protein, 168 aa, Aspergillus fumigatus
MSGLKAGDSFPSDVVFSYIPWSEDKGEITACGIPINYNASKEWADKKVILFALPGAFTPVCSARHVPEYIEKLPEIRAKGVDVVAVLAYNDAYVMSAWGKANQVTGDDILFLSDPDARFSKSIGWADEEGRTKRYALVIDHGKITYAALEPAKNHLEFSSAETVLKHL

SEQ ID NO: 10402 - DNA, 471 bp, Schizosaccharomyces pombe
  CDS (1)..(471)
atggttgctgtcggatctactttgcctaaagttactctttgggaaaacaagcccgaagaggttgttgaattcccttctcaaggcaaattcatcattgtcggtgttcccggcgctttcactcctccttgttcttctcaagttcctggctatattgcaaatgagaagcaatttgctgccaagggcatcagcggaatctatgtcgttgccgtaaatgacgttttcgtcaccaaggcttggaagaagtctttcgacggtggtgagcaaagtggtgttcactttgtcgccgactggaacggagagtttaccaaggcctttgatgctggcttcgacgctagcggtcttttgggccctcttcgctccaagcgttatgccgctgttgtcgagaatggcaaggttgtcaaggttttcattgagaacgaggtcaccgatgttgatatttcctccgctgacaaggtccttagctctctttaa

SEQ ID NO: 10403 - protein, 156 aa, Schizosaccharomyces pombe
MVAVGSTLPKVTLWENKPEEVVEFPSQGKFIIVGVPGAFTPPCSSQVPGYIANEKQFAAKGISGIYVVAVNDVFVTKAWKKSFDGGEQSGVHFVADWNGEFTKAFDAGFDASGLLGPLRSKRYAAVVENGKVVKVFIENEVTDVDISSADKVLSSL

SEQ ID NO: 10404 - DNA, 934 bp, Candida boidinii
  CDS (282)..(785)
aatagtctataattatagccacatttaaaggtatattggtacaaaaggaaaagaaaacaaaagaagtaaaagaaactaaacaatattagtaaaattattgaataagtcgttatgtggcgtttttttaatatataattaataatgtagctttaatttttctaaaatttagtataaaaatggatacttttcttctatagttttagtaaaaatgttaaaggaaatgagttttctttttgtaaggtttgcctgatttttatagtataatacagtataataagaaaatggcaccaattaaaagaggtgatcgcttcccaaccactgacgatgtttattatattccaccagaaggcggtgagccaggaccattggaattgagtaaatttgtcaagacaaagaaatttgttgttgtttcagttccaggtgcattcacaccaccatgtactgagcaacatttaccaggatacatcaaaaatcttccaagaattttatccaaaggtgttgattttgtcttagttatcagtcaaaatgatccatttgttttaaaaggctggaaaaaagagcttggtgcagccgatgctaagaaattagtctttgtcagtgatcctaatttgaaattaactaagaaattaggatctactattgatttatcagccattggtttaggtactagatcaggaagattagcattgattgttaacagaagtggtattgttgaatacgcagccattgaaaacggtggtgaagttgacgtatctactgcccaaaagattattgccaaattataattgacttacatctatctgcctaatgatatattatatagcacacattatatatataatatttaactgttcatttttttctattacctattatctgtctatttgccatatcgtatcaattattatttcaaatatatgtttttattgaggtt

SEQ ID NO: 10405 - protein, 167 aa, Candida boidinii
MAPIKRGDRFPTTDDVYYIPPEGGEPGPLELSKFVKTKKFVVVSVPGAFTPPCTEQHLPGYIKNLPRILSKGVDFVLVISQNDPFVLKGWKKELGAADAKKLVFVSDPNLKLTKKLGSTIDLSAIGLGTRSGRLALIVNRSGIVEYAAIENGGEVDVSTAQKIIAKL

SEQ ID NO: 10406 - DNA, 489 bp, Arabidopsis thaliana
  CDS (1)..(489)
atggctccaattgctgtcggcgatgtcgtaccagacggaactatctccttcttcgatgagaatgatcaacttcagaccgcctccgttcactctctcgccgccggtaaaaaagtcattctctttggtgttcctggtgctttcactcccacttgcagcatgaagcatgttcctgggttcattgagaaagcagaggagctgaagtcaaagggtgttgatgagatcatttgctttagcgtgaacgatccgtttgtgatgaaagcatggggaaaaacatacccagagaacaaacatgtgaagtttgtagctgatgggtctggagaatacacacaccttctcggacttgagcttgaccttaaagacaagggtcttggtgttaggtcaaggagatttgctctgttacttgatgatctcaaagtgactgtagccaatgtcgaatctggtggcgaattcacagtttccagcgccgatgatatcctcaaggctctctaa

SEQ ID NO: 10407 - protein, 162 aa, Arabidopsis thaliana
MAPIAVGDVVPDGTISFFDENDQLQTASVHSLAAGKKVILFGVPGAFTPTCSMKHVPGFIEKAEELKSKGVDEIICFSVNDPFVMKAWGKTYPENKHVKFVADGSGEYTHLLGLELDLKDKGLGVRSRRFALLLDDLKVTVANVESGGEFTVSSADDILKAL

SEQ ID NO: 10408 - DNA, 489 bp, Arabidopsis thaliana
  CDS (1)..(489)
atggctccaattactgtcggcgatgttgtaccagacggaactatctctttcttcgatgaaaatgatcagcttcagaccgtctccgttcactctatcgccgccggtaaaaaagtcattctctttggtgttcctggtgctttcactcccacatgcagtatgagccatgtgcctggattcattgggaaagcagaggagctgaagtcaaagggtattgatgagatcatttgctttagtgtgaatgatccatttgtgatgaaggcatggggaaaaacatatccagagaacaagcatgtgaagtttgtagcagatgggtctggagaatacacgcatcttcttggacttgagcttgaccttaaggacaagggtcttggtattaggtcaaggagattcgctttgttgcttgataaccttaaggtgactgtagccaatgttgaatctggtggcgagttcacggtttccagcgcagaggatattctcaaggctctttaa

SEQ ID NO: 10409 - protein, 162 aa, Arabidopsis thaliana
MAPITVGDVVPDGTISFFDENDQLQTVSVHSIAAGKKVILFGVPGAFTPTCSMSHVPGFIGKAEELKSKGIDEIICFSVNDPFVMKAWGKTYPENKHVKFVADGSGEYTHLLGLELDLKDKGLGIRSRRFALLLDNLKVTVANVESGGEFTVSSAEDILKAL

SEQ ID NO: 10410 - DNA, 677 bp, Arabidopsis thaliana
  CDS (54)..(542)
aagtcaaaactcttctattttcccctgtcttcatatccaacagagatctcttcatggctccaattactgtcggcgatgttgtaccagacggaactatctctttcttcgatgaaaatgatcagcttcagaccgtctctgttcactctatcgccgccggtaaaaaagtcattctctttggtgttcctggtgctttcactcccacatgcagcatgagccatgtgcctggattcattgggaaagcagaggagctgaagtcaaagggtatcgatgagatcatttgctttagtgtgaatgatccatttgtgatgaaggcatggggaaagacataccaagagaacaagcatgtgaagtttgtagcagatgggtctggagaatacacacatcttcttggacttgagcttgatctcaaggacaagggtcttggtattaggtcaaggagatttgctctgttgcttgataaccttaaggtaactgtagccaatgtcgaaaatggtggcgagttcacggtttccagcgcagaggatatccttaaggctctctaagaaacattatcattcgcttgttgtattgtgaatctaaaccgctgtatgtgaagaagagaattatatagcctgatttcaatcaacaagcaagtgtattgacttgcttggcataataaagtatttggttttaatgtt

SEQ ID NO: 10411 - protein, 162 aa, Arabidopsis thaliana
MAPITVGDVVPDGTISFFDENDQLQTVSVHSIAAGKKVILFGVPGAFTPTCSMSHVPGFIGKAEELKSKGIDEIICFSVNDPFVMKAWGKTYQENKHVKFVADGSGEYTHLLGLELDLKDKGLGIRSRRFALLLDNLKVTVANVENGGEFTVSSAEDILKAL

SEQ ID NO: 10412 - DNA, 736 bp, Arabidopsis thaliana
  CDS (1)..(705)
atggcgacttctctctccgtttctagattcatgtcctcctccgccaccgttatctccgtcgctaagccgttactttcccccaccgtatccttcaccgcgccgctctccttcacacgctctctcgctcctaatctctctctcaaattccgcaaccgccgcaccaattccgcctccgccaccaccagatccttcgctacgacacccgtcaccgcctccatttccgtcggagacaagctcccagactccactctctcctacctcgatccatccaccggagacgtcaaaacagtaaccgtctcatccctaaccgccgggaagaaaacaatcctattcgccgttcccggcgcattcacaccaacatgctcacaaaaacacgtccctggattcgtatccaaagccggagaactcagatctaaaggcatcgatgtaatcgcatgtatctccgtcaacgacgcgttcgtgatggaagcgtggaggaaagatcttggaattaacgatgaggtaatgttgctatccgatggaaatggcgaattcacagggaagcttggtgttgaattggatttgagggataagcctgtgggacttggagttaggtcaaggagatatgcgattttggctgatgatggtgttgtgaaagttctgaatcttgaagaaggaggtgcttttactaatagtagtgctgaggatatgcttaaagctctctgattcttatgattttctcatcaatttcgtcttc

SEQ ID NO: 10413 - protein, 234 aa, Arabidopsis thaliana
MATSLSVSRFMSSSATVISVAKPLLSPTVSFTAPLSFTRSLAPNLSLKFRNRRTNSASATTRSFATTPVTASISVGDKLPDSTLSYLDPSTGDVKTVTVSSLTAGKKTILFAVPGAFTPTCSQKHVPGFVSKAGELRSKGIDVIACISVNDAFVMEAWRKDLGINDEVMLLSDGNGEFTGKLGVELDLRDKPVGLGVRSRRYAILADDGVVKVLNLEEGGAFTNSSAEDMLKAL

SEQ ID NO: 10414 - DNA, 606 bp, Arabidopsis thaliana
  CDS (1)..(606)
atggcgatgtcaattctaaagctaagaaatttatcggcactaagatcggcggcaaatagtgcccggatcggagtttcatcgaggggtttctcaaagctcgcggaaggcactgacataacctcggcggcgcctggcgtttctctccagaaagctcgcagctgggacgaaggtgtttcctccaaattctccaccacgccattgtcagatatcttcaaggggaagaaagtcgtcatctttggtcttcctggggcttacacgggagtttgttcacagcagcatgtgcctagctacaagagccacattgataagtttaaagccaaaggcattgattctgtcatctgtgtctctgttaatgatccctttgctatcaatggttgggcagagaagcttggtgccaaagatgcaattgagttttatggagattttgatgggaaatttcacaaaagcttggggctagacaaggatctctctgctgcattgctcgggccacggtctgagagatggtcggcttatgtagaagacgggaaggttaaggcggtgaatgtggaagaagcaccgtctgacttcaaggttacaggggcagaagtcatcttaggacagatctaa

SEQ ID NO: 10415 - protein, 201 aa, Arabidopsis thaliana
MAMSILKLRNLSALRSAANSARIGVSSRGFSKLAEGTDITSAAPGVSLQKARSWDEGVSSKFSTTPLSDIFKGKKVVIFGLPGAYTGVCSQQHVPSYKSHIDKFKAKGIDSVICVSVNDPFAINGWAEKLGAKDAIEFYGDFDGKFHKSLGLDKDLSAALLGPRSERWSAYVEDGKVKAVNVEEAPSDFKVTGAEVILGQI

SEQ ID NO: 10416 - DNA, 540 bp, Rhizobium etli
  CDS (1)..(540): transl_table=11
atgaccatggaaaagcaggtccctattgtcacctttcgcacgcgggttcgcgacgagtctatatccggtcccaacccctaccgctgggaagacaagacgaccgacgactatttcagcggtaagcgggtaatccttttttcgctgccgggcgccttcacgccaatctgctccaccttccaactgcctgatttcgaaagtctttatgtcgagtttaagaagaatggcattgacgacatctactgtctctccgtcaacgatgccttcgtcatgaatgcttggggcaagtctcaggggttgaaaaatgtcaagcttatcccggacggttcgggagaattcactcggaaaatgggtatgctcgtcgccaaggacaatctcggtttcggtctgcgctcctggcgctacgctgccgtgatcaataatggcgtcgtggaggggtggttcgaggaagaaggctttggcgacaactgcgcgaccgatccgtatggcgtttcttcgccgcaaaacattttgaaatgccttaaggccccagccttcgtatga

SEQ ID NO: 10417 - protein, 179 aa, Rhizobium etli
MTMEKQVPIVTFRTRVRDESISGPNPYRWEDKTTDDYFSGKRVILFSLPGAFTPICSTFQLPDFESLYVEFKKNGIDDIYCLSVNDAFVMNAWGKSQGLKNVKLIPDGSGEFTRKMGMLVAKDNLGFGLRSWRYAAVINNGVVEGWFEEEGFGDNCATDPYGVSSPQNILKCLKAPAFV

SEQ ID NO: 10418 - DNA, 489 bp, Brassica napus
  CDS (1)..(489)
atggctccgattgctgtcggtagtgttttaccagacggaaaaattttcctctttgacgagaacgatcagctccagacggtcaccgttcactctctcttggctggtaagaaggtcattctctttggtgtccccggtgctttcacttccgcctgcagcttgcagcatgtgcctagtttcattgagaaagcggaccagctgaaagcaaagggtgttaatgagataatctgctatggcatgaatgatccgtatgtgatgaaagcatggggaaagacattcccagagaacaagcatgtcaagtttgtctcagacggctcaggagaatacacaaagctcctcggactggagcttgaccttaaggacaaaggtcttggtattaggacaaggagatttgctatgttgctcgataacctcaaggtgactgtcgccaacattgaaacaggtggcgagttcacggtttctagcgccgaggatatcctcaaggctctctaa

SEQ ID NO: 10419 - protein, 162 aa, Brassica napus
MAPIAVGSVLPDGKIFLFDENDQLQTVTVHSLLAGKKVILFGVPGAFTSACSLQHVPSFIEKADQLKAKGVNEIICYGMNDPYVMKAWGKTFPENKHVKFVSDGSGEYTKLLGLELDLKDKGLGIRTRRFAMLLDNLKVTVANIETGGEFTVSSAEDILKAL

SEQ ID NO: 10420 - DNA, 606 bp, Brassica napus
  CDS (1)..(606)
atggcgatgtctattctgaagctaagaaactcaccggctttgagatccgccgcaagtatcgcccggatcggagtttcatcaagggctttctcaaagctatcggagggcacggacataacctcggcggctccaggcgtttccctccagaaagctcgcagctgggacgaaggcgtttcctccaaattctccaccacaccattgtcagatatcttcaaggggaagaaagtcgtcatctttggacttcctggagcttacacaggagtctgctcacagcagcatgtgccaagctacaagagccacatggataagttcaaagccaaaggcattgactccgtcatctgtgtttctgtcaatgatccgtatactttaaacggttgggcagagaagattggtgccaaagatgctattgagttttatggagattttgatgggaaattccataaaagcttggggctagacaaggatctctctgctgcattgctcggccctcggtctgagagatggtcggcttatgtagaagacggtaaggtgaaggctgtgaacgtggaagaagcaccatctgacttcaaggtgacgggagccgaagtcattttaggacagatctaa

SEQ ID NO: 10421 - protein, 201 aa, Brassica napus
MAMSILKLRNSPALRSAASIARIGVSSRAFSKLSEGTDITSAAPGVSLQKARSWDEGVSSKFSTTPLSDIFKGKKVVIFGLPGAYTGVCSQQHVPSYKSHMDKFKAKGIDSVICVSVNDPYTLNGWAEKIGAKDAIEFYGDFDGKFHKSLGLDKDLSAALLGPRSERWSAYVEDGKVKAVNVEEAPSDFKVTGAEVILGQI

SEQ ID NO: 10422 - DNA, 489 bp, Brassica napus
  CDS (1)..(489)
atggctcctattgctgtcggcgatgttgtaccagaaggaactatctccttctttgatgagaatgatcagcttcagagcgcctccgttcacactctcgccgctggtaagaaggtcattctcttcggtgtccccggtgctttcactcccacatgcagcatgcagcatgtgcctggattcattgagaaagccgaggagctgaaatcaaagggtgttgatgagatcatttgcttcagcgtgaacgatccatttgtgatgaaggcgtggggaaagacataccctgagaacaagcacgtgaagtttgtggcagatggttcaggagaatacacacagcttcttggactcgagcttgacctcaaggacaagggtcttggtgttaggtcaaggagattcgctctgctgctcgataacctcaaggtgactgtggccaatgttgaatccggtggcgagttcacggtttccagcgctgatgatatcctcaaggctctctaa

SEQ ID NO: 10423 - protein, 162 aa, Brassica napus
MAPIAVGDVVPEGTISFFDENDQLQSASVHTLAAGKKVILFGVPGAFTPTCSMQHVPGFIEKAEELKSKGVDEIICFSVNDPFVMKAWGKTYPENKHVKFVADGSGEYTQLLGLELDLKDKGLGVRSRRFALLLDNLKVTVANVESGGEFTVSSADDILKAL

SEQ ID NO: 10424 - DNA, 606 bp, Brassica napus
  CDS (1)..(606)
atggcgatgtctattctgaagctaagaaactcaccggctttgagatccgccgcaagtatcgcccggatcggagttttatcaagggctttctcaaagctctcggagggcacggacataacctcggcggctccaggcgtttccctccagaaagctcgcagctgggacgaaggcgtttcctccaaattctccaccacaccattgtcagatatcttcaaggggaagaaagtcgtcatctttggacttcctggagcttacactggagtctgctcacagcagcatgtgccaagctacaagagccacatggataagttcaaagccaaaggcattgactccatcatctgtgtctctgtcaatgatccgtatactataaatggttgggcagagaagattggtgccaaagatgctattgagttttatggagattttgatgggaaattccataaaagcttggggctagacaaggatctctctgctgcattgctcggccctcggtctgagagatggtcggcttatgtagaagacggtaaggtgaaggctgtgaacgtggaagaagcaccgtctgacttcaaggtgacaggagccgaagttattttaggacagatctaa

SEQ ID NO: 10425 - protein, 201 aa, Brassica napus
MAMSILKLRNSPALRSAASIARIGVLSRAFSKLSEGTDITSAAPGVSLQKARSWDEGVSSKFSTTPLSDIFKGKKVVIFGLPGAYTGVCSQQHVPSYKSHMDKFKAKGIDSIICVSVNDPYTINGWAEKIGAKDAIEFYGDFDGKFHKSLGLDKDLSAALLGPRSERWSAYVEDGKVKAVNVEEAPSDFKVTGAEVILGQI

SEQ ID NO: 10426 - DNA, 582 bp, Zea mays
  CDS (1)..(582)
atggcggcgacgctggcgaggagggcggggcgctccgcggcgacgacgctatggggcgcggcgaggggcttcgcatcggtggggtccgacatcgtctctgcggctcccggcgtgtcgctgcagaaggcgcggtcctgggacgagggcgtcgccaccaagttctctaccacgcctctcaaggacatcttctacgggaagaaggtggtcatcttcggcttgcccggtgcatatacaggggtttgttcacaagcgcacgttcctagttacaagaagaatattgacaagttgaaagcaaaaggaatcgactctgttatctgtgtagctgtgaatgatccgtatgtcctggatggatgggcaaaaaagctagacgctaaagatacaattgagttctatggtgactttgatgggagtttccacaaaagcttggatttggagatagacctttctgctgctttgcttggccgccgttctcacaggtggtccgcctttgttgacgatggtaagatcaagtctttcaatgttgaggaagcaccgtccgactttaaggtttctggtgcggaggtgatcttggaccagatctga

SEQ ID NO: 10427 - protein, 193 aa, Zea mays
MAATLARRAGRSAATTLWGAARGFASVGSDIVSAAPGVSLQKARSWDEGVATKFSTTPLKDIFYGKKVVIFGLPGAYTGVCSQAHVPSYKKNIDKLKAKGIDSVICVAVNDPYVLDGWAKKLDAKDTIEFYGDFDGSFHKSLDLEIDLSAALLGRRSHRWSAFVDDGKIKSFNVEEAPSDFKVSGAEVILDQI

SEQ ID NO: 10428 - DNA, 489 bp, Glycine max
  CDS (1)..(489)
atggctccaattactgtcggcgatgttgtaccagacggaactatctctttcttcgatgaaaatgatcagcttcagaccgtctccgttcactctatcgccgccggtaaaaaagtcattctctttggtgttcctggtgctttcactcccacatgcagtatgagccatgtgcctggattcattgggaaagcagaggagctgaagtcaaagggtattgatgagatcatttgctttagtgtgaatgatccatttgtgatgaaggcatggggaaaaacatatccagagaacaagcatgtgaagtttgtagcagatgggtctggagaatacacgcatcttcttggacttgagcttgaccttaaggacaagggtcttggtattaggtcaaggagattcgctttgttgcttgataaccttaaggtgactgtagccaatgttgaatctggtggcgagttcacggtttccagcgcagaggatattctccaggctctttaa

SEQ ID NO: 10429 - protein, 162 aa, Glycine max
MAPITVGDVVPDGTISFFDENDQLQTVSVHSIAAGKKVILFGVPGAFTPTCSMSHVPGFIGKAEELKSKGIDEIICFSVNDPFVMKAWGKTYPENKHVKFVADGSGEYTHLLGLELDLKDKGLGIRSRRFALLLDNLKVTVANVESGGEFTVSSAEDILQAL

SEQ ID NO: 10430 - DNA, 594 bp, Glycine max
  CDS (1)..(594)
atggcatcggttatggtgaatcgaggtggttccaggatcatcaagtcagtgtctgcagctcttggtacgaggtttttcgcaaaggttgcaactgggactgacatagtctctgccgcacccaatgcttctctccagaaagctcgtacctgggacgagggtcttgcttccaagttctccaccactcctctcaaagacatcttcaaggacaagaaagttgtcatctttgggctcccaggtgcatacacaggagtttgttcaaacaaacatgttcctccttacaaggagaatattgataagtttaaggctaaggggatagattctgttatttgtgtggctattaatgatccatatactatgaatgcgtgggctgagaagcttcaagccaaagatgctattgagttttatggggactttgacgggagctttcacaaaagtttggaattagttactgatctctctggtgcattgcttggaactcgatcagaaagatggtcagcatatgtggtagatggaaaggttaaggctcttaatgttgaagaagctccatctgatgttaaggtttctggcgcagataccattttgggacagatttga

SEQ ID NO: 10431 - protein, 197 aa, Glycine max
MASVMVNRGGSRIIKSVSAALGTRFFAKVATGTDIVSAAPNASLQKARTWDEGLASKFSTTPLKDIFKDKKVVIFGLPGAYTGVCSNKHVPPYKENIDKFKAKGIDSVICVAINDPYTMNAWAEKLQAKDAIEFYGDFDGSFHKSLELVTDLSGALLGTRSERWSAYVVDGKVKALNVEEAPSDVKVSGADTILGQI

SEQ ID NO: 10432 - DNA, 489 bp, Glycine max
  CDS (1)..(489)
atggctccaattgcagtgggaaacgtgattccagacggcattttggcttacttggatgaagaaaacaaaccccaaactgtctccattcactctctcgccaccggcaagaaagtcatcatctttggggttcccggtgccttcactcctacttgcagcttgaagcacgttcctggcttcattgagagagcagaagagctgaaagggaagggtgtggacgaaataatctgtatcagtgtgaatgatccatttgtgatgaactcatgggccaaaacattcccagagaacaagcatgttaagttccttgctgatggtgcagccaaatacaccaatgcccttggtcttgagcttgacctcactgacaagggtctcggcgtccgctcaaagaggtttgctctgctggtggaagacctcaaggtgaaggttgcgaatgttgaaagtggaggagagttcaccatctccagtgctgaagagatcatcaaggccctttaa

SEQ ID NO: 10433 - protein, 162 aa, Glycine max
MAPIAVGNVIPDGILAYLDEENKPQTVSIHSLATGKKVIIFGVPGAFTPTCSLKHVPGFIERAEELKGKGVDEIICISVNDPFVMNSWAKTFPENKHVKFLADGAAKYTNALGLELDLTDKGLGVRSKRFALLVEDLKVKVANVESGGEFTISSAEEIIKAL

SEQ ID NO: 10434 - DNA, 489 bp, Glycine max
  CDS (1)..(489)
atggctccaattgcagtgggagatgtcattccagacggcattttggcttacttggatgaagaaaacaaaccccaaactgtctctattcactctctcgccgccggcaagaaagtcatcatctttggggttcccggtgccttcactcctacatgcagcttgaagcacgtgcctggcttcattgagagagcagaagagctgaaaggaaagggtgtggacgaaataatctgtatcagcgtgaatgatccctttgtgatgaactcatgggccaaaacgttcccagagaacaagcatgttaagttccttgctgatggtgcagccaaatacaccaatgccctcggtcttgagcttgacctcaccgacaagggtctcggcgtccgctcaaagaggtttgctttgctggtggaagacctcaaggtgaaggttgcaaatgttgaaagtggaggagagttcaccatctccagtgctgaagagatcatcaaggccctctaa

SEQ ID NO: 10435 - protein, 162 aa, Glycine max
MAPIAVGDVIPDGILAYLDEENKPQTVSIHSLAAGKKVIIFGVPGAFTPTCSLKHVPGFIERAEELKGKGVDEIICISVNDPFVMNSWAKTFPENKHVKFLADGAAKYTNALGLELDLTDKGLGVRSKRFALLVEDLKVKVANVESGGEFTISSAEEIIKAL

SEQ ID NO: 10436 - DNA, 594 bp, Glycine max
  CDS (1)..(594)
atggcatccgctatggtgaatcgaggtggttctaggatcatcaaatcagtgtctgcagctcttggtacgaggttttacgccaaggttgcaacagggactgacatagtctctgccgcacccaatgtttctctccagaaagctcgtacctgggacgagggcctggcttccaagttctccaccactcctctcaaagacatcttcaaggacaagaaagttgtcatctttgggctcccgggtgcatacacgggagtttgttcaaacaaacacgttcctccttacaaggagaatattgataagtttaaggctaaggggatagattctgttatttgtgtggctattaatgatccgtacactatgaatgcgtgggctgagaagcttcaagccaaagatgctattgagttttatggggactttgatgggagctttcacaaaagtttggaattagttactgatctctctggtgcattgcttggaactcgatctgaaagatggtcagcatatgtggtagatggaaaggttaaggctcttaatgttgaagaagctccatctgatgttaaagtttctggtgcagataccattttgggacagatttga

SEQ ID NO: 10437 - protein, 197 aa, Glycine max
MASAMVNRGGSRIIKSVSAALGTRFYAKVATGTDIVSAAPNVSLQKARTWDEGLASKFSTTPLKDIFKDKKVVIFGLPGAYTGVCSNKHVPPYKENIDKFKAKGIDSVICVAINDPYTMNAWAEKLQAKDAIEFYGDFDGSFHKSLELVTDLSGALLGTRSERWSAYVVDGKVKALNVEEAPSDVKVSGADTILGQI

SEQ ID NO: 10438 - DNA, 702 bp, Zea mays
  CDS (1)..(702)
atggctacctccgccctcgctgctctgtccgccaccgcggccgccgccggtaagcgcatcctcctgtcgcgccccgcctcctcctcctccctctccttcgcctcccgccgcctggccgccggggcacccctccgggggttccttggcgcgccaatccgggccgtggcgtcgtcggcgtcggcggcccccgcggcggcggccaagaccatcgcggtcggggaccggctccctgacgcgacgctctcctacttcgacacgtcctcccccgacggcgagctgaagacggtgacggtccgcgacctcaccgcggggaagaaggtggtgctcttcgccgtgcccggcgcgttcacgcccacctgcacccagaagcacctcccggggttcgtggccaaggccggggagctccgcgccaagggcgtcgacaccgtggcctgcgtctccgtcaacgacgccttcgtgatgcgcgcgtggaaggagagtctggggatcggggacgaggtgctgctcctgtcggacggcaacggcgagctggcgcgcgccatgggcgtcgagctcgacctctccgacaagcccgtggggctcggcgtccggtcccgccgctacgcgctgctcgcggaggacggcgtggtcaaggtgatcaacctcgaggagggcggcgcgttcaccaacagcagcgccgaggacatgctcaacgcgctctga

SEQ ID NO: 10439 - protein, 233 aa, Zea mays
MATSALAALSATAAAAGKRILLSRPASSSSLSFASRRLAAGAPLRGFLGAPIRAVASSASAAPAAAAKTIAVGDRLPDATLSYFDTSSPDGELKTVTVRDLTAGKKVVLFAVPGAFTPTCTQKHLPGFVAKAGELRAKGVDTVACVSVNDAFVMRAWKESLGIGDEVLLLSDGNGELARAMGVELDLSDKPVGLGVRSRRYALLAEDGVVKVINLEEGGAFTNSSAEDMLNAL

SEQ ID NO: 10440 - DNA, 489 bp, Zea mays
  CDS (1)..(489)
atggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttag

SEQ ID NO: 10441 - protein, 162 aa, Zea mays
MAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKAL

SEQ ID NO: 10442 - DNA, 504 bp, Zea mays
  CDS (1)..(504)
atgactgagctcaaggccggcgacaacttccctgagggtgtcttcttcagctacatccctcccacccctgagatctccaagttctctacttgcggtactcccgttccctacaacgccagccaggagttcaaggacaagaaggtcgtcctcgtctccatccccggtgctttcacccccacctgctccggctcccacattccttcctacaccgagcacatcgacaagatcaaggccaagggtgttgaccaggtcatcgttgttgctttcaacgatgcctttgtcatgaacggctgggccaaggccaacggcgtcaccgacgacagcattctcttcatgtccgacaaggatgccaagttctcccgcagcattggctggaacttcgatgagcgaactggccgcttcgccatcatcattgaccacggcaaggtcacctacgcctccaaggacgaccacccccagagcattgagacctccggtgctctcggtgtcctggcccagctgtaa

SEQ ID NO: 10443 - protein, 167 aa, Zea mays
MTELKAGDNFPEGVFFSYIPPTPEISKFSTCGTPVPYNASQEFKDKKVVLVSIPGAFTPTCSGSHIPSYTEHIDKIKAKGVDQVIVVAFNDAFVMNGWAKANGVTDDSILFMSDKDAKFSRSIGWNFDERTGRFAIIIDHGKVTYASKDDHPQSIETSGALGVLAQL

SEQ ID NO: 10444 - DNA, 27 bp, Artificial sequence
  primer
atgtctgacttagttaacaagaaattc

SEQ ID NO: 10445 - DNA, 24 bp, Artificial sequence
  primer
ctacaaatgagccaagacactttc

SEQ ID NO: 10446 - protein, 183 aa, Artificial sequence
  consensus sequence
  Variant (2)..(4): Xaa in position 2 to 4 is any amino acid
  Variant (6)..(24): Xaa in position 6 to 24 is any amino acid
  Variant (25)..(40): Xaa in position 25 to 40 is any or no amino acid
  Variant (42)..(42): Xaa in position 42 is any amino acid
  Variant (43)..(44): Xaa in position 43 to 44 is any or no amino acid
  Variant (46)..(47): Xaa in position 46 to 47 is any amino acid
  Variant (49)..(49): Xaa in position 49 is any amino acid
  Variant (50)..(50): Xaa in position 50 is any or no amino acid
  Variant (57)..(57): Xaa in position 57 is any amino acid
  Variant (60)..(60): Xaa in position 60 is any amino acid
  Variant (61)..(61): Xaa in position 61 is any or no amino acid
  Variant (63)..(63): Xaa in position 63 is any amino acid
  Variant (65)..(76): Xaa in position 65 to 76 is any amino acid
  Variant (77)..(77): Xaa in position 77 is any or no amino acid
  Variant (79)..(79): Xaa in position 79 is any amino acid
  Variant (81)..(87): Xaa in position 81 to 87 is any amino acid
  Variant (90)..(90): Xaa in position 90 is any amino acid
  Variant (94)..(94): Xaa in position 94 is any amino acid
  Variant (97)..(109): Xaa in position 97 to 109 is any amino acid
  Variant (110)..(117): Xaa in position 110 to 117 is any or no amino acid
  Variant (119)..(127): Xaa in position 119 to 127 is any amino acid
  Variant (129)..(133): Xaa in position 129 to 133 is any amino acid
  Variant (134)..(142): Xaa in position 134 to 142 is any or no amino acid
  Variant (144)..(145): Xaa in position 144 to 145 is any amino acid
  Variant (147)..(159): Xaa in position 147 to 159 is any amino acid
  Variant (160)..(161): Xaa in position 160 to 161 is any or no amino acid
  Variant (163)..(168): Xaa in position 163 to 168 is any amino acid
  Variant (169)..(176): Xaa in position 169 to 176 is any or no amino acid
  Variant (178)..(178): Xaa in position 178 is any amino acid
  Variant (180)..(182): Xaa in position 180 to 182 is any amino acid
GXXXPXXXXXXXXXXXXXXXXXXXXXXXXXXXXXXXXXXXKXXXVXXFXXPGAFTPXCSXXHXPXXXXXXXXXXXXXGXDXXXXXXXNDXFVMXAWXXXXXXXXXXXXXXXXXXXXXDXXXXXXXXXGXXXXXXXXXXXXXXRXXRXXXXXXXXXXXXXXXEXXXXXXXXXXXXXXSXAXXXL

SEQ ID NO: 10447 - DNA, 411 bp, Saccharomyces cerevisiae
  CDS (1)..(411)
atgggagaaattttagaactaactaataagaatttcatgagccacttgaaaaaggacataacttcgcaagaatccttgaaaagtagaattgaggataaaaatggtgatgtcgctagcccgaaagaggataactatcctctattgaatgaaacagcggcatggccagatggggtgattacctctgaagaaggatgttcatcttcaggtgagaaagagaattcaggcttatgttcagaagaaagttcagaagaagatccagaagaagctgaagaggaatctgcaagggcttttggagagttagttgcagtcttgcgggacaaagacataccactgaatgtattggacgaacctcagatgaaagattggcttgaaaaatacaccggtgtttatagaagctcttggcatggttga

SEQ ID NO: 10448 - protein, 136 aa, Saccharomyces cerevisiae
MGEILELTNKNFMSHLKKDITSQESLKSRIEDKNGDVASPKEDNYPLLNETAAWPDGVITSEEGCSSSGEKENSGLCSEESSEEDPEEAEEESARAFGELVAVLRDKDIPLNVLDEPQMKDWLEKYTGVYRSSWHG

SEQ ID NO: 10449 - DNA, 27 bp, Artificial sequence
  primer
atgggagaaattttagaactaactaat

SEQ ID NO: 10450 - DNA, 25 bp, Artificial sequence
  primer
tcaaccatgccaagagcttctataa

SEQ ID NO: 10451 - DNA, 2562 bp, Saccharomyces cerevisiae
  CDS (1)..(2562)
atgtcatttcagattaccccaactcgagatttgaaagttattacagatgagttacaaacactttcctcatacatctttcacacaaacatagtcgatgatttgaactctttacttacatggatgagccctaatgatgccaagagtaaccatcaactacgtcctccaagccttcgtattaagaatatcattaaggttctcttccctaataacgcaaccacatcgccatatagcatgataaacactagtcaggcaaacaattcaatagttaatgagggaaatacaaacaaagagttacaactacaacttttttccacgctcaaagagttttatattttccaggttcgttatcattttttcttacattttaacaacattaattatctaaaagatatccaacgatgggaaaattattacgagtttcctttacgttacgttcctatttttgacgtaaatgtaaacgactgggcacttgaacttaattctttaagacattatctgttgaatagaaatataaagttcaaaaataatttaagaacaagattagacaaattaataatggatgatgatttcgacctggcagacaatttaatccaatggctcaaatctgctaatggttccttatcctctacggaattgatagtcaatgctctttacagcaaaatcaataaattttgtgaagataacatgagtagagtatggaataaaaggtttatgattatggaaacattcaacaaatttattaatcaatattggtctcagttctctaaattagtcggttgtccagaggatgatcacgaactgaccactacagttttcaactgttttgagtccaattttcttaggataagaacgaatgaaatctttgatatatgcgttttggcttatcctgattcaaaggttactttattggaattgaggaaaattatgaaagattttaaagactacacaaatattgtaacaacttttttgtctgatttcaagaaatacattctaaaccccagcgtaactacggtggacgctttgttgagatatgttaaaactatcaaagcatttttggtcctggatccaacagggagatgcctacattcaataaccacgtttgttaaaccttactttcaggagcggaagcacttagtaaatgtattgttatacgcaatgttggacttacctgaagaagaactaaaggagaaaattaatttcaatgtagatatgaaggcactgctctcacttgtagacactttgcacgattctgatatcaatcaagatacgaacatcaccaaaagggacaagaataaaaaaagcccctttctatggaacctcaaggtgaaaggaaagagggaattgaacaaggacctaccaataagacacgccatgctatacgaacatatactcaattattatatagcttgggtaccagagcctaatgacatgattcccggtaacatcaaatcaagttatattaagacaaatttgtttgaggtgcttttggatctatttgaatcaagagaatttttcatatcagaatttcgaaatctcttaaccgacagattattcactttgaaattttatacgttggatgaaaaatggacccgatgtttgaaattaataagagaaaaaatagtcaaattcacagaaacaagtcattccaattatataacaaacggtatattaggactcctagaaacaacagcccctgcagcagatgcagaccagtcgaatttgaatagcattgatgttatgctttgggatataaaatgtagcgaggagctctgccgtaaaatgcatgaagtagccggactggatcccataatatttccaaaatttatctcactcctctactggaagtacaactgcgatacacaaggttctaatgatcttgcatttcatttaccaatagatttagaaagggagctacagaagtattctgatatatactcacagctgaaacctgggcgcaagttacaactatgcaaagataaaggaaaagtagaaatacaattagctttcaaagatggtaggaaattagtgttagacgtttctttagaacaatgcagcgtaataaatcagtttgattctccaaatgatgagccaatttgtttatcactagagcagctttctgagtcactaaatattgctcctcccaggctaactcatttgttagatttctggattcaaaaaggtgtgcttttaaaagaaaatggaacctattccgttattgaacatagcgagatggattttgatcaagcacaaaagaccgccccaatggagattgagaacagtaactatgaactacataacgattctgagatagaaagaaaatatgaattgacacttcaaagaagtctgccattcatcgaaggaatgctgactaatttaggcgcaatgaaacttcataagatccattcttttttgaaaattaccgtgccaaaagattggggatataaccgaattactcttcaacaattagagggatatttaaacactctggccgatgagggtaggctgaagtacattgccaatggttcatatgaaatagtgaaaaatgggcataaaaactcatga

SEQ ID NO: 10452 - protein, 853 aa, Saccharomyces cerevisiae
MSFQITPTRDLKVITDELQTLSSYIFHTNIVDDLNSLLTWMSPNDAKSNHQLRPPSLRIKNIIKVLFPNNATTSPYSMINTSQANNSIVNEGNTNKELQLQLFSTLKEFYIFQVRYHFFLHFNNINYLKDIQRWENYYEFPLRYVPIFDVNVNDWALELNSLRHYLLNRNIKFKNNLRTRLDKLIMDDDFDLADNLIQWLKSANGSLSSTELIVNALYSKINKFCEDNMSRVWNKRFMIMETFNKFINQYWSQFSKLVGCPEDDHELTTTVFNCFESNFLRIRTNEIFDICVLAYPDSKVTLLELRKIMKDFKDYTNIVTTFLSDFKKYILNPSVTTVDALLRYVKTIKAFLVLDPTGRCLHSITTFVKPYFQERKHLVNVLLYAMLDLPEEELKEKINFNVDMKALLSLVDTLHDSDINQDTNITKRDKNKKSPFLWNLKVKGKRELNKDLPIRHAMLYEHILNYYIAWVPEPNDMIPGNIKSSYIKTNLFEVLLDLFESREFFISEFRNLLTDRLFTLKFYTLDEKWTRCLKLIREKIVKFTETSHSNYITNGILGLLETTAPAADADQSNLNSIDVMLWDIKCSEELCRKMHEVAGLDPIIFPKFISLLYWKYNCDTQGSNDLAFHLPIDLERELQKYSDIYSQLKPGRKLQLCKDKGKVEIQLAFKDGRKLVLDVSLEQCSVINQFDSPNDEPICLSLEQLSESLNIAPPRLTHLLDFWIQKGVLLKENGTYSVIEHSEMDFDQAQKTAPMEIENSNYELHNDSEIERKYELTLQRSLPFIEGMLTNLGAMKLHKIHSFLKITVPKDWGYNRITLQQLEGYLNTLADEGRLKYIANGSYEIVKNGHKNS

SEQ ID NO: 10453 - DNA, 2352 bp, Candida glabrata CBS 138
  CDS (1)..(2352)
atgatattaactggggataccaagactttcaagagggctgttttagagtacggcgtcaacggcaacaagaatagcaatgctgaggagtggaatgtgttgcttcaatggttagatccagctggtaagaagaatcaccaattgaagcccccaaacttgttagttaagacaatgatcgagaaattattgctaggaagtaacgactatcaacttctaagtaacattcaggattactactgttggcaatgcagagtttatttttacaatgagtacaaacgaatagagactctcaatgagttgaaaagaatagagaggcacgttttattccctttaaaatatataccaatttttgaaggtaataatcgagttgaaaatgaagtcaggttgtttgggaactatctattaaaaactaacaagaaggttatgtcaagggcggttgagagactccgaaaccggatgcttgaagatgattttgaactagctacggaaattgtagattactttgattattgccagactgattctactagcattgtattggatataatacttgacaaaattgagcagttttgccaattacactatacaagaaaatggaataaaaggtacctaatcatggagacgtttaatcagttcatatcacaatactgggatcaattgtcaagcttactattttgccaggaggataatcataccattacaaatacactttacaaatactttgagaagcaatttatctccattcgaaccaatgaaatatttgatatatgcataagtaatcctgcaagtgttcaaccgacgttattagagttgagaaaggaaatatccactgtgaacgattttaactgtgtagttgttgaacttttgtcaaagttcaatttaaaggttatcaaccctagtattgttactgctgacgctttgtttctttatattcgtacaatcaagacatttagcattttggatccttcaggtcgatatttgcaaacaatttcctcatatgttaaacctcattttagacagcggaaagatctggtacatttattattattttcaatgcttggtcttgatgaaactgatcaactgaatacaatgcctagccaagtcagtgaggaaaaactaactgcattgacaaacgagttaaaggacacagaaatctgttcatacacagaagaatcagatgatgtggtagatcctatgataggatcgttttccaaagaagaggatagtatggtgctagagcaggtaataaagaggtatatggaatggatcccagaagtgccgacatccttcggtaaaggtatcctttctgatcataaattagacttatttgatattctattagaactactagaatcaaaagagacgcttgttatagagttcaagaaccttttgactaaaaagctactcgatttaagaggctacacattggataaaaagtggagcaaattcctaagcctgctcaaaaaacgttttgacaatagaagcacggaaacgatggatgaagaagacctgaataacatcaataccattgatatcatgctaagagatatttacaagagtaggcaaattgctactgatatgcaacttgatttgcataataccaacgtgaaagtgtacccgaagatcgtttctgcattatactggtcaaataattctgacacacaaagcaaagctggtgactttgagatggatggcgaattggaacatctattggaattatattcgcgcttctattcgcagaaacaaatcggccaaaaattagaactgagaagggataacggttctgtctctttgaacttaagctttttggatgggcggaccgtgcactgtaaagcgtcattgcgtcaatactcggtactcacattgttcaaaagccccaaacatgactctaattttcccaccgagggcctcacaatcagtgaattgtgtgcaagatcagggatgcaatctaagcagatggccgatattctacgatattgggtaagcaaagatgtactgtatttttcggacggtaagtatcgtacattagagttcctaagatggaaaggtgactctacatacgccgctataccagatgtcctggaagagtccgtagtagaacgttcttctcaacacgaggacaagcaagagaaccatgtcgaaagggcattgccctacattaaagacatcctcttgaaccttggtaccctcaagatagacaagcttcacgctttactacaatcagccatgccaaaggactcgcactatagcacggtaaaccagaagcagctgcaagattacctcgacaccctcgtcgaagaaggtgtgctttcctctgcgagcaacgacagttacaagctgcctcagataagatag

SEQ ID NO: 10454 - protein, 783 aa, Candida glabrata CBS 138
MILTGDTKTFKRAVLEYGVNGNKNSNAEEWNVLLQWLDPAGKKNHQLKPPNLLVKTMIEKLLLGSNDYQLLSNIQDYYCWQCRVYFYNEYKRIETLNELKRIERHVLFPLKYIPIFEGNNRVENEVRLFGNYLLKTNKKVMSRAVERLRNRMLEDDFELATEIVDYFDYCQTDSTSIVLDIILDKIEQFCQLHYTRKWNKRYLIMETFNQFISQYWDQLSSLLFCQEDNHTITNTLYKYFEKQFISIRTNEIFDICISNPASVQPTLLELRKEISTVNDFNCVVVELLSKFNLKVINPSIVTADALFLYIRTIKTFSILDPSGRYLQTISSYVKPHFRQRKDLVHLLLFSMLGLDETDQLNTMPSQVSEEKLTALTNELKDTEICSYTEESDDVVDPMIGSFSKEEDSMVLEQVIKRYMEWIPEVPTSFGKGILSDHKLDLFDILLELLESKETLVIEFKNLLTKKLLDLRGYTLDKKWSKFLSLLKKRFDNRSTETMDEEDLNNINTIDIMLRDIYKSRQIATDMQLDLHNTNVKVYPKIVSALYWSNNSDTQSKAGDFEMDGELEHLLELYSRFYSQKQIGQKLELRRDNGSVSLNLSFLDGRTVHCKASLRQYSVLTLFKSPKHDSNFPTEGLTISELCARSGMQSKQMADILRYWVSKDVLYFSDGKYRTLEFLRWKGDSTYAAIPDVLEESVVERSSQHEDKQENHVERALPYIKDILLNLGTLKIDKLHALLQSAMPKDSHYSTVNQKQLQDYLDTLVEEGVLSSASNDSYKLPQIR

SEQ ID NO: 10455 - DNA, 2094 bp, Kluyveromyces lactis NRRL Y-1140
  CDS (1)..(2094)
atgactaagactgatgacgaacttaaattacttcatgagaaaattctacttaacctagcttcgaatttagaagaagaggtagatatggttcttgcgtggctcaatcccacattccaaccacaaataccgacattacgaattaaacaatgtttgaaagttgtgttagagcagagcgatgaaagaacgcggtttctcatcgagcagtactacctcacgcttatacgaacgcatttcttcttacaatttgatgatatagtcaactggaaggatatgatcaagctagagaaactatacatatctaaggtcgaattcatgtttggaacgtcagtatactggataaaggaggagatgatttcattcaaacggttgttgatgaaaaagaataatgaattcaggaaacaattgcatgcgaaattagagtcacatattctcgataatgatctagttaggtttgatcaaatgtatcaatggttggcaccggcatttgatggacaagagattgagttcaatgttaggataataaacctaaaagtagatcagatgtcacagaaactaatgaaaaataagattgacgatcgatacttagtaatgaacacttataaccatttcatcaaagatttttggtccaagttctccaagttgttgattatagaagatgatcatgaattgacagccataatatatcaatctttcgagaaaaactatatcaaatataaatgcgacgagttttatacggatattgtaccgaaatttcctgcttcgaggaaatgcttgcttgaattgaggagcatcctgaataaagacataaaaactgtcggcacaaaagtgcttgagaccttatatcacggatttgtatcaaggtttctcacctcaagtcttttaacttgcgaaatactgtattattacattaagacggtgaaatgtttaaagataattgatccgatgggcatttgtctccgatcgctatcaaaggcggtaagagtatatttgaatccaagaccggatattataaaaacgctactactcgggatatttccattccaaaataatgaacggttcaaaattgcatcatcaactgatggtagttccgtacatcttgaaaagttagagcaattttcgagagaggtcggtgatttctcaatgggtcccgaattacccaccgcgttgccttggttcaaccagccccatctacctcggtgtacttacgatggagacgatcaacttttgaaacagtatttgaactgggtaccggaacccccaagaatcaaacttgatgtggaagattttgctgacaatgatggcaaatatgtcccaccggttgatttgatccatgtgctattagacgtactagagtcaaagagaacattagtggacgatctcttaggtgttgtaagtggtaaatttattgaatctgaggaatattccttagatccagaatggcagagaataatggatattatattgaatcacttggaagggacaagaaaaggtactgttacatcagaggaagccgatttaacccacctcaatgatgtagatatcatgctcgaagacctaagattaagcagccaattcagaaatcaagtagcccataaaaataactctcattttgagaatttcccccatattaagatcctttccaaactttattggagacattatcagaacctgaatggaagactcgttactacgaaatacaaatgggacagcgaaatggaacctttgattcaaaaattaacgaaagtgtacgaaagattgaatactggaaggacgctaaaatttgatactggatctagtagccgagtttcaatcaatatagttacgaaatcaggcgaaagacgattcttcaaagtgacaatggaacaatatttggtgatatcacattttcaaaacgagacaaacggcagaaatgctcctggtatgatggctgactgtaattacgttatacctgagagaaggtatacattgaaagatctccataaaatgacatcaatgcccagacagaaaattcttgacatcctttcgttctggcaacaaaaggaaattgttactaaacattcagatgattcttatagtgtacaagaaggaatataa

SEQ ID NO: 10456 - protein, 697 aa, Kluyveromyces lactis NRRL Y-1140
MTKTDDELKLLHEKILLNLASNLEEEVDMVLAWLNPTFQPQIPTLRIKQCLKVVLEQSDERTRFLIEQYYLTLIRTHFFLQFDDIVNWKDMIKLEKLYISKVEFMFGTSVYWIKEEMISFKRLLMKKNNEFRKQLHAKLESHILDNDLVRFDQMYQWLAPAFDGQEIEFNVRIINLKVDQMSQKLMKNKIDDRYLVMNTYNHFIKDFWSKFSKLLIIEDDHELTAIIYQSFEKNYIKYKCDEFYTDIVPKFPASRKCLLELRSILNKDIKTVGTKVLETLYHGFVSRFLTSSLLTCEILYYYIKTVKCLKIIDPMGICLRSLSKAVRVYLNPRPDIIKTLLLGIFPFQNNERFKIASSTDGSSVHLEKLEQFSREVGDFSMGPELPTALPWFNQPHLPRCTYDGDDQLLKQYLNWVPEPPRIKLDVEDFADNDGKYVPPVDLIHVLLDVLESKRTLVDDLLGVVSGKFIESEEYSLDPEWQRIMDIILNHLEGTRKGTVTSEEADLTHLNDVDIMLEDLRLSSQFRNQVAHKNNSHFENFPHIKILSKLYWRHYQNLNGRLVTTKYKWDSEMEPLIQKLTKVYERLNTGRTLKFDTGSSSRVSINIVTKSGERRFFKVTMEQYLVISHFQNETNGRNAPGMMADCNYVIPERRYTLKDLHKMTSMPRQKILDILSFWQQKEIVTKHSDDSYSVQEGI

SEQ ID NO: 10457 - DNA, 2082 bp, Debaryomyces hansenii CBS767
  CDS (1)..(2082)
atgattactatacctctttcgaaagaaaattttaaccaagtgatcccaatccctactcttcaagatttggcggctaattcatcaaattcagatcaacaatcaaataatatagaaaatgatattgattatttacttcattggttaagtccattttggccagacaatagggtgtttaacgagccatctcaaagggtcaaatctgctgttaggagctgtctcagggacgagtctagtcaattagatttcgttaagttgtacggaaattcgatcaaaccaagattttttgaagaactatcaccagtactattggatgatagggttttattaactgaagcgatagataaaattaagtttataaaagactactacaaccaatacatcaagtatttgaatttaaataaattgccttatgatatacttaataggaatctaaattcgttgtttcattcaatattagtcgaaaataagcaatccaaattcataaaaaacttgactaattacttatatgaaatgttgttcggtgatgaaaaatgcctacatggttctgtccatggctacattctggttttgttatcgattgaattaatcgatgaattaaattcaataataatacgcttgtcaattaaacagataaaagattatatacttgccacatgcacaaaagtatgggataaaccattgttagaagagattaactgttggattaaactggatttatttcccagttttaatttgataatgaggctatcaaactttgatttctcagagaagtatttgtacgatttaatcaagattgcacatgatgaactagtctcattaagaattaaagaaatatttggcttagtggtggattatccaaattcctatattgcattatcagaattacatcaatgtctactgttcaagttcaactctcataataccggtaccaatatatctaacttgagcactgttattaattctaacataaatacatctgagattgattcggcaaattcattaataactatttcgaatttctcatctatacttataaacaattcagcgaattctcaagcatatcaaagagctaagttggtagatacatttatacaattatgtcatgaagaattacttcattctggagcaaatactgtgaatgtcattacctgttacacatctacaatcaaatcatttttgattattgatcctaagggtgtgttactcgatagagtagtgagaccaatcagaagatatttgaaaacaagagaagatattattattaaactagtacatggcttattggaccaaagtgaaagcaacgatttactcgaattagctcaagaattaagaaatgggacgaaaaaaacggttatagccgatgatcttatggatttaacttgggtccctgatcctattgacgcattgcctgacttcaaaaagagtaaaatgaccgatataatagaatcattaatatcaatctttgacctgaaagagatatttattaacgagttcactcaattatttggtgagaggttgattaatttgcacgattatgatgtcaaagatgtaactgatcatttagatctactaaaattacgattcggagaaaacgaattcacaacgttagatattatgattaaagatatcgaacaaagtaaaataacaaatgcaaaaatcaattacagaaatgaatactcttttcattctacaattctttcccatttatactggccaacagtttgtgaaaatgtttcccataatgatagcttcaaattacctgatactatttcgaatcagtttgaaaagtttgataaagaatttgctggagttaaaaagggtcgaggcttgaagttacttcctagtctcggcttggtcagacttgaattactgataagaaatacgaaattactgtttgaagtaacacctgataaagcgtccataatatcattatttcatgacaaggttgatgaattgagattgacaaatatagctagtcagttagatatgcagccatatgttgcttcaaaagctatagactactggataaagcagaatgttttaacggaaacatctaaaggaatatacaaggtaaacgaatga

SEQ ID NO: 10458 - protein, 693 aa, Debaryomyces hansenii CBS767
MITIPLSKENFNQVIPIPTLQDLAANSSNSDQQSNNIENDIDYLLHWLSPFWPDNRVFNEPSQRVKSAVRSCLRDESSQLDFVKLYGNSIKPRFFEELSPVLLDDRVLLTEAIDKIKFIKDYYNQYIKYLNLNKLPYDILNRNLNSLFHSILVENKQSKFIKNLTNYLYEMLFGDEKCLHGSVHGYILVLLSIELIDELNSIIIRLSIKQIKDYILATCTKVWDKPLLEEINCWIKLDLFPSFNLIMRLSNFDFSEKYLYDLIKIAHDELVSLRIKEIFGLVVDYPNSYIALSELHQCLLFKFNSHNTGTNISNLSTVINSNINTSEIDSANSLITISNFSSILINNSANSQAYQRAKLVDTFIQLCHEELLHSGANTVNVITCYTSTIKSFLIIDPKGVLLDRVVRPIRRYLKTREDIIIKLVHGLLDQSESNDLLELAQELRNGTKKTVIADDLMDLTWVPDPIDALPDFKKSKMTDIIESLISIFDLKEIFINEFTQLFGERLINLHDYDVKDVTDHLDLLKLRFGENEFTTLDIMIKDIEQSKITNAKINYRNEYSFHSTILSHLYWPTVCENVSHNDSFKLPDTISNQFEKFDKEFAGVKKGRGLKLLPSLGLVRLELLIRNTKLLFEVTPDKASIISLFHDKVDELRLTNIASQLDMQPYVASKAIDYWIKQNVLTETSKGIYKVNE

SEQ ID NO: 10459 - DNA, 2424 bp, Candida albicans SC5314
  CDS (1)..(2424): transl_table=12
atggatacacaggcagaaatcaatgctgatttaatatcatcaattataccgttccccaacttgactgatctatccaacaccacatctgatttcgacaatgatatacagattttattagattggttgtctccttatataccagcaacttctttaaccaagtatcaggattgtggttcccccttgttattgctaagagttcaggaaccgtcacaaagagtgaaatcagctattcgtgggtgtttgaaggatgaaatcaatcagatccaattcattgaattatacattaacacaatcaatgaaaaagtctcacaattttttgaatcgatcgtcacaaagaacttgaaatttattgaatacgttaatataattaagattttgctacattattacaattctcaatttgaatatctcaatttatctgataatgtttataaaaaatttcaagcaaaactcagttttataatcacgtgtaatttgcttaatgaacaatcgtcattcagggccaagatgaaccaattttttgaagaatcattatatgttagagcaactttgagtaacccactgtcatcgatcacattgaacttgattgatataatttccactctagcatcaattggcatgtctgatttgttgaatgaaattgtcatcaaattatccattgataaaatcaaacattttacaaatacatatagtagaaatgtatggaataaacctttactatcaaccatcaacaatttcattcaaaatgaaatttatccaaatttttatattgtgattagctataccacatcgtccaatttgacagattcaatgaataatgtttatctttatgaattggtgagaattgcacatgatgaactaataaatttaagaatccaagaaatatattctatggttttgcaatatcctgaatctcaagttgggctaaacgaattacatcactgtttactgaaagttaaatttaatctgaaacaatatgaattaacgttgctttcgtgtgctattgatcattcagttaatattcaagcagcacagagaactgaattggtaaatagttttatcgattactgtcataagaatattttgcatgccggcgccaataccattgacgtcataaccacctatatcaagactataaaatcatttttaattgttgatccaaaaggtgtattgctcgataaggtcgtgaggcccatacgacaatatttgaaaacgagagaggatattattataaaattagtgcatggattacttgatatttctcctaataatgaattgattgaattggctcgcgaattacgtcatccaagtaacaagtaccgttcaaaacatgatcattcaaaagatgtgttggaagatttgcttgatttgaattggcagcctgatcctattgatgcattacctgatttcaagaaaggtaaagtaagtgatataattgagtccttgatctcgatatttgactccaaggatattttcattgatgaattcacaaggttgtttggtgatagcttaatcaaattgaaggattataacgtggaagaaattgaactgaatttgaatttgctaaaatcccgatttggtaagcaaaattttgccactttggatgttatgattcgtgacataaaggaaagtgaatatttaaatgatttgtttgtcaggaacacgaggaataccaatttcaatacttctgtattatctcatttatattggtcgagtattttggagaacataaataccgatgctaacaattttaaagttcccaaagaaatcgaggacaagtttcaactgtttaaagataaatttgctcaagagaaatatggtagaactttggaactattaccaagtttagggttggttacattacaactagaatttaagaaaagtggtcctcgagtttttaaagtcactccagataaagcatcgataatctctttgttcaatgaaaaagaagatgaattatcagtgagttacatagctcaaacattgaacatgtcagaatatatggtttccaacgggttggcatattgggtgaaagagggtgtacttacggaattaacgaaaaccttgtatattgtcaacgatgatgatgatgaagaagaagaagagggaaatgtgtttccagaaaaggcagaaagctcaaaacatggaatcgatagtgctactagtaatctaacgtcagttaaatctggaatggaagataaattttcagagattgctattattgaatcttatattgttacaatattacaaaatataaccctgataaattttgaaagaatgaaaacattgcttaatttaatggttccaaaagataagctcgactttgccaatgttagtgaaagtctacttgaagaatatcttgattcgttagtagaaaattccaaaattgcttttcaaaacggaaattatagtttacccaagtaa

SEQ ID NO: 10460 - protein, 807 aa, Candida albicans SC5314
MDTQAEINADLISSIIPFPNLTDLSNTTSDFDNDIQILLDWLSPYIPATSLTKYQDCGSPLLLLRVQEPSQRVKSAIRGCLKDEINQIQFIELYINTINEKVSQFFESIVTKNLKFIEYVNIIKILLHYYNSQFEYLNLSDNVYKKFQAKLSFIITCNLLNEQSSFRAKMNQFFEESLYVRATLSNPSSSITLNLIDIISTLASIGMSDLLNEIVIKLSIDKIKHFTNTYSRNVWNKPLLSTINNFIQNEIYPNFYIVISYTTSSNLTDSMNNVYLYELVRIAHDELINLRIQEIYSMVLQYPESQVGLNELHHCLSKVKFNSKQYELTLLSCAIDHSVNIQAAQRTELVNSFIDYCHKNILHAGANTIDVITTYIKTIKSFLIVDPKGVLLDKVVRPIRQYLKTREDIIIKLVHGLLDISPNNELIELARELRHPSNKYRSKHDHSKDVLEDLLDLNWQPDPIDALPDFKKGKVSDIIESLISIFDSKDIFIDEFTRLFGDSLIKLKDYNVEEIESNLNLLKSRFGKQNFATLDVMIRDIKESEYLNDLFVRNTRNTNFNTSVLSHLYWSSILENINTDANNFKVPKEIEDKFQSFKDKFAQEKYGRTLELLPSLGLVTLQLEFKKSGPRVFKVTPDKASIISLFNEKEDELSVSYIAQTLNMSEYMVSNGLAYWVKEGVLTELTKTLYIVNDDDDEEEEEGNVFPEKAESSKHGIDSATSNLTSVKSGMEDKFSEIAIIESYIVTILQNITSINFERMKTLLNLMVPKDKLDFANVSESLLEEYLDSLVENSKIAFQNGNYSLPK

SEQ ID NO: 10461 - DNA, 25 bp, Artificial sequence
  primer
atgtcatttcagattaccccaactc

SEQ ID NO: 10462 - DNA, 26 bp, Artificial sequence
  primer
tcatgagtttttatgcccatttttca

SEQ ID NO: 10463 - DNA, 267 bp, Saccharomyces cerevisiae
  CDS (1)..(267)
atgggtaagggtactccttcattcggtaaacgtcacaacaagtcccacactttgtgtaacagatgtggtcgtcgttctttccatgttcaaaagaagacctgttcctcctgtggttatccagctgctaagaccagatcttacaactggggtgccaaggctaagagaagacacactactggtactggtagaatgagatacttgaaacacgtttcaagaagattcaagaacggtttccaaaccggctctgcttctaaggcttctgcttaa

SEQ ID NO: 10464 - protein, 88 aa, Saccharomyces cerevisiae
MGKGTPSFGKRHNKSHTLCNRCGRRSFHVQKKTCSSCGYPAAKTRSYNWGAKAKRRHTTGTGRMRYLKHVSRRFKNGFQTGSASKASA

SEQ ID NO: 10465 - DNA, 472 bp, Oryza sativa
  CDS (46)..(366)
gcttattacaacttaccaagagaatagaattacttcgtcggaacaatgacgaagggtactcaatcgttcggcaaacgtaattgcaaaactcatacattatgtcgtcgttgtggacgttcatcttaccatttacaacgtcagcgatgtgcagcatgcggttatccatcagctaaaacacgtaaatatcaatggagtgaaaaagctcgtcgtcgaaaaacaacaggcaccggtcgaatgagacatttgaaagttgtgtttcgtcgatttcgaaatggttttcgtgaaggtacattagcaaaatcacgtaaatcccaacgacaagcaacagcaactgcaacaacaactgcaccagctacgactaaatagagatgaagagaaaaatcattgattgtttttgttgtaaaccgtttggtaatacagctgaaaagaagaaaaaattccaataaaaaaaaaagcgagaaacaaaaaacag

SEQ ID NO: 10466 - protein, 106 aa, Oryza sativa
MTKGTQSFGKRNCKTHTLCRRCGRSSYHLQRQRCAACGYPSAKTRKYQWSEKARRRKTTGTGRMRHLKVVFRRFRNGFREGTLAKSRKSQRQATATATTTAPATTK

SEQ ID NO: 10467 - DNA, 285 bp, Zea mays
  CDS (1)..(285)
atggggaagggtacgggcagcttcggcaagcgccggaacaagacgcacacgctctgcatccgctgcggccgccgcagcttccacctccagaagagcacctgctcctcctgcggctaccccgccgcccgcatccgcaagtataactggagtgtgaaagccatcaggcgtaagacaactggtaccggaaggatgaggtacatgcgacacgtgcctcgccgtttcaagagcaacttcaaagaagggactgaggctgccccaaagaagggtgttgctgctgccaactaa

SEQ ID NO: 10468 - protein, 94 aa, Zea mays
MGKGTGSFGKRRNKTHTLCIRCGRRSFHLQKSTCSSCGYPAARIRKYNWSVKAIRRKTTGTGRMRYMRHVPRRFKSNFKEGTEAAPKKGVAAAN

SEQ ID NO: 10469 - DNA, 285 bp, Zea mays
  CDS (1)..(285)
atgacgaagggtacctccagcttcggtaagcgtcacaacaagacgcacaccctgtgccgacgatgcggtcgccgctctctccacatccagaagcatgagtgctcttcttgcggttacccttctgccaagatccgcaagtacaactggtccgagaaggctaagcgaagaaagaccgtcggtaccggccgcactcgctacctcaaggatgtgtcccgacgattcaagaacggtttccagactggcacacccaagggcgctcgtggccttactgccgagaaggcctaa

SEQ ID NO: 10470 - protein, 94 aa, Zea mays
MTKGTSSFGKRHNKTHTLCRRCGRRSLHIQKHECSSCGYPSAKIRKYNWSEKAKRRKTVGTGRTRYLKDVSRRFKNGFQTGTPKGARGLTAEKA

SEQ ID NO: 10471 - DNA, 500 bp, Glycine max
  CDS (45)..(326)
  misc_feature (476)..(476): n is a, g, c or t
  misc_feature (492)..(492): n is a, g, c or t
aaccgccgccactcccattcgctcgcctcctccaaccctaagcgatgacgaagggtaccggcagtttcggcaagcgccggaacaagacccacacgctctgcatccgctgcggccgccgcagcttccacctccagaagagcacctgctcctcctgcggctaccccgccgcccgcatccgcaagtacaactggagtgtgaaggccatcaggcgcaagaccaccggcactggaaggatgaggtacatgcgccacgtgcctcgcaggttcaagagcaacttcagagaaggtaccgaggctgcgcccaggaacagggccgcggccaactagttctggattttgccccatcaggaataccctgaagctagaatttaaagactttttgcttgggttgtaccccgcctaaactattgttgctatagaattgagtatggatctgatatgttttgttgcatgggtttggaaattgacctctgaatntaagtccaaatttgtntgaatgtt

SEQ ID NO: 10472 - protein, 93 aa, Glycine max
MTKGTGSFGKRRNKTHTLCIRCGRRSFHLQKSTCSSCGYPAARIRKYNWSVKAIRRKTTGTGRMRYMRHVPRRFKSNFREGTEAAPRNRAAAN

SEQ ID NO: 10473 - DNA, 547 bp, Triticum aestivum
  CDS (76)..(366)
ggtgctctcttcttcctcctctcctcttccctcggcggcggcgcaggcggcgcggaggcgacaggcgaaggcgaaatgacgaagggaacgggcagcttcggcaagcgccggaacaagacccacacgctgtgcatccgctgcggccgccgcagcttccacctgcagaagagcacctgctcctcgtgcggctaccccgccgcccgcatccgcaagtacaactggagtgtgaaggccatcaggaggaagaccaccggcaccgggaggatgaggtacatgcgccatgtgcccaggaggttcaagagcaacttcagagagggaactgaggccgcaccaaggagcaagggagcctcttccagcggcaactaggcgcggcggccttaacttgttacgctaggcggagccctgatcaccaaacttagcttttttgttgctttctactggaactctatgtttctatgtcgagaggcggacgatatgatgcctggttatgttatttgcacaattatcgtggacgttaatccttcagttttgaatgttgaattgtgtc

SEQ ID NO: 10474 - protein, 96 aa, Triticum aestivum
MTKGTGSFGKRRNKTHTLCIRCGRRSFHLQKSTCSSCGYPAARIRKYNWSVKAIRRKTTGTGRMRYMRHVPRRFKSNFREGTEAAPRSKGASSSGN

SEQ ID NO: 10475 - DNA, 496 bp, Zea mays subsp. mays
  CDS (75)..(359)
gactccacgccgccagtcacgaccacgccgcgcctccgcctggaaccctttagccgagcggagcaagggaagaaatggggaagggtacgggcagcttcggcaagcgccggaacaagacgcacacgctctgcatccgctgcggccgccgcagcttccacctccagaagagcacctgctcctcctgcggctaccccgccgcccgcatccgcaagtataactggagtgtgaaggccatcaggcgtaagacaactggtaccggaaggatgaggtacatgcgacacgtgcctcgccgtttcaagagcaacttcagagaagggactgaggctgccccaaagaagggtgttgctgctgccaactaagtgtggtcttgctgccatcaagaagcgctagaacttgagactttttgattgaattgtacttctgaactatttagcccataatactatgcttgaattaatttcagacgccctggaggaggtatatgtatctttttggc

SEQ ID NO: 10476 - protein, 94 aa, Zea mays subsp. mays
MGKGTGSFGKRRNKTHTLCIRCGRRSFHLQKSTCSSCGYPAARIRKYNWSVKAIRRKTTGTGRMRYMRHVPRRFKSNFREGTEAAPKKGVAAAN

SEQ ID NO: 10477 - DNA, 285 bp, Oryza sativa (japonica cultivar-group)
  CDS (1)..(285)
atggggaagggtacgggcagcttcggcaagcgccggaacaagacgcacacgctctgcgtccgctgcggccgccgcagcttccacctccagaagagcacctgctcctcctgcggctaccccgccgcccgcatccgcaagtacaactggagcgtgaaggccattaggcgcaagaccacaggaactggaaggatgaggtacatgcgacatgtgcctaggaggttcaagagcaacttcagagaaggtactgaggctaccccaaggaagagagctgccgcagccaactag

SEQ ID NO: 10478 - protein, 94 aa, Oryza sativa (japonica cultivar-group)
MGKGTGSFGKRRNKTHTLCVRCGRRSFHLQKSTCSSCGYPAARIRKYNWSVKAIRRKTTGTGRMRYMRHVPRRFKSNFREGTEATPRKRAAAAN

SEQ ID NO: 10479 - DNA, 288 bp, Oryza sativa (japonica cultivar-group)
  CDS (1)..(288)
atgggcaagggcacggggagcttcgggaagcgccggaacaagacgcacacgctctgcgtgcgctgcggccgccgcagcttccacctgcagaagagcacctgctcctcctgcggctaccccgcggcccgcatccgcaagtacaactggagtgtgaaggccatcaggaggaagaccactggaactgggaggatgaggtaccttcgccacgtgcccaagaggttcaagagtaacttcagagaggggactgaggctgcaccaaggaagaagggggctgctgctagcaactag

SEQ ID NO: 10480 - protein, 95 aa, Oryza sativa (japonica cultivar-group)
MGKGTGSFGKRRNKTHTLCVRCGRRSFHLQKSTCSSCGYPAARIRKYNWSVKAIRRKTTGTGRMRYLRHVPKRFKSNFREGTEAAPRKKGAAASN

SEQ ID NO: 10481 - DNA, 342 bp, Oryza sativa (japonica cultivar-group)
  CDS (1)..(342)
atgggtcaccggtcaccaccctgtcttcctcctcatttctcccccaaaccaaaaactaggggtaagggtacgggcagcttcggcaagcgccggaacaagacgcacacgctctgcgtccgctgcggccgccgcagcttccacctccagaagagcacctgctcctcctgcggttaccccgccgcccgcatccgcaagtacaactggagcgtgaaggccattaggcgcaagaccacaggaaccggaaggatgaggtacatgcgacatgtgcctaggaggttcaagagcaacttcagagaaggtactgaggctaccccaaggaagagagctgccgtggccaactag

SEQ ID NO: 10482 - protein, 113 aa, Oryza sativa (japonica cultivar-group)
MGHRSPPCLPPHFSPKPKTRGKGTGSFGKRRNKTHTLCVRCGRRSFHLQKSTCSSCGYPAARIRKYNWSVKAIRRKTTGTGRMRYMRHVPRRFKSNFREGTEATPRKRAAVAN

SEQ ID NO: 10483 - DNA, 267 bp, Candida glabrata CBS 138
  CDS (1)..(267)
atgggtaagggtactccatctttcggtaagcgtcacaacaagtcccacactttgtgtaacagatgtggtcgtcgttccttccacgttcaaaagaagacctgtgcttcttgtggttacccatctgctaagaccagatcttacaactggggccaaaaggctaagagaagacacactactggtaccggtagaatgagatacttgaagcacgtcgctagaagattcaagaacggtttccaatctggtaccgcttctaaggcttccgcttaa

SEQ ID NO: 10484 - protein, 88 aa, Candida glabrata CBS 138
MGKGTPSFGKRHNKSHTLCNRCGRRSFHVQKKTCASCGYPSAKTRSYNWGQKAKRRHTTGTGRMRYLKHVARRFKNGFQSGTASKASA

SEQ ID NO: 10485 - DNA, 267 bp, Kluyveromyces lactis NRRL Y-1140
  CDS (1)..(267)
atgggtaagggtactccatctttcggtaagcgccacaacaagtctcacactctatgtaagagatgtggccgtagtagttaccacattcaaaagcacacctgttcttcttgtggttacccagctgctaagatgagatctcacaactgggctgccaaggctaagagaagaagaaccactggtaccggtagaatgagatacttgaaacacgtttctagaagattcaagaacggtttccaatctggtgaagctaaggcacaatccgcttaa

SEQ ID NO: 10486 - protein, 88 aa, Kluyveromyces lactis NRRL Y-1140
MGKGTPSFGKRHNKSHTLCKRCGRSSYHIQKHTCSSCGYPAAKMRSHNWAAKAKRRRTTGTGRMRYLKHVSRRFKNGFQSGEAKAQSA

SEQ ID NO: 10487 - DNA, 267 bp, Debaryomyces hansenii CBS767
  CDS (1)..(267)
atgagtaaaggtactccatctttaggtaaacgtcacaacaagtcccacgttttatgtaacagatgtggtaagcgttcattccacgtccaaaagaagacctgtgcttcttgtggatacccagctgctaaattgagatctcacaactgggctacaaaggctaagagaagaagaactaccggtactggtcgtatggcttacttgaagcacgtttctagaagatttaagaacggcttccaaaccggtgtcgctaaacctcaatccgcttaa

SEQ ID NO: 10488 - protein, 88 aa, Debaryomyces hansenii CBS767
MSKGTPSLGKRHNKSHVLCNRCGKRSFHVQKKTCASCGYPAAKLRSHNWATKAKRRRTTGTGRMAYLKHVSRRFKNGFQTGVAKPQSA

SEQ ID NO: 10489 - DNA, 255 bp, Yarrowia lipolytica CLIB122
  CDS (1)..(255)
atgaccaagggtaccacttcgttcggtaagaagcacaccaagtcgcacactctctgcacccgatgcggtaagcgatctttccattgccagaagaagacttgcgcctcttgcggatacccctccgccaagatccgatcctacaactggggtcagaaggccaagcgacgacacaccactggtaccggtcgaatgcgatctctcaagctcgttgaccgaaagttccgaaacggtttcggcaacaaggcttccgagtaa

SEQ ID NO: 10490 - protein, 84 aa, Yarrowia lipolytica CLIB122
MTKGTTSFGKKHTKSHTLCTRCGKRSFHCQKKTCASCGYPSAKIRSYNWGQKAKRRHTTGTGRMRSLKLVDRKFRNGFGNKASE

SEQ ID NO: 10491 - DNA, 276 bp, Ostreococcus tauri
  CDS (1)..(276)
atgggtaagaaaggaaagggtaccgggtcgttcggttcgcgccgtaacaagtcgcacacgctgtgccgacgatgcgggaagcgatcgtaccacattcaaaagtccacgtgcgcgtcctgcggctacccgtcggctcgcgttcgtaaatacaactggagcgtgaaggcgatcgggcgcaagaccacgggcaccggccgcatgagataccttaagaccctgccccgccgattcaagaacgggttcagagaaggcaccgcggcgaccaagaaggcgtaa

SEQ ID NO: 10492 - protein, 91 aa, Ostreococcus tauri
MGKKGKGTGSFGSRRNKSHTLCRRCGKRSYHIQKSTCASCGYPSARVRKYNWSVKAIGRKTTGTGRMRYLKTLPRRFKNGFREGTAATKKA

SEQ ID NO: 10493 - DNA, 288 bp, Glycine max
  CDS (1)..(288)
atgggtaagggaacggggagtttcggtaagagaaggaacaagacccacaccctctgtgtgaggtgtggccgccgcagtttccacctccagaagagtcgttgcgccgcgtgcgctttccccgctgcgcgcaccaggaaatataactggagcgtgaaggccattaggagaaagaccaccggaactggaaggatgaggtacttgcgtaacgtgccccgtagatttaagagtggcttcagagacggtaccgaagctgcacccaggaagagaggagctgctgcctctacctaa

SEQ ID NO: 10494 - protein, 95 aa, Glycine max
MGKGTGSFGKRRNKTHTLCVRCGRRSFHLQKSRCAACAFPAARTRKYNWSVKAIRRKTTGTGRMRYLRNVPRRFKSGFRDGTEAAPRKRGAAAST

SEQ ID NO: 10495 - DNA, 264 bp, Kluyveromyces delphensis
  CDS (1)..(264)
atgggtaagggtactccatctttcggtaagcgtcacaacaagtcccacactttgtgtaacagatgtggtcgtcgttccttccacgttcaaaagaagacctgttctgcctgtggttacccagctgctaagactagatcttacaactggggtcaaaaggctaagagaagacacactaccggtaccggtagaatgagatacttgaagcacgtttccagaagattcaagaacggtttccaatccggtactgctgccaagtccgcttaa

SEQ ID NO: 10496 - protein, 87 aa, Kluyveromyces delphensis
MGKGTPSFGKRHNKSHTLCNRCGRRSFHVQKKTCSACGYPAAKTRSYNWGQKAKRRHTTGTGRMRYLKHVSRRFKNGFQSGTAAKSA

SEQ ID NO: 10497 - DNA, 288 bp, Arabidopsis thaliana
  CDS (1)..(288)
atgggtaaaggaacagggagctttggtaagaggaggaacaagtcacacacgctctgtgtgagatgtggtcgccggagctttcacatccagaagagtcgttgctcggcatgtgcttatccagctgccagaaagaggacatataactggagtgtgaaggcaataagaagaaagacaacaggaactggtaggatgaggtatctccgtaatgtccctcgaaggttcaagacttgctttagagaaggtacgcaagccaccccaagaaacaaagctgcagcttcgtcttcctag

SEQ ID NO: 10498 - protein, 95 aa, Arabidopsis thaliana [sequence omitted]

SEQ ID NO: 10499 - DNA, 288 bp, Arabidopsis thaliana
  CDS (1)..(288)
atgactaagggaacgggaagtttcggaaagagaagaaacaagagtcacacactctgtgtcagatgtggccgtcgcagtttccacatccagaagagtcgttgctctgcttgtgcttatcccgccgctcgcaagaggacttacaactggagtgtgaaggcaatccgtagaaagactactggaactggaaggatgaggtatcttcgcaatgtgcctcgcaggttcaagaccggtttcagagagggtaccgaagccaagccaaggaacaagggagttgcttcatcagcttaa

SEQ ID NO: 10500 - protein, 95 aa, Arabidopsis thaliana
MTKGTGSFGKRRNKSHTLCVRCGRRSFHIQKSRCSACAYPAARKRTYNWSVKAIRRKTTGTGRMRYLRNVPRRFKTGFREGTEAKPRNKGVASSA

SEQ ID NO: 10501 - DNA, 288 bp, Arabidopsis thaliana
  CDS (1)..(288)
atgggaaagggaacagggagtttcggtaagaggaggaacaagagtcacacactctgtgtgagatgtggtcgtcgtagtttccacatccagaagagtcgttgctcggcttgtgcttacccagctgctcgcaagaggacttacaactggagtgtgaaggccatcaggaggaagactactggtaccggaaggatgaggtatctccgtaatgttcctcgtcggttcaagactggattcagagaaggtactgaagccaagccaaggagcaaggcatcagcttcatcagcttaa

SEQ ID NO: 10502 - protein, 95 aa, Arabidopsis thaliana
MGKGTGSFGKRRNKSHTLCVRCGRRSFHIQKSRCSACAYPAARKRTYNWSVKAIRRKTTGTGRMRYLRNVPRRFKTGFREGTEAKPRSKASASSA

SEQ ID NO: 10503 - DNA, 270 bp, Schizosaccharomyces pombe
  CDS (1)..(270)
atgactaagggtactcaatcattcggtatgagacataacaagtctcataccatttgccgtcgttgtggaaagcgttctttccacattcaaaagagcacctgcgcatgctgtggttatcccgctgccaagactcgtagttacaactggggtgctaaggccaagagaagaagaactactggcactggccgtatgagctatttgaagaaggttcatcgcagctttaagaacggattccgtgctggcaagcctacttccgctgctactgcttag

SEQ ID NO: 10504 - protein, 89 aa, Schizosaccharomyces pombe
MTKGTQSFGMRHNKSHTICRRCGKRSFHIQKSTCACCGYPAAKTRSYNWGAKAKRRRTTGTGRMSYLKKVHRSFKNGFRAGKPTSAATA

SEQ ID NO: 10505 - DNA, 276 bp, Schizosaccharomyces pombe
  CDS (1)..(276)
atgactaagggtactcaatcattcggtatgagacataacaagtctcataccatttgccgtcgttgtggaaaacgctctttccacattcaaaagagcacctgtgcttgctgtggttatcccgccgctaagacccgtagctacaactggggtgctaaggccaagagaagaagaaccactggtactggccgtatgagctatttgaagaaggttcatcgtagcttcaaaaatggtttccgttctggaaagcctgctgccgctgttgctgcctctgcttag

SEQ ID NO: 10506 - protein, 91 aa, Schizosaccharomyces pombe
MTKGTQSFGMRHNKSHTICRRCGKRSFHIQKSTCACCGYPAAKTRSYNWGAKAKRRRTTGTGRMSYLKKVHRSFKNGFRSGKPAAAVAASA

SEQ ID NO: 10507 - DNA, 267 bp, Saccharomyces cerevisiae
  CDS (1)..(267)
atgggtaagggtactccttcattcggtaagcgtcacaacaaatctcacaccttgtgtaacagatgtggtcgtcgttctttccatgttcaaaagaagacctgttcctcttgtggttacccatccgctaagactagatctcacaactgggctgccaaggcaaagagaagacacactactggtaccggtagaatgagatatttgaagcatgtctccagaagatttaagaacggtttccaaaccggttctgctaaggctacttctgcttaa

SEQ ID NO: 10508 - protein, 88 aa, Saccharomyces cerevisiae
MGKGTPSFGKRHNKSHTLCNRCGRRSFHVQKKTCSSCGYPSAKTRSHNWAAKAKRRHTTGTGRMRYLKHVSRRFKNGFQTGSAKATSA

SEQ ID NO: 10509 - DNA, 279 bp, Emericella nidulans
  CDS (1)..(279)
atgacgaagggtacctccagcttcggaaagcgccacaacaaaactcacactctgtgccggcgttgtggccgccggtcctaccacatccagaagtcgacctgcgcaaactgcggttaccccgctgctaagactcgcaagtacaactggagcgagaaggccaagcgacgcaagaccaccggttccggccgtaccgctcacctgcgggacgtccaccgccgcttcaagaacggcttccaggttggcactcccaagggcgcccgtggtcctgagaaccactaa

SEQ ID NO: 10510 - protein, 92 aa, Emericella nidulans
MTKGTSSFGKRHNKTHTLCRRCGRRSYHIQKSTCANCGYPAAKTRKYNWSEKAKRRKTTGSGRTAHLRDVHRRFKNGFQVGTPKGARGPENH

SEQ ID NO: 10511 - DNA, 285 bp, Oryza sativa
  CDS (1)..(285)
atgggtaagggtacgggcagcttcggcaagcgccggaacaagacgcacacgctctgcgtccgctgcggccgccgcagcttccacctccagaagagcacctgctcctcctgcggttaccccgccgcccgcatccgcaagtacaactggagcgtgaaggccattaggcgcaagaccacaggaaccggaaggatgaggtacatgcgacatgtgcctaggaggttcaagagcaacttcagagaaggtactgaggctaccccaaggaagagagctgccgtggccaactag

SEQ ID NO: 10512 - protein, 94 aa, Oryza sativa
MGKGTGSFGKRRNKTHTLCVRCGRRSFHLQKSTCSSCGYPAARIRKYNWSVKAIRRKTTGTGRMRYMRHVPRRFKSNFREGTEATPRKRAAVAN

SEQ ID NO: 10513 - DNA, 291 bp, Brassica napus
  CDS (1)..(291)
atgacaaagggaacagggagttttggtaagaggaggaacaagagtcacacactatgtgtgagatgtggacgtcgtagcttccacatccagaagagtcgctgctctgcctgcgcttaccccgccgctcgcaagaggacctacaactggagtgtgaaggcaatcaggaggaagacaaccggaaccggaaggatgaggtatttcaaaaatgttccccgccgtttcaagaccggtttcagagaaggtactgaagccaagccaaggaacaagggagcagctgcttcatcagcctaa

SEQ ID NO: 10514 - protein, 96 aa, Brassica napus
MTKGTGSFGKRRNKSHTLCVRCGRRSFHIQKSRCSACAYPAARKRTYNWSVKAIRRKTTGTGRMRYFKNVPRRFKTGFREGTEAKPRNKGAAASSA

SEQ ID NO: 10515 - DNA, 291 bp, Brassica napus
  CDS (1)..(288)
atgacgaagggaacagggagtttcggaaagaggaggaacaagagtcacactctctgtgtcagatgtggccgccgcagtttccacatccagaagagccgttgctccgcctgcgcttaccccgccgctcgcaagaggacctacaactggagtgtgaaggcaatccgtagaaagactacaggaacaggaaggatgaggtatcttcgcaatgtgcctcgcaggttcaagaccggtttcagagagggtaccgaagctaagccaaggaacaaggcagcggcttcttcagcttaaact

SEQ ID NO: 10516 - protein, 95 aa, Brassica napus
MTKGTGSFGKRRNKSHTLCVRCGRRSFHIQKSRCSACAYPAARKRTYNWSVKAIRRKTTGTGRMRYLRNVPRRFKTGFREGTEAKPRNKAAASSA

SEQ ID NO: 10517 - DNA, 294 bp, Brassica napus
  CDS (1)..(291)
atgacaaagggaacagggagtttcggaaagaggaggaacaagagtcacacgctgtgtgtgagatgtggacgtcgtagcttccacatccaaaagagtcgctgctctgcctgcgcttaccccgccgctcgcaagaggacctacaactggagtgtgaaggcaatcaggaggaagacaaccggaaccggcaggatgagatatctcaaaaatgtcccccgtcgcttcaagaccggtttcagagaaggtactgaagccaagccaaggaacaagggagcagctgcttcatcaacctaaaag

SEQ ID NO: 10518 - protein, 96 aa, Brassica napus
MTKGTGSFGKRRNKSHTLCVRCGRRSFHIQKSRCSACAYPAARKRTYNWSVKAIRRKTTGTGRMRYLKNVPRRFKTGFREGTEAKPRNKGAAASST

SEQ ID NO: 10519 - DNA, 294 bp, Brassica napus
  CDS (1)..(291)
atgacaaagggaacagggagttttggtaagaggaggaacaagagtcacacactatgtgtgagatgtggacgtcgtagcttccacatccagaagagtcgctgctctgcctgcgcttaccccgccgctcgcaagaggacctacaactggagtgtgaaggcaatcaggaggaagacaaccggaaccggaaggatgaggtatctcaaaaatgttccccgccgtttcaagaccggtttcagagaaggtactgaagccaagccaaggaacaagggagcagctgcttcatcagcctaaaag

SEQ ID NO: 10520 - protein, 96 aa, Brassica napus
MTKGTGSFGKRRNKSHTLCVRCGRRSFHIQKSRCSACAYPAARKRTYNWSVKAIRRKTTGTGRMRYLKNVPRRFKTGFREGTEAKPRNKGAAASSA

SEQ ID NO: 10521 - DNA, 291 bp, Glycine max
  CDS (1)..(288)
atggggaagggaacagggagttttggtaagagaaggaacaagactcacactctctgtgtgaggtgtggccgccgcagcttccatctccagaagagtcgttgcgccgcttgtgctttccccgccgcacgcactaggaaatataactggagcgtcaaggcaatccgcagaaagaccaccggaactggcaggatgaggtacttgcgtaacgtgcctcgccgattcaagagtggcttcagagaaggtaccgaagctgcacctaggaagaagggagcagctaccactgcataaacc

SEQ ID NO: 10522 - protein, 95 aa, Glycine max
MGKGTGSFGKRRNKTHTLCVRCGRRSFHLQKSRCAACAFPAARTRKYNWSVKAIRRKTTGTGRMRYLRNVPRRFKSGFREGTEAAPRKKGAATTA

SEQ ID NO: 10523 - DNA, 291 bp, Glycine max
  CDS (1)..(288)
atgggtaagggaacggggagtttcggtaagaggaggaacaagacccacaccctctgtgtgaggtgtggccgccgcagcttccacctccagaagagtcgttgctctgcgtgcgcttaccccgctgcgcgcaccaggaaatataactggagcgtgaaggccattaggagaaagaccaccggaactggaaggatgaggtacttgcgtaacgtgcctcgcagattcaagagcggcttcagagagggtaccgaagctgcacccaggaagagaggagctgctgcctctgcctaagct

SEQ ID NO: 10524 - protein, 95 aa, Glycine max
MGKGTGSFGKRRNKTHTLCVRCGRRSFHLQKSRCSACAYPAARTRKYNWSVKAIRRKTTGTGRMRYLRNVPRRFKSGFREGTEAAPRKRGAAASA

SEQ ID NO: 10525 - DNA, 288 bp, Zea mays
  CDS (1)..(285)
atggggaagggtacgggcagcttcggcaagcgccggaacaaaacgcacacgctgtgcatccggtgcggccgccgcagcttccatctccagaagagtacctgctcctcctgcggctaccccgcggcccgcatccgcaagtataattggagtgtgaaggccatcaggcgcaagaccactggtacgggaaggatgaggtacatgcgacacgtgcctcgccgtttcaagagcaacttcagagaagggactgaggctgccccaaagaagagtgctgctgctgccaactaagtg

SEQ ID NO: 10526 - protein, 94 aa, Zea mays
MGKGTGSFGKRRNKTHTLCIRCGRRSFHLQKSTCSSCGYPAARIRKYNWSVKAIRRKTTGTGRMRYMRHVPRRFKSNFREGTEAAPKKSAAAAN

SEQ ID NO: 10527 - DNA, 25 bp, Artificial sequence
  primer
atgggtaagggtactccttcattcg

SEQ ID NO: 10528 - DNA, 24 bp, Artificial sequence
  primer
ttaagcagaagccttagaagcaga

SEQ ID NO: 10529 - protein, 81 aa, Artificial sequence
  consensus sequence
  Variant (2)..(2): Xaa in position 2 is any amino acid
  Variant (6)..(6): Xaa in position 6 is any amino acid
  Variant (12)..(12): Xaa in position 12 is any amino acid
  Variant (15)..(15): Xaa in position 15 is any amino acid
  Variant (20)..(20): Xaa in position 20 is any amino acid
  Variant (29)..(29): Xaa in position 29 is any amino acid
  Variant (32)..(33): Xaa in position 32 to 33 is any amino acid
  Variant (35)..(36): Xaa in position 35 to 36 is any amino acid
  Variant (38)..(38): Xaa in position 38 is any amino acid
  Variant (43)..(44): Xaa in position 43 to 44 is any amino acid
  Variant (46)..(46): Xaa in position 46 is any amino acid
  Variant (50)..(51): Xaa in position 50 to 51 is any amino acid
  Variant (54)..(54): Xaa in position 54 is any amino acid
  Variant (57)..(57): Xaa in position 57 is any amino acid
  Variant (67)..(69): Xaa in position 67 to 69 is any amino acid
  Variant (71)..(71): Xaa in position 71 is any amino acid
  Variant (76)..(77): Xaa in position 76 to 77 is any amino acid
  Variant (79)..(80): Xaa in position 79 to 80 is any amino acid
MXKGTXSFGKRXNKXHTLCXRCGRRSFHXQKXXCXXCXYPAAXXRXYNWXXKAXRRXTTGTGRMRYXXXVXRRFKXXFXXG

SEQ ID NO: 10530 - protein, 59 aa, Artificial sequence
  protein pattern
  Variant (2)..(2): Xaa in position 2 is any amino acid
  Variant (7)..(7): Xaa in position 7 is any amino acid
  Variant (12)..(12): Xaa in position 12 is Arg or Ser
  Variant (14)..(14): Xaa in position 14 is any amino acid
  Variant (16)..(16): Xaa in position 16 is Ile, Leu or Val
  Variant (19)..(20): Xaa in position 19 to 20 is any amino acid
  Variant (22)..(22): Xaa in position 22 is Ala or Ser
  Variant (23)..(23): Xaa in position 23 is Ala, Asn or Ser
  Variant (25)..(25): Xaa in position 25 is Ala or Gly
  Variant (26)..(26): Xaa in position 26 is Phe or Tyr
  Variant (28)..(28): Xaa in position 28 is Ala or Ser
  Variant (30)..(30): Xaa in position 30 is Lys or Arg
  Variant (31)..(31): Xaa in position 31 is any amino acid
  Variant (33)..(33): Xaa in position 33 is any amino acid
  Variant (34)..(34): Xaa in position 34 is His or Tyr
  Variant (37)..(37): Xaa in position 37 is Ala, Gly or Ser
  Variant (38)..(38): Xaa in position 38 is any amino acid
  Variant (41)..(41): Xaa in position 41 is any amino acid
  Variant (44)..(44): Xaa in position 44 is His, Lys or Arg
  Variant (46)..(46): Xaa in position 46 is Thr or Val
  Variant (48)..(48): Xaa in position 48 is Ser or Thr
  Variant (51)..(52): Xaa in position 51 to 52 is any amino acid
  Variant (53)..(53): Xaa in position 53 is His or Tyr
  Variant (54)..(54): Xaa in position 54 is Phe, Leu or Met
  Variant (55)..(55): Xaa in position 55 is Lys or Arg
  Variant (56)..(56): Xaa in position 56 is any amino acid
  Variant (58)..(58): Xaa in position 58 is any amino acid
  Variant (59)..(59): Xaa in position 59 is Lys or Arg
KXHTLCXRCGRXSXHXQKXXCXXCXXPXAXXRXXNWXXKAXRRXTXGXGRXXXXXXVXX

SEQ ID NO: 10531 - protein, 12 aa, Artificial sequence
  protein pattern
  Variant (4)..(4): Xaa in position 4 is Asn, Ser or Thr
  Variant (5)..(5): Xaa in position 5 is Cys, Gly or Asn
  Variant (7)..(7): Xaa in position 7 is any amino acid
  Variant (8)..(8): Xaa in position 8 is Asp, Glu, Ser or Thr
  Variant (10)..(10): Xaa in position 10 is any amino acid
  Variant (11)..(11): Xaa in position 11 is any or no amino acid
RFKXXFXXGXXA

SEQ ID NO: 10532 - protein, 13 aa, Artificial sequence
  protein pattern
  Variant (2)..(3): Xaa in position 2 to 3 is any or no amino acid
  Variant (5)..(6): Xaa in position 5 to 6 is any or no amino acid
  Variant (8)..(8): Xaa in position 8 is any amino acid
MXXGXXTXSFGKR

SEQ ID NO: 10533 - DNA, 336 bp, Saccharomyces cerevisiae
  CDS (1)..(336)
atgctaggaagggcattgcgacctgggtggctgggcattactaggacggtggttaagaaaccaagttgcgggtcctactttaacagaacctttcaaacagcaattaacactacaatgcctcccatgcaagagggcatgctgagtacaatgatgatgatgacggctacggcaacaaggatcactggcacagtcagtgagccattaaacggttcaaatatagtgatgcaactcgattcagtgatgagaaagaggaaaaaaaagatgaagaaacacaaactgcggaaaagaagaaagagggagaaggcagaaagaagaaagctatctcagggtagataa

SEQ ID NO: 10534 - protein, 111 aa, Saccharomyces cerevisiae
MLGRALRPGWLGITRTVVKKPSCGSYFNRTFQTAINTTMPPMQEGMLSTMMMMTATATRITGTVSEPLNGSNIVMQLDSVMRKRKKKMKKHKLRKRRKREKAERRKLSQGR

SEQ ID NO: 10535 - DNA, 417 bp, Arabidopsis thaliana
  CDS (1)..(417)
atggcgaatctaattcctagattcctcaggaacaagtcttgcttcaattcaatccaaaggcttactactactccttctctcttcacttaccagaagccctacttcaacaacaacaacaacatcgactctgttattgagaaacccgatccagtttcttttactaatcctttgattacactctccgggaatgaatccaatcaacctatgcggttttaccctagtttctccatggggttatgcttgaatcccaaaatgattcaaggtctggatctagctgaaacagcgtcgttggaggaggaggaagaggatacgaaggagattgtgatttacgctgatagtgtgaagaagaagaggaagaagaagatgaacaagcacaagtataggaaactcaggaaacagcttggtcgcaagtcatag

SEQ ID NO: 10536 - protein, 138 aa, Arabidopsis thaliana
MANLIPRFLRNKSCFNSIQRLTTTPSLFTYQKPYFNNNNNIDSVIEKPDPVSFTNPLITLSGNESNQPMRFYPSFSMGLCLNPKMIQGLDLAETASLEEEEEDTKEIVIYADSVKKKRKKKMNKHKYRKLRKQLGRKS

SEQ ID NO: 10537 - DNA, 417 bp, Candida glabrata CBS 138
  CDS (1)..(417)
atgcagaagttgaagctcaagttgatgctgaactgctcaagcatagctacaactacaagcgcaaggatgtctttgttgcggatggtgaggccgttcatggctgtggtgccgggcgtgcgtcgtgtctccagtgtaccagtcgccggcgtgcgagtgtcaatgcctatgccatttgggaagatgccactgccgttacgagcatctatacaaacaacagtacaagcaacagtgcaagcaacagtgcaaaccatgcaaccaaccgtgcaaccactacctgtgacgccgcaggcgctggacaaagaggtgtatgtcgactctgtgatgcggaagcggaggaagaagatgaagaagcacaagctgaggaagcgcaggcggaaggagaaggcagagcggaggaagctgtcccaaggccgctag

SEQ ID NO: 10538 - protein, 138 aa, Candida glabrata CBS 138
MQKLKLKLMLNCSSIATTTSARMSLLRMVRPFMAVVPGVRRVSSVPVAGVRVSMPMPFGKMPLPLRASIQTTVQATVQATVQTMQPTVQPLPVTPQALDKEVYVDSVMRKRRKKMKKHKLRKRRRKEKAERRKLSQGR

SEQ ID NO: 10539 - DNA, 22 bp, Artificial sequence
  primer
atgctaggaagggcattgcgac

SEQ ID NO: 10540 - DNA, 25 bp, Artificial sequence
  primer
ttatctaccctgagatagctttctt

SEQ ID NO: 10541 - DNA, 966 bp, Saccharomyces cerevisiae
  CDS (1)..(966)
atgatttgcataacgtgcatgcggcccgtagattccctttatacagtgtactcgaatgaccacattcagctgacagattgtccatattgccaagagacagtagacaaatatgttgagatagataatgtcctgttattcattgatttgcttctattaaaagcaggtgcatatagacacttggtattcaatgctttggaattgcatctctcaaaatatccgaaaagaaaagcgctaaatgattgccagtgtttgcgtgactatacgcaagctttgttatttaacgtaaagaactggttttgtaaatatgaccggttaaatcgcctttggcttctactattatcattcgagatttatttaacttgggttactgaggagagtaaatacatctactatttgaaccgtaacaataatgatggtaagctcatcatgctttcaaaaaaattaccagagagcttcaaatgggactcggcaatcatgcgcaataccattacaagtaaagtgtttacctggagcccaccaatacaatatctttactttgcaagttattgtattcttgacgtttctttattccacacctttacccagtatttcatactgaaaaagttgcattggaagcactattccgtttcttcaaaggatgtcatatcatatacgatcttattatcgtacggtgccaaaatttttccgatattgatgttgatatggccttatgatactctaatttcgatgagtatcattaagtgggtagctaatctctatattattgaatcgttgaagattgtaactaatctttcctattggaatatcataaagatttttataagtgtgtctttattacgatatttcatggttaagccaatacttatagttttcgtggcaaagtttaacttttcagttattaagaatttaatacatcaggagtttatactactactacagaagtcaggaacttatttattgttataa

SEQ ID NO: 10542 - protein, 321 aa, Saccharomyces cerevisiae
MICITCMRPVDSLYTVYSNDHIQLTDCPYCQETVDKYVEIDNVLLFIDLLLLKAGAYRHLVFNALELHLSKYPKRKALNDCQCLRDYTQALLFNVKNWFCKYDRLNRLWLLLLSFEIYLTWVTEESKYIYYLNRNNNDGKLIMLSKKLPESFKWDSAIMRNTITSKVFTWSPPIQYLYFASYCILDVSLFHTFTQYFILKKLHWKHYSVSSKDVISYTILLSYGAKIFPILMLIWPYDTLISMSIIKWVANLYIIESLKIVTNLSYWNIIKIFISVSLLRYFMVKPILIVFVAKFNFSVIKNLIHQEFILLLQKSGTYLLL

SEQ ID NO: 10543 - DNA, 927 bp, Candida glabrata CBS 138
  CDS (1)..(927)
atgatatgcattgagtgcagtgcaccaacggagactttatatacagaatattcgaataaatatgttcagctgacagaatgcaaaaactgtcacagtgaggttgatccctatgttgaaatagataacgttttgctgtttattgatctgctgttattgaaacctggtgcttataggcacttggtttacaactccatggtagtttccttggagtcattcaaagagcattataaggatcagaggaggaggttgccttatcacaagtcgactccaagattaaaggtctcgatcaaaaatatatttaactggtttaaaaaatatgacactataataagattgtgggtgttgttggttgtattcgaggtatatttgacttgggttgaagaggaagagatttatcacacaagagagcgggttcctttcaactccgtgacacttcagcttcttatgatatatgtcaataagtggaatgcccttcaacagtacatgttttttcttgcttattgtgtccttgataatgttttatttcatatgtttacactccgactggtcaaatcctggatgccttggggaaagactaccaattactcatctcaaattgtatcatatacaatactgttatctcagggtgtcaaaatatttcctattttgatgctgatatggccttatgacaacattatctcgatgtcaattaacaaatggatagctaacctatatttaattgaatcaatgaaaatagttacaaactcaagctatggttcaataatgcaattgctagtaattgttttccttttgaggttcacaattttgaatatccttgtactagccttactttcaatgatcacaggagataatttaatcaataatgtactcgtggttctatcacaaacctactttggattgagaacttttgtgagtgaacttctgtaa

SEQ ID NO: 10544 - protein, 308 aa, Candida glabrata CBS 138
MICIECSAPTETLYTEYSNKYVQLTECKNCHSEVDPYVEIDNVLLFIDLLLLKPGAYRHLVYNSMVVSLESFKEHYKDQRRRLPYHKSTPRLKVSIKNIFNWFKKYDTIIRLWVLLVVFEVYLTWVEEEEIYHTRERVPFNSVTLQLLMIYVNKWNALQQYMFFLAYCVLDNVLFHMFTLRLVKSWMPWGKTTNYSSQIVSYTILLSQGVKIFPILMLIWPYDNIISMSINKWIANLYLIESMKIVTNSSYGSIMQLLVIVFLLRFTILNILVLALLSMITGDNLINNVLVVLSQTYFGLRTFVSELL

SEQ ID NO: 10545 - DNA, 909 bp, Kluyveromyces lactis NRRL Y-1140
  CDS (1)..(909)
atgatatgtataaactgtggtcaccaagtggaatccttatatgtgatctattcgggggaccatattagacttaccgactgcccaaaatgctcccaagttgtggacaaatatgtggagtttgatccagtacttttgtccattgaccttttactactgaagaagggagcatatcgacatatgacattcaataaactggaattacagctaaggaaacatccggaatggaaaattagccgacaaaagctaagtacgtggaatcaattcaaagtttttgcaactaatgttagaaattggttaaagaaatatgatcaattgagcagattacaagttttccttgttgcattcgaagtgtatttaaattgggtcacagtggaaacgaaattttcgaagtatagtagtgaattcatgttttccaacaaattaatgatctacaatatacttgaaggatctgtctgggtacagtatctattcttctttgcgtatgtgatgattgaaatgattgtgctacacagcgtatttcaatatgttcttataaacagatggaattggggaaaggttttaaagtatcgtaaggacatagtatactatattttattaatttcgtatggtgcgaaaatcttccctattctaatgcttatatggccttacgatacattattgtccacggcgatcatcaaacttattgctaatatatatattatcgaagcagttcacattgttacccaaaagccatatttcaaaatatctattcttttgatctcaacgctactgctacaataccttcttgcacagactatactcataatcgtggtttctggatttgacatgtcagtgatgttgagttatataatgtctgaatatcggttgatattattcagaatgaacgctaagaagagtttgtatctatag

SEQ ID NO: 10546 - protein, 302 aa, Kluyveromyces lactis NRRL Y-1140
MICINCGHQVESLYVIYSGDHIRLTDCPKCSQVVDKYVEFDPVLLSIDLLLLKKGAYRHMTFNKLELQLRKHPEWKISRQKLSTWNQFKVFATNVRNWLKKYDQLSRLQVFLVAFEVYLNWVTVETKFSKYSSEFMFSNKLMIYNILEGSVWVQYLFFFAYVMIEMIVLHSVFQYVLINRWNWGKVLKYRKDIVYYILLISYGAKIFPILMLIWPYDTLLSTAIIKLIANIYIIEAVHIVTQKPYFKISILLISTLLLQYLLAQTILIIVVSGFDMSVMLSYIMSEYRLILFRMNAKKSLYL

SEQ ID NO: 10547 - DNA, 933 bp, Debaryomyces hansenii CBS767
  CDS (1)..(933)
atgatttgtgtcgaatgtacaaatcctgatattgactgtttgtattttagatataagagtgaatatatcaagttaaccatttgttcaaaatgtggaagagtagctgataaatatattgaatatgataatgttattttgtttcttgacataatgttgttaaaaccccaagcatacagacatttgacgtataatataactgaatctgagttattaaaagatgaagcgactcacaaaggatatataaaacgtaacgctagtcattcaactgttttcagtttgaagggatcgatattaaggtatagagcactaataagattcgtaacagtaatgatcctatttgaagtctatttaacatgtgcttacgaagagagaaaggataaacattcaattataatggcatttattttagaccaggaaatacaataccaatatctatttttcatattaaagctgatcctagaagaagcaacattaaatttttcaattcaatatttttcccataaattcttcaaatggggatctattgagagtaagaatatcaatgaacaatttcaaaatggatatcgtagatacgttttgttggtatctgtattagtttcaagttcaatcaagctatttccaatcctcatgctaatatggccgtacgatagaacaacaatttctacaacgattattaatgtaattggatttctaaatactactgaagcattgaagttggtcactaatatgaactatatatcaatcactgtcattttaggcatatcaacggctttaaaaaatttaatatctcgcagcatcctaggtgtactagtaagctatatgtcgaatagcaccatatcacaaatacaaaccagtgaatataatgaaactattgacctgttacgtaattctatagactttttacggagcttgaaagatagtttaattaattga

SEQ ID NO: 10548 - protein, 310 aa, Debaryomyces hansenii CBS767
MICVECTNPDIDCLYFRYKSEYIKLTICSKCGRVADKYIEYDNVILFLDIMLLKPQAYRHLTYNITESELLKDEATHKGYIKRNASHSTVFSLKGSILRYRALIRFVTVMILFEVYLTCAYEERKDKHSIIMAFILDQEIQYQYLFFILKLILEEATLNFSIQYFSHKFFKWGSIESKNINEQFQNGYRRYVLLVSVLVSSSIKLFPILMLIWPYDRTTISTTIINVIGFLNTTEALKLVTNMNYISITVILGISTALKNLISRSILGVLVSYMSNSTISQIQTSEYNETIDLLRNSIDFLRSLKDSLIN

SEQ ID NO: 10549 - DNA, 810 bp, Yarrowia lipolytica CLIB122
  CDS (1)..(810)
atgatctgtatagaatgtacagaaccggtgtcatcattatacacggagtactcaaccgataacattcgactcactgcatgctccaaatgtaacaaattcgccgacaaatacattgaacacgacggagtgctcatcttcatcgacctgctgctgctcaagaaacaggcctaccgacacctggtcttcaacgtgctcacacctgacacaagcccaagcacaaccaacgacaaccttcaccctcgagtacgacggctgtttctgctcatcaccctttttgaagtgtacctgacgtgggcacaggtggagaagggaccacaaacgccattaacgcgttacctcctgggactgcccattatcacacaatataactactttctcatcatctgtctgactgaggcagtcacatggcacatctcggtacgtgtcatggcaaggattctgttgggctggaaacgcccaaatgcattgtctacagcactactcatttcatcagcaacaaaactactgccgattctcatgatcatctgggactacgatgtgccccttgctgctgctctggtaggctgggctgtcaatttcaacgtcgttgaagccctcactatcgtattgagctgttcatacttcaaggctattctaataacagccatgtcaagtatagcaaagggagctgtttcgaggttcatttttatgcccattctactaaacgactgtgacgtcgagttcccaagtctggacgttagcgccatcggccaacccacactctttgctcaagtctttcaacttatcaagacctacgccgagcgtgtttaa

SEQ ID NO: 10550 - protein, 269 aa, Yarrowia lipolytica CLIB122
MICIECTEPVSSLYTEYSTDNIRLTACSKCNKFADKYIEHDGVLIFIDLLLLKKQAYRHLVFNVLTPDTSPSTTNDNLHPRVRRLFLLITLFEVYLTWAQVEKGPQTPLTRYLLGLPIITQYNYFLIICLTEAVTWHISVRVMARILLGWKRPNALSTALLISSATKLLPILMIIWDYDVPLAAALVGWAVNFNVVEALTIVLSCSYFKAILITAMSSIAKGAVSRFIFMPILLNDCDVEFPSLDVSAIGQPTLFAQVFQLIKTYAERV

SEQ ID NO: 10551 - DNA, 891 bp, Candida albicans SC5314
  CDS (1)..(891): transl_table=12
atgatctgtatagaatgtggatattctaatattgattgtttatattccaagtataaaagtgattatatcaaactaagtgtatgtcccgaatgtaataaaattgctgataaatatattgaatatgattcggtgattctatttttggacattttattacttaaaagacaagcctataaacatttagcatataatttaactgaaatggaaatggaaataggatcatcaactaatttccatataaatgataatacaaattttaaattctttcatacttatagaaaacttatgaaattgatatttatgattttatcatttgaagtttatttaacatgggctaatgaagagaaattattgattcattcacaattaattaatttaattttcaatcaatcagttgtatatcaatatttatttttcattattaaatcaagtctagaaaaccttatattgaatttatcattacaattgattctaagactaggatataaatggggacaaggtccacagaaaataaatggtaatatcagggataaagaattatttggatataaaacatcagtcttattggtaacaacgatggtatcagggtcaatcagattatttcctatattgatgtttatttggccatacgataacatatctatcactaaaccattgataaatttgattgcctttataaatatcgtggaggcactacgagttgtcacgagtttgggatacgtggaactaatactcagtttggcgtttagtattgttatcagaaatatagtgtcaaaactgttactagtactaattgtcagactctttttggattttaactttactgaggtgtattacaatgaaatgtatcaattatattcacagattcaaacctatatacgttggatttaa

SEQ ID NO: 10552 - protein, 296 aa, Candida albicans SC5314
MICIECGYSNIDCLYSKYKSDYIKLSVCPECNKIADKYIEYDSVILFLDILLLKRQAYKHLAYNLTEMEMEIGSSTNFHINDNTNFKFFHTYRKLMKLIFMILSFEVYLTWANEEKLLIHSQLINLIFNQSVVYQYLFFIIKSSLENLILNLSLQLILRLGYKWGQGPQKINGNIRDKELFGYKTSVLLVTTMVSGSIRLFPILMFIWPYDNISITKPLINLIAFINIVEALRVVTSLGYVELILSLAFSIVIRNIVSKSLLVLIVRLFLDFNFTEVYYNEMYQLYSQIQTYIRWI

SEQ ID NO: 10553 - DNA, 900 bp, Ashbya gossypii
  CDS (1)..(900)
atgatatgtatcaactgctgttgccatgtagagtcattgtatgttgcgtatcctggcgaccacatccgactgactgactgctggcaatgcggtgaggtggtggaccggtatgttgagttcgacaatgtgctgctcttcatcgatctgctgttgctgaaaccgggagcataccgccacctagtctacaactcgctggaggttgatatgcggcgataccccgagcacgggacgcgcgagagcgggttccggggctatgtgcaggactggcttctgtggttccgcaagtacgatcggttgaaccggatatggctgctactgatcacgtttgaggtgtacctgatgtggatgacggaggagaaaaagtacaacaactactaccgggagccggcgacgcagtacgggtggcacctgctgaccggggacgtgctgagcctgcaaaacccgctgctgcagtacctgttcttcgcagtgtacgtgatcggggacctcgcgttactgcacaaactgactcgcgaaagcctgttgaattggtcgcagtgggggcaagacctgcggtatgcgaaggacattgtgtcctacaccatcctactgtcgtacggggccaagatattcccgatcttgatgctgatctggccgtacgacagtttggtttcgaccagcatcatcaagtggattgccaacttctacattgtggagtcgctgcggattgtaacgagcaagtcgtactcatacatcattttgttgtttgcagggatctttattgtgcgcagtgtggttctgaagcctgtgcttgcactgatagtctcgcggggaaacatgttgcaggcccagcggtacctatggggggaatatgagttatttaagtttcgcttcttgacgaagagagacatcttcctataa

SEQ ID NO: 10554 - protein, 299 aa, Ashbya gossypii
MICINCCCHVESLYVAYPGDHIRLTDCWQCGEVVDRYVEFDNVLLFIDLLLLKPGAYRHLVYNSLEVDMRRYPEHGTRESGFRGYVQDWLLWFRKYDRLNRIWLLLITFEVYLMWMTEEKKYNNYYREPATQYGWHLLTGDVLSLQNPLLQYLFFAVYVIGDLALLHKLTRESLLNWSQWGQDLRYAKDIVSYTILLSYGAKIFPILMLIWPYDSLVSTSIIKWIANFYIVESLRIVTSKSYSYIILLFAGIFIVRSVVLKPVLALIVSRGNMLQAQRYLWGEYELFKFRFLTKRDIFL

SEQ ID NO: 10555 - DNA, 24 bp, Artificial sequence
  primer
atgatttgcataacgtgcatgcgg

SEQ ID NO: 10556 - DNA, 28 bp, Artificial sequence
  primer
ttataacaataaataagttcctgacttc

SEQ ID NO: 10557 - protein, 285 aa, Artificial sequence
  consensus sequence
  Variant (5)..(5): Xaa in position 5 is any amino acid
  Variant (7)..(12): Xaa in position 7 to 12 is any amino acid
  Variant (13)..(13): Xaa in position 13 is any or no amino acid
  Variant (16)..(17): Xaa in position 16 to 17 is any amino acid
  Variant (19)..(22): Xaa in position 19 to 22 is any amino acid
  Variant (24)..(24): Xaa in position 24 is any amino acid
  Variant (27)..(27): Xaa in position 27 is any amino acid
  Variant (29)..(30): Xaa in position 29 to 30 is any amino acid
  Variant (32)..(35): Xaa in position 32 to 35 is any amino acid
  Variant (37)..(37): Xaa in position 37 is any amino acid
  Variant (39)..(39): Xaa in position 39 is any amino acid
  Variant (41)..(41): Xaa in position 41 is any amino acid
  Variant (43)..(43): Xaa in position 43 is any amino acid
  Variant (45)..(45): Xaa in position 45 is any amino acid
  Variant (48)..(48): Xaa in position 48 is any amino acid
  Variant (50)..(50): Xaa in position 50 is any amino acid
  Variant (55)..(56): Xaa in position 55 to 56 is any amino acid
  Variant (62)..(63): Xaa in position 62 to 63 is any amino acid
  Variant (65)..(79): Xaa in position 65 to 79 is any amino acid
  Variant (80)..(106): Xaa in position 80 to 106 is any or no amino acid
  Variant (108)..(111): Xaa in position 108 to 111 is any amino acid
  Variant (113)..(119): Xaa in position 113 to 119 is any amino acid
  Variant (125)..(125): Xaa in position 125 is any amino acid
  Variant (127)..(129): Xaa in position 127 to 129 is any amino acid
  Variant (131)..(148): Xaa in position 131 to 148 is any amino acid
  Variant (149)..(179): Xaa in position 149 to 179 is any or no amino acid
  Variant (182)..(183): Xaa in position 182 to 183 is any amino acid
  Variant (185)..(208): Xaa in position 185 to 208 is any amino acid
  Variant (210)..(219): Xaa in position 210 to 219 is any amino acid
  Variant (220)..(237): Xaa in position 220 to 237 is any or no amino acid
  Variant (239)..(239): Xaa in position 239 is any amino acid
  Variant (241)..(243): Xaa in position 241 to 243 is any amino acid
  Variant (245)..(245): Xaa in position 245 is any amino acid
  Variant (251)..(251): Xaa in position 251 is any amino acid
  Variant (257)..(273): Xaa in position 257 to 273 is any amino acid
  Variant (274)..(274): Xaa in position 274 is any or no amino acid
  Variant (276)..(279): Xaa in position 276 to 279 is any amino acid
  Variant (282)..(284): Xaa in position 282 to 284 is any amino acid
MICIXCXXXXXXXLYXXYXXXXIXLTXCXXCXXXXDXYXEXDXVXLFXDXLLLKXXAYRHLXXNXXXXXXXXXXXXXXXXXXXXXXXXXXXXXXXXXXXXXXXXXXYXXXXRXXXXXXXFEVYLXWXXXEXXXXXXXXXXXXXXXXXXXXXXXXXXXXXXXXXXXXXXXXXXXXXXXXXQYXXFXXXXXXXXXXXXXXXXXXXXXXXXWXXXXXXXXXXXXXXXXXXXXXXXXXXXXLXSXXXKXFPILMXIWPYDXXXXXXXXXXXXXXXXXXEXXXXVTXXXY

SEQ ID NO: 10558 - protein, 48 aa, Artificial sequence
  protein pattern
  Variant (3)..(4): Xaa in position 3 to 4 is any amino acid
  Variant (6)..(6): Xaa in position 6 is any amino acid
  Variant (7)..(7): Xaa in position 7 is Gly, Asn, Ser or Thr
  Variant (8)..(8): Xaa in position 8 is Asp or Glu
  Variant (9)..(9): Xaa in position 9 is any amino acid
  Variant (11)..(11): Xaa in position 11 is any amino acid
  Variant (13)..(13): Xaa in position 13 is Ser or Thr
  Variant (14)..(14): Xaa in position 14 is any amino acid
  Variant (16)..(17): Xaa in position 16 to 17 is any amino acid
  Variant (19)..(19): Xaa in position 19 is Gly, Asn, Gln or Ser
  Variant (20)..(21): Xaa in position 20 to 21 is any amino acid
  Variant (22)..(22): Xaa in position 22 is Ala or Val
  Variant (24)..(24): Xaa in position 24 is Lys or Arg
  Variant (26)..(26): Xaa in position 26 is Ile or Val
  Variant (28)..(28): Xaa in position 28 is any amino acid
  Variant (30)..(30): Xaa in position 30 is Gly, Asn, Pro or Ser
  Variant (32)..(33): Xaa in position 32 to 33 is Ile or Leu
  Variant (34)..(34): Xaa in position 34 is any amino acid
  Variant (35)..(35): Xaa in position 35 is Ile or Leu
  Variant (37)..(37): Xaa in position 37 is Ile or Leu
  Variant (38)..(38): Xaa in position 38 is Leu or Met
  Variant (42)..(42): Xaa in position 42 is any amino acid
  Variant (43)..(43): Xaa in position 43 is Gly or Gln
  Variant (46)..(46): Xaa in position 46 is Lys or Arg
  Variant (48)..(48): Xaa in position 48 is Leu or Met
LYXXYXXXXIXLXXCXXCXXXXDXYXEXDXVXXXXDXXLLKXXAYXHX

SEQ ID NO: 10559 - protein, 29 aa, Artificial sequence
  protein pattern
  Variant (2)..(5): Xaa in position 2 to 5 is any amino acid
  Variant (6)..(12): Xaa in position 6 to 12 is any or no amino acid
  Variant (14)..(14): Xaa in position 14 is any amino acid
  Variant (15)..(15): Xaa in position 15 is Gly or Ser
  Variant (16)..(16): Xaa in position 16 is Ala, Ile or Val
  Variant (17)..(17): Xaa in position 17 is Lys or Arg
  Variant (18)..(18): Xaa in position 18 is Ile or Leu
  Variant (24)..(24): Xaa in position 24 is Phe or Leu
YXXXXXXXXXXXSXXXXXFPILMXIWPYD

SEQ ID NO: 10560 - protein, 17 aa, Artificial sequence
  protein pattern
  Variant (2)..(2): Xaa in position 2 is Phe, Ile or Leu
  Variant (3)..(4): Xaa in position 3 to 4 is any amino acid
  Variant (5)..(5): Xaa in position 5 is Phe, Leu or Val
  Variant (6)..(6): Xaa in position 6 is Ile, Leu or Met
  Variant (7)..(8): Xaa in position 7 to 8 is any amino acid
  Variant (11)..(11): Xaa in position 11 is Ile or Val
  Variant (14)..(16): Xaa in position 14 to 16 is any or no amino acid
RXXXXXXXFEXYLXXXT

SEQ ID NO: 10561 - protein, 23 aa, Artificial sequence
  protein pattern
  Variant (2)..(6): Xaa in position 2 to 6 is any amino acid
  Variant (7)..(7): Xaa in position 7 is any or no amino acid
  Variant (9)..(10): Xaa in position 9 to 10 is any amino acid
  Variant (11)..(12): Xaa in position 11 to 12 is any or no amino acid
  Variant (14)..(14): Xaa in position 14 is Ala or Ser
  Variant (15)..(15): Xaa in position 15 is Leu, Met or Val
  Variant (16)..(16): Xaa in position 16 is His, Lys or Arg
  Variant (17)..(17): Xaa in position 17 is Ile, Leu or Val
  Variant (20)..(20): Xaa in position 20 is Asn, Gln or Ser
  Variant (21)..(21): Xaa in position 21 is any amino acid
  Variant (22)..(22): Xaa in position 22 is Gly, Asn, Pro or Ser
IXXXXXXNXXXXEXXXXVTXXXY

SEQ ID NO: 10562 - DNA, 660 bp, Saccharomyces cerevisiae
  CDS (1)..(660)
atgtctgccccagctgctaacggtgaagttccaacattcaaactagttcttgtcggtgatggtggtactggtaagaccacttttgtcaagagacatttgaccggtgaattcgaaaagaagtacatcgccaccattggtgtcgaagtgcatcctttatccttttacaccaacttcggtgaaattaaatttgatgtctgggatactgccggccaagaaaaattcggtggtttaagagacggttactacattaacgcccaatgtgccatcatcatgttcgatgttacttccagaattacttacaagaacgttccaaactggcacagggatttagtccgtgtttgtgaaaacatcccaattgtcttgtgtggtaacaaggtcgatgtcaaagaaagaaaggtcaaggccaagactatcactttccacagaaagaaaaacttgcaatactacgatatttctgccaagtccaactacaactttgaaaagcctttcttatggttggccagaaaattggctggtaacccacaattagaatttgttgcttctccagctttagccccaccagaagtccaagtcgatgaacaattgatgcaacaataccaacaagaaatggaacaagctactgctttgccattgcctgatgaagatgatgctgatttataa

SEQ ID NO: 10563 - protein, 219 aa, Saccharomyces cerevisiae
MSAPAANGEVPTFKLVLVGDGGTGKTTFVKRHLTGEFEKKYIATIGVEVHPLSFYTNFGEIKFDVWDTAGQEKFGGLRDGYYINAQCAIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMQQYQQEMEQATALPLPDEDDADL

SEQ ID NO: 10564 - DNA, 657 bp, Aspergillus fumigatus
  CDS (1)..(657)
atgtctgctcctactacaccaactttcaagctcgtccttgttggtgacggtggtactggtaaggcaattcctaccaccttcgtcaagcgccaccttactggtgaattcgaaaagaagtacatcgcaaccctcggtgtcgaagtgcaccctctgaccttcaccaccaacctgggaacgattcagttcgatgtatgggacacagctggtcaggagaagttcggcggtctgagagatggatactacatcaacggccagtgtggtatcatcatgttcgatgtcacctcccgtatcacgtacaagaacgtccccaactggcaccgtgacctcgtccgtgtctgcgagaacatccccatcgttctctgcggcaacaaagtcgatgttaaggagcgcaaggtgaaagccaagaccattactttccaccgcaagaagaacctccagtactacgatatctcggccaagtccaactacaacttcgagaagcccttcctgtggctcgcccgcaagctagtcggcaacgccgccctggaattcgttgctgcccctgctcttgctcctcctgaggtcgctgtcaatccacagctcatggctgagtacgagaaggagatggagagtgctgctgccatgcctctgcccgacgaggaggatgctgatctgtaa

SEQ ID NO: 10565 - protein, 218 aa, Aspergillus fumigatus
MSAPTTPTFKLVLVGDGGTGKAIPTTFVKRHLTGEFEKKYIATLGVEVHPLTFTTNLGTIQFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLARKLVGNAALEFVAAPALAPPEVAVNPQLMAEYEKEMESAAAMPLPDEEDADL

SEQ ID NO: 10566 - DNA, 612 bp, Oryza sativa (japonica cultivar-group)
  CDS (1)..(612)
atgaatcccgagtacgactaccttttcaaacttctcctcattggtgattctggtgttgggaaatcgtgcttgcttctcagatttgcggatgactcatacctggacagctatatcagcacaattggagttgattttaaaatacggacagtagagcaggatgggaagaccatcaagcttcaaatctgggatactgctggacaagaacgtttcaggacgattacaagcagctattaccggggagctcatggaataattattgtatacgatgtgacagaccaagaaagcttcaacaatgtgaagcagtggttgaatgaaattgatcgttatgcaagtgacaatgtaaacaagctccttgttgggaacaagagcgacctaactgccaacaaagttgtgtcatctgaaacagctaaggcgtttgctgatgagatgggcatccccttcatggagacaagtgccaagaacgccactaatgtggagcaggccttcatggctatggccgcatccatcaaggacaggatggctagccaaccggccgcttcaaatgcaaggccaccgaccgtgcagatccgcgggcaacctgtcaaccagaagacgtcgtgctgctcgtcctaa

SEQ ID NO: 10567 - protein, 203 aa, Oryza sativa (japonica cultivar-group)
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVSSETAKAFADEMGIPFMETSAKNATNVEQAFMAMAASIKDRMASQPAASNARPPTVQIRGQPVNQKTSCCSS

SEQ ID NO: 10568 - DNA, 666 bp, Oryza sativa (japonica cultivar-group)
  CDS (1)..(666)
atggcgctcccgaatcagcagacggtggactaccccagcttcaagctcgtcatcgtcggcgacggcggcacgggcaaaaccacctttgtgaagaggcatttgactggcgagttcgagaagaagtatgagcctactatcggtgtggaggtccaccccttggatttcttcactaactgcggcaagatccgcttctactgctgggatacagctggtcaggagaaatttggtggactcagggatggttactatatccatgggcagtgtgctatcataatgttcgatgttacttctcggctgacgtacaagaatgtcccaacttggcaccgtgatttatgcagggtctgtgaaaacatcccaattgtgctctgtggtaacaaggttgatgtgaagaacaggcaggttaaagcaaagcaggttaccttccataggaagaagaacttgcagtactatgaggtgtcagctaagagcaactacaactttgagaagccattcctgtaccttgccaggaaacttgctggcgatggtaacctccactttgtggaaacacctgctcttgctcctccagatgtcacaattgatctagcagcccagcaacagcacgaggctgaactggcagcggctgcagcccaaccactgccagatgatgacgatgacctgatcgagtag

SEQ ID NO: 10569 - protein, 221 aa, Oryza sativa (japonica cultivar-group)
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEVSAKSNYNFEKPFLYLARKLAGDGNLHFVETPALAPPDVTIDLAAQQQHEAELAAAAAQPLPDDDDDLIE

SEQ ID NO: 10570 - DNA, 612 bp, Oryza sativa (japonica cultivar-group)
  CDS (1)..(612)
atggcggccaacgccggcaacaagatccgcaacgccaaactggttcttcttggagatgtgggcgcaggaaaatctagcttggtgcttcgttttgtaaaaggacagtttgttgagtttcaggaatcgacaattggagcagcatttttctcacagaccttagcagttaatgacgaaaccgtgaagtttgaaatctgggatacagctgggcaggagagatatcacagcttggctcccatgtactataggggtgcggctgctgccatagttgtctatgacatcacgaatccggcctctttcacccgtgcaaagaaatgggttcaagaacttcaagctcaaggtaactcgagtacagtggtggctcttgctggcaacaaagccgatttgctagagactaggcaggtgcaaatagaggaagcaaagacatatgcacaggagaatgggcttttcttcatggaaacatctgcgaaaactgcaacaaatgtgaatgacatattttatgaaattgcaaaaagattgcttcaaggacagccagctcagaacccgcaggccggcatggtcctctcccagagaccaaatgagagactggtcagctctgcttcatgctgctcttga

SEQ ID NO: 10571 - protein, 203 aa, Oryza sativa (japonica cultivar-group)
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNSSTVVALAGNKADLLETRQVQIEEAKTYAQENGLFFMETSAKTATNVNDIFYEIAKRLLQGQPAQNPQAGMVLSQRPNERLVSSASCCS

SEQ ID NO: 10572 - DNA, 654 bp, Oryza sativa (japonica cultivar-group)
  CDS (1)..(654)
atggcgtaccgggcggacgacgactacgactacctcttcaaggtggtgctcatcggggactccggggtcgggaagtcgaacctgctgtcccgcttcacgcgcaacgagttcagcctcgagtccaagtccaccatcggcgtcgagttcgccacccgcagcatccacgtcgacgacaaggtcgtcaaggcccagatctgggacaccgccgggcaagaaagatatcgagctattacaagcgcatactatcgcggagcagtaggggcactcgttgtctatgatgtcacgcgacatgtcacctttgagaatgtggagaggtggatgagggagctcaaggatcacacggacgccaacatcgtgatcatgcttgtggggaacaaggcagatttgcgccaccttagggctgtctcgactgaggatgcgaaagcatttgctgagaaagagaacactttcttcatggagacgtcggccctggagtcaatgaatgtggagaatgccttcactgaagtgctcacccagatatatcatgtagtgagcaagaaggctcttgacatcggcgatgacccagctgcaccaccaaaggggcagaccatcaatgttggtggcaaagatgatgtctctgcagtgaaaaagtctgcttgttgttcatcagcgtag

SEQ ID NO: 10573 - protein, 217 aa, Oryza sativa (japonica cultivar-group)
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELKDHTDANIVIMLVGNKADLRHLRAVSTEDAKAFAEKENTFFMETSALESMNVENAFTEVLTQIYHVVSKKALDIGDDPAAPPKGQTINVGGKDDVSAVKKSACCSSA

SEQ ID NO: 10574 - DNA, 666 bp, Oryza sativa (japonica cultivar-group)
  CDS (1)..(666)
atggcgctgccgaatcaggggaccgtggattaccccagcttcaagctggtcatcgtcggcgatggcgggactggtaaaactacatttgtgaagaggcatctcactggagagtttgaaaagaaatatgagccaaccattggtgtcgaagttcaccctctagattttaccaccaactgtggtaagatccgcttctactgctgggacactgctggacaagagaagtttggtggacttagggatggatactatatccatggtcaatgtgcgataattatgtttgatgtcacttcaaggctgacttacaagaatgttccaacatggcatagggacttgtgcagggtgtgtgaaaacatccccattgtcctgtgtggtaacaaggttgatgtgaagaacaggcaggttaaagccaagcaggtcacattccacaggaagaagaatctccagtactatgaaatttctgccaagagcaactacaactttgagaagcccttcctttatcttgcaaggaagcttgctggtgacccgaacctgcatttcgttgaagctgttgctcttaaacctccggaagttcccattgacctggcaatgcagcaacagcatgaggctgagcttgcggctgcagcagcacaacctctcccagatgacgatgacgatctgatcgagtag

SEQ ID NO: 10575 - protein, 221 aa, Oryza sativa (japonica cultivar-group)
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVPIDLAMQQQHEAELAAAAAQPLPDDDDDLIE

SEQ ID NO: 10576 - DNA, 651 bp, Oryza sativa (japonica cultivar-group)
  CDS (1)..(651)
atggcgggcggggagaaggtggactacgtgttcaaggtggtgctgatcggggactccgccgtcggcaagtcccagatcctcgcccgcttcgcccgcaacgagttctccatcgactccaaggccaccatcggcgtcgagttccagacccgcaccctcctcatcgaccacaagtccgtcaaggcccagatctgggacaccgccggccaggagaggtatagagctgtcacgagtgcatactacagaggagcattgggagctctcctagtctacgatatcaccaagcgccagagctttgatcacatccctcgctggctggaggagctccgtggccatgcggacaagaacatagtcatcatgctggttggcaacaagagcgatcttgaagacgagcgggccgtgagcaccgaggatgccaaggagtttgctgagaaggagaacctcttcttcctggagacctccgctctgcaggccaccaacgtcgagaacgccttccagaccgtcctgtcagagatattcaaaattcacagcaagaagaacatggcagcggacccaaaagcaaacggcgctgccccatcgctagcagggaagaaggtcgtcgtcccgggcccagcgcaggagatccccaagagcaagtgctgcagttccatgtga

SEQ ID NO: 10577 - protein, 216 aa, Oryza sativa (japonica cultivar-group)
MAGGEKVDYVFKVVLIGDSAVGKSQILARFARNEFSIDSKATIGVEFQTRTLLIDHKSVKAQIWDTAGQERYRAVTSAYYRGALGALLVYDITKRQSFDHIPRWLEELRGHADKNIVIMLVGNKSDLEDERAVSTEDAKEFAEKENLFFLETSALQATNVENAFQTVLSEIFKIHSKKNMAADPKANGAAPSLAGKKVVVPGPAQEIPKSKCCSSM

SEQ ID NO: 10578 - DNA, 612 bp, Arabidopsis thaliana
  CDS (1)..(612)
atgaatcctgagtacgactatcttttcaagctcctgcttatcggggattctggcgtaggcaagtcttgtcttcttttgagattctctgatgattcttatgtagaaagttacattagcactattggagtcgattttaaaattaggactgtggaacaagatggcaaaacaattaagctccaaatttgggacactgctggtcaagaacggttcaggactattactagcagttactaccgtggggcacatggaattattattgtctacgatgtcacagatgaagaaagcttcaataatgtcaagcaatggttgagtgaaattgatcgttatgctagtgacaatgtcaacaaactccttgttggaaacaagtctgatcttactgaaaacagagccattccttatgaaactgccaaggcttttgccgatgaaatcgggattccttttatggagactagtgcaaaagatgctacaaacgtagaacaggctttcatggcaatgtctgcatccatcaaagagagaatggctagccaaccagctgggaataatgcaagaccaccgaccgtgcagatcagaggacagcctgtggcacagaagaacggctgctgctcaacttga

SEQ ID NO: 10579 - protein, 203 aa, Arabidopsis thaliana
MNPEYDYLFKLLLIGDSGVGKSCLLLRFSDDSYVESYISTIGVDFKIRTVEQDGKTIKLQIWDTAGQERFRTITSSYYRGAHGIIIVYDVTDEESFNNVKQWLSEIDRYASDNVNKLLVGNKSDLTENRAIPYETAKAFADEIGIPFMETSAKDATNVEQAFMAMSASIKERMASQPAGNNARPPTVQIRGQPVAQKNGCCST

SEQ ID NO: 10580 - DNA, 669 bp, Arabidopsis thaliana
  CDS (1)..(669)
atggctttacctaaccaacaaaacgtcgatttaccaaccttcaaacttctcattgttggtgatggaggcactggaaaaaccacctttctcaagagacatctgactggggaatttgagcataatactgaacctactcttggtgtggatatttatcctttagatttcttcactaaccgcggcaagatccgtttcgaatgctgggatactgctggacaagagaaatatagtggtctcaaggatgcatactacatccatggtcaatgtgcgataattatgtttgatgtcacagcacggcacacatacatgaacattgatagatggtaccgtgatctccgcagggtgtgcaagaacattccgattgttctgtgtggtaacaaagttgatgtgccgagtagacaaatcaagccgaagcacgtatcgtaccacaggaagaagtgtctgcagtactatgagatgtctgcgaagaacaattgcaattttgagaaaccctttttgtatcttgctagaagaattgctggagacgcaaaactttcctttgtggagtcaccagaagctcaaattgataaccttgatgttgagtctctgcaattattaactgtagaggcgggaactcagccactcctaatgacgaggatatcatttgaatttaataccttatcgattgagtaa

SEQ ID NO: 10581 - protein, 222 aa, Arabidopsis thaliana
MALPNQQNVDLPTFKLLIVGDGGTGKTTFLKRHLTGEFEHNTEPTLGVDIYPLDFFTNRGKIRFECWDTAGQEKYSGLKDAYYIHGQCAIIMFDVTARHTYMNIDRWYRDLRRVCKNIPIVLCGNKVDVPSRQIKPKHVSYHRKKCLQYYEMSAKNNCNFEKPFLYLARRIAGDAKLSFVESPEAQIDNLDVESLQLLTVEAGTQPLLMTRISFEFNTLSIE

SEQ ID NO: 10582 - DNA, 645 bp, Encephalitozoon cuniculi GB-M1
  CDS (1)..(645)
atggagaggagagagttaacatacaagatatgtctgataggggatggaggagttggaaaaacaacgtacataaacagggtgcttgatggaaggtttgaaaagaactacaatgcaacagttggagcagtgaatcaccccgtgacgtttcttgacgaccaaggaaatgtaataaagtttaatgtgtgggacactgcggggcaggagaagaaggcggttctgaaggacgtatactacataggagccagcggagccatcttcttctttgatgtgacgtcgaggatcacgtgccagaaccttgcgcgatgggttaaggagttccaagcggttgttggtaacgaggcacctatagtcgtctgtgctaacaagatcgacataaagaataggcagaagattagtaagaagctggtgatggaggtgttgaagggaaagaactacgagtactttgagatcagcgcgaagactgcgcataacttcgggcttccgtttttgcacctggcaaggatctttaccggaaggccggatcttatatttgtgtcgaatgtgaatcttgagccaaccgaagtcaattacgactatcatagtcctgaggagtcgaaatacattgactacatggagcaggcgtcgaagatggctccagaggagtaa

SEQ ID NO: 10583 - protein, 214 aa, Encephalitozoon cuniculi GB-M1
MERRELTYKICLIGDGGVGKTTYINRVLDGRFEKNYNATVGAVNHPVTFLDDQGNVIKFNVWDTAGQEKKAVLKDVYYIGASGAIFFFDVTSRITCQNLARWVKEFQAVVGNEAPIVVCANKIDIKNRQKISKKLVMEVLKGKNYEYFEISAKTAHNFGLPFLHLARIFTGRPDLIFVSNVNLEPTEVNYDYHSPEESKYIDYMEQASKMAPEE

SEQ ID NO: 10584 - DNA, 651 bp, Magnaporthe grisea 70-15
  CDS (1)..(651)
atggccgaggctcagcaagtccccaccttcaagctggtgcttgtcggtgacggtggtaccggaaagaccaccttcgtcaaacgccacttgactggtgagttcgagaagaagtacatggccacccttggtgtggaggttcacccgctaggcttcgagacgaactttggcaagattcaattcgatgtgtgggacaccgcaggccaggagaagttcggtggtctgcgtgacggttactacatcaacggccagtgcggtatcatcatgtttgacgtcacatcccgcatcacctacaagaacgtccccaactggcaccgtgacttggttcgtgtgtgcgagaacatccctattgttctctgcggtaacaaggtcgacgtcaaggagcgcaaggtgaaggccaagaccatcaccttccacaggaagaagaacctgcagtattacgacatctcggccaagtcgaactacaacttcgagaagcctttcctgtggctcggccgcaagcttgttggcaaccccggtctggaattcgttgccgcccccgcccttgctccccccaccgccgaggtgaccgcagagcaggcggccgcgtacgagaaagaccttgcagatgctacgcgtgcgcccctgcccgatgatgatgatgaagacttctga

SEQ ID NO: 10585 - protein, 216 aa, Magnaporthe grisea 70-15
MAEAQQVPTFKLVLVGDGGTGKTTFVKRHLTGEFEKKYMATLGVEVHPLGFETNFGKIQFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLGRKLVGNPGLEFVAAPALAPPTAEVTAEQAAAYEKDLADATRAPLPDDDDEDF

SEQ ID NO: 10586 - DNA, 651 bp, Gibberella zeae PH-1
  CDS (1)..(651)
atggctgagcagcagacccctaccttcaagctcgtgcttgtcggtgacggtggtaccggaaagaccaccttcgtcaagcgtcacttgactggtgagttcgagaagaagtacatggccaccctcggtgtcgaggttcaccctcttggcttcaccaccaacttcggtcagatccagttcgatgtctgggataccgccggtcaggagaagttcggtggtctccgtgacggttactacatcaacggccagtgcggtatcatcatgttcgatgttacctcccgtatcacctacaagaacgtccccaactggcaccgtgatctcgtccgagtttgcgagaacattcccattgttctctgcggtaacaaggtcgatgtcaaggagcgcaaggtcaaggccaagaccatcactttccaccgaaagaagaacctccagtactacgatatctccgccaagtccaactacaacttcgagaagcccttcctctggctcgcccgcaagcttgtcggcaaccctcagcttgagttcgttgctgctcccgctttggctccccccactgcccaggtcgacgagaagctcctggaagagtaccgcaaggagatggacgaggccgccgccatgcctctgcctggtgagctttccgacgacgatctgtaa

SEQ ID NO: 10587 - protein, 216 aa, Gibberella zeae PH-1
MAEQQTPTFKLVLVGDGGTGKTTFVKRHLTGEFEKKYMATLGVEVHPLGFTTNFGQIQFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLARKLVGNPQLEFVAAPALAPPTAQVDEKLLEEYRKEMDEAAAMPLPGELSDDDL

SEQ ID NO: 10588 - DNA, 645 bp, Kluyveromyces lactis NRRL Y-1140
  CDS (1)..(645)
atgtctgctgaagttcctactttcaagctagttctagtcggtgatggtggtaccggtaagacaactttcgtcaagagacatttgactggtgaattcgagaagaagtacattgctaccatcggtgttgaagtgcatcctttggctttttacaccaactttggtgaaatcaaattcgatgtctgggataccgcaggtcaagaaaaattcggtggtctaagagatggttattatatcaatgctcaatgtggtatcattatgtttgatgtgacttccagaatcacctacaagaacgttccaaactggcacagagatttggttcgtgtttgtgaaaacattccaatcgttttgtgtggtaacaaggtcgatgtcaaggaaagaaaagttaaggccaagaccattaccttccacagaaagaagaacctacaatactacgatatctctgccaagtccaactataacttcgaaaagccattcttgtggttagccagaaagttggccggtaacccacaattggactttgttgcctctccagctttggctccaccagaagtccaagtcgatgagcaattgatgcaacaataccaacaagaaatggaacaagccactgctttgccattgcctgatgaagatgatgctgatttgtaa

SEQ ID NO: 10589 - protein, 214 aa, Kluyveromyces lactis NRRL Y-1140
MSAEVPTFKLVLVGDGGTGKTTFVKRHLTGEFEKKYIATIGVEVHPLAFYTNFGEIKFDVWDTAGQEKFGGLRDGYYINAQCGIIMFDVTSRITYKNVPNWHRDLVRVCENIPIVLCGNKVDVKERKVKAKTITFHRKKNLQYYDISAKSNYNFEKPFLWLARKLAGNPQLDFVASPALAPPEVQVDEQLMQQYQQEMEQATALPLPDEDDADL

SEQ ID NO: 10590 - DNA, 627 bp, Kluyveromyces lactis NRRL Y-1140
  CDS (1)..(627)
atgaattcaaacgttacgtctatcaagttggtactcctaggagaagctgcggtggggaaatcttccattgttttgcgctttgtgtccaatgattttgctgagaataaagaacccactattggagcagcctttctaacacagcgagtaaatatggctgaccacacaataaagtttgaaatctgggatactgctggtcaggaaagatttgcatcgttggccccaatgtattatagaaatgctcaagcagctttagtggtttatgatgtaacaaagccgcagtcatttatcaaggctcgccactgggtaaaagaattacacgaacaagcgagcaaagggattgtaatcgcattggttggaaataagatggatttgttggaatctgaagaggataggaaagtagccaaagaagaggctgaaaaattgtcacaggaagagaaccttttattcttcgagactagcgctaagactggtgataacgtcaacgaagtgttcttggccattggagagaaaatacccttaaagaagtcggatgggtccaataccgatgggttacgtggaacagaagatggaaggatcgacttgaacaaacccgatgatacctcgaatcccaactcatgtggttgttaa

SEQ ID NO: 10591 - protein, 208 aa, Kluyveromyces lactis NRRL Y-1140
MNSNVTSIKLVLLGEAAVGKSSIVLRFVSNDFAENKEPTIGAAFLTQRVNMADHTIKFEIWDTAGQERFASLAPMYYRNAQAALVVYDVTKPQSFIKARHWVKELHEQASKGIVIALVGNKMDLLESEEDRKVAKEEAEKLSQEENLLFFETSAKTGDNVNEVFLAIGEKIPLKKSDGSNTDGLRGTEDGRIDLNKPDDTSNPNSCGC

SEQ ID NO: 10592 - DNA, 645 bp, Debaryomyces hansenii CBS767
  CDS (1)..(645)
atggctcaagaagttccaactttcaagttagttttagtcggagatggtggtaccggtaagaccacattcgtcaagagacatttaacgggtgaattcgaaaagaaatacattgctactttaggggtcgaagtccacccattaggattccacaccaactttggggaattgaagttcgatgtgtgggacactgctggtcaagaaaagttcgggggattaagagatggatactacatcaacggacaatgtgggatcattatgttcgatgtgacatcaagaatcacttataagaatgttccaaactggcatagagatttggtcagagtgtgtgaaaacattccaattgtgttgtgtggtaataaggttgatgtcaaggaacgtaaggttaaggccaagaccatcactttccacagaaagaagaacttgcaatactacgatatctctgccaaatccaactataacttcgaaaagccattcttgtggttggccagaaagttggttggtaaccctcaattagaattcgttgcttctccagcattggctccaccagaagtccaagttgatgctgacttgatgcaaagatatcaacaagaaatggaacaagccactgccttgccattgcctgatgaagatgatgctgatttgtag

SEQ ID NO: 10593 - protein, 214 aa, Debaryomyces hansenii CBS767
MAQEVPTFKLVLVGDGGTGKTTFVKRHLTGEFEKKYIATLGVEVHPLGFHTNFGELKFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLARKLVGNPQLEFVASPALAPPEVQVDADLMQRYQQEMEQATALPLPDEDDADL

SEQ ID NO: 10594 - DNA, 630 bp, Yarrowia lipolytica CLIB122
  CDS (1)..(630)
atgtctgcccccagaaaaaccaccagcgtcaaactggtgctgctcggcgaggccgcggtcggcaagtcgtcgctggtgctgcggttcgtcagcaacgagttccaggaaaacaaagagcccaccatcggcgcagccttcctcacacaaaagtgcaacttccccgaccgcacaatcaaatttgaaatctgggacacggccggacaggagcgattcgcctctctggcgcccatgtactatcgaaacgcccagaccgcgctcgtggtctatgacatcaccaagcctcagtcattcatcaaggcccgacactgggtcagcgagctcaagtcccaggcatctccaggcatcatcattgccctggtcggcaacaagcgagatctggtggacgacgacgagtctgcccgaaaggtggcggaggacgagggcaagcagctcgccgaggaggagggtctgctcttttttgaaacctcggcaaagaccggcctcaacgtcaaggacgtgttcatggccattgcccagaagattcccgaggagcagaaggcgccatctggaggcctcagaggagcagaggaggacagcagggtcgacctcaactcggccgtcgctggccccgaaagcagctgtgcttgttag

SEQ ID NO: 10595 - protein, 209 aa, Yarrowia lipolytica CLIB122
MSAPRKTTSVKLVLLGEAAVGKSSLVLRFVSNEFQENKEPTIGAAFLTQKCNFPDRTIKFEIWDTAGQERFASLAPMYYRNAQTALVVYDITKPQSFIKARHWVSELKSQASPGIIIALVGNKRDLVDDDESARKVAEDEGKQLAEEEGLLFFETSAKTGLNVKDVFMAIAQKIPEEQKAPSGGLRGAEEDSRVDLNSAVAGPESSCAC

SEQ ID NO: 10596 - DNA, 657 bp, Aspergillus nidulans FGSC A4
  CDS (1)..(657)
atggcatccagagccgcagcaggcgcccgtccaggtgctaggttcgctcagttcaagctcgttctcctcggagaatctgccgtaggaaagagctcattagtcctgagatttgttaaggaccaattcgacgactatcgagaatcaacaatcggtgccgcattcctgacacaaaccatttcgctggatgaaagtacaacagtgaaatttgagatctgggataccgccggtcaagaaagatacaagtccttggctcccatgtactaccggaatgcgaactgtgctgtcgttgtatatgatatcactcaagcttcatcgctagacaaagccaaatcatgggtcaaggaattacaacgccaggcaaacgaaaatattgtcatcgccctcgcaggcaacaagcttgatcttgttaccgagaaccccgacaagagggctatccccactgctgatgctgaagcatatgcgcgcgaagccggtcttcttttcttcgagacttccgctaaaacgtcttcaaatgtgcgcgaactcttcacagccatcgcaaagaagcttccacttgatcaagctggaccccgaaacatgcgaacagcacctcgccctggtgtagatctccgaccggaagcaccgggaacccaaagtggcggagcgtgtaattgttag

SEQ ID NO: 10597 - protein, 218 aa, Aspergillus nidulans FGSC A4
MASRAAAGARPGARFAQFKLVLLGESAVGKSSLVLRFVKDQFDDYRESTIGAAFLTQTISLDESTTVKFEIWDTAGQERYKSLAPMYYRNANCAVVVYDITQASSLDKAKSWVKELQRQANENIVIALAGNKLDLVTENPDKRAIPTADAEAYAREAGLLFFETSAKTSSNVRELFTAIAKKLPLDQAGPRNMRTAPRPGVDLRPEAPGTQSGGACNC

SEQ ID NO: 10598 - DNA, 654 bp, Ustilago maydis 521
  CDS (1)..(654)
atgtctgccgcgaacctggaagtttcccagttcaagctcgtcctcgtcggtgacggtggtaccggcaagaccaccttcgtcaagcgtcacttgaccggagagttcgagaagaagtacattgccacactcggtgttgaggtacacccgcttcagttccacaccaacctcggtcccatctgcttcaacgtctgggacactgcgggacaggagaagtttggtggtctgcgtgatggatactacatccagggtcaatgcggtatcatcatgttcgacgtgacttcgcgtattacctacaagaacgtgcccaactggcaccgtgatttggagcgcgtctgcgagaacatccccattgttctttgcggtaacaaggttgatgtcaaggagcgcaaggtcaagaccggtgcggttaccttccaccgcaagaagaacttgcagtactttgaaatctcggccaagtccaactacaacttcgaaaagcctttcctctggttggcgcgaaagctcgtcggcaaccacgctctcgagttcgctgctgctcccgctcttgctccccccgaggtccaggtcgaccaggccctcatggctcaatacgacgccgaactccagcgcgctgctgctgctcctctgcccgatgaggacgacggtgatctctaa

SEQ ID NO: 10599 - protein, 217 aa, Ustilago maydis 521
MSAANLEVSQFKLVLVGDGGTGKTTFVKRHLTGEFEKKYIATLGVEVHPLQFHTNLGPICFNVWDTAGQEKFGGLRDGYYIQGQCGIIMFDVTSRITYKNVPNWHRDLERVCENIPIVLCGNKVDVKERKVKTGAVTFHRKKNLQYFEISAKSNYNFEKPFLWLARKLVGNHALEFAAAPALAPPEVQVDQALMAQYDAELQRAAAAPLPDEDDGDL

SEQ ID NO: 10600 - DNA, 666 bp, Ustilago maydis 521
  CDS (1)..(666)
atggccgctgctccaaggaaccctcgtcagcttcagttcaagctcgtcctgctcggcgagtcggctgttggcaagtcgagtttggtccttagatttgtcaaggaccaattcgacgactatcgcgagagcaccatcggagctgctttcctcacgcaaactgtcagcctcgatgcacagaccaccgtcaagttcgagatctgggataccgcgggacaagagcgatacaagtcgctcgcacccatgtactaccgtaatgccaactgcgctgtggtagtgtacgacatcacgcagccttcgtcgctcgacaaggccaaagcgtggatccgcgaacttcagcgtcaagctgaccccaatatcatcattgccctggcaggcaacaaggcggatttggcgagcacacgccgtgctatccccaccgaagaggccgaaaagtacgcacaggaagagggtcttctcttcctcgagacttcggccaagaactcgtccaacgtctcggagctgtttaccatgatcgcgcgcaagctgccgacagagcaggcagccgaatcgcagcgcagcggcgccggtcgagcgggcgcaggagctgccggtgcgggaggcgcgagaccaggtgtggaccttagagggcagcaaggaggtcaagagcaggacgcttgcaactgttga

SEQ ID NO: 10601 - protein, 221 aa, Ustilago maydis 521
MAAAPRNPRQLQFKLVLLGESAVGKSSLVLRFVKDQFDDYRESTIGAAFLTQTVSLDAQTTVKFEIWDTAGQERYKSLAPMYYRNANCAVVVYDITQPSSLDKAKAWIRELQRQADPNIIIALAGNKADLASTRRAIPTEEAEKYAQEEGLLFLETSAKNSSNVSELFTMIARKLPTEQAAESQRSGAGRAGAGAAGAGGARPGVDLRGQQGGQEQDACNC

SEQ ID NO: 10602 - DNA, 630 bp, Ustilago maydis 521
  CDS (1)..(630)
atgccgaaccctcactatgactttctcatcaagcttttgctgatcggtgactcgggcgtcggaaagtcgtgcctactgctgcgattctgcgacgatgcttggactccgtcgttcatcacgacgattggcattgacttcaagatccgcacgatcgagctggacggaaaacgcatcaagctgcagatctgggacacggctggccaggagcgattccgcaccatcaccaccgcctactaccgtggagcgatgggcatcttgctcgtgtttgacgtgaccgaccaaaagtcgtttgaaaacgtacgaacgtggcatgccaacattgagcaacacgcgagcgaaggcgtttccaagatcctgatcggcaacaagtcggactgggaggagaagcgcgcagtgacgaccgagcagggtgaagaactcgccaaggagctcggtatcccttacatcgagacatcagccaagtccaactcgaatgtagaagaagccttcttcaacttggcgcgagaggtcaagacgcgactcatcgacacagcagcagtcacccaagcgtcgccagcagcggcagcgggtaatgttaatgttaactcggcacccaagtcgggagctgctggtggtggttgctgtagctag

SEQ ID NO: 10603 - protein, 209 aa, Ustilago maydis 521
MPNPHYDFLIKLLLIGDSGVGKSCLLLRFCDDAWTPSFITTIGIDFKIRTIELDGKRIKLQIWDTAGQERFRTITTAYYRGAMGILLVFDVTDQKSFENVRTWHANIEQHASEGVSKILIGNKSDWEEKRAVTTEQGEELAKELGIPYIETSAKSNSNVEEAFFNLAREVKTRLIDTAAVTQASPAAAAGNVNVNSAPKSGAAGGGCCS

SEQ ID NO: 10604 - DNA, 666 bp, Pisum sativum
  CDS (1)..(666)
atggccttgcctaatcagcaaacgattgattatcctagtttcaagcttgtgatcgtcggtgacggtggcacaggaaaaacaactttcgtaaagaggcatcttactggagaatttgagaagaaatatgaaccaactattggtgttgaagtgcatccattggatttcttcacaaactgtggtaagattcgtttctactgctgggatactgctggtcaagagaagtttggtggtctcagagatggatactatattcatggacagtgtgctattataatgtttgatgttactgcacggctgacatacaagaatgtccctacttggcaccgtgatctttgccgggtctgtgaaaacatcccaattgttctttgtggaaacaaggttgatgtgaagaacaggcaagtgaaggcaaagcaggttaccttccacaggaagaaaaatttgcagtactatgaaatatcagctaagagcaactacaactttgagaagcctttcctgtatcttgccaggaaacttgcaggtgatcctaatttgcactttgtagaatctcctgcactggctccaccagaagttcaaattgatattgctttacaacaaaggcatgagaatgagattcttgaggctgctaatcagccccttcctgatgatgatgacgatgcttttgaatag

SEQ ID NO: 10605 - protein, 221 aa, Pisum sativum
MALPNQQTIDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDIALQQRHENEILEAANQPLPDDDDDAFE

SEQ ID NO: 10606 - DNA, 919 bp, Daucus carota
  CDS (18)..(668)
gaaagtacacacacacaatggctgctccgcccgctagacctcgagccgattacgattaccttatcaagcttcttttgatcggtgacagcggtgtgggtaagagttgcctccttttacgattctcagatggttctttcaccactagttttattacaaccattggtattgattttaagataagaacaattgagatggacggaaaacgaattaaactgcaaatctgggatactgcgggtcaggaacggttcagaacaattactactgcttattaccgtggagccatgggtattttgctggtgtatgatgtaactgatgaatcttccttcaacaatatcaggaactggatccgtaacattgaacaacatgcttctgataatgtaaacaagatcctggtgggcaacaaagctgacatggatgaaagcaaaagggctgttcccacctcaaaggggcaggcacttgctgatgaatatggcattaagttcttcgaggctagtgcaaagacgaatatgaatgtagaagaggttttcttttcaattgccaaggatataaagcaaagacttgctgaaactgattcaaagaccgagccgcaaactattaagatcaaccaacaagagcagggagcagggacctctgcagcttcacaaaaatcagcttgctgtggttcttaatagatattcatctgtggcgaaaagttgattactgtggtatactagagaagaaagttgaataccgcggtggtaaggagattttgttttgttttgattgcttgtattgttcgcactagaaccataattattacaaagttgtgtttgagcaatagttcctattttaagaatcaaacagtataggagttttacttgtttagttcattatactgtatgtccttgcagtgtgcaagtaggcagcctcttctttgttc

SEQ ID NO: 10607 - protein, 216 aa, Daucus carota
MAAPPARPRADYDYLIKLLLIGDSGVGKSCLLLRFSDGSFTTSFITTIGIDFKIRTIEMDGKRIKLQIWDTAGQERFRTITTAYYRGAMGILLVYDVTDESSFNNIRNWIRNIEQHASDNVNKILVGNKADMDESKRAVPTSKGQALADEYGIKFFEASAKTNMNVEEVFFSIAKDIKQRLAETDSKTEPQTIKINQQEQGAGTSAASQKSACCGS

SEQ ID NO: 10608 - DNA, 660 bp, Ostreococcus tauri
  CDS (1)..(660)
atgagcgcaccgccgagcaacacgccgacgtttaagctcatcctcgtcggtgacggtggcaccgggaagacgacgttcgtgaagcgtcacttgactggagagtttgagaagaaatatttgcccacggtgggcgtgagcgtgcacccgttggacttccacacgaactgcggtcccattcgcttcgactgctgggatacggcgggacaggaaaagtttggtggcttgcgtgatgggtactacattcacggacagtgcgcgatcatcatgttcgacgtgacgtcgcggacgacgtataagaatgtgccgacgtggcaccgcgacatcacgcgcgtgtgcgaagacattccgatcgtgttgtgcgggaataaggtcgacgtgcgcaaccgccaggtgcgcgctaagtcgatcacgttccaccggaagaagaacttgcagtactacgagttgtcggccaagtcaaactacaactttgaaaagccgttcttgtacctcgcgcgcaagttaagcggtaacccgcagcttcaatttaccgaatccccggcgctcgcgccgccgaccgtcaccgtcgatttggcggaggtggcggcgtacgagaaggagctcgcggacgccgcggcgcagccgttgccggatgaggacgacgagttgctcgacgcgtag

SEQ ID NO: 10609 - protein, 219 aa, Ostreococcus tauri
MSAPPSNTPTFKLILVGDGGTGKTTFVKRHLTGEFEKKYLPTVGVSVHPLDFHTNCGPIRFDCWDTAGQEKFGGLRDGYYIHGQCAIIMFDVTSRTTYKNVPTWHRDITRVCEDIPIVLCGNKVDVRNRQVRAKSITFHRKKNLQYYELSAKSNYNFEKPFLYLARKLSGNPQLQFTESPALAPPTVTVDLAEVAAYEKELADAAAQPLPDEDDELLDA

SEQ ID NO: 10610 - DNA, 782 bp, Pisum sativum
  CDS (8)..(616)
caccgccatgaatcctgaatatgattatttgttcaagcttttgttgattggagattctggtgtgggcaagtcatgtctcctcctgaggtttgctgatgattcataccttgacagctatatcagtaccattggagtggactttaaaatacgcactgttgagcaagacgggaagaccattaaacttcaaatttgggacactgctggtcaagaacgtttccgtactatcactagcagctactaccgtggggctcatggcataattgttgtttatgatgtcactgaccaagagagcttcaacaatgttaagcagtggctgaatgaaatcgaccgctatgcaagtgaaaacgttaacaagcttctagttggaaacaagagtgatctagcggataataaagttgtgtcctctgaaacagcaaaggcatttgcagatgaaattggaattcctttcatggaaactagtgctaaaaatgccaacaatgtggaacaggctttcatggccatggctgctgaaataaaaaacagaatggctagtcaaccatcaaacaatgccaggcctccaacagttcaaattcgaggacagccagtgaaccagaagtctggttgctgctcgtcttagagactaaatattcatggtcttagacggacatatgtgtctctgtggcatgcaaaattagttctcacataatgcttttatatgaagattgttcgccgtgatttaatctttatcattcagctcgttgttaaaactttcattcttttcaatgtatttgattctaaaaaaa

SEQ ID NO: 10611 - protein, 202 aa, Pisum sativum
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKSDLADNKVVSSETAKAFADEIGIPFMETSAKNANNVEQAFMAMAAEIKNRMASQPSNNARPPTVQIRGQPVNQKSGCCSS

SEQ ID NO: 10612 - DNA, 864 bp, Pisum sativum
  CDS (69)..(680)
cgtggagcaccgatccgatcactctccctccgtaattcaccctctccggccatttctccttccccgtcatgaatcccgaatatgattatctgttcaagctccttcttattggagactctggtgttggtaaatcgtgccttcttctaagatttgctgatgattcatacattgaaagctacataagcactattggagttgattttaaaatacggactgttgagcaggatgggaagacaattaaactacagatttgggataccgccggacaagaacgatttaggacaataaccagtagctactatcgtggggcacatggaatcattattgtttatgatgtgacagatgaagagagcttcaataatgtgaagcagtggctcagtgaaattgaccgctatgccagtgataatgttaacaagcttttggttggaaacaagagtgatctgacagcaaatagagttgtatcatatgatacagccaaagaatttgcagatcaaatcggcataccttttatggaaacaagtgcaaaagatgctacaaatgtggaaggggcattcatggccatggctgctgccatcaaggatagaatggcgagccaaccatccgcaaacaatgcaaggcctccaacagtgcagattagaggacaaccagttgggcaaaaaggtgggtgctgctcttcctaaccagatcgcatttcagttattggtctgctgcttgctgcccttttcatgtaagatttgttctgtcactaaatagtggaccaatgtcacataatccatcgcgtggtttcagaattgacttagattatcccattctttacatacacttgaatggtatgtttgtgctaagtatagtacttgtgttaat

SEQ ID NO: 10613 - protein, 203 aa, Pisum sativum
MNPEYDYLFKLLLIGDSGVGKSCLLLRFADDSYIESYISTIGVDFKIRTVEQDGKTIKLQIWDTAGQERFRTITSSYYRGAHGIIIVYDVTDEESFNNVKQWLSEIDRYASDNVNKLLVGNKSDLTANRVVSYDTAKEFADQIGIPFMETSAKDATNVEGAFMAMAAAIKDRMASQPSANNARPPTVQIRGQPVGQKGGCCSS

SEQ ID NO: 10614 - DNA, 811 bp, Pisum sativum
  CDS (61)..(669)
tccggagacaactcaccgatctccgccgtctaatcaactcttccttaaactttatcagagatgaatcctgagtatgattatctgttcaagcttcttcttattggagactctggtgtcggcaaatcatgccttcttctgagatttgctgatgattcttacattgatagctacataagcaccattggagttgattttaaaatccgtaccgttgagcaggatgggaagactattaagctccagatttgggatacagctggccaagaacgatttaggacaatcaccagtagctactaccgtggggcacatggaatcattattgtttatgatgtgacagatgaagagagcttcaataatgtgaagcaatggctcagtgaaattgaccgctatgctagtgataatgttaacaagctcttggttggcaacaagtgtgatctgacagaaaatagagctgtgccgtatgaaacagctaaagcatttgcagatgaaataggcatacctttcatggagactagtgcaaaggattctacaaatgtcgaacaggcatttatggcaatggcttcttccatcaaggaaagaatggcaagccaacctacaaacaatgcaaggcctccaacagtgcagataaggggacagccagttggtcagaaaagtgggtgctgctcatcttaaccacaatatatcttctgatctatttcatttggtctactgatcattgcatgtaagaattttttttttgctatgttattatatgactaaaatagtggaccaatgtaagaatttgtctggtggtttggaactgacctagatgatc

SEQ ID NO: 10615 - protein, 202 aa, Pisum sativum
MNPEYDYLFKLLLIGDSGVGKSCLLLRFADDSYIDSYISTIGVDFKIRTVEQDGKTIKLQIWDTAGQERFRTITSSYYRGAHGIIIVYDVTDEESFNNVKQWLSEIDRYASDNVNKLLVGNKCDLTENRAVPYETAKAFADEIGIPFMETSAKDSTNVEQAFMAMASSIKERMASQPTNNARPPTVQIRGQPVGQKSGCCSS

SEQ ID NO: 10616 - DNA, 537 bp, Phaeosphaeria nodorum
  CDS (1)..(537)
atggccgaagctgccgcagcaggcaacgtgcccaccttcaagcttgtgcttgtcggtgatggcggtaccggaaagaacctcggccccatccagttcgacgtctgggacactgcaggtcaggaaaagttcggtggtctccgtgatggatactacatcaacggccagtgcggtatcatcatgttcgacgtcacctcgcgtatcacatacaagaacgtccccaactggcaccgtgacttggtccgtgtttgcgagaacatccccattgtccttaccggcaacaaggtcgacgtaaaggagcgcaaggtcaaggccaagtccatcaccttccaccgcaagaagaacctccagtactacgacatctcggccaagtccaactacaacttcgagaagcccttcctctggctcgccaggaaactcgtcggcaaccagaccctgagcggcacccggctcggccatacactcattcagtcattacatttccaagattttcgagggctacagcgccggccctgtggtttcaacgcccgcataccatga

SEQ ID NO: 10617 - protein, 178 aa, Phaeosphaeria nodorum
MAEAAAAGNVPTFKLVLVGDGGTGKNLGPIQFDVWDTAGQEKFGGLRDGYYINGQCGIIMFDVTSRITYKNVPNWHRDLVRVCENIPIVLTGNKVDVKERKVKAKSITFHRKKNLQYYDISAKSNYNFEKPFLWLARKLVGNQTLSGTRLGHTLIQSLHFQDFRGLQRRPCGFNARIP

SEQ ID NO: 10618 - DNA, 780 bp, Medicago truncatula
  CDS (1)..(780)
atgagtcgttctcaaattgaagtagatccagaattgcaaccgatgatttgggactttcctataaatcaaagagatgaaattcgttgtgcctatcttaaacatgggccatgccaacctattcttagaacatatcctttatcaaatgatgatcatcctcgtcgttttcaagcttcttggtttcaattatttccttattgcttcgccgctggaaccggaaaaaccacttttgttaaaaggcatctaactggcgaatttgagagagagaaatatgaacacttttatacaaattgtggaaaaattcggtttaattgctgggacactgctggccaaggaaaatttggtggtctcagagatgcttattacactcaaggacaatgtgctattattatgttcgatgtaactgctcgtttgacatacaaaaatgttccgacatggcacggagatatcactcgtgtgtgtgagaatatacccattgtcctgtgtggaaacaaggttgatgtgaagaatagacagatcaaagcaaagcaagttatatttcacaggaagaagaatctacaatactatgaaatatctgcaaagagtaactataatttcgagaaacctttcttataccttgccaagaaacttgcaggtaatatgaaccttcactttgtggagatgcctgctcttgctcctcctgaagtcgcctttgatatagctgcgcaagaatcgattgaacaagaaatatgtatgccagcatttcagcctcttcctgatggcgatgatgaagcatttgagtaa

SEQ ID NO: 10619 - protein, 259 aa, Medicago truncatula
MSRSQIEVDPELQPMIWDFPINQRDEIRCAYLKHGPCQPILRTYPLSNDDHPRRFQASWFQLFPYCFAAGTGKTTFVKRHLTGEFEREKYEHFYTNCGKIRFNCWDTAGQGKFGGLRDAYYTQGQCAIIMFDVTARLTYKNVPTWHGDITRVCENIPIVLCGNKVDVKNRQIKAKQVIFHRKKNLQYYEISAKSNYNFEKPFLYLAKKLAGNMNLHFVEMPALAPPEVAFDIAAQESIEQEICMPAFQPLPDGDDEAFE

SEQ ID NO: 10620 - DNA, 666 bp, Medicago truncatula
  CDS (1)..(666)
atggctttgcctaatcagcaaaccgttgattatcctagtttcaagcttgttatcgtcggtgacggtggcactggaaagacaactttcgtcaagaggcatcttactggagagttcgagaagaaatatgaacctacaattggtgtggaagtgcatccattggatttcttcacaaactgcggaaagattcggttctactgctgggatactgctggacaagagaagtttggtggcctcagagatggatactatatccatgggcagtgtgctattataatgtttgatgttacagcccgactgacatacaagaatgtccctacctggcaccgtgatctttgccgggtttgtgaaaacatcccgattgttctctgtggtaataaggttgatgtgaagaacagacaagtaaaggcaaagcaggttaccttccacaggaagaagaatttgcagtactatgagatttcagctaagagcaactataactttgagaagcctttcctttaccttgccaggaaacttgcaggggatcctaacttgcactttgtagaatctcctgcattggctccaccagaagttcaaattgatttagctgcacaacaagtacatgagaatgagcttctccaagctgctaatcaaccccttcctgatgacgatgatgatgcttttgagtaa

SEQ ID NO: 10621 - protein, 221 aa, Medicago truncatula
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLAAQQVHENELLQAANQPLPDDDDDAFE

SEQ ID NO: 10622 - DNA, 666 bp, Medicago truncatula
  CDS (1)..(666)
atggctttgcccaatcagcaaaccgttgattacccgagcttcaagcttgtcatcgtcggcgatggcggcactggaaagacaacatttgtgaagaggcatcttaccggagaatttgagaagaaatatgaacctacaattggtgtggaagtgcatccattggatttcttcacaaactgcggcaagattcgcttctactgctgggatactgctggacaagagaagtttggtggcctcagagatggatactatatccacgggcaatgtgctattataatgtttgatgttactgcccgtctaacatacaaaaatgttcctacctggcaccgtgatctttgtcgggtctgtgaaaacatcccaattgttctttgcggtaacaaggttgatgtgaaaaacaggcaagtgaaggcaaagcaggttaccttccacaggaagaagaatttgcagtactatgagatttcagctaagagcaactataactttgagaagcctttcctttaccttgccaggaaacttgcaggggatcctaacttgcactttgtagaatctcctgcattggctccaccagaagttcaaattgatttagctgcacaacaagtacaagagaatgagcttctccaagctgctaatcaaccccttcctgatgacgatgatgatacatttgagtag

SEQ ID NO: 10623 - protein, 221 aa, Medicago truncatula
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLAAQQVQENELLQAANQPLPDDDDDTFE

SEQ ID NO: 10624 - DNA, 666 bp, Medicago truncatula
  CDS (1)..(666)
atggctttgcccaatcagcaaaccgttgattaccctagcttcaagcttgtcatcgtcggcgatggtggcacaggaaaaacaacattcgtgaagaggcatcttactggagagtttgagaagaaatatgaacctacaattggtgtggaagtgcatccattggatttcttcacaaactgcggcaagattcgcttctactgctgggatactgctggacaagagaagtttggtggtctcagagatggatactatatccatgggcagtgtgcgattataatgtttgatgttactgcccgactgacttacaagaatgtccctacctggcaccgtgacctttgccgtgtttgtgaaaacatccctattgttctttgcggcaacaaggttgatgtgaagaacagacaagtaaaggcaaagcaggttaccttccacagaaaaaagaatttgcagtactatgagatttcagctaagagcaactataactttgagaagcctttcttgtacctagccaggaaacttgcaggtgatcctaacttgcactttgtagaatctcctgcactggctccaccagaagttcaaatcgatttggttgcacaacaacaacatgagaatgagcttcaacaagctgctaaccaaccacttcctgatgatgacgacgatgcatttgagtag

SEQ ID NO: 10625 - protein, 221 aa, Medicago truncatula
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLVAQQQHENELQQAANQPLPDDDDDAFE

SEQ ID NO: 10626 - DNA, 609 bp, Brassica oleracea
  CDS (1)..(609)
atgaatcctgaatatgactatctgttcaagcttctgctcattggtgattctggtgttggcaaatcatgcttgcttcttaggtttgctgatgattcctacctggatagctacatcagcaccattggtgttgactttaaaatccgcactgttgaacaagatggaaagaccatcaaactccagatttgggatacggcaggtcaagagcgtttccgaaccatcactagcagttactacagaggagctcatggcatcattgtgacttatgatgtaacagaccaagaaagcttcaacaatgtcaagcaatggctaaatgaaatcgaccgctacgctagtgagaatgtgaacaagctactggttgggaacaagtgtgatctcacttcacagaaagttgtctccaccgaaactgccaaggctttcgcagatgaacttgggatcccattcctggaaacgagtgccaagaatgctaccaatgtcgaagaagctttcatggccatgactgccgcaatcaagacaagaatggcgagtcaacctgcaggaggatccaagccatcaacggtccagatccgaggacaaccagtaaaccaacagtcaggctgctgctcttcttaa

SEQ ID NO: 10627 - protein, 202 aa, Brassica oleracea
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKCDLTSQKVVSTETAKAFADELGIPFLETSAKNATNVEEAFMAMTAAIKTRMASQPAGGSKPSTVQIRGQPVNQQSGCCSS

SEQ ID NO: 10628 - DNA, 612 bp, Brassica oleracea
  CDS (1)..(612)
atgaatcctgaatatgactatctgttcaagcttttgcttatcggtgactctggtgttggaaaatcctgcttgcttctaagatttgctgatgattcttacctggatagctacatcagtaccattggtgttgactttaaaatccgcacagttgaacaggacggaaagacaatcaaactccagatctgggacacagcaggccaagaacgtttcaggacaatcaccagcagctactacagaggagctcatgggatcattgtcacttatgatgtcactgaccaagagagcttcaacaacgtcaaacaatggcttaatgaaatcgaccgttacgccagtgagaatgtcaacaagctgctcgttgggaacaaaaacgatctcacctcacagaaggttgtatccactgagacagctcaggcgtttgcagatgaacttgggatccctttcttggaaacaagtgccaaaaatgcaaccaatgttgaagaagctttcatggccatgactgctgctattaagaccagaatggctagccaaccatctggaggtgccaagccaccgactgtccagattcgcggacagccagtgaaccagcagcaatcaggatgttgctcttcttga

SEQ ID NO: 10629 - protein, 203 aa, Brassica oleracea
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKNDLTSQKVVSTETAQAFADELGIPFLETSAKNATNVEEAFMAMTAAIKTRMASQPSGGAKPPTVQIRGQPVNQQQSGCCSS

SEQ ID NO: 10630 - DNA, 645 bp, Aspergillus oryzae
  CDS (1)..(645)
atggctgccccagtcccaacctttaagcttgtccttgtcggtgacggtggtactggaaagaccaccttcgtcaagcgccaccttactggcgaattcgagaagaagtatatcgcaactctcggtgtcgaagtgcaccctcttaatttcaccaccaaccttggacaaatccagttcgacgtgtgggatactgccggccaggagaagttcggtggtctgagagatggatactatatcaacggccagtgcggtatcatcatgttcgatgttacctcccgtatcacctacaagaacgttcccaactggcaccgtgatctcgtccgtgtctgcgagaatatccccatcgtgctgtgcggcaacaaggttgatgtcaaggagcgtaaggtgaaagccaagaccatcaccttccaccgcaagaagaacctccagtactacgatatctccgctaagtcgaactacaacttcgagaagcccttcctctggcttgctcggaagctggtcggcaacgccacactggatttcgttgctgcccctgctcttgctcctcctgaggtctcggtcgacccggaagttttgaagcagtatgaggcggatatcgtaactgcctcggcccaacctttgcccgatgaggatgatgccgatctgtaa

SEQ ID NO: 10631 - protein, 214 aa, Aspergillus oryzae
MAAPVPTFKLVLVGDGGTGKTTFVKRHLTGEFEKKYIATLGVEVHPLNFTTNLGQIQFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLARKLVGNATLDFVAAPALAPPEVSVDPEVLKQYEADIVTASAQPLPDEDDADL

SEQ ID NO: 10632 - DNA, 666 bp, Solanum tuberosum
  CDS (1)..(666)
atggctttaccaaaccaacaaactgtagattatccaagcttcaagcttgttattgtgggggatggaggaactgggaagacaacttttgtcaaaaggcatctcactggtgaattcgagaaaaaatatgaacccactattggtgtggaggtgcatccactagacttcttcacaaattgtgggaaaattcgcttttattgctgggatacagccggacaagagaagtttggaggtctcagagatggttactacattcatgggcaatgtgcaattatcatgttcgatgttacagcccggctgacctacaagaatgttcctacttggcatagagatctttgcagggtttgtgaaaacatccccattgttctctgtggaaacaaagttgatgtgaagaacaggcaggttaaggcaaagcaagttaccttccacaggaagaaaaatttgcaatactatgagatctcggcaaagagtaactacaactttgagaagccttttctgtaccttgctagaaagcttgctggggatggtaatcttcactttgtggaatcacctgcacttgctcccccagaagtacaaattgacttagctgcacaggcactgcatgaacaggagcttcaacaagcccttaatcagccacttccagatgacgatgatgaagcatttgaatag

SEQ ID NO: 10633 - protein, 221 aa, Solanum tuberosum
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDGNLHFVESPALAPPEVQIDLAAQALHEQELQQALNQPLPDDDDEAFE

SEQ ID NO: 10634 - DNA, 885 bp, Glycine max
  CDS (96)..(704)
tccttcgtgcgtgcgattctcctgatatccaaggtgaagcaccgacaccggacctatctccggcgaatccccagtccccactttcttccttcgaaatgaatcccgagtatgattatctgttcaagctccttcttattggagactctggtgttggtaaatcatgccttcttctgagattttctgatgattcgtacatcgaaagctacataagcaccattggagttgattttaaaatacgtaccgttgagcaagatggaaagaccattaaactacagatctgggacacagctgggcaagaacgatttaggacaatcaccagtagctactaccgtggtgcccatgggatcattattgtttatgatgtgacagatgaagagagcttcaataatgtgaagcagtggctcagtgaaattgatcgctatgcaagtgataatgttaacaagcttttggttggcaacaagtgtgatctggaagcaaatagagcagtgtcatatgaaacagctaaggcatttgcagatggaataggcataccttttatggaaacaagtgcaaaagatgctacaaatgtcgaacaggctttcatggcaatgactgcttcaatcaaggatagaatggcaagccaacctgcaaataatgcaaggcctccaacagtgcagatcaggggtcagccagttgcacagaaaggtgggtgctgctcttcctgaccacagttactcagatccattttatttggtcacctttttcatgtaagattttttttattattatatttcgctaaatagtggaccagtgtcagaatttgtctgttggtttggaactgacctagatgatccattctttgaatatacttaatgatgtggcttgtgcaaagtataatactcatca

SEQ ID NO: 10635 - protein, 202 aa, Glycine max
MNPEYDYLFKLLLIGDSGVGKSCLLLRFSDDSYIESYISTIGVDFKIRTVEQDGKTIKLQIWDTAGQERFRTITSSYYRGAHGIIIVYDVTDEESFNNVKQWLSEIDRYASDNVNKLLVGNKCDLEANRAVSYETAKAFADGIGIPFMETSAKDATNVEQAFMAMTASIKDRMASQPANNARPPTVQIRGQPVAQKGGCCSS

SEQ ID NO: 10636 - DNA, 1025 bp, Glycine max
  CDS (127)..(783)
aattcggaacgagcagcgaagtcgtgttcgattgcttcgtgcgtgcgattctcctgtatccaaggtgaagcaccgacaccggacctatctccggcgaatccccagtccccactttcttccttcgaaatgaatcccgagtatgattatctgttcaagctccttcttattggagactctggtgttggtaaatcatgccttcttctgagattttctgatgattcgtacatcgaaagctacataagcaccattggagttgattttaaaatacgtaccgttgagcaagatggaaagaccattaaactacagatctgggacacagctgggcaagaacgatttaggacaatcaccagtagctactaccgtggtgcccatgggatcattattgtttatgatgtgacagatggggaagagagcttcaataatgtgaagcagtggctcagtgaaattgatcgctatgcaagtgataatgttaacaagcttttggttggcaacaagtgtgatctggaagcaaatagagcagtgtccaatattgaaacagctgatctggaagcaaatagagcagtgtccaatattgaaacagctaaggcatttgcagatggaataggcataccttttatagaaacaagtgcaaaagatgctacaaatgtcgaacaggctttcatggcaatgactgcttcaatcaaggatagaatggcaagccaacctgcaaataatgcaaggcctccaacagtgcagatcaggggccagccagttgcacagaaaggcgggtgctgctcttcctgaccacagttactcagatccaatttattgggccacctttttcatgtaagattttttttattattatatttcgctaaatagtggaccagtgtcagaatttgtctgttggtttggaactgacctagatgatcccattctttgaatatacttaatgatgtggcttgtgcaaagtataatactcatcaatgctaaatacatattcctattcatatcttttaaaaaaaaaaaaaatttaaaaaaaaaaa

SEQ ID NO: 10637 - protein, 218 aa, Glycine max
MNPEYDYLFKLLLIGDSGVGKSCLLLRFSDDSYIESYISTIGVDFKIRTVEQDGKTIKLQIWDTAGQERFRTITSSYYRGAHGIIIVYDVTDGEESFNNVKQWLSEIDRYASDNVNKLLVGNKCDLEANRAVSNIETADLEANRAVSNIETAKAFADGIGIPFIETSAKDATNVEQAFMAMTASIKDRMASQPANNARPPTVQIRGQPVAQKGGCCSS

SEQ ID NO: 10638 - DNA, 1008 bp, Solanum lycopersicum
  CDS (151)..(762)
cggtacgagtcttaactttctcttctccttttctccggcgaccttttttttactccggtcagctatccgccggaaaactgtaatctattggtgtattcatagcttccttgattgtaccttctcttcgatctcaactttatattagtcatcatgaatccagaatacgactatctgttcaagcttttgcttattggagattctggtgttggtaaatcgcgtcttctcttgagatttgctgatgattcatatcttgagagttacatcagcaccatcggtgtggactttaaaatccgcacagttgatcaggatgggaaaaccattaaacttcaaatttgggatactgctggtcaagaacgttttaggacaattaccagcagttactatcgtggtgcacatggcataattgtggtttatgatgtaaccgatcaagagagcttcaataatgtcaagcaatggttgagtgagatagatcgatatgcaagtgataatgtgaacaaacttcttgttggaaacaagtgcgatctcacagctcagaaggtggtttccacagagactgctcaggcttttgctgatgagatcggcatccctttcatggaaactagtgcaaaaaatgccaccaacgtagagcaggctttcatggctatggctgcttcaatcaagaacagaatggcaagccaaccggcatcaaacaatgcacgacctccaaccgtgcagatccgaggacaacctgtcaaccaaaagagcggttgctgctcatcttgaaaggacgaagctcgatgatgattctgatgtggaatgtaaaattagtctctcttgatggcttataggagactcttcacttttattactttctttcaactctttatcgacactcaattcttttcaatctatttggattaacatatgtagaaaatctaggtatattggtgaatactagtatttgctttctattctttggaccttcatcaaaatgattttatctgcaaaaaaaaaaaaaaaaaaaaaaaa

SEQ ID NO: 10639 - protein, 203 aa, Solanum lycopersicum
MNPEYDYLFKLLLIGDSGVGKSRLLLRFADDSYLESYISTIGVDFKIRTVDQDGKTIKLQIWDTAGQERFRTITSSYYRGAHGIIVVYDVTDQESFNNVKQWLSEIDRYASDNVNKLLVGNKCDLTAQKVVSTETAQAFADEIGIPFMETSAKNATNVEQAFMAMAASIKNRMASQPASNNARPPTVQIRGQPVNQKSGCCSS

SEQ ID NO: 10640 - DNA, 1082 bp, Solanum lycopersicum
  CDS (109)..(720)
gcgatttccggcgacgatccgattttccggcgatatccaaccgtagagaacagagacatcctgcttcccttcgtcttggatcagtcgacttcttcgtttcgcaaaatcatgaatcccgaatatgattatttgttcaaacttttgttaataggagattcaggtgttggaaagtcatgtcttctcctgagatttgccgatgattcttatttggacagctacatcagcacaattggtgttgactttaaaatacgtactgtggagcaagatgggaagactattaaacttcaaatttgggacactgctggacaagaacgtttcaggacaatcacaagtagttactaccgtggggcacatggcattataatagtttatgatataactgatcaagaaagtttcaacaatgttaagcaatggttgagtgaaattgatcgctatgcaagcgaaaacgtgaacaagcttttggttggaaataagtctgacttgaatgataaccgagctgtgtcttatgatacagcaaaggcttttgctgatgaaattggcattccatttatggaggcaagtgcaaagagtgccactaatgttgaacaagctttcatggcaatggcagctgagataaagaataggatggcaacccagccagcatcaaacaatgcaaagccacccaccgtgcagatacggggacaacctgtgaaccaaaaaaacggctgctgttcttcttagatgtcagattctgcttgctagaattgcttctagagtcaccattccaatcgcaatacattgctttcgaagctgtgtcagttccattcttttcatctacaggtatccaaatggcctatacaaaccacaagaattgcttttcaagtataggaactctttctccctcctttgatattttcacttcgttgcgtttccttgtcttagttgcagtgattatttctgcagtttcaggcatatatatgtttagaagttggttttagatggggatatatagtggatagaactgtaacgctgttgtacttaactattatgaacttcaaataaattgctcagccaaaatgttcttgtaaaaaaaaaaaaaaaaa

SEQ ID NO: 10641 - protein, 203 aa, Solanum lycopersicum
MNPEYDYLFKLLLIGDSGVGKSCLLLRFADDSYLDSYISTIGVDFKIRTVEQDGKTIKLQIWDTAGQERFRTITSSYYRGAHGIIIVYDITDQESFNNVKQWLSEIDRYASENVNKLLVGNKSDLNDNRAVSYDTAKAFADEIGIPFMEASAKSATNVEQAFMAMAAEIKNRMATQPASNNAKPPTVQIRGQPVNQKNGCCSS

SEQ ID NO: 10642 - DNA, 645 bp, Trichophyton rubrum
  CDS (1)..(645)
atggctgagcaacaagtcccaacctttaagctcgtccttgtcggtgacggcggtactggaaagaccaccttcgttaagcgtcatcttactggcgaattcgagaagaaatacattgccactctcggtgtccaagttcaccccctgaaattccagaccaacctcggcacaacccaattcgacgcttgggacacagctggtcaggagaagttcggtggtcttcgagatggatattacatcaacggacagtgtggtatcatcatgttcgatgttacctcccgtatcacctacaagaacgttcccaactggcaccgtgatctcgtccgtgtctgcgagaacattccaattgtcttgtgcggtaacaaggtcgatgttaaggagcgtaaggtgaaggccaagaccatcaccttccaccgaaagaagaacctccagtactacgacatctccgccaggtccaactataacttcgaggagcccttcctgtggcttgccaggaagctgctcggaaacgcctctttggaattcgttgctgctcccgcccttgctcctcctgaggtgcaggtcgatgccaccctcatgcagcagtacagcgacgagatggccgacgccaaccaggacctgcccgacgaggacgaggctgacctttaa

SEQ ID NO: 10643 - protein, 214 aa, Trichophyton rubrum
MAEQQVPTFKLVLVGDGGTGKTTFVKRHLTGEFEKKYIATLGVQVHPLKFQTNLGTTQFDAWDTAGQEKFGGLRDGYYINGQCGIIMFDVTSRITYKNVPNWHRDLVRVCENIPIVLCGNKVDVKERKVKAKTITFHRKKNLQYYDISARSNYNFEEPFLWLARKLLGNASLEFVAAPALAPPEVQVDATLMQQYSDEMADANQDLPDEDEADL

SEQ ID NO: 10644 - DNA, 1280 bp, Triticum aestivum
  CDS (246)..(896)
gcggccgctcttcctgccccttgccattccaagaacgttctccggggcgtctcctcctcctcccaccaccccatcccgttgctgtaactccgataagcgcgcgccgccgccgacggccccagaagccacctccgagctgccatccgcgggaagagcgggtggcttgaccgattctgcgaggacgaagaggaggacgaacgtacgagggcgtggcctacacgtgaccaccgcggcgaaaccaaagaatggcgtaccgggcggacgacgactacgactacctcttcaaggtggtgctcatcggcgactcgggcgtcgggaaatccaacctcctcacccggttcacgcgcaacgagttcagcctggagtcaaagtccacaatcggggtcgagttcgccaccaggagcattagggtcgacgataaggtcgtcaaggcgcagatctgggatacggctggccaagagagatatcgtgcaattacaagcgcatattacagaggagctgtcggtgcgcttgttgtgtatgatgtgacacgccatgtgaccttcgagaatgtggagaggtggctgaaggagctcaaggaccataccgatgctaacattgtgatcatgctagtcggcaacaaggctgacctgcgccacttgcgggctgtctctgtggaggatgccaaggcatttgcggagagggaatacacctttttcatggaaacctctgccctggagtccatgaatgtagaggacgctttcactgaggtgttaacccagatctaccgagtggtcagcaagaaagctcttgacatcggcgacgaccctgccgctccaccacgagggcagaccatcaacgtagggtccaaagacgatgtctctgccgtaaagaaggctggatgctgctcatcctaatccgtagactttgaaaagtataccgggcccttgtttatcattgatggatgggtagctgcgtcttgggcgtgcttttggaggcccatacttaacccagggggttggaaacgatataaaacactaacagtaatagaactagcagccgttttttggtggcagtcatggtatcctaattgttgcagtcttggttcatatcggacgccaaggatcccttccacaatcgattatgtatgtaccctattaagtatgtgtaactgaagctttcatccttttctcctttcttttgagagaaactgttgttatcttgtttgtatgattcttcacattttgctaatcagtgacataatgtaaatcttatggaggaatactattaaaaaaaaaaaa

SEQ ID NO: 10645 - protein, 216 aa, Triticum aestivum
MAYRADDDYDYLFKVVLIGDSGVGKSNLLTRFTRNEFSLESKSTIGVEFATRSIRVDDKVVKAQIWDTAGQERYRAITSAYYRGAVGALVVYDVTRHVTFENVERWLKELKDHTDANIVIMLVGNKADLRHLRAVSVEDAKAFAEREYTFFMETSALESMNVEDAFTEVLTQIYRVVSKKALDIGDDPAAPPRGQTINVGSKDDVSAVKKAGCCSS

SEQ ID NO: 10646 - DNA, 681 bp, Oryza sativa subsp
  CDS (1)..(681)
atgtcgcgtgcgcaggctctccctgaccccgcggccgtggggtacccctccttcaagctcatcctcgtcggcgatggcggcaccgggaagacgacgttcgtgaagaggcacatcaccggggagttcgagaagcgctacgaaccgacgatcggggtggaggtgcggccactggacttccacacgagccgcggcaaggtgcggttctgctgctgggacaccgccggccaggagaagttcggcggcctccgtgatggatactatatccatggtcattgcgcgatcatcatgtttgatgtcacctcgcgtctcacgtacaagaacgttcccacctggcacaaggacatctgcagggtctgcgacaacataccgatcgtgctgtgcggcaacaaggtggacatgaagaacaggcaggtgaaggccaagatggtgaccttccacaggaagaagaacctccagtattacgagatctctgccaagagcaactacaacttcgagaagcctttcctctaccttgccaggaagctcacaggggacatgaaccttcggttcgtcgaggagttggccctcctccccgccgacgtcaccatcgacctcatcgcgcagcaaaagattgagacagagatagctgctgctgcggcgatgcctctcccggacgaggacgaggatggactgatggactga

SEQ ID NO: 10647 - protein, 226 aa, Oryza sativa subsp
MSRAQALPDPAAVGYPSFKLILVGDGGTGKTTFVKRHITGEFEKRYEPTIGVEVRPLDFHTSRGKVRFCCWDTAGQEKFGGLRDGYYIHGHCAIIMFDVTSRLTYKNVPTWHKDICRVCDNIPIVLCGNKVDMKNRQVKAKMVTFHRKKNLQYYEISAKSNYNFEKPFLYLARKLTGDMNLRFVEELALLPADVTIDLIAQQKIETEIAAAAAMPLPDEDEDGLMD

SEQ ID NO: 10648 - DNA, 1001 bp, Nicotiana sylvestris
  CDS (58)..(723)
cacacaaaaaaccctagctctctctacaagcttcctgccttttccttagcgttcaatatggctctaccaaaccaacaaactgtagattatccaagcttcaagcttgtaatcgtgggtgatggaggaactgggaaaacaacttttgtcaagaggcatcttactggtgaattcgagaagaaatatgaacccactattggtgtggaggttcatccattagacttcttcacaaattgtgggaaaattcgcttttattgctgggatactgctggacaagagaagtttggaggtctacgggatggttactacattcatgggcaatgcgcaattatcatgtttgatgttacagcccgtctgacctacaagaatgttcctacgtggcatcgagatctctgcagggtttgtgaaaacatccctattgttctttgtggaaacaaagttgatgtcaagaacaggcaggttaaggcaaagcaagttaccttccacaggaagaaaaatttgcaatactatgagatctcagcaaagagtaactacaacttcgagaagccttttctgtaccttgccagaaagcttgctggggatgctaatcttcactttgtggaatcacctgcacttgctcccccagaagtacaaattgacttggctgcacagcaactgcatgaacaagagcttttgcaagccgctgctcagccacttcccgatgacgatgatgaagcttttgaatagaaggaatagctcagagcggatcagtttcactgttgcttcttcctatattcctacttatattttgtatttcctatattaggctgttagtatttgacttttgagaattcatttgctgcttcctagtatttatagatgggttactagtagttatgtttgtctgagaccatgagctgtggtttatttggctagatagtgttatattctgatcctgatgtaagcatgcacattcgcgagctcggtttgagcttattataatgttacttgcctacgtaaaaaaa

SEQ ID NO: 10649 - protein, 221 aa, Nicotiana sylvestris
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDLAAQQLHEQELLQAAAQPLPDDDDEAFE

SEQ ID NO: 10650 - DNA, 860 bp, Helianthus annuus
  CDS (69)..(734)
atggactgaaggagtagaaaactcaaaccacaatcacagcagcagcagcagctttctatatatacagcatggctctgccgaatcagcaaactgttgattacccgagtttcaagcttgtaattgtcggtgatggtggaactggaaaaactacttttgtgaagagacacttgaccggagaatttgagaagaaatatgaaccaaccattggtgttgaggttcatcccttggatttcttcaccaattgtggaaagattcggttttactgctgggacacagctggacaggagaaatttggtggtcttcgtgatggatattatattcacggtcaatgtgccattatcatgtttgatgtaaccgcaagattgacttacaagaatgttcccacatggcatcgtgatctttgccgtgtgtgtgaaaacatcccaatcgtgctttgcggtaacaaggttgatgtaaagaaccgtcaagtgaaggcaaaacaggttactttccatagaaagaagaacctgcagtattatgagatctcagccaagagcaattacaactttgagaagccatttctttatctcgcccggaaacttgctggagaccccaatttgcattttgtcgagtctcctgcccttgctcctccagaagtgcaaatagacatggccgcacaacaacagcatgaagcagagcttgctgcagctgctagccagccgcttccagatgatgatgatgatgcttttgaatagggtccaaaagttgaagcggattttatgagggtttgtgtctgttgagttttggattgttgaatggttttattataaacgtttggtaggatgcagtgaggtttgtgtttgcaaaaaaaaaaaaaaaaa

SEQ ID NO: 10651 - protein, 221 aa, Helianthus annuus
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDMAAQQQHEAELAAAASQPLPDDDDDAFE

SEQ ID NO: 10652 - DNA, 1018 bp, Triticum aestivum
  CDS (85)..(750)
gcggccgctcctcctcctcccctagggttttgctgcccccctccacacccgtgccgccgccgccgtcgccgcccgcgtccccccatggcgctgccgaaccagaacaccgtcgattaccccagcttcaagctcgtcatcgtcggcgatggcgggactggcaaaaccacttttgtgaagaggcatctcactggagagtttgagaagaaatacgagcccaccattggtgttgaagttcacccattggatttcaccactaactgcggaaagatccgtttctactgctgggacactgctgggcaagagaagtttggtggccttagagatggatactatatccatggtcagtgtgcgattatcatgtttgatgtcacttcaaggctgacctacaagaatgttcctacgtggcacagggacctgtgcagggtttgtgagaacatccccattgtcctgtgcggcaacaaggttgatgtgaagaacaggcaggttaaggccaagcaggtgacattccacaggaagaagaacctgcagtactatgagatctctgccaagagcaactacaactttgagaagcccttcctttaccttgcaaggaagctggctggtgatcccaacatccacttcgttgaagcagtggcccttaagcccccggaagtgaccttcgacctggccatgcagcaacagcacgaggctgagcttgcggctgcagcggcacagccactgcccgacgacgatgacgatctgatcgagtagagagaggatgatgagtctgtctgtcttatcaatcaatactttgagagccagagactgtgcgagtcggttttaggttgaaggcttgatttggagtagtcaagccggatgtttttcctgtctgccttgccttgtctggtgggctgcaaactgtttgtgtgacattgatctacatgatgttgcttgccatggatttgttgttggccaccttgatggttcatcagtattattatgcctgttggctcaaatgtgtggatcatataaaaaaaaa

SEQ ID NO: 10653 - protein, 221 aa, Triticum aestivum
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNIHFVEAVALKPPEVTFDLAMQQQHEAELAAAAAQPLPDDDDDLIE

SEQ ID NO: 10654 - DNA, 821 bp, Cicer arietinum
  CDS (12)..(677)
tactctcttccatggcgttgcccaatcagcaaactgttgattaccctagtttcaagcttgttatcgtcggtgacggtggcactggaaagactacattcgtgaagaggcatcttactggtgaatttgagaagaaatatgaaccaactattggggtggaggttcatccattggatttcttcacaaactgtggaaagattcgtttctactgttgggacactgctggacaagagaagttcggcggactcagagacggatattatatccatgggcagtgtgctattataatgtttgatgttactgcccgactaacttacaagaatgtacctacctggcaccgtgatctttgccgggtttgtgaaaacatcccgattgttctttgcggtaacaaggttgatgtgaagaacagacaagtgaaggcaaagcaggttacattccatagaaagaagaatttgcagtactatgaaatttcagccaagagcaactataactttgagaagcctttcctgtatcttgcccggaaacttgcaggtgatcctaacttgcactttgttgaatctcctgccttggctcctccagaggttcagatcgatttagttgcacaacaacagcatgaggctgagattgcccaagctgctaatcagccccttcctgatgatgatgatgatgcatttgagtagaacctgtgtgtgtggtgacaatcttcttgagtgtatgcttactgtttgttttggaggttgtaatattcacctttttggatgtggatttgaggatctaaattcaaccagtatgaaatattttacttgaaaaaaaaaaaaaaaaaa

SEQ ID NO: 10655 - protein, 221 aa, Cicer arietinum
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLVAQQQHEAEIAQAANQPLPDDDDDAFE

SEQ ID NO: 10656 - DNA, 1134 bp, Capsicum annuum
  CDS (131)..(742)
ggcacgagcaacattttccctcggcgatttcccggcgacgatccgattttccggcgatatacggccgttgggaacagagaatctttccggttcccttctcgtatttggatcaatcggcttcgcaaaaatcatgaatcccgaatatgactacttgttcaaacttctgttgataggagattcaggtgttggaaagtcatgtcttctcctgagatttgccgatgactcttatttggacagctacatcagcacaattggtgttgactttaaaatacgtactgtggagcaagatgggaagactattaaacttcaaatttgggacactgctggacaagaacgtttcaggacaatcacaagtagttactaccgtggggcacatggcataataatagtttatgatataactgatcaagaaagcttcaacaatgttaagcaatggttgagtgaaattgatcgctatgcaagcgaaaatgtaaacaagcttttggttggaaacaagtctgacttgaatgataaccgagcagtgtcgtacgatacagcaaaggcatttgctgatgaaattggcattccatttatggaggctagtgcaaagagtgccactaatgttgagcaagctttcatggcaatggcagctgagataaagaataggatggcaacacagccagcatcaaacaatgcaaagccacccaccgtgcagatacgcggacaacctgttaaccaaaaaagtggctgctgttcttcttaggtgtcgcattctgctagctagaattgcttccagagtcacattccaatcggaatgccttgttttctaagctgtgccagttccattctttttatacaccggtatccaagtggcctgtacaaatcacaagaagtgcttttacgtataggactctttcgtctccgttctatattttcacttcgtcgggtttccatgtcaaagttgcagtgtttgtttctgcagtttcaggcataatatatgttttagaagttggtttttattagatgggatagtgatagagctgtaatgctgttgtacttgactatcatgctcttcaaataaaatgctcttgccataatgttcttgtgagatgtttttaacttctcaaatctcaaaaaaaaaaaaaaaaaaaaaaa

SEQ ID NO: 10657 - protein, 203 aa, Capsicum annuum
MNPEYDYLFKLLLIGDSGVGKSCLLLRFADDSYLDSYISTIGVDFKIRTVEQDGKTIKLQIWDTAGQERFRTITSSYYRGAHGIIIVYDITDQESFNNVKQWLSEIDRYASENVNKLLVGNKSDLNDNRAVSYDTAKAFADEIGIPFMEASAKSATNVEQAFMAMAAEIKNRMATQPASNNAKPPTVQIRGQPVNQKSGCCSS

SEQ ID NO: 10658 - DNA, 720 bp, Neurospora crassa
  CDS (1)..(720)
atgtcgtcctcattaccttgggactacatcgcaaagctagtgtgcatcggcgactcaggctgcggtaaatcctcgctcaccatccggctctgcgagggccgcttcgtcacccaccacgacgtgaccatcggtgtcgaattcggctcacgcatcgtccccgtcgcatccgacccccctgtcccgcaaaaacacatgaaactctccctctgggacacggccggccaagaaacctacaaatccgtcacgcgctcctacttccgcggcgcctcgggcgccctcctcgtcttcgacctctcgcgcaaacagacatttgagcacgtaaccgactggctgaacgaccttcgcgccattgccgagccggacattgtggtgatcttggtcggcaacaaggccgatcttaccgaagcaaacgacgaaaacgagggagaaaacaacaagcgagaagtaacgaggaaagaagcggaagagtgggcaaggaggaatggagtgctcgagtacgtggagacgagcgccaagagcggggagaacgtcgagaaggcgtttatgagggtggccgagaggatataccagaatattcaggcgggaaagtacgatttgaatgatagacggtcgggggtaaaggggcctagtgctgggttaggtggaggcggcgcaggagggggaggaacgcatgtgaagttgacgggggataaggcgggcggttatggagggtgttgttga

SEQ ID NO: 10659 - protein, 239 aa, Neurospora crassa
MSSSLPWDYIAKLVCIGDSGCGKSSLTIRLCEGRFVTHHDVTIGVEFGSRIVPVASDPPVPQKHMKLSLWDTAGQETYKSVTRSYFRGASGALLVFDLSRKQTFEHVTDWLNDLRAIAEPDIVVILVGNKADLTEANDENEGENNKREVTRKEAEEWARRNGVLEYVETSAKSGENVEKAFMRVAERIYQNIQAGKYDLNDRRSGVKGPSAGLGGGGAGGGGTHVKLTGDKAGGYGGCC

SEQ ID NO: 10660 - DNA, 1136 bp, Triticum aestivum
  CDS (256)..(885)
ggcaaccaagcagagtatccatcgcccacgccacgccacgcaagaacacaacaccacacacccgagtcgccaagaagaaagccccaaccttttttcctcccgatccgtcgtcctcgtcgtcgccacaagagtttctctccggattcgccgccctctccttctctccagccagccagccggccagcgagcgagcgagcgagcgatcgatcggatcccgcccgtcggaggttccaagtctcgcctgatctatcagagatggcggccaacgccggcgccggcgccggtggcagcaagatccgcaacgccaagctggttcttctgggggatgtcggcaccggcaagtccagcctggtgctccggttcgtcaagggccagttcgtcgagttccaggaatcgaccatcggcgcggccttcttctcgcagaccctggcggtcaacgatgagacggtcaagttcgaaatctgggacacggccggccaggagaggtaccacagcctggcgcccatgtactaccgcggcgccgcggccgcgatcgtcgtctacgacatcaccaacgcggcctcttttacacgtgcaaagaaatgggttcaagaacttcaagcacaagggaatccaaacacagtaatggctcttgctgggaacaaggctgatatgttggaggcaaggcaggtgccagtggaagaagcgacgacttacgcacaagggaatgggctcttcttcattgaaacgtctgccaaaacagccatcaatgtgaatgacgtattctatgagctcgcaaagagactgctcgcggggcagcaggcgcagaacccgcaggcggggatggtgctctcacagagaccggccgagaggatggtgagcagcacgtcgtgctgctcatcataggatgcttggccgtggagagacggccgccatggatggcctcagaagccacaggaggaaagaaaaatgtatgcgctgtggacgattgctgccatcccagcttgctacactacagtctagcccttgtttcttgtcatatgttggttctgtaaatgtgaatagtagtggggtgttgctgctgcagatgttcagatatgttgttgcagtgcattctggtgcttaaataaaaaaaaaaaaaaaaaaaaaaaaaaaaa

SEQ ID NO: 10661 - protein, 209 aa, Triticum aestivum
MAANAGAGAGGSKIRNAKLVLLGDVGTGKSSLVLRFVKGQFVEFQESTIGAAFFSQTLAVNDETVKFEIWDTAGQERYHSLAPMYYRGAAAAIVVYDITNAASFTRAKKWVQELQAQGNPNTVMALAGNKADMLEARQVPVEEATTYAQGNGLFFIETSAKTAINVNDVFYELAKRLLAGQQAQNPQAGMVLSQRPAERMVSSTSCCSS

SEQ ID NO: 10662 - DNA, 645 bp, Ashbya gossypii
  CDS (1)..(645)
atggcagcagaagttcctacattcaagttggtgttggtcggcgacggtggtactgggaagacgacgttcgtcaagcgtcatttgacgggtgagttcgagaagaagtacatcgccacgatcggtgtggaggttcacccattggcgttctacaccaacttcggcgaaatcaagttcgacgtgtgggacacggccgggcaggagaagttcggcgggttgcgggacggctactacatcaacgcgcagtgcggtatcatcatgttcgacgtgacatcgcggatcacgtacaagaacgtgcccaactggcaccgcgacctcgtgcgcgtgtgcgagaacatcccgatcgtgttgtgcggcaacaaggtcgacgtcaaggagcgcaaggtgaaggccaagaccatcaccttccaccgcaagaagaacttgcagtactacgacatctcggccaagtccaactacaacttcgagaagccattcttgtggttggcgcgcaagttggccggcaacccacagttggacttcgtggcgtcgcctgccttggcgcctccagaggtgcaggtggacgagcagttgatgcagcagtaccagcaggagatggagcgcgctacggccttgccgttgccggatgaggacgatgcggacttgtga

SEQ ID NO: 10663 - protein, 214 aa, Ashbya gossypii
MAAEVPTFKLVLVGDGGTGKTTFVKRHLTGEFEKKYIATIGVEVHPLAFYTNFGEIKFDVWDTAGQEKFGGLRDGYYINAQCGIIMFDVTSRITYKNVPNWHRDLVRVCENIPIVLCGNKVDVKERKVKAKTITFHRKKNLQYYDISAKSNYNFEKPFLWLARKLAGNPQLDFVASPALAPPEVQVDEQLMQQYQQEMERATALPLPDEDDADL

SEQ ID NO: 10664 - DNA, 1245 bp, Candida albicans
  CDS (481)..(1125): transl_table=12
taaataacaatttccacttgattcccatcaaaagcaaataatttacaacttcaaacttagtattgtctattttacaaccaattgtaattacaaattactagtttagcaaggaaaaaaacaaaaatatcgcatgaaatgtatgcaaatttcagtttttcctcattattattgtattgctttgtcggttgttatgtgtcgtttgtcgttgtcgatgagagtaaaaaaattttttttctctctctttctactactagtactaatgatgatgaagtgaggatgggatgatgatgaagaagaatagaaatggaaggcaagtgagagagagacatacaaaacgacaaaacgacaaaaaaaaaacacaacaaacaacaaaagattgaggacgagcaaagaaagaaaggaaaaaaaaatttttgatttcttttcttgttcatcgaatctgatcaaaacaacagaccaatcaatcatatatatttaaagatggctcaagaagttcctacattcaaattagttttagttggtgacggtggtaccggtaaaaccacttttgttaaaagacatttaactggtgaattcgaaaaaaaatacattgctactttaggggttgaagtcaatccattaggattccacaccaactttggggaattgaaattcgatgtttgggatactgctggtcaagaaaaatttggtggtttaagagacggttactatattaacggtcaatgtggtatcattatgtttgatgtcacttcaagaatcacttataaaaacgttccaaactggcatagagatttagtcagagtttgtgaaaacattccaattgttttatgtggtaacaaagttgatgttaaagaacgtaaagtcaaagctaaaaccatcactttccacagaaagaagaacttgcaatactacgatatctctgctaaatccaactataactttgaaaaaccattcttgtggttggctagaaaattggttggtaacccacaattagaattcgttgcctccccagctttggctccaccagaagttcaagttgatgccgacttgatgcaaaaataccaacaagaaatggaacaagctactgctttaccattgcctgatgaagatgatgctgatttgtaaacaaagtaaaaagtgagtgttttacaatgaatcaaacaaaaacaaaagggaatgcaacgtttgcttttctttgttctgcaatatatatatataataaaataaaggaataaggcatttaaa

SEQ ID NO: 10665 - protein, 214 aa, Candida albicans
MAQEVPTFKLVLVGDGGTGKTTFVKRHLTGEFEKKYIATLGVEVNPLGFHTNFGELKFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLARKLVGNPQLEFVASPALAPPEVQVDADLMQKYQQEMEQATALPLPDEDDADL

SEQ ID NO: 10666 - DNA, 645 bp, Candida glabrata
  CDS (1)..(645)
atgagtgctgaagttcctacatttaagctagttttggttggtgacggtggtaccggtaagaccacttttgtcaagagacatttgactggtgagtttgagaagaagtacattgccaccattggtgttgaagtgcacccattggccttccacactaacttcggtgagatcaagtttgatgtctgggataccgctggtcaagagaagttcggtggtctaagagacggttactacatcaacgcccaatgtggtatcattatgttcgatgttacttccagaatcacttacaagaacgttccaaactggcacagagacttggtccgtgtctgtgagaacatcccaattgtcctatgtggtaacaaggtcgatgttaaggagagaaaggtgaaggctaagaccatcactttccacagaaagaagaacttgcaatactacgatatttccgccaagtctaactacaacttcgaaaagccattcttgtggttggctagaaagttggctggtaaccctcaattggaattcgtcgcctccccagctttggctccaccagaagtccaagtcgatgagcaattgatgcaacaataccaacaagaaatggaacaagctaccgctttgccattgccagatgaagacgatgctgatttgtaa

SEQ ID NO: 10667 - protein, 214 aa, Candida glabrata
MSAEVPTFKLVLVGDGGTGKTTFVKRHLTGEFEKKYIATIGVEVHPLAFHTNFGEIKFDVWDTAGQEKFGGLRDGYYINAQCGIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMQQYQQEMEQATALPLPDEDDADL

SEQ ID NO: 10668 - DNA, 645 bp, Yarrowia lipolytica
  CDS (1)..(645)
atgtcccaggaagttgctgctttcaagcttgtgcttgtcggagacggtggaaccggaaagaccaccttcgttaagcgacacgagaccggtgagttcgtgaaccgatacaacgccaccctcggagtggaggtgcaccccctcaacttcgccaccgactgcggaaacatccgattcgacgtgtgggataccgctggacaggagaagttcggaggtctccgagacggctactacatcaacggccagtgcggaatcatcatgttcgacgtcacctcccgaatcacatacaagaacgtgcccaactggcaccgagatctcgttcgagtgtgcgagaacatccccatcgtcctgtgcggaaacaaggtcgacgtcaaggagcgaaaggtcaaggccaagaccatcaccttccaccgaaagaagaacctccagtactacgacatttccgccaagtccaactacaactttgagaagcccttcctgtggctggctcgaaagctcgccggaaacccctctctggagtttgtcgccacccccgccctgcgacccgccgagaccgccatcgaccccgaggtcatgcaggccatgcagaaggatctcgaggaggccaacgccatgcctcttcccgatgaggatgatgctgacttttaa

SEQ ID NO: 10669 - protein, 214 aa, Yarrowia lipolytica
MSQEVAAFKLVLVGDGGTGKTTFVKRHETGEFVNRYNATLGVEVHPLNFATDCGNIRFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLARKLAGNPSLEFVATPALRPAETAIDPEVMQAMQKDLEEANAMPLPDEDDADF

SEQ ID NO: 10670 - DNA, 663 bp, Saccharomyces cerevisiae
  CDS (1)..(663)
atgtcagcacctgctcaaaacaatgccgaggttcccactttcaagttagttcttgttggtgatggaggtactggtaagactacctttgtgaagagacatctgaccggtgaatttgaaaaaaaatacattgcaactatcggagtagaagttcatcctctatctttttacactaatttcggtgaaattaagttcgatgtctgggataccgcaggccaagaaaaatttggcgggttaagggatggttattacatcaatgctcaatgtgcaattattatgttcgatgtcacatccagaatcacttacaagaacgtccctaattggcatagagacttagtccgtgtatgtgaaaatattcccatagtgctatgtggcaataaagtcgatgtcaaagagagaaaggtcaaggccaagactatcactttccatagaaaaaagaacttacaatattatgacatttctgcaaaatccaattataattttgaaaagcctttcttgtggttggctagaaaacttgccggtaacccacaattggagtttgttgcgtctcctgcattggccccacctgaggtgcaagttgacgagcaactaatgcaccaataccagcaagaaatggaccaagccactgctttaccattacctgatgaagacgatgctgatttataa

SEQ ID NO: 10671 - protein, 220 aa, Saccharomyces cerevisiae
MSAPAQNNAEVPTFKLVLVGDGGTGKTTFVKRHLTGEFEKKYIATIGVEVHPLSFYTNFGEIKFDVWDTAGQEKFGGLRDGYYINAQCAIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMHQYQQEMDQATALPLPDEDDADL

SEQ ID NO: 10672 - DNA, 1049 bp, Gossypium hirsutum
  CDS (80)..(703)
tctctgaccaaagatcatataaaatctcacaattttccagcaatcgctaaaaaataataaaaatctcaaatccgatcccatggcttctcgtcggcgtatgctgttaaaggttataattctcggtgatagcggggttgggaaaacatctctcatgaatcagtatgttaatcgtaagttcagtaatcagtacaaagctacgattggagccgattttttgacaaaagaggttcagtttgatgatagattgtttacattgcagatatgggatactgctgggcaggaaaggtttcaaagtttaggtgtggctttctatcggggtgctgattgctgtgtacttgtgcatgatgttaatgtcatgaagtcctttgataatcttaacaactggcgagaagagtttctgattcaggcgagtccgtctgaccctgaaaactttccatttgttgtgttgggaaacaaggttgatgttgacggtggtaacagtcgcgtggtttctgagaagaaagcaaaggcatggtgtgcttcaaaaggaaacataccttactttgagacctctgcaaaagaaggattcaatgtcgatgctgcttttgagtgcatagccagaaatgctctcaagaatgagcctgaagaagaaatctaccttcccgaaaccattgatgttgctagtggaggacggccacagagatctacaggctgcgaatgttaaatgagtcattggatggatcttgttttgtcagagttgcaaaaacagctgccaaagatttcgcatttctatcagttaatattgcaggctctgactattagtaataaactagtgatgacataagacttggatttttgtatcataaattggttagaaaagtaaagttgggttgatcctcctcttgttgatttttcattcaacttccaactaaaaaaattcatgtttaaaagtaattgtaccatgcctcctacttactacgctgtgatcactcatattctgtaataataaaatatggagcttctgttgaaaaaaaaaaaaaaaaaaaaaaaaaaaaaaaaaaaaaaaaaaa

SEQ ID NO: 10673 - protein, 207 aa, Gossypium hirsutum
MASRRRMLLKVIILGDSGVGKTSLMNQYVNRKFSNQYKATIGADFLTKEVQFDDRLFTLQIWDTAGQERFQSLGVAFYRGADCCVLVHDVNVMKSFDNLNNWREEFLIQASPSDPENFPFVVLGNKVDVDGGNSRVVSEKKAKAWCASKGNIPYFETSAKEGFNVDAAFECIARNALKNEPEEEIYLPETIDVASGGRPQRSTGCEC

SEQ ID NO: 10674 - DNA, 666 bp, Arabidopsis thaliana
  CDS (1)..(666)
atggctctacctaaccagcaaaccgtagattatcccagcttcaagcttgtcattgttggtgatggaggcacagggaagactacttttgttaagagacatcttactggggagtttgagaagaagtatgaacctactattggtgtggaggttcatccattagatttcttcacaaactgtggcaagatccgtttttactgctgggacactgctggacaagagaaatttggtggccttagggatggatactacatccatggtcaatgtgctataataatgtttgacgtcacagcacggctcacatacaagaatgttccgacatggcaccgtgatctctgcagggtgtgtgaaaacatcccgattgttctgtgtgggaacaaagttgatgtgaagaacaggcaagtgaaggcaaagcaggttacattccacaggaagaagaatctgcagtactatgagatatcagcaaagagcaactacaactttgagaagcctttcttgtaccttgctagaaaactggctggagaccaaaaccttcactttgtggagacaccagcgcttgctccaccagaggttcacattgacattgctgatcagcagaagaacgaggccgagctcttacaggctgcagctcaacccctccccgatgacgatgatgatatctttgagtaa

SEQ ID NO: 10675 - protein, 221 aa, Arabidopsis thaliana
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDQNLHFVETPALAPPEVHIDIADQQKNEAELLQAAAQPLPDDDDDIFE

SEQ ID NO: 10676 - DNA, 954 bp, Solanum lycopersicum
  CDS (104)..(769)
ccctaacgcatttctctttttcttctctctcaaaataaaaaaaaaccctacagctccctcttacgaagcttagcttcgagtttttcttctcatcttttcgataatggctttaccaaaccagcaaactgtagactatccaagcttcaagcttgttattgtgggagatggaggaactggcaagacaacatttgtcaaaaggcatctcactggtgaattcgagaaaaaatacgaacccactattggtgtggaggttcatccactagacttcttcacaaattgtgggaagattcggttttattgctgggatacagctggacaagagaagtttggaggtctcagagatggttactacattcatgggcaatgtgcaattatcatgtttgatgttacagcccgtctgacctacaagaatgttcctacatggcatagagatctttgtagggtttgtgaaaacatccccattgttctctgtggaaacaaagttgatgtcaagaacaggcaggttaaggctaagcaagttaccttccacaggaagaaaaatttgcaatactatgagatctcagcaaagagtaactacaactttgagaagccttttctgtaccttgccagaaagcttgctggggatggtaatcttcactttgtggagtcacctgcacttgctcccccagaagtacacatcgacttagctgcacaggcactgcatgaagaagagcttcaacaagccgccaatcagccacttccagatgacgatgacgaagcatttgaatagaaggcatagctcagagcggatcagtttcactgttgcacctttcaatttccttgtccttaaactttctatattcggacttctgtttttgtggtttgaggatttatttgctgcttccttgtattttgattggttattagatatttatctggggccgtgaggctgtattgtatttggaaaaaaaaaaa

SEQ ID NO: 10677 - protein, 221 aa, Solanum lycopersicum
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDGNLHFVESPALAPPEVHIDLAAQALHEEELQQAANQPLPDDDDEAFE

SEQ ID NO: 10678 - DNA, 666 bp, Arabidopsis thaliana
  CDS (1)..(666)
atggctctacctaaccaacaaaccgtagattatcctagcttcaagctcgtcatcgttggtgatggaggcacagggaaaacgacctttgtgaagagacatcttactggggagtttgagaagaagtatgaacctactattggtgtggaggttcatcctttggatttcttcacaaactgcggaaagatccgtttttactgctgggatactgctggacaagagaaatttggtggccttagggatggatactacatccatggtcaatgtgcgataataatgtttgacgtcacagcaaggctcacatacaagaatgttccgacatggcatcgtgatctttgcagggtgtgtgaaaacatcccgattgttctgtgtggaaacaaagtcgatgtgaagaacaggcaagtgaaggcaaagcaagtcacattccacaggaagaagaatctgcagtactatgagatatcagcaaagagcaactacaacttcgagaagcctttcttgtaccttgctaggaaactggctggagaccagaaccttcactttgtggagtcaccagctcttgctccaccagaggttcaccttgacattgctgctcagcagcagaatgaggccgatcttgcagctgctgcagctcagcctctccccgatgatgatgatgacgcatttgagtaa

SEQ ID NO: 10679 - protein, 221 aa, Arabidopsis thaliana
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDQNLHFVESPALAPPEVHLDIAAQQQNEADLAAAAAQPLPDDDDDAFE

SEQ ID NO: 10680 - DNA, 928 bp, Solanum lycopersicum
  CDS (24)..(689)
tttttcttctcatcctttcgataatggctttaccaaaccaacaaactgtagattatccaagcttcaagcttgttattgtgggggatggaggaactgggaagacaacttttgtcaaaaggcatctcactggtgaattcgaaaaaaaatatgaacccactattggtgtggaggttcatccactagacttcttcacaaattgtgggaaaattcgcttttattgctgggatacagctggacaagagaagtttggaggtctcagagatggttactacattcatgggcaatgtgcaattatcatgtttgatgttacagctcgtctgacctacaagaatgttcctacttggcatagagatctttgcagggtttgtgaaaacatccccattgttctctgtggaaacaaagttgatgtcaagaacaggcaggtcaaggcaaagcaagttaccttccacaggaagaaaaatttgcaatactatgagatctcggcaaagagtaactacaactttgagaagccttttttgtaccttgctagaaagcttgcaggggatggtaatcttcactttgtggaatcacccgcacttgctcccccagaagtacaaattgacttagctgcacaggcattgcatgaacaggagcttcaagctgcccttaatcagccacttcctgatgacgatgatgaagcatttgaatagatggcagagattagtttcactgttgcacctttccatatttctagtccttcaattttctctatttggacttttgtatttgtttgaggatttatttgctgcttccttgtattattgattggttattagatatgtttgtctggggcaaatgaggctgtgttttgttaggttagatattctgatcttgatgtaggtgttgaggctctgttctgagcttgttataatattacttacttggtcgc

SEQ ID NO: 10681 - protein, 221 aa, Solanum lycopersicum
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDGNLHFVESPALAPPEVQIDLAAQALHEQELQAALNQPLPDDDDEAFE

SEQ ID NO: 10682 - DNA, 666 bp, Arabidopsis thaliana
  CDS (1)..(666)
atggctctacctaaccagcaaaccgtggattaccctagcttcaagctcgttatcgttggcgatggaggcacagggaagaccacatttgtaaagagacatcttactggagagtttgagaagaagtatgaacccactattggtgttgaggttcatcctcttgatttcttcactaactgtggcaagatccgtttctactgttgggatactgctggccaagagaaatttggtggtcttagggatggttactacatccatggacaatgtgctatcatcatgtttgatgtcacagcacgactgacatacaagaatgttccaacatggcaccgtgatctttgcagggtttgtgaaaacatcccaattgttctttgtgggaataaagttgatgtgaagaacaggcaagtcaaggccaagcaggtaacattccacaggaagaagaacctccagtattacgagatatctgccaagagcaactacaacttcgagaagccattcttgtaccttgctagaaagctcgccggggacgctaatcttcactttgtggaatcacctgcccttgctcccccggaagttcaaatcgacttggctgctcagcagcagcatgaggcggagcttgcagcagcagcaagtcagccacttcctgatgacgatgatgacaccttcgagtag

SEQ ID NO: 10683 - protein, 221 aa, Arabidopsis thaliana
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDLAAQQQHEAELAAAASQPLPDDDDDTFE

SEQ ID NO: 10684 - DNA, 1039 bp, Nicotiana tabacum
  CDS (91)..(756)
agagcttgaactaaagctttttcttgaacagcagaccatatgtctgaatcggagctctcaaaaccctcgcagcattctcctcaaaacaacatggctcttccaggtcagcaagccgtggattatcccagttttaaacttgttattgttggcgatggtggaactggaaaaactacatttgtgaagaggcatcttactggtgaatttgaaaagaaatatgaacccaccattggagtggaggtgcatccattggatttcttcacaaactgtgggaagattaggttttactgctgggatacagctggtcaggagaaatttggtggccttagggatggatactatattcatggtcaatgtgctatcatcatgtttgatgtgacagcccgattgacatacaagaatgtccccacatggcatagggatctttgccgtgtctgtgaaaatattcccattgttctttgcggaaacaaggttgatgtgaagaaccgtcaagttaaggctaagcaggttactttccaccggaagaagaatttgcaatactatgagatatcagcaaagagtaactacaactttgagaagcctttcctttaccttgccaggaaacttgccggggatcctaacttgcactttgtggagtctcctgcccttgctcctcctgaagtacagatcgacttggctgcacaacaacaacatgaggctgagcttgctgctgctgccagtcaacccctcccagatgatgatgatgagacctttgattaagaggtaatcaaccttctcggacagcttttgtggatgcggttatgatttttcttttttcctatgtactggtgtcccatttttttccaccattgatgggcttctgaggactctctgttccagaatatgtaggctttttgaactctgttcttgttctattttctttctggtttgtgagaacgatatgaagtttttattcatatcttctgaatgtggacctctatttgtttggatggaccgatttggatagatgaagctagtttggttgcttaaaaaaaaaaaaagg

SEQ ID NO: 10685 - protein, 221 aa, Nicotiana tabacum
MALPGQQAVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLAAQQQHEAELAAAASQPLPDDDDETFD

SEQ ID NO: 10686 - DNA, 667 bp, Nicotiana tabacum
  CDS (1)..(666)
atggctctaccaaaccaacaaactgtagattatccaagcttcaagcttgtaatcgtgggcgatggaggaactgggaaaacaacttttgtcaagaggcatcttactggtgaatttgagaagaaatatgaacccactattggtgtggaggttcatccattagacttcttcacaaattgtgggaaaattcgcttttattgctgggatactgctggacaagagaagtttggaggtcttcgggatggttactacattcatgggcaatgcgcaattatcatgtttgatgttacagcccgtctgacctacaagaatgttcctacgtggcatcgagatctctgcagggtttgtgaaaacatccccattgttctttgtggaaacaaagttgatgtcaagaacaggcaggttaaggcaaagcaagttaccttccacaggaagaaaaatttgcaatactatgagatctcagcaaagagtaactacaactttgagaagccttttctgtaccttgccagaaagcttgctggggatgctaatcttcactttgtggaatcacctgcacttgctccccctgaagtacaaattgatttagctgcacagcaactgcatgaacaagagcttttgcaagccgctgcgcacgcacttccagatgacgatgatgaagcttttgaataga

SEQ ID NO: 10687 - protein, 221 aa, Nicotiana tabacum
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDLAAQQLHEQELLQAAAHALPDDDDEAFE

SEQ ID NO: 10688 - DNA, 946 bp, Vicia faba
  CDS (88)..(753)
caaattcgaaaacccttgtgaaatataaaccctcgctctctctttttctttctctcctcaaccctctgaaaccaacgactgcatttcatggcgttgccgaatcagcaaaccgttgattaccctagcttcaagcttgttatcgtcggagacggtggcacaggaaagacgacgtttgtgaagaggcatcttactggagaatttgagaagaaatatgaaccaactattggtgtggaagtgcatccattggatttcttcacaaactgtggaaagatccgtttctactgctgggatactgctggtcaagagaagtttggtggtcttagagatggatactatatccatgggcagtgtgcaattataatgtttgatgttactgcccgactgacatacaaaaatgttcctacctggcatcgagatctttgtcgggtttgtgaaaacatcccaattgttctttgtggaaacaaggttgatgtgaagaacaggcaagtgaaggccaagcaggttactttccacaggaagaagaatttgcagtactatgagatttcagctaagagcaattacaactttgagaagcctttcctgtatcttgccaggaaacttgcaggtgatgctaatttgcactttgtcgaatctcctgcactggctccaccagaagttcaaattgatattgccttacaacaaaggcatgaaaatgaaattcttgaagctgctaatcaaccccttcctgatgacgatgatgatgcatttgagtagaagaaggacccttgggattgatggcttttgtcttgaactggcacttttgtgtaatctataaaattatgtgtttgaggttgaactgttaacattttttatatagatttggggtttttgatttattcgtggtgtgattgagatgtcttacttttatgccaaccctcactatggctgccagttgaccttcgttgcc

SEQ ID NO: 10689 - protein, 221 aa, Vicia faba
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDIALQQRHENEILEAANQPLPDDDDDAFE

SEQ ID NO: 10690 - DNA, 924 bp, Nicotiana tabacum
  CDS (13)..(666)
tgaattccataaatggcaggtgggtacagagctgaggatgactacgattacctgttcaagttggtcctaattggggattctggtgtcggcaaatctaatctgctttctcgattttcgcgaaatgagttcaatcttgaatccaagtccactatcggcgttgaattcgctacccgtagcattcgggtcgatgataagatcgttaaggcccagatttgggacactgctggccaagaaaggtaccgtgcaattacaagtgcatactacagaggggctgttggtgcattagtagtgtacgatatcactcgacatgtcacatttgaaaatgtggagagatggttaaaagagcttcgagaccatacggaccaaaatattgtcataatgcttgttgggaacaaggctgatttacgtcatttgcgtgctgtctcgacagaggatgccaaggcgtttgctgaaagagagaataccttctttatggaaacttcagcactcgagtcgttgaatgttgagaatgcctttacagaagtattgactgagatatacaaggtggtctgtcgtaaagcgctagaagttggggatgatcctgctgcattgccaaaggggcaaactattaatgttggcaaggatgatgtttcagctgtgaaaaaagttggttgctgctcgtcataagcaaaagattaagaaatcagtgagtgatgactgcgattctgtgcctatacttccaaatgcttactgcaaccagcaaatgctcctccttagttgcattcagttttgaatctcttaggacatgtagcattatgttcatccttatccgcaggatgatgtctttaatcactttattcgacatcttgtattgtttcattaacttacctttagtttgtacactactttgttttggtctttggctcaaaaaaaaaaaaaaaaaaa

SEQ ID NO: 10691 - protein, 217 aa, Nicotiana tabacum
MAGGYRAEDDYDYLFKLVLIGDSGVGKSNLLSRFSRNEFNLESKSTIGVEFATRSIRVDDKIVKAQIWDTAGQERYRAITSAYYRGAVGALVVYDITRHVTFENVERWLKELRDHTDQNIVIMLVGNKADLRHLRAVSTEDAKAFAERENTFFMETSALESLNVENAFTEVLTEIYKVVCRKALEVGDDPAALPKGQTINVGKDDVSAVKKVGCCSS

SEQ ID NO: 10692 - DNA, 651 bp, Schizosaccharomyces pombe
  CDS (1)..(651)
atggctcaaccacaaaacgttcctacctttaagcttgtacttgtcggcgatggtggtaccggtaagaccacgttcgtcaagcgtcatttgactggtgaatttgaaaagaagtatattgcaactttgggtgttgaggtccatcctttgcattttcatactaattttggtgaaatttgctttaatgtttgggataccgctggtcaagaaaagttaggtggccttcgtgatggttactatattcaaggtcaatgtggtattatcatgtttgatgttacttcccgtattacctataagaatgttccccattggtggcgtgatcttgtccgtgtttgtgaaaacattcccattgttctttgcggtaacaaagttgatgttaaagagcgtaaagtcaaggctaaggctatcactttccatcgcaagaaaaaccttcaatactacgacatctccgccaagtccaattataacttcgaaaaacctttcttatggcttgcccgtaagctggttggcaaccccaacctggagtttgttgcttcgcctgcccttgctcctcctgaggttcaagtcgatcagcaattgttagctcaataccaacaggaaatgaacgaggctgctgctatgcctttacctgatgaggatgacgctgatttgtaa

SEQ ID NO: 10693 - protein, 216 aa, Schizosaccharomyces pombe
MAQPQNVPTFKLVLVGDGGTGKTTFVKRHLTGEFEKKYIATLGVEVHPLHFHTNFGEICFNVWDTAGQEKLGGLRDGYYIQGQCGIIMFDVTSRITYKNVPHWWRDLVRVCENIPIVLCGNKVDVKERKVKAKAITFHRKKNLQYYDISAKSNYNFEKPFLWLARKLVGNPNLEFVASPALAPPEVQVDQQLLAQYQQEMNEAAAMPLPDEDDADL

SEQ ID NO: 10694 - DNA, 1065 bp, Zea mays
  CDS (118)..(729)
gctctcgctctctcgtccccctcagatccaccgactcgctctgagtctctgaccgccccttccgtcgtccccgttcgaaggcgcggcaagcagcgattcagccagattccattcgacatgaatcccgagtacgactaccttttcaaacttctgcttattggtgattctggtgttgggaaatcatgcttgcttctcagatttgcggatgattcatatttggacagctacatcagcacaattggggttgattttaaaattcggacagtagagcaagatgggaagaccataaaacttcaaatttgggatactgctgggcaagagcgcttcaggaccatcactagcagctactaccgtggagctcatggaatcattattgtatatgacgtgacagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaggcatttgctgatgagatgggcatcccgttcatggagacgagtgccaaaaacgccaccaacgtccagcaggccttcatggctatggctgcatccatcaaggacaggatggccagccaaccagccgcggccaacgcaaggccagcgacggtgcagatccgcgggcaacccgtcaaccagaagacgtcttgctgctcgtcttaagcttgcctgatttctctggttccttgtgactattactaccgtttgtgcgagcatgcaaatgtatttgttgcattattgctgatagcatctgttcgttggccagatgagtagagagctgaaaaaatgttaagaacaccatagagagaagtctatccgtgctctctcaacttaaggagcaaacagcaagacttcatttttttctactttactgtttattagtcgcgttacatttgtgaacagttattgtaatgtccaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10695 - protein, 203 aa, Zea mays
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNATNVQQAFMAMAASIKDRMASQPAAANARPATVQIRGQPVNQKTSCCSS

SEQ ID NO: 10696 - DNA, 612 bp, Oryza sativa
  CDS (1)..(612)
atgaatcccgagtacgactaccttttcaaacttctcctcattggtgattctggtgttgggaaatcgtgcttgcttctcagatttgcggatgattcatacctggacagctacatcagcacaattggagttgattttaaaatacggacagtagagcaggatgggaagaccatcaagcttcaaatctgggatactgctggacaagaacgtttcaggacaattacaagcagctattaccggggagctcatggaattattattgtatatgatgtgacagaccaagaaagcttcaacaatgtgaagcagtggttgaatgaaattgatcgttatgcaagtgacaatgttaacaagctcctcgttgggaacaagagcgacctaactgccaacaaagttgtgtcatctgaaacagctaaggcgtttgctgatgagatgggcatcccattcatggagacaagtgccaagaacgccactaatgtggagcaggcctttatggctatggctgcatccatcaaggacaggatggcgagccaaccggccgctgcaaatgcaaggccaccgacggtgcagatccgcgggcaacctgtcaaccagaagacgtcgtgctgctcgtcctaa

SEQ ID NO: 10697 - protein, 203 aa, Oryza sativa
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVSSETAKAFADEMGIPFMETSAKNATNVEQAFMAMAASIKDRMASQPAAANARPPTVQIRGQPVNQKTSCCSS

SEQ ID NO: 10698 - DNA, 609 bp, Oryza sativa
  CDS (1)..(609)
atgaatcccgacgactaccttttcaaacttctcctcattggtgattctggtgttgggaaatcgtgcttgcttctcagatttgcggatgattcatacctggacagctacatcagcacaattggagttgattttaaaatacggacagtagagcaggatgggaagaccatcaagcttcaaatctgggatactgctggacaagaacgtttcaggacaattacaagcagctattaccggggagctcatggaattattattgtatatgatgtgacagaccaagaaagcttcaacaatgtgaagcagtggttgaatgaaattgatcgttatgcaagtgacaatgttaacaagctcctcgttgggaacaagagcgacctaactgccaacaaagttgtgtcatctgaaacagctaaggcgtttgctgatgagatgggcatcccattcatggagacaagtgccaagaacgccactaatgtggagcaggcctttatggctatggctgcatccatcaaggacaggatggcgagccaaccggccgctgcaaatgcaaggccaccgacggtgcagatccgcgggcaacctgtcaaccagaagacgtcgtgctgctcgtcctaa

SEQ ID NO: 10699 - protein, 202 aa, Oryza sativa
MNPDDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVSSETAKAFADEMGIPFMETSAKNATNVEQAFMAMAASIKDRMASQPAAANARPPTVQIRGQPVNQKTSCCSS

SEQ ID NO: 10700 - DNA, 672 bp, Oryza sativa
  CDS (1)..(672)
atggctcggcggccggcgccgtgggagcagggcggcgacgagtacgactacctgttcaagatcgtgctgatcggggactccggcgtggggaagtcgaacctcctctcccgcttcacccgcaacagcttctccctcgactccaagtccaccatcggcgtcgagttcgccacccgcaccatccaggttgaaggaaagattgtaaaggcacagatatgggacacagccgggcaagaacggtaccgggccatcacaagcgcatactaccgcggcgcagtgggagcattgctagtctatgatgtcacaaaggccacaacttttgagaatgtgaagaggtggctcaaggagctccgtgaccatgccgactccaacatcgtcgtcatgctcatcggcaacaagatcgacctcaagcatctccggtcagtgtccttggaggacgcaacaagctttgcagagagggagggcctatccttcgtcgagacctcggcgctcgacgcgacgaatgtggataaagcttttcagacagtgctcactgagatctaccggatcatcagcaagaaggcattggctgcagatgaggctggagctggtgctggtgctgtcagagagggccaatctatccaagtctccgcgacagattccagcagttttacatcaagatgttgctctttctag

SEQ ID NO: 10701 - protein, 223 aa, Oryza sativa
MARRPAPWEQGGDEYDYLFKIVLIGDSGVGKSNLLSRFTRNSFSLDSKSTIGVEFATRTIQVEGKIVKAQIWDTAGQERYRAITSAYYRGAVGALLVYDVTKATTFENVKRWLKELRDHADSNIVVMLIGNKIDLKHLRSVSLEDATSFAEREGLSFVETSALDATNVDKAFQTVLTEIYRIISKKALAADEAGAGAGAVREGQSIQVSATDSSSFTSRCCSF

SEQ ID NO: 10702 - DNA, 654 bp, Oryza sativa
  CDS (1)..(654)
atgggcgggcgggtggatcacgagtactcgtacctgttcaagatggtgctgatcggcgacagcggcgtcggcaagtctaatatcctctcccgcttcacccgcaaccacttctccctcgactccaagtccaccatcggcgtcgagttcgccaccaaatccctgcagatggagggcaaaacaataaaggctcagatctgggacacagcaggacaggagagatatcgtgccatcacaagtgcttactaccgtggcgctgttggggctctccttgtttacgacatcacaaagaggcagagcttcgacaatgtccacaggtggcttcgtgagctccgcgaccatgccgactcgagcattgttatcatgatggtcggtaataagtctgatttgattcatctaagggctgtctccgaggatgaaggtaaggcattggctgaaaaggaggggctgttttttcttgagacatcagctatggaggccgtgaatgtggaggaagcctttcagactatcatcacagaggtctatggcattgttaacaggaaagcactggccgccaaagaagcagctgctgcttctgctccgctgccttcccagggtaaaactatcagcattgacagcgctgcaggaaacacaaagagggcatgctgctctgcttga

SEQ ID NO: 10703 - protein, 217 aa, Oryza sativa
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVGNKSDLIHLRAVSEDEGKALAEKEGLFFLETSAMEAVNVEEAFQTIITEVYGIVNRKALAAKEAAAASAPLPSQGKTISIDSAAGNTKRACCSA

SEQ ID NO: 10704 - DNA, 651 bp, Oryza sativa
  CDS (1)..(651)
atggctgcgccgccggcgagggctcgggcggactacgactacctcatcaagctcctcctcatcggggacagcggtgttggcaagagttgccttctcctgcggttttctgatggttccttcactacaagctttattaccacaattggtattgacttcaaaattagaacaatagagctggacgggaagcgtattaagctacaaatttgggacacagctggccaagaacgtttccggacaattaccactgcgtactaccgtggagccatgggtatcctgcttgtttatgatgtcaccgacgagtcatctttcaacaacattcggaactggattcggaatattgagcaacatgcctctgataatgtcaacaaaattttggttggcaacaaggctgatatggatgagagtaaaagggctgtccctactgcgaaaggccaagcactggctgatgagtatggcatcaaatttttcgaaactagtgcgaagacaaacctcaacgtggagcaagtttttttctccattgcacgtgacattaagcagaggcttgctgagaccgactccaagcctgaggacaagacaatcaagattaacaacaagacggatcagggtgccgacaaaccagcagcttctggatctgcatgctgcggctcctga

SEQ ID NO: 10705 - protein, 216 aa, Oryza sativa
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDKTIKINNKTDQGADKPAASGSACCGS

SEQ ID NO: 10706 - DNA, 600 bp, Oryza sativa
  CDS (1)..(600)
atggcgctgccgaatcaggggaccgtggattaccccagcttcaagctggtcatcgtcggcgatggcgggactggtaaaactacatttgtgaagaggcatctcactggagagtttgaaaagaaatatgagccaaccattggtgtcgaagttcaccctctagattttaccaccaactgtggtaagatccgcttctactgctgggacactgctggacaagagaagtttggtggacttagggatggatactatatccatggtcaatgtgcgataattatgtttgatgtcacttcaaggctgacttacaagaatgttccaacatggcatagggacttgtgcagggtgtgtgaaaacatccccattgtcctgtgtggtaacaaggttgatgtgaagaacaggcaggttaaagccaagcaggtcacattccacaggaagaagaatctccagtactatgaaatttctgccaagagcaactacaactttgagaagcccttcctttatcttgcaaggaagcttgctggtgacccgaacctgcatttcgttgaagctgttgctcttaaacctccggaagttcccattgacctggcaatgcagcaacagtaa

SEQ ID NO: 10707 - protein, 199 aa, Oryza sativa
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVPIDLAMQQQ

SEQ ID NO: 10708 - DNA, 648 bp, Oryza sativa
  CDS (1)..(648)
atggcgggggctccgtcgaggtcgcgcggcgacttcgaccacctcatcaagctcctcctcatcggcgacagcggagtaggaaagagttgcttgcttctgaggttctcagatgacactttcactacaagttttatcaccaccattggcattgatttcaaggttcggacagttgagcttgatggaaagcgtgtaaaattgcagatttgggatactgctggtcaagaacgtttccggacaattacaactgcctactatagaggtgctatgggcattctgcttgtttatgatgttacagacgagtcatccttcaacaacattagaaattggatccgcaacatagaacaacatgcatctgataatgtcaacaagattttggtgggcaacaaggttgatatggatacaaagcgggtggtgtccacagctcaaggacaaaagctcgcagatgagtatggaatgaaattttttgagacgagtgcaaaaacaaatcagaacgtggagcaggtattctttaccattgcaagggacataaagcaaagattgaccgaaactgttgctgcagcagctgagcccccaactattcaaatcagtaggcaagaaccagatcaggcagctgcctcgtcaagatggtcagcctgctgtaacacctga

SEQ ID NO: 10709 - protein, 215 aa, Oryza sativa
MAGAPSRSRGDFDHLIKLLLIGDSGVGKSCLLLRFSDDTFTTSFITTIGIDFKVRTVELDGKRVKLQIWDTAGQERFRTITTAYYRGAMGILLVYDVTDESSFNNIRNWIRNIEQHASDNVNKILVGNKVDMDTKRVVSTAQGQKLADEYGMKFFETSAKTNQNVEQVFFTIARDIKQRLTETVAAAAEPPTIQISRQEPDQAAASSRWSACCNT

SEQ ID NO: 10710 - DNA, 651 bp, Oryza sativa
  CDS (1)..(651)
atggcgtacagggcggaggacgactacgactacctgttcaaggtggtgctcatcggcgactccggggtcggcaaatccaacctcctctcccgcttcacccgcaacgagttcagcctcgagtccaagtccaccatcggcgtcgagttcgccaccaggagcatccgcgtcgacgacaaggtcgtcaaggcccagatctgggacaccgccggccaggagaggtatcgggcgattacaagtgcatactatcgaggggcagttggcgcacttgtcgtgtacgacgtgacacgccatgtcacctttgagaatgtagagaggtggttgaaggagctccgggatcacacagatgcaaacatcgtcatcatgcttgttggcaacaaggctgatctgcgtcaccttagggccgtatcggttgaggacgccaagggcttcgccgagagggaaagcaccttcttcatggaaacgtccgcgttggagtccatgaatgtagaaagtgccttcactgaggtgctaactcagatctatcgcgtggtcagcaagaaggccctcgacatcggcgatgaccctgctgctccaccaagaggacagaccatcaatgttggtggcaaagatgatgtttctgctgtgaaaaagtctggatgctgttcatcctaa

SEQ ID NO: 10711 - protein, 216 aa, Oryza sativa
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERESTFFMETSALESMNVESAFTEVLTQIYRVVSKKALDIGDDPAAPPRGQTINVGGKDDVSAVKKSGCCSS

SEQ ID NO: 10712 - DNA, 612 bp, Oryza sativa
  CDS (1)..(612)
atggcggccaaccccggcaacaagatccgcaacgccaagctggttcttcttggagatgtgggcacgggcaagtcgagcctcgttctccggtttgtgaagggccagtttgttgagttccaggagtccaccatcggcgcggccttcttctcgcaaaccttggcggttaacgatgagacggtgaagttcgaaatctgggatactgcagggcaggagaggtatcatagcttggctccgatgtactatcggggtgcggctgccgcgatagttgtctacgacatcacaaatgcggcctctttcacacgtgcaaaaaaatgggttcaagaacttcaagcgcaaggaaacccaaacacgataatggctcttgctggtaacaaggctgatatggtagaggcgaggcaggtgccagcagaagaggcaaagacctacgcacaagagaatggccttttcttcatggaaacatctgcgaaaacggcgatcaatgtgaacgatgtattccacgagatcgcaaagagattgcttcaaggacagcaggctcaagacacaccggctggaatggttctcaaccagagaccagctgagaggatggtgagcagttcttcatgctgctcataa

SEQ ID NO: 10713 - protein, 203 aa, Oryza sativa
MAANPGNKIRNAKLVLLGDVGTGKSSLVLRFVKGQFVEFQESTIGAAFFSQTLAVNDETVKFEIWDTAGQERYHSLAPMYYRGAAAAIVVYDITNAASFTRAKKWVQELQAQGNPNTIMALAGNKADMVEARQVPAEEAKTYAQENGLFFMETSAKTAINVNDVFHEIAKRLLQGQQAQDTPAGMVLNQRPAERMVSSSSCCS

SEQ ID NO: 10714 - DNA, 618 bp, Brassica napus
  CDS (1)..(618)
atgtcgatgcgaagaagaagtttgcttaaagttattgtccttggagacagcggggttggcaaaacatcgttgatgaatcaatatgtgaataataagtttagtcaacagtacaaagccacgattggagctgattttgtcaccaaggagcttcaaatcgatgacaggctcgtcacactccaaatttgggacactgctgggcaagagaggttccagagtcttggtgttgctttctatagaggtgcagattgttgtgtgcttgtttatgatgttaactacctcaagtcatttgattctctggacaattggcacgaggagtttcttaagcaggctagcccacgggatccaacggccttcccgttcatattgcttggtaacaaggttgatattgatggaggaaacagtcgagtggtatcagagaagaaagctagagaatggtgtgctcaaatgggaaacatatgctattacgagacatcggctaaagaagattacaatgtagatgaatcgttcttgtgcatcacaaaacttgcccttgccaatgagcgcgaccaagatatatattttcaggggattccagagtctggttcagagcctgagcaaagaggaggatgtgcttgctga

SEQ ID NO: 10715 - protein, 205 aa, Brassica napus
MSMRRRSLLKVIVLGDSGVGKTSLMNQYVNNKFSQQYKATIGADFVTKELQIDDRLVTLQIWDTAGQERFQSLGVAFYRGADCCVLVYDVNYLKSFDSLDNWHEEFLKQASPRDPTAFPFILLGNKVDIDGGNSRVVSEKKAREWCAQMGNICYYETSAKEDYNVDESFLCITKLALANERDQDIYFQGIPESGSEPEQRGGCAC

SEQ ID NO: 10716 - DNA, 666 bp, Brassica napus
  CDS (1)..(666)
atggctttaccgaaccagcaaaccgttgattaccctagcttcaagctcgtcatcgttggtgatggaggcacaggaaaaaccacatttgtcaagagacatcttactggagagtttgagaagaagtatgaacctactattggtgttgaggttcaccctttagatttcttcactaactgtggcaagatccgcttttactgttgggatactgctggacaagagaagtttggtggtttaagggatggatactacatccatgggcaatgtgctgtcatcatgtttgatgtcacagcacgtctgacatacaagaatgtaccaacatggcaccgtgatctttgcagggtctgtgaaaacatcccgattgtactctgcgggaacaaagttgatgtgaagaacaggcaagtgaaggccaagcaggtgacattccacaggaagaagaatctccagtattacgagatatctgctaagagcaactacaatttcgagaagccattcttgtaccttgctaggaaactcgcaggggaccctaaccttcactttgtggaatcacctgcccttgctcccccagaagtacagattgacatggctgctcagcaacagcacgaggcggagctcgcagccgcagcaagtcagccactccctgatgacgatgatgacacgttcgagtag

SEQ ID NO: 10717 - protein, 221 aa, Brassica napus
MALPNQQTVDYPSFKLVIVGDGGTGKTTFVKRHLTGEFEKKYEPTIGVEVHPLDFFTNCGKIRFYCWDTAGQEKFGGLRDGYYIHGQCAVIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDMAAQQQHEAELAAAASQPLPDDDDDTFE

SEQ ID NO: 10718 - DNA, 666 bp, Brassica napus
  CDS (1)..(666)
atggctctacctaaccagcaaaccgtcgattaccctagcttcaagctcgtcattgttggtgacggaggcacaggaaaaacaactttcgtcaagagacatcttactggagagttcgagaagaagtatgaacctacaattggtgtggaggttcatcctctagatttcttcacaaactgtggcaagatccgtttctactgctgggacactgccggtcaagaaaagttcggtggccttagagatggttactacatccatggtcaatgtgcggtaatcatgttcgacgtgacagcgcggctcacatacaagaacgtccccacgtggcaccgtgacctctgccgtgtgtgtgagaacatccccatcgttctctgcgggaacaaggtcgatgtgaagaacaggcaagtgaaggctaagcaggtgacgttccacaggaagaagaatcttcagtactacgagatctccgcgaagagcaactacaactttgagaagcccttcttgtacctcgctaggaagcttgcgggggaccagaaccttcactttgtcgagtcgccggctcttgctccccctgaggttcacattgacgttgctgagcagcagaggaacgaggctgatctcattgccgcagccgctcagcctcttccagatgatgatgatgatgcttttgagtaa

SEQ ID NO: 10719 - protein, 221 aa, Brassica napus
MALPNQQTVDYPSFKLVIVGDGGTGKTTFVKRHLTGEFEKKYEPTIGVEVHPLDFFTNCGKIRFYCWDTAGQEKFGGLRDGYYIHGQCAVIMFDVTARLTYKNVPTWHRDLCRVCENIPIVLCGNKVDVKNRQVKAKQVTFHRKKNLQYYEISAKSNYNFEKPFLYLARKLAGDQNLHFVESPALAPPEVHIDVAEQQRNEADLIAAAAQPLPDDDDDAFE

SEQ ID NO: 10720 - DNA, 645 bp, Brassica napus
  CDS (1)..(645)
atggcgtctgtttctgctttggcaaagttcaagttggtgttcttaggagatcaatctgtgggcaaaacaagcatcatcacccgtttcatgtatgataaattcgacacctcttaccagcctaccattgggatcgattttctgtccaaaacaatgtacctcgaagatcgaactgttcgcttgcagctttgggatacggcgggacaagaaagattcaggagtctgatcccaagttacatcagagactcttctgttgcaattgttgtgtatgatgtagccaataggcaaacgtttctgaatattccgaaatggatcgatgatgtacacagagaaagaggtggttcaggcgacgttattattgtccttgttggtaacaaaactgatcttgttgataaaagacaagtatcgatcagtgaaggggaagaaaagggtaaagagcatggagtgatgttcattgagaccagcgccaaagaaaatttcaacattaaggctttgttcaggaagatagctgcagcactgcctgggatggattcatattcctcggcgacaaaatcagacgatatggttgatgtgaacctaaagaacacttcaagttcatcacaaggtgagcaacaaggaggaggtggtggaggcggctgttcttgttga

SEQ ID NO: 10721 - protein, 214 aa, Brassica napus
MASVSALAKFKLVFLGDQSVGKTSIITRFMYDKFDTSYQPTIGIDFLSKTMYLEDRTVRLQLWDTAGQERFRSLIPSYIRDSSVAIVVYDVANRQTFLNIPKWIDDVHRERGGSGDVIIVLVGNKTDLVDKRQVSISEGEEKGKEHGVMFIETSAKENFNIKALFRKIAAALPGMDSYSSATKSDDMVDVNLKNTSSSSQGEQQGGGGGGGCSC

SEQ ID NO: 10722 - DNA, 666 bp, Glycine max
  CDS (1)..(666)
atggctttgccacagcaacatacggttgactatcccagtttcaagcttgtcatcgtaggcgacggaggaactgggaaaaccacttttgtcaagagacacataacgggagagtttgagaagaaatatgaaccaaccattggtgtggaggttcatccactagacttccataccaattgtggaagaattcgcttttactgctgggacactgctggccaagaaaaattcggtggtcttagagatggttattatattcatggacactgtgctatcattatgtttgatgtaacagctcgcatgacatacaggaacgttgctacatggcacagagatctctgtcgggtgtgtgagaacattcccattgttctctgcggaaacaaggttgatgtgaagaatagacaggttaaagcaaagcaggttacatttcacaggaaaaagaatctgcagtactatgagatatctgcaaagagtaactacaatttcgaaaaaccctttctataccttgccaagaaacttgcaggggatcagggccttcattttgtggaaatgcctgctcttgctcccccggacgtagtcattgatatagctacacaacaattgaatgaagaagagatatgtagagcggctgctcagcctcttcctgatgacgaagatgatttatttgaataa

SEQ ID NO: 10723 - protein, 221 aa, Glycine max
MALPQQHTVDYPSFKLVIVGDGGTGKTTFVKRHITGEFEKKYEPTIGVEVHPLDFHTNCGRIRFYCWDTAGQEKFGGLRDGYYIHGHCAIIMFDVTARMTYRNVATWHRDLCRVCENIPIVLCGNKVDVKNRQVKAKQVTFHRKKNLQYYEISAKSNYNFEKPFLYLAKKLAGDQGLHFVEMPALAPPDVVIDIATQQLNEEEICRAAAQPLPDDEDDLFE

SEQ ID NO: 10724 - DNA, 651 bp, Brassica napus
  CDS (1)..(651)
atggctgctcctcctgctagagctcgcgctgattacgattacctcattaaactactcttgatcggagacagcggtgtgggtaagagttgcctcctcttgcgtttttcagatggctcctttaccaccagtttcattacaaccattggaattgatttcaagatacggactattgagctggatgggaagagaattaagctgcaaatctgggatactgcaggacaggagcggttccggactatcacaactgcgtactaccgtggagccatgggcattttgcttgtgtatgatgtcaccgatgaatcatctttcaacaacatcaggaactggatccgtaacattgagcagcacgcttctgataatgtcaacaagattctcgtggggaacaaggcagatatggatgaaagcaaaagagctgtgccaaaagctaagggacaagctcttgcagatgaatacggaatcaagttcttcgagactagtgccaagacgaacttaaacgttgaggaagttttcttttcaataggtaaagacattaagcaaagactcgcagataccgatgcaagggctgagccacaaacaatcagaatcaaccaatccgaccaaggtgcagggacgtcgcaagctactcagaaatcagcatgttgcggttcgtag

SEQ ID NO: 10725 - protein, 216 aa, Brassica napus
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPKAKGQALADEYGIKFFETSAKTNLNVEEVFFSIGKDIKQRLADTDARAEPQTIRINQSDQGAGTSQATQKSACCGS

SEQ ID NO: 10726 - DNA, 666 bp, Glycine max
  CDS (1)..(666)
atggctttgcccaaccagcaaaccgtggattaccctagtttcaaactcgttatcgtcggcgatggtggcacaggaaagacaacctttgtgaaaaggcatctcaccggagaattcgagaagaaatatgagccaaccatcggtgtggaggttcacccattggattttttcacaaactgtggaaagattcgattttactgctgggatactgctggacaggagaaatttggtggcctcagagatggatactatatccatggacaatgtgctattatcatgtttgatgttactgcccggctaacatacaaaaatgttcccacctggcaccgtgatctttgcagggtctgtgagaacatcccaattgttctttgcggtaacaaggttgatgtcaagaacaggcaagttaaggcaaagcaggttacattccacaggaagaagaatttgcagtactatgagatttcagctaagagcaactacaactttgaaaagccattcttatatttggccaggaaacttgcaggtgatcctaacttgcacttcgtagaatctcctgcattggctccaccagaagttcaaattgatttagctgcacagcaacagcacgaggctgagcttcttgcagctgctagtcagccccttcctgacgatgatgatgaatcttttgagtag

SEQ ID NO: 10727 - protein, 221 aa, Glycine max
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDLAAQQQHEAELLAAASQPLPDDDDESFE

SEQ ID NO: 10728 - DNA, 621 bp, Triticum aestivum
  CDS (1)..(621)
atggcctctcgccgccgcaccctcctcaaggtcatcatcctcggcgacagcggggttgggaagacttccttgatgaaccaatatgtgaacaagaagttcagcaaccagtacaaggctacgattggcgccgatttcctcaccaaggaggtgcagttcgaggacaggctcttcaccctacaaatatgggatactgccggtcaggagaggtttcaaagtcttggtgttgcattctaccgcggtgcagattgttgtgttctagtttacgatgttaactcaatgaaatcatttgataatctgaacaactggcgtgaagagtttctaattcaggctagcccatcagatcctgataacttcccttttgttctgctgggtaacaaagttgatgtagatggcgggaatagtcgcgtggtttctgagaaaaaggcgaaggcatggtgtgcctctaaagggaacatcccatactttgagacttctgccaaggatggaatcaacgtggaggaagctttccagtgtatagtaaagaacgctctgaagaacgagccagaggaagaactgtatatgccggacaccgtggacgtggtgggtggcaaccggggtcaaggatcatcaggatgctgttag

SEQ ID NO: 10729 - protein, 206 aa, Triticum aestivum
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGINVEEAFQCIVKNALKNEPEEELYMPDTVDVVGGNRGQGSSGCC

SEQ ID NO: 10730 - DNA, 621 bp, Brassica napus
  CDS (1)..(621)
atgccttctcgtagacgtaccctcctcaaagtcatcatcctcggcgatagcggggtggggaaaacctctttgatgaatcaatatgttaataaaaagttcagcaaccagtacaaggccaccattggagctgacttcttgactaaggaagttcagtttgaagatcgccttttcactttacagatctgggatacagctggacaagaaaggttccagagccttggtgtagctttctaccggggtgctgattgctgtgttcttgtatatgatgtcaactccatgaaatcatttgacaatctcaacaactggagagaagagtttctcatccaggcgagtccatcggatccagagaattttccctttgtggttattggaaacaaggtcgacgttgatggtggaaacagccgagtggtttcagagaaaaaagctaaggcttggtgtgcttcaaagggaaacatcccttactttgagacctcagccaaggaaggcaccaatgtggaggaagcattcgaatgcatcgccaggaacgccctgaagagtggagaagaggaagagctgtacttgccagacacaatcgatgtcgggacaagcaatcaacagaggtctacagggtgtgaatgctaa

SEQ ID NO: 10731 - protein, 206 aa, Brassica napus
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVVIGNKVDVDGGNSRVVSEKKAKAWCASKGNIPYFETSAKEGTNVEEAFECIARNALKSGEEEELYLPDTIDVGTSNQQRSTGCEC

SEQ ID NO: 10732 - DNA, 666 bp, Brassica napus
  CDS (1)..(666)
atggctctaccgaaccagcaaaccgtcgattatcctagcttcaagctcgtcattgttggtgacggaggcacagggaaaactactttcgtcaagaggcatcttactggggagtttgagaagaagtatgaacctaccattggtgtggaggttcatcctttggatttcttcacaaactgtggcaagatccgtttctactgctgggatactgctggtcaagagaagttcggtggccttagggatggttactacatccatggccagtgtgctgtgattatgtttgacgtcacagcacgtctcacatacaagaacgttccaacatggcaccgtgatctctgcagggtgtgcgagaatattcccattgttctctgtgggaacaaagtcgatgtcaagaacaggcaagccaaggccaagcaggtgacattccacaggaagaagaatctgcagtactacgagatatccacaaagagcaactacaacttcgagaagcccttcttgtacctcgctaggaaacttgctggcgaccctaaccttcactttgtcgagtcaccagctcttgctccccctgaggttcacattgacgttgctgagcagcagaagaacgaggctgatctcattgccgccgctgctcagcctctcccagatgatgatgatgacgtttctgagtaa

SEQ ID NO: 10733 - protein, 221 aa, Brassica napus
MALPNQQTVDYPSFKLVIVGDGGTGKTTFVKRHLTGEFEKKYEPTIGVEVHPLDFFTNCGKIRFYCWDTAGQEKFGGLRDGYYIHGQCAVIMFDVTARLTYKNVPTWHRDLCRVCENIPIVLCGNKVDVKNRQAKAKQVTFHRKKNLQYYEISTKSNYNFEKPFLYLARKLAGDPNLHFVESPALAPPEVHIDVAEQQKNEADLIAAAAQPLPDDDDDVSE

SEQ ID NO: 10734 - DNA, 639 bp, Glycine max
  CDS (1)..(639)
atgaattcttcttctggtcagagcagtggctatgatctctccttcaagatcttgctgatcggtgactctgctgtgggaaaaagtagcctccttgttagcttcatctccaattctgctgaagatattgcccccacaattggtgttgattttaagatcaagatgctcactgtaggagggaagagattgaaactaactatttgggacactgctggacaggaaaggttcagaacgctaactagttcttactatagaggagcgcaaggaatcattcttgtttatgatgtaacgagaagagacaccttcacaaacttatcagaagtgtggtctaaagaagtggaactctattcaactaatcagaattgcgtgaagatgctagttggaaataaagttgatagagattctgaaagggttgtgagcaaagaagagggtttagcacttgccgaggagttgggatgtttgttttttgaatgtagtgccaaaactcgagaaaatgtggagcggtgcttcgaggaacttgcactgaagataatggaagttcctagtcttttggaagaaggatctacagcagtaaaaaggaatattctaaagcaacaacaggaacaaccccaagcatccgaatttggtggttgttgctcttaa

SEQ ID NO: 10735 - protein, 212 aa, Glycine max
MNSSSGQSSGYDLSFKILLIGDSAVGKSSLLVSFISNSAEDIAPTIGVDFKIKMLTVGGKRLKLTIWDTAGQERFRTLTSSYYRGAQGIILVYDVTRRDTFTNLSEVWSKEVELYSTNQNCVKMLVGNKVDRDSERVVSKEEGLALAEELGCLFFECSAKTRENVERCFEELALKIMEVPSLLEEGSTAVKRNILKQQQEQPQASEFGGCCS

SEQ ID NO: 10736 - DNA, 624 bp, Triticum aestivum
  CDS (1)..(624)
atggcgtcgcgccggcgaatgctcctcaaggtcatcatcctcggcgacagcggggtcgggaagacgtcgctgatgaaccagtacgtcaacaacaagttcagcaaccagtacaaggccaccatcggcgccgatttcctcaccaaggaggtcaagatcgacgaccgcctcttcactctacagatatgggacacggcaggacaggaacgttttcagagtcttggtgtggcgttttatcggggagctgactgttgtgttcttgtatatgatgtcaatgttaccaagtcatttgaaaaactcaacaactggcgtgaggaatttctaattcaagctagcccgtcagatccagagaattttccttttgttttacttggaaacaagattgatgttgatggtggtaacagcaggactgtttctgagaaaaaagctaaagcctggtgtgcttccaagggaaacatcccttattttgagacgtctgctaaagaaggcttcaatgtggaagcagctttcgagtgtatagcaaggaatgccatcaagaatgaacctgaagaagatatatatctccctgatacaatcgacatgggcggtgctggaaggcaacaacgctcgtcaggttgtgaatgctag

SEQ ID NO: 10737 - protein, 207 aa, Triticum aestivum
MASRRRMLLKVIILGDSGVGKTSLMNQYVNNKFSNQYKATIGADFLTKEVKIDDRLFTLQIWDTAGQERFQSLGVAFYRGADCCVLVYDVNVTKSFEKLNNWREEFLIQASPSDPENFPFVLLGNKIDVDGGNSRTVSEKKAKAWCASKGNIPYFETSAKEGFNVEAAFECIARNAIKNEPEEDIYLPDTIDMGGAGRQQRSSGCEC

SEQ ID NO: 10738 - DNA, 615 bp, Zea mays
  CDS (1)..(615)
atggcggcaaccgcgggcggcaacaagatccgcaacgccaagctggttcttcttggggacgtgggcgccggcaagtccagcctggtcctccggtttgtgaaaggccagttcgtcgagttccaggaatccaccatcggcgcggctttcttctcgcagaccctggcggtgaacgacgagacggtcaagttcgagatatgggacacggcggggcaggagcggtaccacagcttggctcccatgtattaccggggcgctgcggctgccatagttgtctacgacatcacgaacgcggcctcttttacgcgtgcgaagaaatgggttcaagaacttcaagcacaaggaaactcgaatacaatagtggctcttgccgggaacaaggctgatttgttagatacgaggcaggtgtcagcagatgaagcaaaggcgtatgctcaagagaatggtctcttcttcatggaaacttctgccaaaacagctaccaatgtgaacgacgtgttctatgagattgcgaagaaactgcttcaagggcagcaggttcagaacccacaaggcgggatggttctcaaccagagaccacctgagaggatggtgagctcttcttcctgctgtgcgtga

SEQ ID NO: 10739 - protein, 204 aa, Zea mays
MAATAGGNKIRNAKLVLLGDVGAGKSSLVLRFVKGQFVEFQESTIGAAFFSQTLAVNDETVKFEIWDTAGQERYHSLAPMYYRGAAAAIVVYDITNAASFTRAKKWVQELQAQGNSNTIVALAGNKADLLDTRQVSADEAKAYAQENGLFFMETSAKTATNVNDVFYEIAKKLLQGQQVQNPQGGMVLNQRPPERMVSSSSCCA

SEQ ID NO: 10740 - DNA, 612 bp, Zea mays
  CDS (1)..(612)
atggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttagcggtcaatgatgagactgttaagttcgaaatctgggatactgccgggcaggagaggtatcatagcttggctcccatgtactataggggtgcagctgctgccattgttgtctatgacatcacaaatccggcctccttcacccgtgccaagaaatgggttcaagaacttcaagctcaaggaaatcagaataccatagtggctcttgctggaaacaaggctgatatgctagatgcgaggcaggtgccagcagaggaagcaaaggcgtatgctcaggagaatgggctcttcttcatggagacatctgctaaaactgcaatcaatgtgaatgacatattttatgagattgcaaagaaattgcttcaagggcaacaagctccaagcccacaggctggaatggttctgaatcagagaccaaatgagaggacggtcagcagttcttcatgctgctcttga

SEQ ID NO: 10741 - protein, 203 aa, Zea mays
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNQNTIVALAGNKADMLDARQVPAEEAKAYAQENGLFFMETSAKTAINVNDIFYEIAKKLLQGQQAPSPQAGMVLNQRPNERTVSSSSCCS

SEQ ID NO: 10742 - DNA, 648 bp, Zea mays
  CDS (1)..(648)
atggattcctcctcgtccagcctcagccagcagcccgagttcgactacctcttcaagctactccttatcggcgactccggcgtcggcaagagcagcctcctcctccgcttcaccgccgactccttcgatgacctctcccctaccataggtgttgacttcaaggtgaagatggttagcattggtggcaaaaaactcaagcttgccatctgggacacagctggacaagagaggtttaggaccttgaccagctcttactacagaggggcacaggggatcattatggtgtatgatgtcagtcgacgagagacgttcaccaatctttctgatatatgggccaaggaaattgacctgtattcaaccaaccaggactgtgtaaagatgcttgttggaaataaagtagacaaggaaagtgagagggctgtcacgaaaaaggagggaattgaatttgccagggaatacggttgtttgtttctagaatgcagtgcgaaaacaaaagtaaacgtagaacagtgttttgaggaactggttctaaagatcttagacacgccaagcctcctggcggatgcttcctcagcaggggtcagcaagaagaacatcttcaagcagaaggctccagaagctgacgccgccacaggcagctgctgttaa

SEQ ID NO: 10743 - protein, 215 aa, Zea mays
MDSSSSSLSQQPEFDYLFKLLLIGDSGVGKSSLLLRFTADSFDDLSPTIGVDFKVKMVSIGGKKLKLAIWDTAGQERFRTLTSSYYRGAQGIIMVYDVSRRETFTNLSDIWAKEIDLYSTNQDCVKMLVGNKVDKESERAVTKKEGIEFAREYGCLFLECSAKTKVNVEQCFEELVLKILDTPSLLADASSAGVSKKNIFKQKAPEADAATGSCC

SEQ ID NO: 10744 - DNA, 603 bp, Glycine max
  CDS (1)..(603)
atggctacgatcggacacaacaatctcaatgccaaattggttcttctcggggacatgggtgctgggaaatccagcctcgttttgcgctttgtcaagggtcaatttctcgaatttcaggaatcaacaataggggcagcgttcttttcacagacgctggcagtaaatgacgcgacggtaaagtttgagatatgggacacagcaggacaagagaggtaccatagcttggctcccatgtattacagaggtgctgctgctgctatcattgtctatgacatcactagctcggactcctttacccgaactaagaagtgggtccaagagcttcaaaagcaagggaatcctaatatggtcatggctcttgctggtaacaaagctgatttggaagataagaggaaagtgacagctgaagaagcacgtgtatatgctgaagaaaatggtttgtttttcatggagacctctgccaaaactgcatccaacgttaatgatatattctatgaaatagccaagaggttaccaagggctcagccagctcagaacccagctgggatggtacttgttgatagacccgccgaaggaactagggctgcatcatgttgttcataa

SEQ ID NO: 10745 - protein, 200 aa, Glycine max
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSDSFTRTKKWVQELQKQGNPNMVMALAGNKADLEDKRKVTAEEARVYAEENGLFFMETSAKTASNVNDIFYEIAKRLPRAQPAQNPAGMVLVDRPAEGTRAASCCS

SEQ ID NO: 10746 - DNA, 618 bp, Triticum aestivum
  CDS (1)..(618)
atggcggccagcgccggcagcaagatccgcaacgccaaactggttcttcttggcgatgtgggtgctgggaaatccagcctggtgcttcggtttgtaaaaggacaatttgttgaattccaggaatcgacaattggagcggctttcttctctcaaacattggctgttaatgacgagactgtgaagtttgaaatttgggatactgctgggcaggagaggtatcacagcttggcccccatgtactacaggggtgctgccgcagccatagttgtctatgacatctcgaaccaggcatccttcacccgagcaaagaaatgggttcaagaacttcaagctcaaggaaaccagaatacagtagtggctcttgctggcaacaaagctgatttgcttgaggcgagggaggttcaaatagaggaagccaagacgtatgcgcaggagaatggcctcttcttcatggaaacatctgctaaaactgcaaccaatgtgaatgacatattttatgagattgcgaagagattgctgcaagggcaggcagcgcagaacccacaggcggcggggatggttctctcccagagacccaatgagagagtggtcagcgcggcttcgtgctgctcctcctga

SEQ ID NO: 10747 - protein, 205 aa, Triticum aestivum
MAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEAREVQIEEAKTYAQENGLFFMETSAKTATNVNDIFYEIAKRLLQGQAAQNPQAAGMVLSQRPNERVVSAASCCSS

SEQ ID NO: 10748 - DNA, 612 bp, Zea mays
  CDS (1)..(612)
atgaatcccgagtatgattaccttttcaaacttctgcttatcggtgattctggtgttggaaaatcatgcttgcttctcagatttgcagatgattcatatctggacagctacatcagcacaattggagttgactttaaaattaggacagtagagcaagacgggaagaccataaagcttcaaatttgggatactgctggacaagagcgcttcaggacaatcactagcagctactaccgcggagctcacggaatcattattgtatatgacgtgacagaccaagaaagcttcaataatgtgaagcaatggttaaacgagattgaccgttatgcaagtgacaatgttaacaagctccttgttgggaacaagagcgatctaactgctaacaaagttgtggcaaccgagacagcaaaggcgtttgctgatgagatgggcatcccattcatggagacgagtgccaaaaacgccatcaatgtggagcaggccttcatggctatggctgcatccatcaaggacaggatggccagccaaccagctgcggctaacgcaaggccagcgaccgtgcagatccgcggtcaacccgtcaaccagaagacgtcttgctgctcatcctaa

SEQ ID NO: 10749 - protein, 203 aa, Zea mays
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNAINVEQAFMAMAASIKDRMASQPAAANARPATVQIRGQPVNQKTSCCSS

SEQ ID NO: 10750 - DNA, 621 bp, Zea mays
  CDS (1)..(621)
atggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgctaaggatggaacgaacgtggaagatgccttccagtgtattgtaaagaatgctctgaagaatgaaccggaggaagaattgtatgtgccagataccgtggatgtggtaggtggcaaccgggctcagagatcatctggctgctgttaa

SEQ ID NO: 10751 - protein, 206 aa, Zea mays
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAQRSSGCC

SEQ ID NO: 10752 - DNA, 657 bp, Zea mays
  CDS (1)..(657)
atggcggccccgccgtcgaggtcgcggggcgactacgaccacctgattaagctcctgctcatcggcgacagcggagttggaaagagttgcttgctgctgcggttctctgatgacacattcacgacaagttttatcaccaccatcggcattgatttcaaggttaggacggtcgagctcgatggaaagcgtgtaaaattacaaatttgggacactgctggtcaagaacgtttccgaacaattaccactgcttactacagaggagctatgggcattctgcttgtatacgatgtcacagacgaatcgtccttcgataacattaggaactggattcgcaacatagagcagcacgcatctgataatgtcaacaagatcttggtgggcaacaaggtcgatatggatgcgaagcgggtggtctccacagctcaaggtcagaagctcgcagatgaatacgggatcaagtttttcgagacgagtgcgaaaacgaaccgaaatgtggagcaggtattcttcgccatggcaagggacgtgaagcaaaggctcaccgagaccgttgccgctgcggctgagcccccgaccattcagattagcaggccagaccccgaccaggctgacgcagcctcctcgcggcggtggtcgtcgtcctgctgtaacacctga

SEQ ID NO: 10753 - protein, 218 aa, Zea mays
MAAPPSRSRGDYDHLIKLLLIGDSGVGKSCLLLRFSDDTFTTSFITTIGIDFKVRTVELDGKRVKLQIWDTAGQERFRTITTAYYRGAMGILLVYDVTDESSFDNIRNWIRNIEQHASDNVNKILVGNKVDMDAKRVVSTAQGQKLADEYGIKFFETSAKTNRNVEQVFFAMARDVKQRLTETVAAAAEPPTIQISRPDPDQADAASSRRWSSSCCNT

SEQ ID NO: 10754 - DNA, 627 bp, Zea mays
  CDS (1)..(627)
atggcaccggtgtcagcgctcgccaagtacaagctcgtcttcctgggggaccagtccgtcggcaagacgagcatcatcacccgcttcatgtacgacaagttcgataacacctaccaggctacgattggtattgatttcctgtcaaagacaatgtaccttgaagatagaactgtgagactccaactctgggatactgctggtcaggaaagattcaggagtttaattccaagctatattagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcaatagaggaaggggagggcaaggcgaaggaccttggagtcatgtttattgaaaccagtgctaaggctggttttaacattaaggcgctgttccgtaaaattgctgctgcacttcctggaatggagacgctctcatcagcgaaacaggaagacatggttgatgtgaacttgaggtccggcaatgcaaactcgtcccagtctcaggctcaggctgggggatgcagttgttag

SEQ ID NO: 10755 - protein, 208 aa, Zea mays
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIEEVRTERGSDVIIVLVGNKTDLVDKRQVSIEEGEGKAKDLGVMFIETSAKAGFNIKALFRKIAAALPGMETLSSAKQEDMVDVNLRSGNANSSQSQAQAGGCSC

SEQ ID NO: 10756 - DNA, 624 bp, Zea mays
  CDS (1)..(624)
atggcgacgcgcaggcgaatgctcctcaaggtcatcatcctcggcgacagcggggtcggcaagacctcgctgatgaaccagtacgtcaacaacaggttcagcaaccagtacaaggccaccatcggcgcggatttcctcaccaaggaggtccagatcgacgaccgcctcttcacactgcagatatgggatacggcaggacaggagcggtttcaaagtcttggtgtggcattttataggggagctgactgctgtgttcttgtatatgatgtcaacgtatccaagtcatttgaaaagctcaacaactggcgtgagaaattcctaattcaagccagcccatcagacccagagaatttcccatttgttgtgcttggtaacaagatcgatgttgatggtggtaacagccggactgtttctgagaagaaggctaaagcatggtgtgcttcaaagggaaacatcccctactttgagacgtcggctaaagagggcttcaatgtagaggctgcatttgagtgtatagcgaggaatgctgtaaaaaatgagccagaagaagatatgtatcttcctgatacgattgatgttgggggcgctggaaggcaacaacgttcgtcaggttgtgaatgctag

SEQ ID NO: 10757 - protein, 207 aa, Zea mays
MATRRRMLLKVIILGDSGVGKTSLMNQYVNNRFSNQYKATIGADFLTKEVQIDDRLFTLQIWDTAGQERFQSLGVAFYRGADCCVLVYDVNVSKSFEKLNNWREKFLIQASPSDPENFPFVVLGNKIDVDGGNSRTVSEKKAKAWCASKGNIPYFETSAKEGFNVEAAFECIARNAVKNEPEEDMYLPDTIDVGGAGRQQRSSGCEC

SEQ ID NO: 10758 - DNA, 612 bp, Hordeum vulgare
  CDS (1)..(612)
atgaatccggagtatgactatctctttaagcttttgcttattggagactcaggtgttggcaagtcatgccttctcttaagatttgccgatgactcatacctggagagttatatcagtactatcggtgttgattttaaaatacgtaccgtggagcaagatggaaagactatgaagctgcaaatctgggacactgctgggcaagaacgcttcagaactattactagtagctactatcgtggggctcacgggatcattattgtctatgacgtgacagacctggacagcttcaacaatgtgaagcagtggttgaacgagattgatcgctatgctagtgagaatgtgaacaagcttcttgtagggaacaaatgtgatctcactgacaaaaaagttgtatcatacgagacagcgaaggcatttgctgatgagattgggatcccattcatggagaccagtgcaaagaatgccttgaatgttgagcaggctttcatggccatgtctgcttcaatcaaggacaggatggcgagccagccagccgcaaacagcgctcgcccagccacggtgcagatccgcgggcaacctgttgaacagaagacgagctgctgctcttcttag

SEQ ID NO: 10759 - protein, 203 aa, Hordeum vulgare
MNPEYDYLFKLLLIGDSGVGKSCLLLRFADDSYLESYISTIGVDFKIRTVEQDGKTMKLQIWDTAGQERFRTITSSYYRGAHGIIIVYDVTDLDSFNNVKQWLNEIDRYASENVNKLLVGNKCDLTDKKVVSYETAKAFADEIGIPFMETSAKNALNVEQAFMAMSASIKDRMASQPAANSARPATVQIRGQPVEQKTSCCSS

SEQ ID NO: 10760 - DNA, 621 bp, Hordeum vulgare
  CDS (1)..(621)
atggcctcgcgacgccgcacgctcctcaaggtcatcatcctcggcgacagcggggtcgggaagacgtccttgatgaaccaatatgtgaacaagaagttcagtaaccagtacaaggccaccatcggcgcggatttcctcaccaaggaggtgcaatacgaggacaggctcttcactctgcagatatgggatactgctggacaggaaaggtttcagagtcttggtgttgcattctaccgtggagcagattgttgtgttctagtttatgatgttaattcaatgaaatcatttgataatctgaacaactggcgcgaagaatttctgatccaggctagtccgtctgatcctgataacttcccttttgttctgctgggaaacaaagttgatattgatggtggcaacagccgcgtggtctctgagaagaaggcaaaggcttggtgtgcctcaaagggcaacatcccttacttcgagacatctgcgaaagaaggaacaaatgtagaagacgcttttcagtgcattgtaaaggatgctctgaagaatgaaccagaagaagaactgtacattcctgacaccgtcgatgtggtgggtggcaaccgcacccaaagatcaccaggctgctgttag

SEQ ID NO: 10761 - protein, 206 aa, Hordeum vulgare
MASRRRTLLKVIILGDSGVGKTSLMNQYVNKKFSNQYKATIGADFLTKEVQYEDRLFTLQIWDTAGQERFQSLGVAFYRGADCCVLVYDVNSMKSFDNLNNWREEFLIQASPSDPDNFPFVLLGNKVDIDGGNSRVVSEKKAKAWCASKGNIPYFETSAKEGTNVEDAFQCIVKDALKNEPEEELYIPDTVDVVGGNRTQRSPGCC

SEQ ID NO: 10762 - DNA, 621 bp, Brassica napus
  CDS (1)..(621)
atgagcaccgagtacgattatctgttcaagcttttgttgatcggtgactcgtctgttggaaaatcatgcctccttctccgattcgccgatgatgcttacattgacagttacattagtaccattggtgttgacttcaaaattaggacgattgagctggatgggaagaccgttaagctgcaaatctgggatactgctgggcaagaacgtttcaggaccatcactagcagctactacagaggagctcatggaatcattattgtgtacgactgtactgagatggagagcttcaacaacgtgaagcagtggttgagtgagatcgacagatatgctaatgacagtgtttgcaagcttcttatcggtaacaagaatgatatggttgagagtaaagttgtttccaccgaaactggaaaggctttagcagatgagcttggaattccctttcttgagaccagtgctaaggattctatcaacgtcgaacaggcattcttaactattgctggcgagatcaagaagagaatgggaagccagcctaatgcaaacaatacatctggaagtggaactgttcagatgaaaggtcagccaattctacagaacaatggcggttgctgcagtagtagttaa

SEQ ID NO: 10763 - protein, 206 aa, Brassica napus
MSTEYDYLFKLLLIGDSSVGKSCLLLRFADDAYIDSYISTIGVDFKIRTIELDGKTVKLQIWDTAGQERFRTITSSYYRGAHGIIIVYDCTEMESFNNVKQWLSEIDRYANDSVCKLLIGNKNDMVESKVVSTETGKALADELGIPFLETSAKDSINVEQAFLTIAGEIKKRMGSQPNANNTSGSGTVQMKGQPILQNNGGCCSSS

SEQ ID NO: 10764 - DNA, 609 bp, Brassica napus
  CDS (1)..(609)
atgaatcctgaatatgactatctgttcaagcttttgcttatcggtgattctggtgttggaaaatcatgcttgcttctaagatttgctgatgattcttacctggatagctacatcagtaccattggtgttgactttaaaatccgcacagttgaacaagacggaaagacaatcaaactccagatttgggacacagcaggtcaagaacgtttcaggacaatcaccagcagttactacagaggagctcatggaatcattgtcacctatgatgtcacagaccaagagagcttcaacaacgtcaaacagtggctgaatgaaatcgaccgttacgccagtgagaatgtgaacaagctactggttgggaacaaaaacgatctcacatcacagaaggttgtatccactgagacagctcaggcttttgcagatgaactggggatccctttcttggaaacaagtgctaaaaatgcaaccaatgtcgaagaagctttcatggccatgactgctgctattaagaccagaatggctagccaaccagctggaggtgccaagccaccgacggtcaatattcgcggacagccggtgaaccagcaatcaggctgttgctcatcttga

SEQ ID NO: 10765 - protein, 202 aa, Brassica napus
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKNDLTSQKVVSTETAQAFADELGIPFLETSAKNATNVEEAFMAMTAAIKTRMASQPAGGAKPPTVNIRGQPVNQQSGCCSS

SEQ ID NO: 10766 - DNA, 651 bp, Brassica napus
  CDS (1)..(651)
atggctgctccacctgctagggccagagccgattacgactatctcatcaagcttcttttgatcggagatagcggtgtgggtaaaagttgcctgcttctacgtttctctgatggctccttcaccactagcttcatcaccaccattggcattgactttaagatcagaaccattgagcttgatggcaaacgtatcaagctccagatttgggacactgctggtcaagaacgcttccgcactatcaccaccgcttattaccgtggggcaatgggcattttgctagtctatgatgtcacagacgagtcctccttcaacaacattaggaactggattcgtaatatcgaacagcatgcttcagataatgttaacaagatcttggttgggaacaaggctgacatggacgaaagcaagagggctgtacctacagcaaagggtcaggctcttgctgatgagtacggaattaagttcttcgaaactagtgctaagacaaacctaaacgtggaagaagttttcttctccataggcaaggacataaaacagaggctttctgacactgactccaaggcagagcctgccacgatcaagataagccaaacagaccaggcagctggagccgggcaagccacacagaagtctgcatgctgtggaagttaa

SEQ ID NO: 10767 - protein, 216 aa, Brassica napus
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGKDIKQRLSDTDSKAEPATIKISQTDQAAGAGQATQKSACCGS

SEQ ID NO: 10768 - DNA, 666 bp, Brassica napus
  CDS (1)..(666)
atggctgtaccaaaccagcaaaccgtcgattaccctagcttcaagctcgtcatcgttggtgatggaggcacagggaaaactacgttcgtgaagaggcatcttactggagagtttgagaagaagtatgaacccactattggtgttgaggttcaccctctagacttcttcactaactgtggcaagatccgcttttactgctgggatactgctggacaagagaagtttggtggtcttagggatggttactacatccatgggcagtgtgccgtcatcatgtttgatgtcacagcacgtctgacatacaagaatgtcccaacatggcaccgtgatctttgcagggtctgtgaaaacatcccgattgttctttgtgggaacaaagttgatgtgaagaacaggcaagtgaaggccaagcaggtgacattccacaggaagaagaatctccagtactacgagatctctgccaagagcaactacaatttcgagaagccattcttgtaccttgctaggaaactcgccggggaccctaaccttcactttgtggaatcacctgcccttgctcccccagaagtacagattgacatggctgctcagcaacagcatgaggcggagcttgcagccgcagcaagtcagccactccctgatgacgatgatgacacgttcgagtag

SEQ ID NO: 10769 - protein, 221 aa, Brassica napus
MAVPNQQTVDYPSFKLVIVGDGGTGKTTFVKRHLTGEFEKKYEPTIGVEVHPLDFFTNCGKIRFYCWDTAGQEKFGGLRDGYYIHGQCAVIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDMAAQQQHEAELAAAASQPLPDDDDDTFE

SEQ ID NO: 10770 - DNA, 666 bp, Brassica napus
  CDS (1)..(666)
atggctctaccgaaccagcaaaccgtcgattatcctagcttcaagctcgtcattgttggtgacggaggcacagggaaaactactttcgtcaagaggcatcttactggggagtttgagaagaagtatgaacctaccattggtgtggaggttcatcctttggatttcttcacaaactgtggcaagatccgtttctactgctgggatactgctggtcaagagaagttcggtggccttagggatggttactacatccatggccagtgtgctgtgattatgtttgacgtcacagcacgtctcacatacaagaacgttccaacatggcaccgtgatctctgcagggtgtgcgagaatattcccattgttctctgtgggaacaaagtcgatgtcaagaacaggcaagtcaaggccaagcaggtgacattccacaggaagaagaatctgcagtactacgagatatccgcaaagagcaactacaacttcgagaagcccttcttgtacctcgctaggaaacttgctggcgaccctaaccttcactttgtcgagtcaccagctcttgctccccctgaggttcacattgacgttgctgagcagcagaagaacgaggctgatctcattgccgccgctgctcagcctctcccagatgatgatgatgacgcttttgagtaa

SEQ ID NO: 10771 - protein, 221 aa, Brassica napus
MALPNQQTVDYPSFKLVIVGDGGTGKTTFVKRHLTGEFEKKYEPTIGVEVHPLDFFTNCGKIRFYCWDTAGQEKFGGLRDGYYIHGQCAVIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVHIDVAEQQKNEADLIAAAAQPLPDDDDDAFE

SEQ ID NO: 10772 - DNA, 615 bp, Brassica napus
  CDS (1)..(615)
atgaatcccgccgagtacgactaccttttcaagctcctgctcattggggattctggcgtgggcaagtcttgtctactgttgagattctctgatgattcgtatgtagaaagttacataagcactattggagtcgattttaaaattcggactgtggagcaagacgggaagacgattaagctccaaatttgggacactgctggtcaagagcgcttcaggactattactagcagttattaccgtggcgcacatggaatcattattgtctacgacgtcacagatcaagaaagctttaataatgtgaagcaatggttgagtgaaattgatcgttatgctagtgacaatgtgaacaaactcctagttggaaacaagtgtgatcttgctgaaaacagagccgttccatatgaaaccgcaaaggcttttgccgatgaaattggaattcctttcatggagactagtgcaaaagatgctacaaacgtggaacaggctttcatggccatgtcggcatccatcaaagagagtatggcaagccaaccagctgggaacattgccagaccgccgacggtgcagatcagaggacagcctgttgcccaaaagaatggctgttgctcaacttga

SEQ ID NO: 10773 - protein, 204 aa, Brassica napus
MNPAEYDYLFKLLLIGDSGVGKSCLLLRFSDDSYVESYISTIGVDFKIRTVEQDGKTIKLQIWDTAGQERFRTITSSYYRGAHGIIIVYDVTDQESFNNVKQWLSEIDRYASDNVNKLLVGNKCDLAENRAVPYETAKAFADEIGIPFMETSAKDATNVEQAFMAMSASIKESMASQPAGNIARPPTVQIRGQPVAQKNGCCST

SEQ ID NO: 10774 - DNA, 651 bp, Brassica napus
  CDS (1)..(651)
atggctggttacaaagcagatgatgaatacgattaccttttcaaggttgttctcatcggtgattccggtgttggaaaatctaatctgctttcacgattcacgaagaacgagtttagtctcgagtccaaatccaccatcggagtcgagttcgcgactcggagtttgaatgttgatgataaagtcatcaaagcccagatttgggatactgctggtcaagaaaggtaccgagccatcactagcgcgtattaccgaggagctgttggagcgcttcttgtctacgacgtaacccgacactccacattcgaaaacgtggagacgtggctcaaagaactcagaaaccacactgatccgaacatcgtagtcatgctcgtgggcaacaaatctgatctccgccacctcgtggctgttcagacagaggacgccaagtcattcgccgagaaagagtctctttgcttcatggaaacctctgctcttgagtccacgaacgtcgaggacgctttcgcgcaagtcctcactcagatccacagtattgtgagtaaaaaggccatggaagcagccagcgagtcagctaacgccccgtcgagaggagacaagatcgaaatcggtaaagatgtttctgccgtcaagaaagctggatgctgttcgaactaa

SEQ ID NO: 10775 - protein, 216 aa, Brassica napus
MAGYKADDEYDYLFKVVLIGDSGVGKSNLLSRFTKNEFSLESKSTIGVEFATRSLNVDDKVIKAQIWDTAGQERYRAITSAYYRGAVGALLVYDVTRHSTFENVETWLKELRNHTDPNIVVMLVGNKSDLRHLVAVQTEDAKSFAEKESLCFMETSALESTNVEDAFAQVLTQIHSIVSKKAMEAASESANAPSRGDKIEIGKDVSAVKKAGCCSN

SEQ ID NO: 10776 - DNA, 603 bp, Brassica napus
  CDS (1)..(603)
atggccaccgctggaaacaagaacatcaacgccaaattggtattgcttggagatgttggggctggaaaatcaagtcttgtgcttcggtttgtcaaagatcagtttgttgagttccaggaatcaaccataggtgcagcttttttctctcaaacactggctgtgaatgacgcaactgtcaagtttgagatatgggatacagctggtcaggaacgttaccatagcttggctccaatgtactacaggggtgcagctgctgccattattgtctttgacattactaatcaagcgtcatttgagagagcgaagaaatgggttcaagaactgcaggcacaaggtaaccctaatatggtgatggctcttgctggaaacaaagctgatttattggatgcaaggaaagtgtctccagaggaggcagagacatatgcgcaagagaacagccttttcttcatggaaacctcagcgaagactgcaacaaatgtcaaagacatcttctacgaaatcgcaaaaaggctaccgcgcgtgcagccagcagaaaacccaacagggatggttctcccaaacgggccaggagctacggcagcaagcgcatcatgttgtgcttaa

SEQ ID NO: 10777 - protein, 200 aa, Brassica napus
MATAGNKNINAKLVLLGDVGAGKSSLVLRFVKDQFVEFQESTIGAAFFSQTLAVNDATVKFEIWDTAGQERYHSLAPMYYRGAAAAIIVFDITNQASFERAKKWVQELQAQGNPNMVMALAGNKADLLDARKVSPEEAETYAQENSLFFMETSAKTATNVKDIFYEIAKRLPRVQPAENPTGMVLPNGPGATAASASCCA

SEQ ID NO: 10778 - DNA, 603 bp, Brassica napus
  CDS (1)..(603)
atggccaccgctggaaacaagaacatcaacgccaaattggtactgcttggggatgttggagctggaaaatcaagtcttgtgcttcggttcgtcaaagatcagtttgttgaattccaggaatcaacgataggtgcagccttcttctctcaaacattggctgtgaatgatgcaactgtcaagtttgagatttgggatacagctggccaggaacgttaccatagcttggctcctatgtactacaggggtgctgctgctgccattattgtctttgacattactaatcaaggctcatttgagagggcgaagaaatgggttcaggaactgcaggctcaaggcaatcctaatatggtgatggctcttgctggaaacaaagctgatttattagatgcaaggaaagtgtctgcagaggaggcagagacatatgctctagagaacagccttttcttcatggaaacctcagccaagactgcaacaaatgtcaaagacatattctatgaaatcgcaaaaaggctaccgcgcgtgcagccagcaaaaaacccaacagggatggttcccccaaacgggccaggagctacggcagcaagcgcatcatgttgtgcttaa

SEQ ID NO: 10779 - protein, 200 aa, Brassica napus
MATAGNKNINAKLVLLGDVGAGKSSLVLRFVKDQFVEFQESTIGAAFFSQTLAVNDATVKFEIWDTAGQERYHSLAPMYYRGAAAAIIVFDITNQGSFERAKKWVQELQAQGNPNMVMALAGNKADLLDARKVSAEEAETYALENSLFFMETSAKTATNVKDIFYEIAKRLPRVQPAKNPTGMVPPNGPGATAASASCCA

SEQ ID NO: 10780 - DNA, 621 bp, Brassica napus
  CDS (1)..(621)
atgccttcccgtagaagaactctcctcaaagtcatcatcctcggcgatagcggggtggggaagacctctttgatgaatcaatatgttaacaagaagtttagcaaccagtacaaggccaccattggtgccgatttcttgactaaggaagtacactatgaagaccgcctcttcactttgcagatatgggacacggctggtcaagaaaggttccagagccttggtgtagctttttatcgcggtgctgattgttgtgtacttgtctatgatgtcaactccgccaaatcatttgaggatctcaacaactggagggaagagtttctgatccaggcgagtccatctgatccagagaacttcccctttgttgtcatcggcaacaaaatcgatgtggatggtggaaacagccgtgtggtttcagagaagaaggctcgagcttggtgtgcttcaaaaggaaacatcccttactatgaaacttctgccaaagagggcaccaatgttgaagacgcattcatgtgtattaccaagaatgcaatgaagagtggagaagaggaagaaatgtacatgcccgacacaattgatgtcggaaccagcaatccacagaggtcaacaggatgtgaatgctaa

SEQ ID NO: 10781 - protein, 206 aa, Brassica napus
MPSRRRTLLKVIILGDSGVGKTSLMNQYVNKKFSNQYKATIGADFLTKEVHYEDRLFTLQIWDTAGQERFQSLGVAFYRGADCCVLVYDVNSAKSFEDLNNWREEFLIQASPSDPENFPFVVIGNKIDVDGGNSRVVSEKKARAWCASKGNIPYYETSAKEGTNVEDAFMCITKNAMKSGEEEEMYMPDTIDVGTSNPQRSTGCEC

SEQ ID NO: 10782 - DNA, 627 bp, Brassica napus
  CDS (1)..(627)
atggctccggtctcggcgctcgccaagtataagctcgtgtttctgggagatcaatccgtggggaagacgagtatcatcactcgattcatgtacgacaaattcgacaacacttaccaggccacgattggtattgattttctatcaaagacaatgtaccttgaagatcggactgtcagactgcagttgtgggatacagcagggcaagagagattcaggagtcttattccgagctatatcagggactcttctgttgctgttattgtctatgatgttgcaagcaggcaatctttcctgaacactactaagtggatcgatgaggttaggacagagcgtggtagtgatgtcatagttgtgctcgtgggaaataaaaccgaccttgtggacaaaaggcaagtgtcaatagaggaagcagaagccaaggctcgtgagcttaatgtaatgttcatcgaaaccagtgccaaagcgggcttcaacataaaggcgcttttccgcaagatcgcagcagctttgccaggaatggaaacactgtcttcgacaaagcaagaggatatggttgatgtcaatctcaagtcttccaacgccaatgcatctttggctcagcagcaatcaggaggatgttcttgttaa

SEQ ID NO: 10783 - protein, 208 aa, Brassica napus
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQSFLNTTKWIDEVRTERGSDVIVVLVGNKTDLVDKRQVSIEEAEAKARELNVMFIETSAKAGFNIKALFRKIAAALPGMETLSSTKQEDMVDVNLKSSNANASLAQQQSGGCSC

SEQ ID NO: 10784 - DNA, 621 bp, Brassica napus
  CDS (1)..(621)
atgccttctcgtagacgtaccctcctcaaagtcatcatcctcggcgatagcggggtggggaaaacctctttgatgaatcaatatgttaataaaaagttcagcaaccagtacaaggccaccattggggcggacttcttgactaaggaagtccagtttgaagatcgtcttttcactttacagatctgggatacagctggacaggaaaggtttcagagccttggggtagctttttaccggggtgctgattgctgtgttcttgtatatgatgtcaactccatgaaatcatttgacaatctcaacaactggagagaagagtttctgatccaggcgagtccatcggatccagagaattttccgtttgttcttatcggaaataaggtcgacgtggatggtggaaacagcagagtggtttcagagaagaaagctaaagcttggtgtgcttcaaagggaaacatcccctactttgagacctctgctaaggaaggcaccaatgtggaggaagcattccaatgcattgccaagaacgccctgaagagcggagaagaggaagagctgtacttgccagacacaatcgatgtcgggacaagcaatcaacagaggtctacagggtgtgaatgctaa

SEQ ID NO: 10785 - protein, 206 aa, Brassica napus
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVLIGNKVDVDGGNSRVVSEKKAKAWCASKGNIPYFETSAKEGTNVEEAFQCIAKNALKSGEEEELYLPDTIDVGTSNQQRSTGCEC

SEQ ID NO: 10786 - DNA, 621 bp, Brassica napus
  CDS (1)..(621)
atgagcaccgagtacgattatctgtttaagcttttgttgatcggtgactcgtctgttggaaaatcatgcctccttctccgattcgccgatgatgcttacattgacagttacattagtaccattggtgttgacttcaaaattaggacgattgagctggatgggaagaccgttaagctgcaaatctgggatactgttgggcaagaacgtttcaggaccatcactagcagctactacagaggagctcatggaatcattattgtgtacgactgtactgagatggagagcttcaacaacgtgaagcagtggttgagtgagatcgataggtatgctaatgacagtgtttgcaagcttcttatcggtaacaagaatgatatggttgagagtaaagttgtttccaccgaaactggaaaggccttagcggatgagcttggaattccatttctggagaccagtgctaaggattctatcaatgtcgaacaagcattcttaactattgctggcgagattaagaagagaatgggaagccagcctaatgcaaacaatacatctggaagtggaactgttcagatgaaaggtcagccaattctacagaacaatggcggttgctgcagtagtagttaa

SEQ ID NO: 10787 - protein, 206 aa, Brassica napus
MSTEYDYLFKLLLIGDSSVGKSCLLLRFADDAYIDSYISTIGVDFKIRTIELDGKTVKLQIWDTVGQERFRTITSSYYRGAHGIIIVYDCTEMESFNNVKQWLSEIDRYANDSVCKLLIGNKNDMVESKVVSTETGKALADELGIPFLETSAKDSINVEQAFLTIAGEIKKRMGSQPNANNTSGSGTVQMKGQPILQNNGGCCSSS

SEQ ID NO: 10788 - DNA, 621 bp, Brassica napus
  CDS (1)..(621)
atgccttctcgtagacgtaccctcctcaaagtcatcatcctcggcgatagcggggtggggaaaacctctttgatgaatcaatatgttaataaaaagttcagcaaccagtacaaggccaccattggagctgacttcttgactaaggaagtccagtttgaagatcgccttttcactttacagatctgggatacagctggacaagaaaggtttcagagccttggtgtagctttctaccggggtgctgattgctgtgttcttgtatatgatgtcaactccatgaaatcatttgacaatctcaacaactggagagaagagtttctcatccaggcaagtccatcggatccagagaattttccctttgtggttattggaaacaaggtcgacgttgatggcggaaacagccgagtggtttcagagaaaaaagctaaggcttggtgtgcttcaaagggaaacatcccttactttgagacctcagctaaggaaggcaccaatgtggaggaagcattcgaatgcatcgccaagaacgccctgaagaccggagaagaggaagagctgtacttgccagacacaatcgatgtcgggacaagcaatcaacagaggtctacagggtgtgaatgctaa

SEQ ID NO: 10789 - protein, 206 aa, Brassica napus
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVVIGNKVDVDGGNSRVVSEKKAKAWCASKGNIPYFETSAKEGTNVEEAFECIAKNALKTGEEEELYLPDTIDVGTSNQQRSTGCEC

SEQ ID NO: 10790 - DNA, 651 bp, Brassica napus
  CDS (1)..(651)
atggctgctccaccggctagggccagagccgattacgactatctcataaagcttcttttgattggagatagcggtgtgggtaaaagttgcctccttctacgtttctctgatggctccttcaccactagcttcattaccaccattggcattgactttaagatcagaaccattgagcttgatggcaaacgtatcaagctccagatttgggacactgctggtcaagaacgtttccgcaccatcaccactgcttattaccgtggggcaatgggcattttgctagtgtatgatgtcacagacgagtcctccttcaacaacattaggaactggattcgtaatatcgaacagcatgcgtcagataatgttaacaagatcttggttgggaacaaggctgacatggacgaaagcaagagggcggtacctacagcaaagggtcaggctcttgctgatgagtacggaattaagttctttgaaactagtgctaagacaaacctaaacgtggaagaagttttcttctccatagggagggacataaaacagaggctttctgacactgactccaaggcagagcctgccacgatcaagataagccaaacagaccaggcagctggagccgggcaggccacacagaagtctgcatgctgtggaagttaa

SEQ ID NO: 10791 - protein, 216 aa, Brassica napus
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSKAEPATIKISQTDQAAGAGQATQKSACCGS

SEQ ID NO: 10792 - DNA, 648 bp, Brassica napus
  CDS (1)..(648)
atggctgctcctcctgctagagctcgcgctgattacgattacctcattaaactactcttgatcggagacagcggtgtgggtaagagttgcctcctcttacgtttctcagatggctcctttaccaccagtttcattacaaccattggaattgatttcaagatacggactattgagctggatgggaagagaattaagctgcaaatctgggatactgctggacaggagcggttccggactatcacaactgcgtactaccgtggagccatgggcattttgcttgtgtatgatgtcaccgatgaatcatctttcaacaatatcaggaactggatccgtaacattgagcagcacgcttctgataatgtcaacaagattctagtggggaacaaggctgatatggatgaaagcaaacgagctgtgccaaaagctaagggccaagctcttgcagatgaatacggaatcaagtttttcgagactagtgccaagactaacctaaacgttgaggaagttttcttttcaattggtaaagacattaagcaaagacttgctgataccgatgcaaaggctgagccacaaacaatcaaaatcaaccaatccgaccaaggtgcagggacatctcaagctactcagaaatcagcatgttgtggttag

SEQ ID NO: 10793 - protein, 215 aa, Brassica napus
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPKAKGQALADEYGIKFFETSAKTNLNVEEVFFSIGKDIKQRLADTDAKAEPQTIKINQSDQGAGTSQATQKSACCG

SEQ ID NO: 10794 - DNA, 609 bp, Brassica napus
  CDS (1)..(609)
atgaatcctgaatatgactatctgttcaagcttttgcttatcggtgactctggtgttggaaaatcctgcttgcttcttagatttgctgatgattcttaccttgatagctacatcagtaccattggtgttgactttaaaatccgcacagttgaacaggacggaaagacaatcaaactccagatctgggacacagcaggccaagaacgtttcaggacgatcaccagcagctactacagaggagctcatgggatcattgtcacttatgatgtcactgaccaagagagcttcaacaacgtcaaacaatggctcaatgaaatcgaccgttacgctagtgagaatgtgaacaagctactcgttgggaacaaaaacgatctcacgtcacagaaggttgtatccactgagacagctcaggcgtttgcagatgaacttgggatccctttcttggaaacaagtgccaaaaatgcaaccaatgttgaagaagctttcatggccatgactgctgctattaagaccagaatggctagccaaccatctggaggtgccaagccaccgactgtccagattcgcggacagccagtgaaccagcaatcaggatgttgctcttcttga

SEQ ID NO: 10795 - protein, 202 aa, Brassica napus
MNPEYDYLFKLLLIGDSGVGKSCLLLRFADDSYLDSYISTIGVDFKIRTVEQDGKTIKLQIWDTAGQERFRTITSSYYRGAHGIIVTYDVTDQESFNNVKQWLNEIDRYASENVNKLLVGNKNDLTSQKVVSTETAQAFADELGIPFLETSAKNATNVEEAFMAMTAAIKTRMASQPSGGAKPPTVQIRGQPVNQQSGCCSS

SEQ ID NO: 10796 - DNA, 621 bp, Brassica napus
  CDS (1)..(621)
atgccttctcgtagacgtaccctcctcaaagtcatcatcctcggcgatagcggggtggggaaaacctctttgatgaatcaatatgttaataaaaagttcagcaaccagtacaaggccaccattggggcggacttcttgactaaggaagtccagtttgaagatcgtcttttcactttacagatctgggatacagctggacaggaaaggtttcagagccttggggtagctttttaccggggtgctgattgctgtgttcttgtatatgatgtcaactccatgaaatcatttgacaatctcaacaactggagagaagagtttctgatccaggcgagtccatcggatccagagaattttccgtttgttcttatcggaaataaggtcgacgttgatggtggaaacagccgagtggtttcagagaaaaaagctaaggcttggtgtgcttcaaagggaaacatcccttactttgagacctcagccaaggaaggcaccaatgtggaggaagcattcgaatgcatcgccaagaacgccctgaagagtggagaagaggaagagctgtacttgccagacacaatcgatgtcgggacaagcaatcaacagaggtctacagggtgtgaatgctaa

SEQ ID NO: 10797 - protein, 206 aa, Brassica napus
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVLIGNKVDVDGGNSRVVSEKKAKAWCASKGNIPYFETSAKEGTNVEEAFECIAKNALKSGEEEELYLPDTIDVGTSNQQRSTGCEC

SEQ ID NO: 10798 - DNA, 612 bp, Brassica napus
  CDS (1)..(612)
atgggatgtgctgcttctcttccagataggaactctggagctttaaacggtctcaccagttcagagaatgcagctccagcagatgctaagaatctacgcgtaaagttagttcttttaggagattctggtgtgggtaaaagctgcattgtccttcaatttgtccgtggtcaatttgacgcaacatctaaggtaactgttggagcttcattcttgtcccaaacaataaccttgcaagactctaccacagtgaagtttgaaatctgggatacagcagggcaagagaggtattctgctcttgctccactatactaccgtggagctggagttgctgttattgtgtatgatataacaagccctgaatcgttcaagaaagctcagtattgggttaaggaactgcagaagcatggaagcccagacattgttatggctttggttggtaacaaagctgatctacatgaaaaaagagaagtaccatccgaggatggtatggagcttgcagagaagaacggcatgttcttcattgaaacgtcagctaagacggctgataacataaatgaactgtttcaggaaattggaaagaggctacctcgtccttctcaaccatcatcatga

SEQ ID NO: 10799 - protein, 203 aa, Brassica napus
MGCAASLPDRNSGALNGLTSSENAAPADAKNLRVKLVLLGDSGVGKSCIVLQFVRGQFDATSKVTVGASFLSQTITLQDSTTVKFEIWDTAGQERYSALAPLYYRGAGVAVIVYDITSPESFKKAQYWVKELQKHGSPDIVMALVGNKADLHEKREVPSEDGMELAEKNGMFFIETSAKTADNINELFQEIGKRLPRPSQPSS

SEQ ID NO: 10800 - DNA, 651 bp, Brassica napus
  CDS (1)..(651)
atggctgctccacctgctagggccagagctgattacgactatctcatcaagcttcttttgatcggagatagcggtgtgggtaagagttgtctgcttctacgtttctctgatggctccttcaccactagcttcatcaccaccattggcattgactttaagatcagaaccattgagcttgatggcaaacgtatcaagcttcagatttgggacactgctggtcaagaacgtttccgcaccatcaccaccgcttattaccgtggggcgatgggcattttgctggtctatgatgtcaccgacgagtcctccttcaacaatattaggaactggattcgtaatattgaacaacatgcgtcagataatgttaacaagatcttggttgggaacaaggctgacatggacgaaagcaagagggcggttcctacagcaaagggtcaggctcttgctgatgagtacggaattaagttctttgaaactagtgctaagacaaacctaaacgtggaagaagttttcttctccatcgggagggacataaagcagaggctttctgacactgactccaaggcagagcctgcgacgatcaggataagccaaactgaccaggcagctggagctgcgcaggccacacagaagtctgcatgctgtggaagttaa

SEQ ID NO: 10801 - protein, 216 aa, Brassica napus
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIGRDIKQRLSDTDSKAEPATIRISQTDQAAGAAQATQKSACCGS

SEQ ID NO: 10802 - DNA, 651 bp, Brassica napus
  CDS (1)..(651)
atggctgctccacctgctaggggtagagccgattacgattacctcataaagctcctcctaatcggtgatagcggtgtgggcaaaagttgtttgctgttaaggttctctgatggctcattcaccactagcttcatcaccaccattggcattgattttaagatacgaactattgagcttgataccaaacgcatcaagctccagatttgggatactgctggtcaagaacgttttcgaaccatcaccactgcttattaccgaggggcaatgggcattttgctggtctatgatgtcacagacgagtcatcctttaacaatattaggaactggattcgtaatatcgaacagcacgcttcggataatgtcaacaagatcttggtagggaacaaagccgatatggacgagagcaagagggctgttccaacatcaaagggtcaagcacttgctgatgaatatggaatcaagttctttgaaacaagtgccaaaacaaatctaaatgtggaagaggttttcttctcgatagcaaaggacattaagcagagactcacagatactgactcgagagcagagcctgcgacgattaggataagccaaacagaccaggctgctggagccggacaagccacgcagaagtctgcatgctgtggaacttaa

SEQ ID NO: 10803 - protein, 216 aa, Brassica napus
MAAPPARGRADYDYLIKLLLIGDSGVGKSCLLLRFSDGSFTTSFITTIGIDFKIRTIELDTKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIAKDIKQRLTDTDSRAEPATIRISQTDQAAGAGQATQKSACCGT

SEQ ID NO: 10804 - DNA, 648 bp, Brassica napus
  CDS (1)..(648)
atggctgctcctcctgctagagctcgcgctgattacgattacctcattaaactactcttgatcggagacagcggtgtgggtaagagttgcctcctcttgcgtttttcagatggctcctttaccaccagtttcattacaaccattggaattgatttcaagatacggactattgagctggatgggaagagaattaagctgcaaatctgggatactgcaggacaggagcggttccggactatcacaactgcgtactaccgtggagccatgggcattttgcttgtgtatgatgtcaccgatgaatcatctttcaacaacatcaggaactggatccgtaacattgagcagcacgcttctgataatgtcaacaagattctagtggggaacaaggcagatatggatgaaagcaaacgagctgtgccaaaagctaagggacaagctcttgcagatgaatacggaatcaagttcttcgagactagtgccaagacgaacttaaacgttgaggaagttttcttttcaataggtaaagacattaagcaaagacttgcagataccgatgcaagggctgagccacaaacaatcagaatcaaccaatccgaccaaggtgcagggacatctcaagctactcagaaatcagcatgttgtggttag

SEQ ID NO: 10805 - protein, 215 aa, Brassica napus
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPKAKGQALADEYGIKFFETSAKTNLNVEEVFFSIGKDIKQRLADTDARAEPQTIRINQSDQGAGTSQATQKSACCG

SEQ ID NO: 10806 - DNA, 612 bp, Zea mays
  CDS (1)..(612)
atggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttagcggtcaatgatgagactgttaagttcgaaatctgggatactgccgggcaggagaggtatcatagcttggctcccatgtactataggggtgcagctgctgccattgttgtctatgacatcacaaatccggcctccttcacccgtgccaagaaatgggttcaagaacttcaagctcaaggaaatcagaataccatagtggctcttgctggaaacaaggctgatatgctagatgcgaggcaggtgccagcagaggaagcaaaggcgtatgctcaggagaatgggctcttcttcatggagacatctgctaaaactgcaatcaatgtgaatgacatattttatgagattgcaaagagattgcttcaagggcaagaggctccaagtccacaggctggaattgttctgaatcagagaccagatgagaggatggtcagcacttcctcgtgctgctcatga

SEQ ID NO: 10807 - protein, 203 aa, Zea mays
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNQNTIVALAGNKADMLDARQVPAEEAKAYAQENGLFFMETSAKTAINVNDIFYEIAKRLLQGQEAPSPQAGIVLNQRPDERMVSTSSCCS

SEQ ID NO: 10808 - DNA, 666 bp, Glycine max
  CDS (1)..(666)
atggctttgcccaatcagcaaaccgtcgattaccctagtttcaaactcgtcatcgtcggtgacggtggtacaggaaagacaacgttcgtgaaaaggcatcttaccggtgaatttgagaagaaatacgaaccgaccattggagtggaggttcacccattggatttcttcacaaactgtggaaagattcgcttctactgttgggatactgccggacaagagaagtttggtggcctcagggatggatattatatccatgggcaatgcgccattatcatgtttgatgttactgcccgactaacttacaaaaatgtccctacctggcatcgggatctttgccgggtctgtgagaacatcccaattgttctttgcggtaacaaggttgatgtgaagaacaggcaagtgaaggcaaagcaggttactttccacaggaagaagaatttacagtactatgagatttcagctaaaagcaactacaattttgagaagcctttcctgtatttggccagaaaacttgcaggtgatcctaacttgcactttgtggagtctccagcattggctccaccagaagttctaattgatttagctgcacagcaacaacatgaggccgagcttcttgcagctgctagtcagccccttcctgacgatgatgatgaatcttttgagtaa

SEQ ID NO: 10809 - protein, 221 aa, Glycine max
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVLIDLAAQQQHEAELLAAASQPLPDDDDESFE

SEQ ID NO: 10810 - DNA, 666 bp, Glycine max
  CDS (1)..(666)
atggctttgcccaatcagcaaaccgtcgattaccccagcttcaagctcgtcatcgtcggtgacggtggcacaggaaagacaaccttcgtgaaaaggcatctcactggtgaattcgagaagaaatatgaaccgaccattggtgtggaggttcatccgttggattttttcactaactgcggaaagattcgattctattgttgggatactgctgggcaagagaagtttggcggcctcagagatggatattatatccatgggcaatgtgcgattatcatgtttgatgttactgcccgtctaacatacaagaatgtccctacctggcaccgtgatctttgcagggtctgtgaaaacatcccaattgttctttgcggtaacaaggttgatgtcaagaacaggcaagtgaaggcaaagcaggttactttccacaggaagaagaatttgcagtactacgagatatctgctaagagcaactacaattttgaaaagccatttttgtacttggccaggaaacttgcaggcgatactaacttgcactttgtagaatctcctgcattggctccaccagaagttcaaattgatttagctgcgcaacaacagcacgaggctgagcttcttgcagctgctagtcagccccttcctgacgacgatgatgatcaatttgagtag

SEQ ID NO: 10811 - protein, 221 aa, Glycine max
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDTNLHFVESPALAPPEVQIDLAAQQQHEAELLAAASQPLPDDDDDQFE

SEQ ID NO: 10812 - DNA, 609 bp, Glycine max
  CDS (1)..(609)
atgaatcccgagtatgattatctgttcaagctccttcttattggagactctggtgttggtaaatcatgccttcttctgagatttgctgatgattcgtacatcgagagctacataagcaccattggagttgattttaaaatacgtactgttgagcaggatggaaagaccattaaactacagatctgggacacagccgggcaagaacgatttaggacaatcaccagtagctactatcgtggggcccatgggatcattattgtttatgatgtgacagatgaagagagcttcaataatgtgaagcagtggctcagtgaaattgatcgctatgcaagtgataatgttaacaagcttttggttggaaacaagtgtgatctggaagcaaatagagctgtgtcatatgaaacagctaaagcattcgcagatgaaataggcataccttttatggaaacaagtgcaaaagatgctacaaatgttgaacaggctttcatggcaatggctgcttcaatcaaggatagaatggcaagccaacctgcaaacaatgcaaggcctccaacagtgcagatcaggggacagccagttgcacagaaaggtgggtgctgctcttcctaa

SEQ ID NO: 10813 - protein, 202 aa, Glycine max
MNPEYDYLFKLLLIGDSGVGKSCLLLRFADDSYIESYISTIGVDFKIRTVEQDGKTIKLQIWDTAGQERFRTITSSYYRGAHGIIIVYDVTDEESFNNVKQWLSEIDRYASDNVNKLLVGNKCDLEANRAVSYETAKAFADEIGIPFMETSAKDATNVEQAFMAMAASIKDRMASQPANNARPPTVQIRGQPVAQKGGCCSS

SEQ ID NO: 10814 - DNA, 651 bp, Glycine max
  CDS (1)..(651)
atggcagcaccacctgcgagggcacgtgccgattacgattacctcatcaagcttcttcttattggcgatagcggtgtgggaaagagttgtctgcttttgcgattttctgatggttccttcacaaccagttttatcaccaccattggcattgattttaagataagaaccattgaacttgatggcaaacgcattaagttacaaatctgggatacagctggtcaggagcgatttcgaactattaccacagcttattaccgtggagccatgggtatcttgctcgtttatgatgttactgatgaagcatctttcaacaatattagaaattggattcgcaacattgaacaacatgcttctgacaatgtaaacaagatacttgtgggtaacaaggctgatatggatgaaagtaaaagggctgtgcctacctccaaaggtcaagcccttgctgatgagtatggtatcaagtttttcgaaaccagtgcaaagacaaacatgaatgtggaggaggttttcttttcaatagcaagagatatcaagcaaaggcttgctgacacagattctaaggctgaacctcagactatcaagattaaccaacccgaccagacagctacagggggtcttgcggctcaaaaatcggcttgctgtggttcatga

SEQ ID NO: 10815 - protein, 216 aa, Glycine max
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSKAEPQTIKINQPDQTATGGLAAQKSACCGS

SEQ ID NO: 10816 - DNA, 651 bp, Glycine max
  CDS (1)..(651)
atggcagcaccacctgcgagggcacgtgccgattacgattacctcatcaagcttcttcttattggcgatagcggtgtcggaaagagttgtctgcttttgcgattttctgatggttccttcacaaccagttttatcaccaccattggcattgattttaagataagaaccattgaacttgatggcaaacgcattaagttacaaatctgggatactgctggtcaggagcgatttcgaactattaccacagcttattaccgtggagccatgggcatattgcttgtttatgatgttactgatgaagcatctttcaacaatattaggaattggattcgcaacattgaacaacatgcttctgacaatgtaaacaagatacttgtgggtaacaaggctgatatggatgaaagtaaaagggctgtgcctacctccaaaggtcaagcccttgctgatgagtatggtatcaagttttttgaaaccagtgcgaagacaaacatgaatgtggaggaggttttcttttcaatagcaagagatatcaagcaaaggcttgcagacacagattctaaggctgaacctcagactatcaagattaaccaacccgaccaggcagccaccgggggtctagctgctcaaaaatcggcttgctgtggttcatga

SEQ ID NO: 10817 - protein, 216 aa, Glycine max
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSKAEPQTIKINQPDQAATGGLAAQKSACCGS

SEQ ID NO: 10818 - DNA, 630 bp, Glycine max
  CDS (1)..(630)
atggattcgagttcggggcatcaagaattcgattatttgtttaagttgttgatgattggagactctggggttggcaagagtagtcttcttctcagtttcacctccgatgcttttgaagatctctcccccactatcggtgttgattttaaggtcaaatatgtgatgatggggggtaaaaagctgaagcttgcaatttgggatactgctggtcaggagagattcagaacactgacaagttcttactacagaggggcacaaggaatcatcatggtttatgatgtaacccggcgagatacatttacaaatctttctgaaatatgggcaaaggaaatagacctttattcaactaatcaagattgcatcaagatgcttgttggaaacaaactagataaggacggtgatagagttgtgacaaagaaagagggaatagactttgccagggaatacggttgcctatttattgaatgcagtgctaaaactcgagttaatgttcagcaatgctttgaagagcttgttttgaagattctggatacacctagcctcatagccgagggctcaaagggtgttaaaaagaacattttcaaggacaggccaccccagtctgatgcatccgcaagtagttgttgctga

SEQ ID NO: 10819 - protein, 209 aa, Glycine max
MDSSSGHQEFDYLFKLLMIGDSGVGKSSLLLSFTSDAFEDLSPTIGVDFKVKYVMMGGKKLKLAIWDTAGQERFRTLTSSYYRGAQGIIMVYDVTRRDTFTNLSEIWAKEIDLYSTNQDCIKMLVGNKLDKDGDRVVTKKEGIDFAREYGCLFIECSAKTRVNVQQCFEELVLKILDTPSLIAEGSKGVKKNIFKDRPPQSDASASSCC

SEQ ID NO: 10820 - DNA, 621 bp, Glycine max
  CDS (1)..(621)
atggcgccagtgtcagctctcgcaaagtacaagctggtgttcttgggcgatcaatccgttgggaaaaccagcatcatcactcgcttcatgtacgacaaattcgacaacacttatcaggctacaatcggtatcgattttctgtcaaaaactatgtatcttgaagatcgaactgttcgactgcagttgtgggatacagctggccaggaaagatttagaagtcttattccaagctacattagggactcatctgttgctgtcattgtttatgatgttgcaagccgtcagactttcctaaacacatcaaagtggattgaagaggtgcgcagtgaaagaggcagcgatgttattgttgttcttgttgggaacaaaactgatcttgtggataaaaggcaagtctctacagaggaaggggaagcaaagtcccgagagctaaacgttatgtttattgaagctagtgcaaaagctggctttaatataaaggccctctttcgaaaaattgctgctgcattacccggaatggaaacattatctacaacaaaacaggaagatatggttgacgtgaacctgaggtcttctggtagccatgattcccaacctcagtcgggtggatgttcttgctga

SEQ ID NO: 10821 - protein, 206 aa, Glycine max
MAPVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTSKWIEEVRSERGSDVIVVLVGNKTDLVDKRQVSTEEGEAKSRELNVMFIEASAKAGFNIKALFRKIAAALPGMETLSTTKQEDMVDVNLRSSGSHDSQPQSGGCSC

SEQ ID NO: 10822 - DNA, 606 bp, Glycine max
  CDS (1)..(606)
atgggttgcggctcctcccttccagataggggctcaaggcagttcccgggtcgacccaattccgagaatggtggagggcaggacgccaagaatctgagggtcaagcttgttctcttaggtgattctggtgttggcaaaagctgtattgttctacgatttgttcgtggtcagtttgatccaacatctaaggtaactgttggagcttcttttttgtcacaaacaatagctctgcaagactctacaacagtcaagtttgaaatatgggatactgctggtcaagagaggtacgctgcgttagcaccactctattaccgtggtgcagcagttgcagttattgtttatgatataacaagcccagaatctttcagcaaagcacagtactgggttaaggagctacaaaaacatggaagccctgatatagtgatggcactggtcggtaataaagctgatcttcttgagaagcgggaagttgctgtccaggatggcactgactatgcagagaagaatggtatgtttttcatagagacatctgcaaagacagcagataatataaatgaactgtttgaggaaattgccaaaagactgcctcgcccatcagttagttga

SEQ ID NO: 10823 - protein, 201 aa, Glycine max
MGCGSSLPDRGSRQFPGRPNSENGGGQDAKNLRVKLVLLGDSGVGKSCIVLRFVRGQFDPTSKVTVGASFLSQTIALQDSTTVKFEIWDTAGQERYAALAPLYYRGAAVAVIVYDITSPESFSKAQYWVKELQKHGSPDIVMALVGNKADLLEKREVAVQDGTDYAEKNGMFFIETSAKTADNINELFEEIAKRLPRPSVS

SEQ ID NO: 10824 - DNA, 603 bp, Glycine max
  CDS (1)..(603)
atggctacgatcggacacaacaatctcaatgccaaattggttcttctcggggacatgggtgctgggaaatccagcctcgttttgcgctttgtcaagggtcaatttctcgaatttcaggaatcaacaataggggcagcgttcttttcacagacgctggcagtaaatgacgcgacggtaaagtttgagatatgggacacagcaggacaagagaggtaccatagcttggctcccatgtattacagaggtgctgctgctgctatcattgtctatgacatcactagctcggactcctttacccgagctaagaagtgggtccaagagcttcaaaaacaagggaatcctaatatggtcatggctcttgctggtaacaaagctgatttggaagacaagaggaaagtgacagctgaagaagcacgtgtatatgctgaagaaaatggtttgtttttcatggagacctctgccaaaactgcatccaacgtgaatgatatattctatgaaatagccaagaggttaccaagggctcagccagctcagaacccagctgggatggtacttgttgatagacccgccgaaggaactagggctgcatcatgttgttcataa

SEQ ID NO: 10825 - protein, 200 aa, Glycine max
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSDSFTRAKKWVQELQKQGNPNMVMALAGNKADLEDKRKVTAEEARVYAEENGLFFMETSAKTASNVNDIFYEIAKRLPRAQPAQNPAGMVLVDRPAEGTRAASCCS

SEQ ID NO: 10826 - DNA, 654 bp, Glycine max
  CDS (1)..(654)
atgggggcgtatagagctgatgaggattacgattatttgttcaaggtggtactgattggggactctggtgtgggaaaatcgaaccttttgtcgaggttcaccaagaacgaattcagccttgaatcaaagtccaccattggggttgagtttgccaccagaagcattagggttgatgataaagttctcaaggctcagatttgggacactgctggccaagaaaggtatcgagcaatcactagtgcatattatcgcggagctgttggtgctttattagtctatgatgttacccgccatgttacatttgaaaatgtggagagatggttgaaggagctcagagatcacacagatgccaacattgtggttatgcttgttgggaacaaagcagacttgcgtcatctgcgagcagtttccaccgaagaaactacaaattttgcggaacgggagaaaacgtttttcatggaaacatccgctctcgagtccctgaacgttgaaagtgccttcacagaagtgctgacacagatctatcatgttgtaagcaagaaggcccttgaaattggtgatgatccagcagcattaccaaaaggacagacgataaatgttgggtctcgtgatgatgcatcggctgtgaagaaagatggatgttgttctgcttga

SEQ ID NO: 10827 - protein, 217 aa, Glycine max
MGAYRADEDYDYLFKVVLIGDSGVGKSNLLSRFTKNEFSLESKSTIGVEFATRSIRVDDKVLKAQIWDTAGQERYRAITSAYYRGAVGALLVYDVTRHVTFENVERWLKELRDHTDANIVVMLVGNKADLRHLRAVSTEETTNFAEREKTFFMETSALESLNVESAFTEVLTQIYHVVSKKALEIGDDPAALPKGQTINVGSRDDASAVKKDGCCSA

SEQ ID NO: 10828 - DNA, 609 bp, Glycine max
  CDS (1)..(609)
atgaatcccgagtatgattatctgttcaagctccttcttattggagactctggtgttggtaaatcatgccttcttctgagattttctgatgattcgtacatcgaaagctacataagcaccattggagttgattttaaaatacgtactgttgagcaagatggaaagaccattaaactacagatctgggacacagctgggcaagaacgatttaggacaatcaccagtagctactaccgtggtgcccatgggatcattattgtttatgatgtgacagatgaagagagcttcaataatgtgaagcagtggctcagtgaaattgatcgctatgcaagtgataatgttaacaagcttttggttggcaacaagtgtgatctggaagcaaatagagcagtgtcatatgaaacagctaaggcattcgcagatgaaataggcataccttttatggaaacaagtgcaaaagatgctacaaatgttgaacaggctttcatggcaatggctgcttcaatcaaggatagaatggcaagccaacctgcaaacaatgcaaggcctccaacagtgcagatcaggggacagccagttgcacagaaaggtgggtgctgctcttcctaa

SEQ ID NO: 10829 - protein, 202 aa, Glycine max
MNPEYDYLFKLLLIGDSGVGKSCLLLRFSDDSYIESYISTIGVDFKIRTVEQDGKTIKLQIWDTAGQERFRTITSSYYRGAHGIIIVYDVTDEESFNNVKQWLSEIDRYASDNVNKLLVGNKCDLEANRAVSYETAKAFADEIGIPFMETSAKDATNVEQAFMAMAASIKDRMASQPANNARPPTVQIRGQPVAQKGGCCSS

SEQ ID NO: 10830 - DNA, 645 bp, Glycine max
  CDS (1)..(645)
atggctgctccaccggcaagagctcgtgcggattacgattatctcataaaacttctcttgattggcgatagtggtgtcggaaagagttgccttcttctacgattctctgatggttctttcacaactagtttcatcacaactataggcattgattttaagataagaaccattgagcaggatggaaaacggatcaagctccaaatttgggatactgcaggtcaggagcggttccgaacaattacaactgcttactatcgtggtgctatgggcatattgctagtctatgacgttacagacgaatcttcatttaacaatatcaggaattggattcgcaatattgagcaacatgcttcagacaatgttaacaaaatactggtggggaacaaagctgatatggatgaaagcaaaagggctgtgcctacgtccaagggccaagcactggctgacgagtatgggatcaaattctttgaaactagtgcaaagacaaatctaaacgtggaggaagttttcttctcaatagcaagagatataaaacaaaggctggctgacactgactccaaggcagagccttcaacaatcaaaatcaaccaagaccagtcaggaggggctggacaggctgcacaaaaatcggcttgttgtggttga

SEQ ID NO: 10831 - protein, 214 aa, Glycine max
MAAPPARARADYDYLIKLLLIGDSGVGKSCLLLRFSDGSFTTSFITTIGIDFKIRTIEQDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIARDIKQRLADTDSKAEPSTIKINQDQSGGAGQAAQKSACCG

SEQ ID NO: 10832 - DNA, 651 bp, Glycine max
  CDS (1)..(651)
atggcagcagcacccgctagagctcgtgccgattacgattacctcatcaagcttcttcttatcggcgacagcggtgtggggaagagttgtctacttttgaggttttctgatggctcattcacaaccagttttatcaccaccattggtatcgattttaagataagaaccattgaactagacagcaaacggattaagttacaaatctgggatactgctggtcaggagcggttccgaactattaccacagcttattaccgtggagccatgggtatcttgctggtttatgatgttactgatgaagcatctttcaataatattaggaattggatccgcaatattgaacaacatgcttctgacaatgtaaacaagatacttgttggcaacaaggctgatatggatgaaagtaaaagggctgtacctacctccaaagggcaagcacttgctgatgagtatggtatcaagttctttgaaactagtgcaaaaaccaacatgaacgtggaagaggtcttcttttcaatagcaagagatattaagcaaaggcttgcagacacagattcaagagctgagcctcagactatcaagattaaccaacctgaccaggcaaccagtggtggtcaacctgcgcaaaagtcggcttgctgtggttcatga

SEQ ID NO: 10833 - protein, 216 aa, Glycine max
MAAAPARARADYDYLIKLLLIGDSGVGKSCLLLRFSDGSFTTSFITTIGIDFKIRTIELDSKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSRAEPQTIKINQPDQATSGGQPAQKSACCGS

SEQ ID NO: 10834 - DNA, 627 bp, Glycine max
  CDS (1)..(627)
atggattcgagttcaacccaggaattcgaatatttgtttaagttgttgatgattggggactcaggtgttggcaagagtagtctcctcctctgtttcacatctgattcctttgaagatctttctcccacaattggtgttgattttaaagtcaagtatttgacaatggaaggtaaaaagctgaagcttgccatttgggatacagctggtcaagagagattcagaacattgacaagttcttactaccgaggtgctcaagggatcattatggcttatgatgtaactcggcgggaaacgtttacaaatctctctgaaatatgggcaaaggaaatagacctttattcaactaatcaagattgcatcaagatgcttgttggaaacaaactagataaggagggtgatagagttgtgacaaagaaagagggaatagactttgccagggaatacggttgcctatttattgaatgcagtgctaaaactcgagttaatgttcagcaatgctttgaagagcttgttttgaagattctggatacacctagcctcatagccgagggctcaaagggtgttaaaaagaacattttcaaggacaggccaccccagtctgatgcatccgcaagtagttgttgctga

SEQ ID NO: 10835 - protein, 208 aa, Glycine max
MDSSSTQEFEYLFKLLMIGDSGVGKSSLLLCFTSDSFEDLSPTIGVDFKVKYLTMEGKKLKLAIWDTAGQERFRTLTSSYYRGAQGIIMAYDVTRRETFTNLSEIWAKEIDLYSTNQDCIKMLVGNKLDKEGDRVVTKKEGIDFAREYGCLFIECSAKTRVNVQQCFEELVLKILDTPSLIAEGSKGVKKNIFKDRPPQSDASASSCC

SEQ ID NO: 10836 - DNA, 624 bp, Glycine max
  CDS (1)..(624)
atggcgtctgtttcagctttagccaagtacaagctcgtcttcttgggtgaccaatccgtgggcaaaaccagcatcatcactcgcttcatgtacgataaattcgataacacctatcaggctacaattggtattgattttctatcaaaaactatgtatctcgaagatcgaactgttcgactgcagttgtgggatacagctggccaggaaagatttagaagtcttattccaagctacattagggactcatctgtagctgttattgtatatgatgttgcaagccggcagactttcctaaatactgcaaagtggattgaagaggtgcgaacagagagaggcagtgatgtcattattgttcttgttgggaacaaaactgatcttgtcgagaaaagacaagtctctatagaggaaggggaagcaaaagcacgtgagctcaatgtcatgttcattgaaactagtgctaaggctgggtttaatataaaggccctatttcgaaaaattgctgcagcactacctggaatggaaacactatcttctgcaaaacaagaagacatggttgatgtaaacttaaagtctacaaatggcagtgctcagtctcaacctcagtcaagtggatgtgcttgttaa

SEQ ID NO: 10837 - protein, 207 aa, Glycine max
MASVSALAKYKLVFLGDQSVGKTSIITRFMYDKFDNTYQATIGIDFLSKTMYLEDRTVRLQLWDTAGQERFRSLIPSYIRDSSVAVIVYDVASRQTFLNTAKWIEEVRTERGSDVIIVLVGNKTDLVEKRQVSIEEGEAKARELNVMFIETSAKAGFNIKALFRKIAAALPGMETLSSAKQEDMVDVNLKSTNGSAQSQPQSSGCAC

SEQ ID NO: 10838 - DNA, 621 bp, Glycine max
  CDS (1)..(621)
atgtcgttgcgcaggcgaaccttgctcaaggtcattgttctcggcgacagcggggttgggaagacctcgttgatgaatcaatacgtgcacaagaagtttagtcagcaatataaggctaccattggagctgattttgtcaccaaagagcttcagattgacgacagacttgtcactctacaaatatgggacactgctgggcaagagcgattccagagtctcggggttgcattttatagaggcgcggattgctgtgttcttgtgtatgatgtgaatgtgatgaagtcgttcgatacccttgagaactggcatgaggagtttctcaaacaggcaaaccctcctgatcccagggcatttccatttattttacttggaaacaagatcgatattgatggtgggaatagtcgagtggtttctgagaagaaagcaaaggactggtgtgccgcaaaagggaatattccctactttgaaacatccgcaaaagaggattacaatgttgatgctgcattcctgtgtattgccaaagctgctttagccaatgagcatgaacaagacatatattttcaagggattcctgaggcggcagttccagagaatgagcagaggagtggatgtgcatgctga

SEQ ID NO: 10839 - protein, 206 aa, Glycine max
MSLRRRTLLKVIVLGDSGVGKTSLMNQYVHKKFSQQYKATIGADFVTKELQIDDRLVTLQIWDTAGQERFQSLGVAFYRGADCCVLVYDVNVMKSFDTLENWHEEFLKQANPPDPRAFPFILLGNKIDIDGGNSRVVSEKKAKDWCAAKGNIPYFETSAKEDYNVDAAFLCIAKAALANEHEQDIYFQGIPEAAVPENEQRSGCAC

SEQ ID NO: 10840 - DNA, 609 bp, Glycine max
  CDS (1)..(609)
atgaatcccgagtatgattatctgttcaagctccttcttattggagactctggtgttggtaaatcatgccttcttctgagatttgctgatgattcgtacatcgagagctacataagcaccattggagttgattttaaaatacgtactgttgagcaggatggaaagaccattaaactacagatctgggacacagccgggcaagaacgatttaggacaatcaccagtagctactatcgtggggcccatgggatcattattgtttatgatgtgacagatgaagagagcttcaataatgtgaagcagtggctcagtgaaattgatcgctatgcaagtgataatgttaacaagcttttggttggaaacaagtgtgatctggaagcaaatagagctgtgtcatatgaaacagctaaagcattcgcagatgaaataggcataccttttatggaaacaagtgcaaaagatgctacaaatgttgaacaggctgtcatggcaatggctgcttcaatcaaagatagaatggcaagccaacctgcaaacaatgcaaggcctccaacagtgcagatcaggggtcagccagttgcacagaaaggtgggtgctgctcttcctga

SEQ ID NO: 10841 - protein, 202 aa, Glycine max
MNPEYDYLFKLLLIGDSGVGKSCLLLRFADDSYIESYISTIGVDFKIRTVEQDGKTIKLQIWDTAGQERFRTITSSYYRGAHGIIIVYDVTDEESFNNVKQWLSEIDRYASDNVNKLLVGNKCDLEANRAVSYETAKAFADEIGIPFMETSAKDATNVEQAVMAMAASIKDRMASQPANNARPPTVQIRGQPVAQKGGCCSS

SEQ ID NO: 10842 - DNA, 606 bp, Glycine max
  CDS (1)..(606)
atgagtaacgaatacgattatctgttcaagcttctcctaatcggcgactcttccgttggaaaatcctgcttgcttctcagattcgctgatgactcctacgtcgacagctacataagtaccattggagttgatttcaaaatcagaaccgtggagctggaaggaaaaaccgtcaagctgcagatttgggatacagctggacaggagcgattcaggactataacaagcagttactatagaggagcacatggaattattattgtctatgatgttactgagatggaaagctttaacaatgtcaagcagtggttgaatgagattgatagatatgcaaatgacactgtatgcaagcttcttgtggggaataaatccgatctagttgataacaaggttgttgactcgctaacagccaaggcatttgcagatgagcttggtatccctttccttgagacaagtgctaaagactcaatcaatgtggagcaggctttcttgaccatggcagcagagattaagaagaagatgggaagccaaacaactactggtaagtcggcagaaagtgttcaaatgaaggggcaaccaatcccacagaagagcaactgctgtggttag

SEQ ID NO: 10843 - protein, 201 aa, Glycine max
MSNEYDYLFKLLLIGDSSVGKSCLLLRFADDSYVDSYISTIGVDFKIRTVELEGKTVKLQIWDTAGQERFRTITSSYYRGAHGIIIVYDVTEMESFNNVKQWLNEIDRYANDTVCKLLVGNKSDLVDNKVVDSLTAKAFADELGIPFLETSAKDSINVEQAFLTMAAEIKKKMGSQTTTGKSAESVQMKGQPIPQKSNCCG

SEQ ID NO: 10844 - DNA, 609 bp, Glycine max
  CDS (1)..(609)
atgaatcccgaatacgattatttgttcaagcttttgctgattggagattctggtgtaggcaagtcatgtcttctcctgaggtttgctgatgattcataccttgacagctatatcagtaccattggagtggactttaaaatccgcactgtggagcaggatgggaagactattaaacttcaaatttgggacactgcgggtcaggaacgtttccgaacaatcactagcagctattatcgtggggctcatggcattattgttgtttatgatgtcactgaccaagagagctttaataatgttaagcagtggctgaatgaaattgaccgttatgcaagtgaaaatgttaacaagcttctagttggaaacaagtgcgatctcacggcaaataaagttgtgtcctatgagacagcaaaggcttttgcagatgaaattggaattcccttcatggaaactagtgctaaaaatgccaccaatgttgaacaggctttcatggccatggctgctgaaattaaaaacagaatggcaagccagccagtgaacaatgcgaggcctccaacagttcaaattcgaggacagccagtgaaccagaaggctggttgctgctcgacttag

SEQ ID NO: 10845 - protein, 202 aa, Glycine max
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLTANKVVSYETAKAFADEIGIPFMETSAKNATNVEQAFMAMAAEIKNRMASQPVNNARPPTVQIRGQPVNQKAGCCST

SEQ ID NO: 10846 - DNA, 654 bp, Glycine max
  CDS (1)..(654)
atgggggcgtatagagctgatgaggattacgattatttgttcaaggtggtactgattggggactctggtgttggcaaatcgacccttttgtctcggttcacccggaacgaattcagccttgaatccaagtccaccattggggttgagtttgccaccagaagcattcgggttgatgataaggttgtcaaggctcagatttgggacgctgctggtcaagaacggtatcgagctattactagtgcatattatcgcggagctgttggtgctttactagtttatgatgttacccgtcatgttacttttgaaaatgtggagagatggttaaaggagctgagagatcacacagatgccaacattgtggtgatgcttgtagggaacaaagcagacctgcgtcatctgcgtgcagtttccaccgaagatgctagaactttcgctgagcgagagaacacatttttcatggaaacatctgccctcgagtccttgaatgttgaaaatgccttcacagaagtgctgacccagatctatcatgttgtaagcaagaaggcccttgagattggagacgatccagcagctttgccaaaaggacagacaattaatgttgggtcccgtgatgatgtatcagctgtgaagaaatctggatgttgttctgcttga

SEQ ID NO: 10847 - protein, 217 aa, Glycine max
MGAYRADEDYDYLFKVVLIGDSGVGKSTLLSRFTRNEFSLESKSTIGVEFATRSIRVDDKVVKAQIWDAAGQERYRAITSAYYRGAVGALLVYDVTRHVTFENVERWLKELRDHTDANIVVMLVGNKADLRHLRAVSTEDARTFAERENTFFMETSALESLNVENAFTEVLTQIYHVVSKKALEIGDDPAALPKGQTINVGSRDDVSAVKKSGCCSA

SEQ ID NO: 10848 - DNA, 609 bp, Glycine max
  CDS (1)..(609)
atgaatcccgagtatgataatctgttcaagctccttcttattggagactctggtgttggtaaatcatgccttcttctgagatttgctgatgattcgtacatcgagagctacataagcaccattggagttgattttaaaatacgtactgttgagcaggatggaaagaccattaaactacagatctgggacacagccgggcaagaacgatttaggacaatcaccagtagctactatcgtggggcccatgggatcattattgtttatgatgtgacagatgaagagagcttcaataatgtgaagcagtggctcagtgaaattgatcgctatgcaagtgataatgttaacaagcttttggttggaaacaagtgtgatctggaagcaaatagagctgtgtcatatgaaacagctaaagcattcgcagatgaaataggcataccttttatggaaacaagtgcaaaagatgctacaaatgttgaacaggctttcatggcaatggctgcttcaatcaaggatagaatggcaagccaacctgcaaacaatgcaaggcctccaacagtgcagatcaggggacagccagttgcacagaaaggtgggtgctgctcttcctaa

SEQ ID NO: 10849 - protein, 202 aa, Glycine max
MNPEYDNLFKLLLIGDSGVGKSCLLLRFADDSYIESYISTIGVDFKIRTVEQDGKTIKLQIWDTAGQERFRTITSSYYRGAHGIIIVYDVTDEESFNNVKQWLSEIDRYASDNVNKLLVGNKCDLEANRAVSYETAKAFADEIGIPFMETSAKDATNVEQAFMAMAASIKDRMASQPANNARPPTVQIRGQPVAQKGGCCSS

SEQ ID NO: 10850 - DNA, 612 bp, Glycine max
  CDS (1)..(612)
atgaatcccgagtatgactatctgttcaagctccttctgattggagactctggtgttggtaaatcatgccttcttctaagatttgctgatgattcatacattgagagctacataagcaccatcggagttgattttaaaattcgcactgttgagcaggatgggaagacaattaaactacagatttgggatactgctggacaagaacgatttaggacaataactagtagctactatcgtggagcacatggaatcattattgtttatgacgtgacagatgaagatagcttcaataatgtgaagcaatggctcagtgaaattgaccgctatgccagtgataatgttaacaaacttttggttggaaacaagagtgatctgacagcaaatagagttgtctcatatgacacagctaaggaattcgcagatcaaattggcatacctttcatggaaacaagtgcaaaagatgctacaaatgtggaagatgctttcatggccatgtctgctgccatcaagaatagaatggctagtcagccttcagcaaacaatgcaaggcctccaacagtgcagatcagagggcaacctgttggacaaaaaagtggttgctgctcttcctaa

SEQ ID NO: 10851 - protein, 203 aa, Glycine max
MNPEYDYLFKLLLIGDSGVGKSCLLLRFADDSYIESYISTIGVDFKIRTVEQDGKTIKLQIWDTAGQERFRTITSSYYRGAHGIIIVYDVTDEDSFNNVKQWLSEIDRYASDNVNKLLVGNKSDLTANRVVSYDTAKEFADQIGIPFMETSAKDATNVEDAFMAMSAAIKNRMASQPSANNARPPTVQIRGQPVGQKSGCCSS

SEQ ID NO: 10852 - DNA, 606 bp, Glycine max
  CDS (1)..(606)
atgagtaacgaatacgattacctgttcaagcttctcctaatcggagactcttccgttggaaaatcctgcttgcttctcagattcgctgatgactcctatgtcgacagctacataagtaccattggagttgatttcaaaatcagaacggtggagctggaagggaaaaccgtcaagctgcagatttgggatacagctggacaggagcgattcaggactataacaagcagttattatagaggagcacatggaattattattgtctatgatgttactgagatggaaagctttaacaatgtcaaacagtggttgaatgagattgacagatatgcaaatgactctgtatgcaagcttcttgtggggaataaatctgatctcgttgataacaaggttgtagactcattaactgccaaggcatttgcggatgagcttggtatccctttccttgagacaagtgctaaagactccatcaatgtggagcaggctttcttgactatgacagctgagattaagaagaagatgggaagccaaacaactgctggtaagtcggcagaaactgttcaaatgaaggggcaaccgatcccacagaagagcaactgctgtggttag

SEQ ID NO: 10853 - protein, 201 aa, Glycine max
MSNEYDYLFKLLLIGDSSVGKSCLLLRFADDSYVDSYISTIGVDFKIRTVELEGKTVKLQIWDTAGQERFRTITSSYYRGAHGIIIVYDVTEMESFNNVKQWLNEIDRYANDSVCKLLVGNKSDLVDNKVVDSLTAKAFADELGIPFLETSAKDSINVEQAFLTMTAEIKKKMGSQTTAGKSAETVQMKGQPIPQKSNCCG

SEQ ID NO: 10854 - DNA, 654 bp, Glycine max
  CDS (1)..(654)
atggcggcgtacaaagccgacgatgattacgattacttgttcaaggtggttctgatcggcgactccggcgtcggaaaatctaaccttctttctcggttcacgcgaaacgagttcagcctcgaatcgaagtccaccattggcgttgagttcgccaccagaagcattcgcgtcgatgataaggtcgtcaaggctcagatttgggacactgctggtcaagaacggtaccgagctattacaagtgcatattatcgaggagctgttggtgctttactagtctatgatgttacacgtcatgttacttttgaaaatgtggagagatggctaaaagagctgagagatcacacagatgccaacattgtggtgatgcttgtagggaacaaagcagacctgcgtcatctgcgtgcagtttccactgaagatgctacaactttcgctgagcgagagaacacatttttcatggaaacatctgccctcgagtccttgaacgttgaaaatgccttcacagaagtgctgacccagatctatcatgttgtaagcaagaaggcccttgaggttggagatgatccagcagctttaccaaaaggacagacaattaatattgggtcccgtgatgatgtatcggctgtgaagaaatctggatgttgttctgcttga

SEQ ID NO: 10855 - protein, 217 aa, Glycine max
MAAYKADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATTFAERENTFFMETSALESLNVENAFTEVLTQIYHVVSKKALEVGDDPAALPKGQTINIGSRDDVSAVKKSGCCSA

SEQ ID NO: 10856 - DNA, 621 bp, Glycine max
  CDS (1)..(621)
atgccttcccgaagaagaactctcttgaaggtcatcattctcggtgacagcggggtggggaagacgtctttgatgaaccagtatgtgaataagaagtttagtaatcagtacaaggcaaccattggagcggattttttaaccaaagaagtgcaatttgaagataggcttttcaccttacagatttgggatacagctggccaagaaagattccaaagccttggagttgctttctatcgtggtgctgattgttgtgttcttgtatatgatgttaattcaatgaaatcatttgacaaccttaataactggagggaggaatttctgattcaagcaagtccttccgatccagagaattttccttttgttgtcataggaaacaaaatagatattgatggtggaaacagcagagtggtgtcagaaaagaaggctcgggcttggtgtgcatcaaaaggaaatattccatattttgagacatctgccaaagaaggtattaatgttgaagaagcattccaatgcatagcaaagaatgccctgaaaagtggagaagaagaagaattatacctgccagacacaattgatgttggaaacagcagtcagccacgggcaacaggatgtgagtgctga

SEQ ID NO: 10857 - protein, 206 aa, Glycine max
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVVIGNKIDIDGGNSRVVSEKKARAWCASKGNIPYFETSAKEGINVEEAFQCIAKNALKSGEEEELYLPDTIDVGNSSQPRATGCEC

SEQ ID NO: 10858 - DNA, 609 bp, Glycine max
  CDS (1)..(609)
atgaatcccgaatacgattatttgttcaagcttttgctgattggagattctggtgtaggcaagtcatgtcttctcctgaggtttgctgatgattcataccttgacagctatatcagtaccattggagtggactttaaaatccgcactgtggagcaggatgggaagactattaaacttcaaatttgggacactgcgggtcaggaacgtttccggacaatcactagcagctactatcgtggggctcatggcattattgttgtttatgatgtcactgaccaagagagcttcaacaatgttaagcagtggctgaatgaaattgaccgttatgcaagtgaaaatgttaacaagcttctagttggaaacaagtgtgatcttacggcaaataaagttgtgtcctctgagacagcaaaggcatttgctgatgaaattggaattcctttcatggaaactagtgctaaaaatgccaccaatgttgaacaggctttcatggccatggctgctgaaattaaaaacagaatggcaagccaaccagtgaacaatgccaggcctccaacagttcaaattcgaggacagccagtgaaccagaaggctggttgctgctcgacttag

SEQ ID NO: 10859 - protein, 202 aa, Glycine max
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLTANKVVSSETAKAFADEIGIPFMETSAKNATNVEQAFMAMAAEIKNRMASQPVNNARPPTVQIRGQPVNQKAGCCST

SEQ ID NO: 10860 - DNA, 645 bp, Glycine max
  CDS (1)..(645)
atggctgctccaccggcaagagctcgtgcggattacgattatctcataaaacttctcttgattggcgatagtggtgtcggaaagagttgccttcttctacgattctctgatggttctttcacaactagtttcatcacaactataggcattgattttaagataagaaccattgagcaggatggaaaacggatcaagctccaaatttgggatactgcaggtcaggagcggttccgaacaattacaactgcttactatcgtggtgctatgggcatattgctagtctatgatgttacagatgaagcatcatttaacaatatcaggaattggattcgcaatattgagcaacatgcttcagacaatgttaacaaaatactggtggggaacaaagctgatatggatgaaagcaaaagggctgtgcctacgtccaagggccaagcactggctgatgagtatgggatcaaattctttgaaactagtgcaaagacaaatctaaacgtggaggaagttttcttctcaatagcaagagatataaaacaaaggctggctgacactgacaccaaggcagagccttcaacaatcaaaatcaaccaagaccagtcaggaggggctggacaggctgcacaaaaatcggcttgttgtggttga

SEQ ID NO: 10861 - protein, 214 aa, Glycine max
MAAPPARARADYDYLIKLLLIGDSGVGKSCLLLRFSDGSFTTSFITTIGIDFKIRTIEQDGKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNLNVEEVFFSIARDIKQRLADTDTKAEPSTIKINQDQSGGAGQAAQKSACCG

SEQ ID NO: 10862 - DNA, 645 bp, Glycine max
  CDS (1)..(645)
atggatgcttcatcttcctcgtcgagtcaacctgaattcgattacttgttcaagcttctcttgattggggattctggcgttggcaaaagcaccctgcttttgagttttacctctgatactttcgaggatctttctcccaccatcggtgtagatttcaaagttaaatatgttacaatgggagggaaaaagttaaaacttgctatttgggacacagctgggcaggaaaggtttagaacacttactagttcatattacagaggagcacaaggaataattatggtatatgatgtaacaaggcgggaaacctttacaaatctatctgatatatgggctaaagaaattgacttatactcaacaaatcaagattgcatcaagatgcttgttggaaacaaagttgataaggaaagtgaaagggttgtcagcaaaaaggaaggaatagactttgctagggaatatggatgtctgtatactgaatgcagtgcaaaaaccagagtcaatgttgcacagtgttttgatgagcttgtgatgaagattttggagacaccaagcctcttggctgagggctcgtccggtgtgaaaaaaaacatcttcaagcagaaacccccacagtctgatgcatcaagtagtggctgctgctcatggtga

SEQ ID NO: 10863 - protein, 214 aa, Glycine max
MDASSSSSSQPEFDYLFKLLLIGDSGVGKSTLLLSFTSDTFEDLSPTIGVDFKVKYVTMGGKKLKLAIWDTAGQERFRTLTSSYYRGAQGIIMVYDVTRRETFTNLSDIWAKEIDLYSTNQDCIKMLVGNKVDKESERVVSKKEGIDFAREYGCLYTECSAKTRVNVAQCFDELVMKILETPSLLAEGSSGVKKNIFKQKPPQSDASSSGCCSW

SEQ ID NO: 10864 - DNA, 603 bp, Glycine max
  CDS (1)..(603)
atgggttgcggctcctcccttccagataggggctcaaggcagttgggtcgacccaattccgagaatggtggagggcaggacgccaagaatctgagggtcaagcttgttctcttaggtgattctggtgttggcaaaagctgtattgttctacgatttgttcgtggtcagtttgatccaacatctaaggtaactgttggagcttcttttttgtcacaaacaatagctctgcaagactctacaacagtcaagtttgaaatatgggatactgctggtcaagagaggtacgctgcgttagcaccactctattaccgtggtgcagcagttgcagttattgtttatgatataacaagcccagaatctttcagcaaagcacagtactgggttaaggagctacaaaaacatggaagccctgatatagtgatggcactggtcggtaataaagctgatcttctcgagaagcgggaagttgctgtccaggatggcactgactatgcagagaagaatggtatgtttttcatagagacatctgcaaagacagcagataatataaatgaactgtttgaggaaattgccaaaagactgcctcgcccatcagttagttga

SEQ ID NO: 10865 - protein, 200 aa, Glycine max
MGCGSSLPDRGSRQLGRPNSENGGGQDAKNLRVKLVLLGDSGVGKSCIVLRFVRGQFDPTSKVTVGASFLSQTIALQDSTTVKFEIWDTAGQERYAALAPLYYRGAAVAVIVYDITSPESFSKAQYWVKELQKHGSPDIVMALVGNKADLLEKREVAVQDGTDYAEKNGMFFIETSAKTADNINELFEEIAKRLPRPSVS

SEQ ID NO: 10866 - DNA, 654 bp, Glycine max
  CDS (1)..(654)
atggcggcgtacaaagccgacgatgattacgattacttgttcaaggtggttctgatcggcgactccggcgtcggaaaatctaaccttctttctcggttcacgcgaaacgagttcagcctcgaatcgaagtccaccattggcgttgagttcgccaccagaagcattcgcgtcgatgataaggtcgtcaaggctcagatttgggacactgctggtcaagaacggtaccgagctattacaagtgcatattatcgaggagctgttggtgctttactagtctatgatgttacacgtcatgttacttttgaaaatgtggagagatggctaaaagagctgagagatcacacagatgccaacattgtggtgatgcttgtagggaacaaagcagacctgcgtcatctgcgtgcagtttccactgaagatgctacaactttcgctgagcgagagaacacatttttcatggaaacatctgccctcgagtccttgaatgttgaaaatgccttcacagaagtgctgacccagatctatcatgttgtaagcaagaaggcccttgagattggagacgatccagcagctttgccaaaaggacagacaattaatgttgggtcccgtgatgatgtatcagctgtgaagaaatctggatgttgttctgcttga

SEQ ID NO: 10867 - protein, 217 aa, Glycine max
MAAYKADDDYDYLFKVVLIGDSGVGKSNLLSRFTRNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDATTFAERENTFFMETSALESLNVENAFTEVLTQIYHVVSKKALEIGDDPAALPKGQTINVGSRDDVSAVKKSGCCSA

SEQ ID NO: 10868 - DNA, 621 bp, Glycine max
  CDS (1)..(621)
atgtcgttgcgcaggcgaaccttgctcaaggtcattgttctcggcgacagcggggttggaaagacctcgttgatgaatcaatacgtgcacaagaagtttagtcagcaatataaggctaccattggggctgattttgtcaccaaagagcttcagattgatgacagacttgtcactctacaaatatgggacactgctgggcaagagagattccagagtctcggggttgcattttacagaggcgccgattgctgtgttcttgtgtatgatgtgaatgtgatgaaatcgtttgatacccttgagaactggcatgaggagtttctcaaacaggcaaaccctcctgatcccagggcatttccatttattttacttggaaacaagatcgatattgatggtgggaatagtcgagtggtttctgagaagaaagcaaaggactggtgtgcctcaaaagggaatattccctactttgaaacatccgcaaaagaggattacaatgttgatgctgcattcctgtgtattgccaaagctgctttagccaatgagcatgaacaagacatatattttcaagggattcctgaggcggcagttccagagaatgagcagaggagtggatgtgcatgctga

SEQ ID NO: 10869 - protein, 206 aa, Glycine max
MSLRRRTLLKVIVLGDSGVGKTSLMNQYVHKKFSQQYKATIGADFVTKELQIDDRLVTLQIWDTAGQERFQSLGVAFYRGADCCVLVYDVNVMKSFDTLENWHEEFLKQANPPDPRAFPFILLGNKIDIDGGNSRVVSEKKAKDWCASKGNIPYFETSAKEDYNVDAAFLCIAKAALANEHEQDIYFQGIPEAAVPENEQRSGCAC

SEQ ID NO: 10870 - DNA, 609 bp, Glycine max
  CDS (1)..(609)
atgaatcccgagtatgattatctgttcaagctccttcttattggagactctggtgttggtaaatcatgccttcttctgagattttctgatgattcgtacatcgaaagctacataagcaccattggagttgattttaaaatacgtaccgttgagcaagatggaaagaccattaaactacagatctgggacacagctgggcaagaacgatttaggacaatcaccagtagctactaccgtggtgcccatgggatcattattgtttatgatgtgacagatgaagagagcttcaataatgtgaagcagtggctcagtgaaattgatcgctatgcaagtgataatgttaacaagcttttggttggcaacaagtgtgatctggaagcaaatagagcagtgtcatatgaaacagctaaggcatttgcagatggaataggcataccttttatggaaacaagtgcaaaagatgctacaaatgtcgaacaggctttcatggcaatgactgcttcaatcaaggatagaatggcaagccaacctgcaaataatgcaaggcctccaacagtgcagatcaggggtcagccagttgcacagaaaggtgggtgctgctctttctga

SEQ ID NO: 10871 - protein, 202 aa, Glycine max
MNPEYDYLFKLLLIGDSGVGKSCLLLRFSDDSYIESYISTIGVDFKIRTVEQDGKTIKLQIWDTAGQERFRTITSSYYRGAHGIIIVYDVTDEESFNNVKQWLSEIDRYASDNVNKLLVGNKCDLEANRAVSYETAKAFADGIGIPFMETSAKDATNVEQAFMAMTASIKDRMASQPANNARPPTVQIRGQPVAQKGGCCSF

SEQ ID NO: 10872 - DNA, 651 bp, Glycine max
  CDS (1)..(651)
atggccgcagcaccggctagagctcgtgccgattacgattacctcatcaagcttcttcttatcggcgacagcggtgtcgggaagagttgtctgcttttgagattttctgatggctcattcacaaccagttttatcaccaccattggtatcgattttaagataagaaccattgaactagacggcaaacggattaagttacaaatctgggatactgctggtcaggaacggtttcgaactattaccacagcttattaccgtggagccatgggtatcttgctggtttatgatgttactgatgaagcatctttcaataatattaggaattggattcgcaatattgaacaacatgcttctgacaatgtaaacaagatacttgttggcaacaaggctgatatggatgaaagtaaaagggctgtacctacctccaaagggcaagcacttgctgatgagtatggtatcaagttctttgaaactagtgcaaaaaccaacatgaacgtggaagaggtcttcttttcaatagcaagagatatcaagcaaaggcttgcagacacagattcaagagctgagcctcagactatcaagattaaccaaccagaccaggcaaccagtggtggtcaacctgcgcaaaagtcggcttgctgtggttcatga

SEQ ID NO: 10873 - protein, 216 aa, Glycine max
MAAAPARARADYDYLIKLLLIGDSGVGKSCLLLRFSDGSFTTSFITTIGIDFKIRTIELDGKRIKLQIWDTAGQERFRTITTAYYRGAMGILLVYDVTDEASFNNIRNWIRNIEQHASDNVNKILVGNKADMDESKRAVPTSKGQALADEYGIKFFETSAKTNMNVEEVFFSIARDIKQRLADTDSRAEPQTIKINQPDQATSGGQPAQKSACCGS

SEQ ID NO: 10874 - DNA, 621 bp, Glycine max
  CDS (1)..(621)
atgccttcccgaagaagaactctcttgaaggtcatcattctcggtgacagcggggtggggaagacgtctttgatgaaccagtatgtgaataagaagtttagtaatcagtacaaggcaaccattggagcggattttttaaccaaagaagtgcaatttgaagataggcttttcaccttacagatttgggatacagctggccaagaaagattccaaagccttggagttgctttctatcgtggtgctgattgttgtgttcttgtatatgatgttaattcaatgaaatcatttgacaaccttaataactggagggaggaatttctgattcaagcaagtccttctgatccagagaattttccttttgttgtcataggaaacaaaatagatattgatggtggaaacagcagagtggtgtcagaaaagaaggctcgggcttggtgtgcatcaaaaggaaatattccatattttgagacatctgccaaagaaggtcttaatgttgaagaagcattccaatgcatagcaaagaatgccctgaaaagtggagaagaagaagaattatacctgccagacacaattgatgttggaaacagcagtcagccacgggcaacaggatgtgagtgctga

SEQ ID NO: 10875 - protein, 206 aa, Glycine max
MPSRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPENFPFVVIGNKIDIDGGNSRVVSEKKARAWCASKGNIPYFETSAKEGLNVEEAFQCIAKNALKSGEEEELYLPDTIDVGNSSQPRATGCEC

SEQ ID NO: 10876 - DNA, 633 bp, Helianthus annuus
  CDS (1)..(633)
atgtcgtacgattacctttacaaatacataatcatcggcgacacaggtgtggggaaatcctgtctgttgttgcaattcactgataagcggtttcaaccggttcatgatttgactattggagtcgaatttggtgctcgtatggtctccattcatggtaggcctgtcaagcttcagatttgggatactgctggacaagagtcattcagatcaatcactaggtcatattacagaggagcagccggggcacttctcgtttatgacattactaggagggaaacattcaaccatctagctgggtggcttgaagatgcacggcaacatgccaacccgaacatgacaatcatgcttgtagggaataaaagtgatctttcccaccgaagggctgttagcaaagaggaaggagaacagtttgcaaaggaaaacgacctcttgttcttagaggcatccgcaagaacatcacaaaatgttgaggaggcttttttgaagactgctgagaagatacttcagaagatccaggaaggtgtatttgatgtgtccaatgagtcatctgggatcaaggtcggatatgggcgtcctcaaggcacaggagcaagagacggaacagttgctcagagcggcggctgttgtagttga

SEQ ID NO: 10877 - protein, 210 aa, Helianthus annuus
MSYDYLYKYIIIGDTGVGKSCLLLQFTDKRFQPVHDLTIGVEFGARMVSIHGRPVKLQIWDTAGQESFRSITRSYYRGAAGALLVYDITRRETFNHLAGWLEDARQHANPNMTIMLVGNKSDLSHRRAVSKEEGEQFAKENDLLFLEASARTSQNVEEAFLKTAEKILQKIQEGVFDVSNESSGIKVGYGRPQGTGARDGTVAQSGGCCS

SEQ ID NO: 10878 - DNA, 630 bp, Helianthus annuus
  CDS (1)..(630)
atggatgcttcttcggtgtccgaatttgattatttgttcaagctgttgatgatcggagattcaggcgttggtaagagcagtcttctgttgagtttcacttccgatacgtgcgaagaactttctcctactattggggtggattttaaggtaaaacatgttacgcttggaggaaagaagttaaagcttgctatttgggataccgctggacaggaaagattcagaactttaaccagttcatattatagaggagcacagggaattataatggtttatgacgtaacccgaagagagacattcacaaacttatctgatatatgggcaaaggaaattgatctctactcaacaaatcaagattgcatcaagatgcttgttggtaataaagttgataaggaaagtgagagggttgtaacaaagaaagaaggaatcgactttgcaagggaatatggatgcctttttattgaatgtagtgcaaaaacacgggtcaatgtggagcaatgttttgaggaacttgttttaaagatcttggatacacctagtttgacttctgaggggtcaactaccgtgaaaaggaacaacatatttagccaaaagcctccagtttccgatgactcgaccaatggatgctgctga

SEQ ID NO: 10879 - protein, 209 aa, Helianthus annuus
MDASSVSEFDYLFKLLMIGDSGVGKSSLLLSFTSDTCEELSPTIGVDFKVKHVTLGGKKLKLAIWDTAGQERFRTLTSSYYRGAQGIIMVYDVTRRETFTNLSDIWAKEIDLYSTNQDCIKMLVGNKVDKESERVVTKKEGIDFAREYGCLFIECSAKTRVNVEQCFEELVLKILDTPSLTSEGSTTVKRNNIFSQKPPVSDDSTNGCC

SEQ ID NO: 10880 - DNA, 666 bp, Helianthus annuus
  CDS (1)..(666)
atggcgttgccgaatcagcaaactgttgattatccgagtttcaagcttgttattgtcggcgatggtggaactggaaaaacaacttttgtgaagagacatttgaccggagaatttgagaaggaatacgaaccaactattggtgttgaggttcaccctttggatttcttcactaattgtggaaagatccggttttactgttgggatacagccggccaggagaaatttggtggtcttcgtgatggatattacattcacggtcaatgtgccatcattatgtttgatgtcactgcaaggttgacttacaagaatgttcccacatggcatcgtgatctttgccgtgtttgtgaaaatattccaattgtactttgtggaaacaaagttgatgtcaagaaccgtcaagtgaaggcaaaacaagttacttttcacagaaagaagaacttgcagtattacgagatatctgctaagagtaattacaactttgagaagccttttctttatcttgcaaggaaactcgctggggaccctaacttgcattttgttgagtctcctgctctagctcctccggaagtgcaaattgacattgctgctcaacaacagcatgaagctgagcttgctgcagctgccagccagcctcttccagatgacgacgatgatgcttttgaatag

SEQ ID NO: 10881 - protein, 221 aa, Helianthus annuus
MALPNQQTVDYPSFKLVIVGDGGTGKTTFVKRHLTGEFEKEYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDIAAQQQHEAELAAAASQPLPDDDDDAFE

SEQ ID NO: 10882 - DNA, 666 bp, Helianthus annuus
  CDS (1)..(666)
atggcgcttccgaaccagcaaaccgttgattaccccagcttcaaacttgttattgttggcgatggtggaactggcaaaactacgtttgtgaagagacatttgacgggagaattcgagaagaaatacgaaccaactattggtgtggaggttcatcctttggatttcttcaccaactgcggtaagattcggttttactgctgggacacagctgggcaagagaagttcggtggccttagagatggatattacattcacggccaatgtgcgatcattatgttcgacgttactgccagattgacgtacaagaatgttcccacgtggcaccgtgatctttgcagggtgtgtgagaacatcccgattgtgctatgtggaaacaaggttgatgttaagaaccgtcaagtgaaagcaaaacaagttacttttcaccgaaagaaaaacttgcagtattatgaaatttcggctaagagtaactacaactttgagaagccatttctctaccttgctaggaaacttgccggggatgcaaacttgcactttgtcgagtctcctgcacttgctccaccagaagttcaaatcgacatggttgctcaacaacagcatgaaaaggaacttgcggatgctgtaaaccagcctcttccggatgacgatgatgacgcttttgaatag

SEQ ID NO: 10883 - protein, 221 aa, Helianthus annuus
MALPNQQTVDYPSFKLVIVGDGGTGKTTFVKRHLTGEFEKKYEPTIGVEVHPLDFFTNCGKIRFYCWDTAGQEKFGGLRDGYYIHGQCAIIMFDVTARLTYKNVPTWHRDLCRVCENIPIVLCGNKVDVKNRQVKAKQVTFHRKKNLQYYEISAKSNYNFEKPFLYLARKLAGDANLHFVESPALAPPEVQIDMVAQQQHEKELADAVNQPLPDDDDDAFE

SEQ ID NO: 10884 - DNA, 600 bp, Helianthus annuus
  CDS (1)..(600)
atgagcaacgaatacgattatctcttcaaacttttactcatcggtgactcctccgtcggaaaatcatgccttcttctccgatttgctgatgattcttatgtggatagttacataagcacaattggagttgactttaaaatcaggactgtggagcaggataggaagaccatcaagctgcaaatatgggatactgctggccaggagcggtttcggactataacaagcagttactacagaggagcacatggaataattatagtgtatgatgtgactgagatggagagcttcaacaatgtgaagcaatggctgagtgaaatcgacagatatgcaaatgaatcagtctgcaagcttcttgttggaaacaaatgtgatctagttgagaacaaggttgttgacacacaaacagctaaggcatttgcagatgagctcgggatccctttcctcgagaccagtgcaaaagactccgtaaacgtggaacaggctttcttgacaatggctgcagagataaagaaaaaaatgggtaaccagccaacgggcgacaagagcacagttcaaatcaaagggcagccgattgagcagaagagcaattgttgtggttaa

SEQ ID NO: 10885 - protein, 199 aa, Helianthus annuus
MSNEYDYLFKLLLIGDSSVGKSCLLLRFADDSYVDSYISTIGVDFKIRTVEQDRKTIKLQIWDTAGQERFRTITSSYYRGAHGIIIVYDVTEMESFNNVKQWLSEIDRYANESVCKLLVGNKCDLVENKVVDTQTAKAFADELGIPFLETSAKDSVNVEQAFLTMAAEIKKKMGNQPTGDKSTVQIKGQPIEQKSNCCG

SEQ ID NO: 10886 - DNA, 612 bp, Helianthus annuus
  CDS (1)..(612)
atgaatcacgaatatgattacttgttcaagcttttgctgattggggattcgggagtcggcaaatcttgtctcctacttagatttgctgatgactcatatattgacagctacatcagcacaattggtgtggactttaaaatccgcaccgttgagcaggatggaaaaaccattaagcttcaaatttgggacacagctggacaagaaaggttcaggacaattaccagtagctactaccgtggggcccatggcattatcatagtttacgatgttactgacctagacagtttcaacaacgttaagcaatggttgagtgaaattgaccgttatgcaagtgaaaatgtgaataaacttcttgttggaaacaaatgtgaccttacagaaagtagagccgtgtcctatgatactgctaaggaatttgcggataacattggcattccgtttatggaaactagtgccaaagatgctaccaatgttgagcaggctttcatggccatgtcctctgacatcaaaaacaggatggcaagtcagcctggggcaaacaacacgaggccaccttctgtgcagctcaagggtcaacctgttggtcaaaagggcggttgctgctcatcttag

SEQ ID NO: 10887 - protein, 203 aa, Helianthus annuus
MNHEYDYLFKLLLIGDSGVGKSCLLLRFADDSYIDSYISTIGVDFKIRTVEQDGKTIKLQIWDTAGQERFRTITSSYYRGAHGIIIVYDVTDLDSFNNVKQWLSEIDRYASENVNKLLVGNKCDLTESRAVSYDTAKEFADNIGIPFMETSAKDATNVEQAFMAMSSDIKNRMASQPGANNTRPPSVQLKGQPVGQKGGCCSS

SEQ ID NO: 10888 - DNA, 600 bp, Helianthus annuus
  CDS (1)..(600)
atgagcaacgaatacgattatctcttcaaacttttactcatcggtgactcctccgtcggaaaatcatgccttcttctccgatttgctgatgattcttatgtggatagttacataagcacaattggagttgactttaaaattaggactgtggagcaggataggaagaccatcaagctgcagatatgggatactgctggccaggagcggtttcggactataacaagcagttactacagaggagcacatggaataattatcgtgtatgatgtgactgagatggagagcttcaacaatgtgaagcaatggctgagtgaaatcgacagatatgcaaatgaatcagtctgcaagcttcttgttggaaacaaatgtgatctagttgagaacaaggttgttgacacacaaacagctaaggcatttgcagatgagctcgggatccctttcctcgagaccagtgcaaaagactccgtaaacgtggaacaggctttcttgacaatggctgcagagataaagaaaaaaatgggtaaccagccaacgggcgacaagagcatagttcaaatcaaagggcagccgattgagcagaagagcaattgttgtggttaa

SEQ ID NO: 10889 - protein, 199 aa, Helianthus annuus
MSNEYDYLFKLLLIGDSSVGKSCLLLRFADDSYVDSYISTIGVDFKIRTVEQDRKTIKLQIWDTAGQERFRTITSSYYRGAHGIIIVYDVTEMESFNNVKQWLSEIDRYANESVCKLLVGNKCDLVENKVVDTQTAKAFADELGIPFLETSAKDSVNVEQAFLTMAAEIKKKMGNQPTGDKSIVQIKGQPIEQKSNCCG

SEQ ID NO: 10890 - DNA, 612 bp, Helianthus annuus
  CDS (1)..(612)
atgaatcccgaatacgactatctgttcaagcttttactcattggagattcaggagttggaaaatcatgtctcctattgcgttttgctgatgattcgtacttggaaagttacattagcaccattggggttgactttaaaattcgcactgtggaacaagatggcaaaacaattaagcttcaaatttgggatacagctggacaagaacgtttcaggaccatcactagcagctactatcgtggagctcatggcattattgttgtttatgacgtgacagatcaagagagtttcaacaacgtgaaacaatggttgagtgaaatcgatcgttacgctagtgagaacgtaaacaagcttcttgtcggaaacaaatgcgatcttacgtctcagaaagctgtttcctacgaaacaggaaaggcgtttgctgatgagatcgggatcccgtttctcgaaacaagtgccaagaattccaccaatgtcgaagaggcgtttatggctatgactgctgaaataaaaaacaggatggcaagccagccggcaatgaacaatgctagaccgctaactgttgaaatccgaggtcaaccggtcaaccaaaagtcaggatgctgctcttcttga

SEQ ID NO: 10891 - protein, 203 aa, Helianthus annuus
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLSEIDRYASENVNKLLVGNKCDLTSQKAVSYETGKAFADEIGIPFLETSAKNSTNVEEAFMAMTAEIKNRMASQPAMNNARPLTVEIRGQPVNQKSGCCSS

SEQ ID NO: 10892 - DNA, 609 bp, Helianthus annuus
  CDS (1)..(609)
atgactcctgagtatgactacctgttcaagcttttgctcattggagattcgggtgtaggaaagtcatgtctacttctgaggtttgctgacgattcttacttggacagttacataagcaccatcggagtcgattttaaaattcgtaccgtggagcaagatgccaaggttatcaagcttcaaatttgggatactgctggccaagaacgttttaggacaatcacaagcagctactatcgaggagcacatggcatcatcgtggtttatgatgtgacggaccaagagagctttaataacgttaagcagtggctgagtgaaatcgaccgttacgctagtgagaacgttaacaagatccttgttggaaacaaatgcgatcttgttgcaaataaagtcgtttcaaccgaaacagccaaggcatttgctgatgaaattggaattccgttcttggaaacaagtgcaaaagatgcaaccaatgtcgaacaggctttcatggccatgacggcttccatcaaagacaggatggcgagtcaacccaatttgaatacctcaaagcctccaacggtcaacattcgtggtcaaccggtctcccagaacagcggatgctgctcttag

SEQ ID NO: 10893 - protein, 202 aa, Helianthus annuus
MTPEYDYLFKLLLIGDSGVGKSCLLLRFADDSYLDSYISTIGVDFKIRTVEQDAKVIKLQIWDTAGQERFRTITSSYYRGAHGIIVVYDVTDQESFNNVKQWLSEIDRYASENVNKILVGNKCDLVANKVVSTETAKAFADEIGIPFLETSAKDATNVEQAFMAMTASIKDRMASQPNLNTSKPPTVNIRGQPVSQNSGCCS

SEQ ID NO: 10894 - DNA, 615 bp, Hordeum vulgare
  CDS (1)..(615)
atgagcgcctccgagtacgactacctcttcaagctgctcctcatcggcgactcctccgtcggcaagtcctgcctcctcctccgcttcgccgacgatgcgtacgtcgacacctacatcagcaccatcggagttgatttcaaaatacggacagtcgagctcgacggcaagtcggtgaagctgcagatttgggacacagcaggccaggaaaggttcaggacaataacgagcagttactaccggggagcgcatggaatcattatcgtatatgacgtgacagatagggaaagcttcaacaatgtcaagcagtggttgagtgagattgataggtatgccagtgacagtgtgtgcaagcttctagtcgggaacaaatgtgatttggttgacagtaaggtcgtcgatacagaggaggccaaggcttttgcagaatcattaggaatgaatttcctggagacaagtgcaaaggagtccatcaatgtggagacagctttcttaaccatgtcatcagaaatcaagaacaagatggcgagccaacctgcagcggagcggaaatcgacggtccatgttcacatgaaagggcagcccatacagcagcagcagagcagctgctgctcctga

SEQ ID NO: 10895 - protein, 204 aa, Hordeum vulgare
MSASEYDYLFKLLLIGDSSVGKSCLLLRFADDAYVDTYISTIGVDFKIRTVELDGKSVKLQIWDTAGQERFRTITSSYYRGAHGIIIVYDVTDRESFNNVKQWLSEIDRYASDSVCKLLVGNKCDLVDSKVVDTEEAKAFAESLGMNFLETSAKESINVETAFLTMSSEIKNKMASQPAAERKSTVHVHMKGQPIQQQQSSCCS

SEQ ID NO: 10896 - DNA, 600 bp, Hordeum vulgare
  CDS (1)..(600)
atgggctgctcctcctccgcgccagctagaagcactggagggctgaacaatatcaacggtagctcttccgccaccgattcaaacgacttgcgtgccaagttggtattgctcggagactctggtgttggaaaaagctgcatcgttcttcgctttgttcgcggtcagttcgatccaacttccaaggtaactgttggtgcatcatttttatcacaaacattggcgttggaggattcgacaatagtgaagtttgaaatctgggatactgctggacaagagagatatgctgccttggcacctctttactacagaggagctgctgctgcggttgttgtctatgacataactagcccagaatcatttaagaaagcacaatattgggtgaaggaacttcaaaaacatggtaatcctggtattgtcatggttttggttggtaataaagctgatctacatgaaagtcgaagcgtaccttctcaggaggcacaagagtatgcagagaagaacagtatgttattcatggagacgtcagcaaaaacatctgataatataaatcaagtatttgaggaaatcgcgaagaggttgcccaagccaacaacgtcttga

SEQ ID NO: 10897 - protein, 199 aa, Hordeum vulgare
MGCSSSAPARSTGGLNNINGSSSATDSNDLRAKLVLLGDSGVGKSCIVLRFVRGQFDPTSKVTVGASFLSQTLALEDSTIVKFEIWDTAGQERYAALAPLYYRGAAAAVVVYDITSPESFKKAQYWVKELQKHGNPGIVMVLVGNKADLHESRSVPSQEAQEYAEKNSMLFMETSAKTSDNINQVFEEIAKRLPKPTTS

SEQ ID NO: 10898 - DNA, 612 bp, Hordeum vulgare
  CDS (1)..(612)
atgaatccggagtatgattacctcttcaagcttttgcttattggagactcaggcgttggcaagtcatgtcttctgttaagatttgcggatgattcgtacctggatagttacatcagtactattggagttgattttaaaatacggactgtggagcaggatggaaagactatcaagctgcaaatctgggacactgctgggcaagaacgttttagaactattaccagcagctactaccgaggggcccatgggattattatagtctacgatgtgacagaccaagatagcttcaacaatgtgaagcagtggctgaacgagattgatcgctatgctagtgagaatgtgaacaagcttctcgtggggaacaaatgtgatctcgctgacaaaagagctgtatcatatgaaacagcaaaggcatttgctgatgagattggcattccattcatggagaccagtgcaaagaacgccctgaatgttgaacaggctttcatggccatggctgcttcgatcaaggataggatggccagccagccagcagcaaacaacgctcgcccagcgactgtacagatccgcgggcaacctgtcgaccagaagaccagctgctgctcttcttag

SEQ ID NO: 10899 - protein, 203 aa, Hordeum vulgare
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQDSFNNVKQWLNEIDRYASENVNKLLVGNKCDLADKRAVSYETAKAFADEIGIPFMETSAKNALNVEQAFMAMAASIKDRMASQPAANNARPATVQIRGQPVDQKTSCCSS

SEQ ID NO: 10900 - DNA, 654 bp, Hordeum vulgare
  CDS (1)..(654)
atgggcggacgtgtggatcacgagtactcctacctgttcaagatggtgctcatcggggatagcggcgtcggcaagtccaacatcctctcccgattcacccgcaaccacttctccctcgactccaagtccaccatcggcgtggagttcgccaccaagtccttgcagatggagggaaaaacaataaaggctcagatctgggacacagctggtcaggagaggtatcgtgcaattacaagcgcatattaccggggcgctgtaggggctctccttgtatatgacatcacaaagaagcagagctttgacaatgttaataggtggctgcatgagctccgtgatcacgctgactccagcattgtcatcatgatggtcggtaacaagtccgacctgacacatctaagggctgtctctgaggatcaaggcaaggcactggcagaaaaggagggcctgtttttccttgagacatcagctatggaggctgtgaatgtggtagaagcgtttcagactatcatcacagaggtctatggtattgtcaacaagaaagcactggccgccaaagaagcagcagcagcagctgttccattgccttcccagggtaaaaccatcagcgttgacagtactgtgggcaattcaaagagggcatgctgcaatacttga

SEQ ID NO: 10901 - protein, 217 aa, Hordeum vulgare
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKKQSFDNVNRWLHELRDHADSSIVIMMVGNKSDLTHLRAVSEDQGKALAEKEGLFFLETSAMEAVNVVEAFQTIITEVYGIVNKKALAAKEAAAAAVPLPSQGKTISVDSTVGNSKRACCNT

SEQ ID NO: 10902 - DNA, 606 bp, Hordeum vulgare
  CDS (1)..(606)
atgaatcccgaatacgactacctcttcaagctacttctcatcggagattctggtgtgggaaagtcttgtttgctcttacgatttgccgatgacacatataccgaaagttacatctcgaccatcggcgtagactttaaaattcgaactattgagctagatggcaaaacggtgaagttacaaatctgggatactgcggggcaagaaagatttcgaaccatcacttcatcatattatagaggtgcacacggcatttgtgtcgtatacgatgtcacagatatggattcattcaacaacgttaagcaatggctccaggaaattgacagatatgctacagaaggagtcaacaaactccttgtaggcaataaaagtgatatgtcggataagaaagtcgttgagtacacagttgcaaaggaatttgccgacagtctcgggattccatttttggaaacctcggccaaaaatgccagtaatgttgaacaagcctttttaaccatggctcgtcaaatcaaggagaggatggggacaactacagcaaacaacaaaccaacagtacaggtcggacagggacagggagttcaatcaagcaccaacaacggctgttgttag

SEQ ID NO: 10903 - protein, 201 aa, Hordeum vulgare
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYTVAKEFADSLGIPFLETSAKNASNVEQAFLTMARQIKERMGTTTANNKPTVQVGQGQGVQSSTNNGCC

SEQ ID NO: 10904 - DNA, 645 bp, Hordeum vulgare
  CDS (1)..(645)
atggctgcgccgccggcgagggcccgggccgactacgactacctcatcaagctcctcctcatcggggacagcggtgttggcaagagttgcctccttctgcggttctctgatggctccttcactacgagctttattaccacgattggtattgactttaagatcagaacaatagagctggatcagaaacgtattaagctacaaatatgggacacggctggtcaagaacggttccggactattaccactgcgtattaccgtggagccatgggtatcctgcttgtttatgacgtcaccgacgagtcatctttcaacaacataaggaactggatccggaacattgagcagcatgcctctgacaacgtcaacaaaattttgattggcaacaaggctgatatggatgagagtaaaagggctgtacctactgcgaaggggcaagctttggccgatgaatatggcatcaagttctttgaaactagtgccaagacaaacctgaacgtggagcaggttttcttctccattgcccgcgacattaagcagaggcttgccgagaccgattccaagcctgaggacaaaacaatcaagattaacaaggcagaaggcggtgatgcgccggcagcttcgggatctgcctgctgtggctcttaa

SEQ ID NO: 10905 - protein, 214 aa, Hordeum vulgare
MAAPPARARADYDYLIKLLLIGDSGVGKSCLLLRFSDGSFTTSFITTIGIDFKIRTIELDQKRIKLQIWDTAGQERFRTITTAYYRGAMGILLVYDVTDESSFNNIRNWIRNIEQHASDNVNKILIGNKADMDESKRAVPTAKGQALADEYGIKFFETSAKTNLNVEQVFFSIARDIKQRLAETDSKPEDKTIKINKAEGGDAPAASGSACCGS

SEQ ID NO: 10906 - DNA, 606 bp, Linum usitatissimum
  CDS (1)..(606)
atgggcaccgaatacgactatctcttcaagcttctgctaatcggcgactcctccgttggaaaatcttgcctgctgctccgatttgctgatgattcgtacgttgacagctacatcagtactataggagttgatttcaaaatcagaactgtggagctggatggaaagacggtcaagcttcagatctgggatactgctggtcaggagcgctttagaacaataacaagcagttattaccgaggggcacatggaatcatcattgtctatgatgttactgacatggacagcttcaacaatgtcaaacaatggttaaatgagattgaccgatatgcaaatgatactgtatgcaagcttttggttgggaacaaatgcgatcttgttgagaacaaagttgtcgatacgcagacagcaaaggcgttggccgatgagctaggcatcccttttctggagaccagtgccaaagattcaataaatgtggaacaagctttcttaacaatggctgcagaaattaagaaaaaaatgggtaatcaaccgacagctagcaaggcgaccggaacggttcagatgaaaggacaaccgatccagcaaagcaacaactgctgtggttaa

SEQ ID NO: 10907 - protein, 201 aa, Linum usitatissimum
MGTEYDYLFKLLLIGDSSVGKSCLLLRFADDSYVDSYISTIGVDFKIRTVELDGKTVKLQIWDTAGQERFRTITSSYYRGAHGIIIVYDVTDMDSFNNVKQWLNEIDRYANDTVCKLLVGNKCDLVENKVVDTQTAKALADELGIPFLETSAKDSINVEQAFLTMAAEIKKKMGNQPTASKATGTVQMKGQPIQQSNNCCG

SEQ ID NO: 10908 - DNA, 651 bp, Linum usitatissimum
  CDS (1)..(651)
atggctgctccgcccgcaagagctcgtgccgattatgattaccttataaagctcctcctgatcggcgataccggtgtgggtaagagttgcctcctcctacgtttctcagatggttccttcaccactagtttcattacgaccataggtattgatttcaagataaggacaattgagcttgatggaaaacggatcaagttgcaaatatgggatactgctggtcaagagcgtttccgcactattacaactgcttactatcgtggagcaatgggtattttgctcgtgtatgatgtcactgatgagtcatcattcaacaatatcaggaattggattcgcaacattgaacaacatgcctctgataatgtgaacaagatcttggttggaaacaaagccgatatggatgagagcaaaagggcggttcctaccgcaaagggccaggctcttgcagacgaatacggcatcaagttctttgagacgagtgcaaagacaaacttaaacgtggaggaggttttcttctcaatagccagagacatcaagcaacgacttgcagatacggattcaaagtccgagccacagacgatcaagattaaccagccggaccaggcgggtggttcgaaccaggctgcacaaaagtctgcttgctgtggttcttag

SEQ ID NO: 10909 - protein, 216 aa, Linum usitatissimum
MAAPPARARADYDYLIKLLLIGDTGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIARDIKQRLADTDSKSEPQTIKINQPDQAGGSNQAAQKSACCGS

SEQ ID NO: 10910 - DNA, 639 bp, Linum usitatissimum
  CDS (1)..(639)
atgggatcttcttcaggtagtagtgggtatgatctgtcgttcaagttgttgttgattggagattcaagtgttggcaaaagcagcctgcttgtcagcttcatctccaccacctctgctgaagaagatcttgctcccaccattggtgtggacttcaagatcaagcagctgacagtagctggcaagagattgaagctcaccatttgggatactgctgggcaggagaggttcaggacactaacaagctcttactacaggaatgcacagggaatcatacttgtttatgacgtgacaaggagagagacctttacgaacctatcggacgtatgggctaaagaagttgagctctactgcacaaaccaggactgtgtcaagatgcttgttggcaacaaagttgacaaagactctgacagaactgtaaccagagaagaaggaatggaacttgcaaaacagcacggatgtttgttcctcgagtgcagtgccaaaactcgtgaaaacgtggagcaatgcttcgaggagctcgcgcaaaagataaaggatgttccaagtctcttggaagaaggatctacagccgggaagaggaacattctaaagcaaaacccagatcgacaaatgtctcaaagcaacggctgttgctcttaa

SEQ ID NO: 10911 - protein, 212 aa, Linum usitatissimum
MGSSSGSSGYDLSFKLLLIGDSSVGKSSLLVSFISTTSAEEDLAPTIGVDFKIKQLTVAGKRLKLTIWDTAGQERFRTLTSSYYRNAQGIILVYDVTRRETFTNLSDVWAKEVELYCTNQDCVKMLVGNKVDKDSDRTVTREEGMELAKQHGCLFLECSAKTRENVEQCFEELAQKIKDVPSLLEEGSTAGKRNILKQNPDRQMSQSNGCCS

SEQ ID NO: 10912 - DNA, 612 bp, Linum usitatissimum
  CDS (1)..(612)
atgaactctgagtacgattacttgttcaagcttttgcttatcggagattccggagtcggcaagtcatgtctacttttgcgattcgctgatgattcgtacttggacagttacatcagtaccatcggagtggacttcaaaattcgcaccgtggagcaggatggcaaaaccattaagctccaaatctgggatacggcagggcaagaacgattcaggaccattacaagtagttactatcgtggtgctcatgggattattgtggtctatgatgtcacagaccaagagagtttcaacaatgtcaaacagtggttgagtgaaattgatcgctacgcaagtgagaacgtgaacaaacttctagttgggaacaagagtgacctcactgccaacaaagttgtttcatatgaaactgctaaggcatttgccgatgaaattgggattcccttcatggagacgagtgccaagaacgcttccaatgtcgaagatgcttttatggcaatgtcagctgcaatcaagaccaggatggctagccaacctgtgtcaggcactgccagacctccaacggtgcaaatccgcggagaaccagtgaaccagaagtcaggttgctgctcttcttga

SEQ ID NO: 10913 - protein, 203 aa, Linum usitatissimum
MNSEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLSEIDRYASENVNKLLVGNKSDLTANKVVSYETAKAFADEIGIPFMETSAKNASNVEDAFMAMSAAIKTRMASQPVSGTARPPTVQIRGEPVNQKSGCCSS

SEQ ID NO: 10914 - DNA, 609 bp, Linum usitatissimum
  CDS (1)..(609)
atgaacactgaatacgattacttgttcaagcttttgcttattggagattctggagtcggcaaatcgtgtctgcttttgagattcgctgatgattcgtaccttgacagctacatcagtaccataggagtcgatttcaaaatccgcactgtggagcaggatgggaagaccatcaaactccaaatttgggacacagcagggcaagagcgatttaggacgatcaccagcagttactacaggggtgctcacgggatcattgttgtttatgatgtcacggaccaagagagtttcaacaacgtaaaacagtggctgaacgagatcgatcgctacgctagcgagcacgtgaacaagcttcttgtgggaaacaagagtgacctcactagcaacaaagtcgtttcgtatgaaacagggaaggcattagctgatgaactcggtatcccgttcatggagacgagtgccaagaacgcgtccaacgtagaagacgctttcatggccatgtcagctgcaatcaagaccaggatggctagccagcccacgaacaatgccaagccaccgactgtccaaatccgtggagaaccggtcaaccagaagtcaggctgctgttcttcttga

SEQ ID NO: 10915 - protein, 202 aa, Linum usitatissimum
MNTEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASEHVNKLLVGNKSDLTSNKVVSYETGKALADELGIPFMETSAKNASNVEDAFMAMSAAIKTRMASQPTNNAKPPTVQIRGEPVNQKSGCCSS

SEQ ID NO: 10916 - DNA, 651 bp, Linum usitatissimum
  CDS (1)..(651)
atggctgctccgcccgcaagagctcgtgccgattatgattaccttataaagctcctcctgatcggcgatagcggtgtgggtaagagttgcctcctcctacgtttctcagatggttccttcaccactagtttcattacgaccattggtattgatttcaagataaggacaattgagcttgatggaaaacggatcaagttgcaaatatgggatactgctggtcaagagcgtttccgcactattacaactgcttactatcgtggagcaatgggtattttgctcgtgtatgatgtcactgatgagtcatcattcaacaatatcaggaattggattcgcaacattgaacaacatgcctctgataatgtgaacaagatcttggttggaaacaaagccgatatggatgagagcaaaagggcggttcctaccgcaaagggccaggctcttgcagacgaatacggcatcaagttctttgagacgagtgcaaagacaaacttaaacgtggaggaggttttcttctcaatagccagagacatcaagcaacgacttgcagatacggattcaaagtccgagccacagacgatcaagattaaccagccggaccaggcgggtggttcgaaccaggctgcacaaaagtctgcttgctgtggttcttag

SEQ ID NO: 10917 - protein, 216 aa, Linum usitatissimum
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEEVFFSIARDIKQRLADTDSKSEPQTIKINQPDQAGGSNQAAQKSACCGS

SEQ ID NO: 10918 - DNA, 639 bp, Linum usitatissimum
  CDS (1)..(639)
atgggatcttcttcaggtagtagtgggtatgatctgtcgttcaagttgttgttgattggagattcaagtgttggcaaaagcagcctgcttgtcagcttcatctccaccacctctgctgaagaagatcttgctcccaccattggtgtggacttcaagatcaagcagctgacagtagctggcaagagattgaagctcaccatttgggatactgctgggcaggagaggttcaggacactaacaagctcttactacaggaatgcacagggtatcatacttgtttatgacgtgaccaggagagagacctttacgaacctatcggacgtatgggctaaagaagttgagctctactgcacaaaccaggactgtgtcaagatgcttgttggcaacaaagttgacaaagactctgacagaactgtaaccagagaagaaggaatggaacttgcaaaagagcgtggatgtttgttcctcgagtgcagtgccaaaactcgtgaaaacgtggagcaatgcttcgaggagcttgcgcaaaagataaaggatgttccaagtctcttggaagaaggatctacggccgggaagaggaacattctaaagcaaaacccagatcgccaaatgtctcaaagcaacggctgttgctcttaa

SEQ ID NO: 10919 - protein, 212 aa, Linum usitatissimum
MGSSSGSSGYDLSFKLLLIGDSSVGKSSLLVSFISTTSAEEDLAPTIGVDFKIKQLTVAGKRLKLTIWDTAGQERFRTLTSSYYRNAQGIILVYDVTRRETFTNLSDVWAKEVELYCTNQDCVKMLVGNKVDKDSDRTVTREEGMELAKERGCLFLECSAKTRENVEQCFEELAQKIKDVPSLLEEGSTAGKRNILKQNPDRQMSQSNGCCS

SEQ ID NO: 10920 - DNA, 645 bp, Zea mays
  CDS (1)..(645)
atggcggcgcctccggcgagggcccgggccgactacgacttcctcatcaagctgctcctcatcggcgatagcggtgttgggaaaagttgtctccttttacggttctcagatggctccttcactactagcttcatcaccaccattgggattgacttcaaaataagaacagttgagcttgatggtaagcgcataaagttacagatatgggatactgctggtcaagaacgttttcgaactattacaaccgcctactacaggggtgcaatgggaattttgcttgtctatgatgttactgatgagtcatctttcaataatataagaaactggataaggaacattgagcaacatgcttccgacaatgtgaataaaattttggtaggcaacaaagctgacatggatgaaagcaaacgcgctgtaccgacttcaaaagggcaggctcttgctgacgagtatggcatcaagttttttgaaacgagtgcgaagaccaacctgaatgtggagcaggtttttttctccatagcaagagatatcaagcaaaggctttctgaatctgattcaaagccagaggatcgcacgatcagtattaacagacctgatggtggtgaggcttcggcttcacaaaaatcagcttgctgcggatcgtga

SEQ ID NO: 10921 - protein, 214 aa, Zea mays
MAAPPARARADYDFLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLSESDSKPEDRTISINRPDGGEASASQKSACCGS

SEQ ID NO: 10922 - DNA, 648 bp, Zea mays
  CDS (1)..(648)
atggcggcgccgccggcgagggcccgggccgactacgactaccttatcaagctgctcctcattggagacagcggtgttggcaagagttgcctcctgttgcggttctctgatggttccttcactacaagctttattaccacaattggtattgactttaagatacgaacgatagaattggatggcaagcgtataaagctacagatttgggatacggcgggccaagaacgcttccggactattaccaccgcgtactaccgaggagctatgggcatcttgctggtttatgatgtcaccgatgaatcttcttttaacaacatccgaaactggattcggaacattgaacagcacgcctctgataacgtcaacaagattttggttggcaacaaggccgatatggacgaaagcaagagggctgtacctactgcaaaaggacaagcacttgctgatgagtacgggatcaagttttttgaaacgagtgccaagacaaacctgaatgtggagcaagtgtttttctccatcgcacgtgacatcaagcagaggcttgcggagactgattcaaagccagaggacaaggcaatcaaaattaacaagccagaccagggttccgaggcaccagctgcccagcgatctgcttgctgcggctcataa

SEQ ID NO: 10923 - protein, 215 aa, Zea mays
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDKAIKINKPDQGSEAPAAQRSACCGS

SEQ ID NO: 10924 - DNA, 612 bp, Zea mays
  CDS (1)..(612)
atgaatcccgagtacgactacctcttcaagctgctcctcatcggcgactccggtgttgggaagtcttgcctgctgctgaggtttgcggatgattcatatctggagagctatatcagtactattggagttgattttaaaatccgcaccgttgagcaagatgggaagacaataaagctacagatttgggatactgctggccaagaacgctttaggaccatcacaagcagctactaccgtggagctcatggcattattgttgtgtatgatgtaactgaccaggagagctttaacaatgtcaagcagtggctgaatgaaattgataggtatgccagtgaaaatgtgaacaagcttttggtggggaacaagtgtgacctggctgagaacagagtagtttcttacgaggctggcaaggcccttgctgatgacatcggaataccattccttgagactagtgccaaggatgcaacaaatgtggagaaggcattcatgaccatggcaggggagataaagaacaggatggcaagtcaaccagctgcaagtggtgctagtaggcctgcaactgtgcaaatgcggggtcagcctgtttctcagcaaagcagctgctgctcttga

SEQ ID NO: 10925 - protein, 203 aa, Zea mays
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAENRVVSYEAGKALADDIGIPFLETSAKDATNVEKAFMTMAGEIKNRMASQPAASGASRPATVQMRGQPVSQQSSCCS

SEQ ID NO: 10926 - DNA, 648 bp, Zea mays
  CDS (1)..(648)
atggcagcgccaccggcgagggcccgagccgactacgactacctcatcaaactgctcctcatcggtgacagcggtgttggaaaaagttgtctcctgttacggttttcagatggatcattcaccactagcttcattaccactattggcattgacttcaagataaggactgtcgagttggatggcaaacggattaagttgcagatctgggacactgcaggccaagaacgtttccgcacgattactactgcttactacaggggagcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggctgtgcccacttcgaaggggcaagctctcgctgacgaatacgggataaagttttttgaaacgagtgcaaagacaaacctgaatgtcgagcaggttttcttttccatagcaagggacatcaaacagagactttcggagaccgattccaagcctgaggatcgaactatcaagatcaaggctgaaggggaagctgaggcagcggcggcggcgcagaattcagcttgctgtggctcctga

SEQ ID NO: 10927 - protein, 215 aa, Zea mays
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLSETDSKPEDRTIKIKAEGEAEAAAAAQNSACCGS

SEQ ID NO: 10928 - DNA, 666 bp, Zea mays
  CDS (1)..(666)
atggcgctgccgaatcagcaggttgtggattaccccagcttcaagctcgtcatcgttggcgacggtggaactggcaaaaccacatttgtgaagaggcatcttactggcgagtttgagaagaaatatgagcccaccattggtgttgaagttcaccctctggattttagcactaactgtggcaaaattcgcttctattgctgggacactgctgggcaagaaaagttcggtggcctcagggatggctactacattcatggtcagtgtgccatcattatgtttgatgtcacttcgaggctgacatacaagaatgttccaacatggcacagggacctgtgcagggtgtgtgagaacatccccatcgttctctgcggaaacaaggttgatgtaaagaacaggcaggtcaaagccaagcaagttacattccacaggaagaagaacttgcagtactatgagatttctgccaagagcaattacaactttgagaagcccttcctttacctcgcaaggaagctggcaggggatcagaaccttcactttgtcgaagccgttgctctgaagccaccggaagtgcagattgatatggccatgcagcagcagcatgaagctgagcttgcagctgccgctgcgcaacccctccctgatgacgatgatgacctgatcgaatag

SEQ ID NO: 10929 - protein, 221 aa, Zea mays
MALPNQQVVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAVALKPPEVQIDMAMQQQHEAELAAAAAQPLPDDDDDLIE

SEQ ID NO: 10930 - DNA, 654 bp, Triticum aestivum
  CDS (1)..(654)
atgggcggacgggtggatcacgagtactcctacctgttcaagatggtgctcatcggggatagcggcgtcggcaagtccaacatactctcccgattcacccgcaaccacttctccctcgactccaagtccaccatcggcgtggagttcgccaccaagtccttgcagatggagggaaaaacaataaaggctcagatctgggacactgctggccaggagaggtaccgtgcaattacaagcgcatattaccggggcgctgtaggggctctccttgtatatgacatcacaaagaagcagagctttgacaatgttaataggtggctgcgtgagctccgtgatcacgctgactctagcattgtcatcatgatggtcggtaacaagtctgacctgacacatctaagagctgtctctgaagatcaaggcaaggcactggctgaaaaggagggcctgtttttccttgagacatcagctatggaggctgtaaatgtggtagaagcctttcagactatcatcacagaggtctatggtattgtcaacaagaaagcactggccgccaaagcagcagcagcagcagctgttccattgccttcccagggtaaaaccatcagcattgacagtactgccgggaactcaaagaaggcatgctgcaatacttga

SEQ ID NO: 10931 - protein, 217 aa, Triticum aestivum
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKKQSFDNVNRWLRELRDHADSSIVIMMVGNKSDLTHLRAVSEDQGKALAEKEGLFFLETSAMEAVNVVEAFQTIITEVYGIVNKKALAAKAAAAAAVPLPSQGKTISIDSTAGNSKKACCNT

SEQ ID NO: 10932 - DNA, 612 bp, Triticum aestivum
  CDS (1)..(612)
atgaatcccgaatatgactacctcttcaagctgctgctcattggggactcgggcgtggggaagtcttgcctgctgctgaggtttgcggatgattcatatctggagagctatatcagtactattggtgttgacttcaaaatccgcaccgttgagcaagatgggaagacgataaagctgcaaatttgggatactgctggacaagagcgatttaggaccatcacaagcagctactaccgcggtgcccatggcatcattgttgtgtatgatgtgactgaccaggagagcttcaacaacgtcaaacagtggcttaatgaaatcgacaggtacgctagtgaaaatgtgaacaagcttttggtggggaacaagtgcgatctagctgagagcagagtggtttcttacgaggctggcaaggcccttgccgatgagattggaataccattcctggaaaccagtgccaaggatgcaacaaatgtggagaaggcatttatgaccatggctgcagagataaagaacaggatggcaagccaaccggctggaaatgccagcaagcctgccaccgtgcaaatgcggggtcagcctgttgcccagcaaaacggatgctgctcgtcttga

SEQ ID NO: 10933 - protein, 203 aa, Triticum aestivum
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAESRVVSYEAGKALADEIGIPFLETSAKDATNVEKAFMTMAAEIKNRMASQPAGNASKPATVQMRGQPVAQQNGCCSS

SEQ ID NO: 10934 - DNA, 621 bp, Triticum aestivum
  CDS (1)..(621)
atgggcaacgagttcgactacctgttcaagctcctcttgatcggcgactcctcggtcggcaagtcctgcttcctcctccgtttctccgacgattcgtatgtggacagctacattagcaccatcggcgttgactttaaaatccgcactctcgagatggatgggaagaccatcaaattgcagatttgggacacagcaggacaggagcggttcagaaccatcacaagcagctactaccgaggagctcacgggatcatcattgtctatgacatcacggacatggagagcttcaacaatgtcaagcaatggctgagcgagatcgacaagtacgccaacgacagcgtgcgcaagctacttgtcggtaacaagtgtgatctggctgagagcagggtcgtcgatactgcggtggcacaggcctgtgctgatgagatgggtattcctttcctagaaacaagtgctaaagagtccatcaatgtggaagaggcctttttggcaatgtctgcagcaatcaagaagagcaaagctggaggccttgagaggaaggcatccaatctggtccagatgaaaggccagccaattcagcagcagcagcacaagcagaagagcagctgctgttcaacatga

SEQ ID NO: 10935 - protein, 206 aa, Triticum aestivum
MGNEFDYLFKLLLIGDSSVGKSCFLLRFSDDSYVDSYISTIGVDFKIRTLEMDGKTIKLQIWDTAGQERFRTITSSYYRGAHGIIIVYDITDMESFNNVKQWLSEIDKYANDSVRKLLVGNKCDLAESRVVDTAVAQACADEMGIPFLETSAKESINVEEAFLAMSAAIKKSKAGGLERKASNLVQMKGQPIQQQQHKQKSSCCST

SEQ ID NO: 10936 - DNA, 612 bp, Triticum aestivum
  CDS (1)..(612)
atgaatcccgagtatgattacctcttcaagcttttgcttattggagactcgggtgttggcaagtcatgtcttctgttaagatttgcagacgactcgtacctggatagttacatcagtactattggagttgatttcaaaataaggactgtggagcaggacggaaagactatcaagctgcaaatttgggacactgctgggcaagaacgttttagaactattaccagcagctactaccgaggggcccatgggattattatcgtctatgatgtgacagaccaagatagcttcaacaatgtgaagcagtggttgaacgagattgaccgctatgccagtgagaatgtgaacaagcttctcgtggggaacaaatgtgatctggctgacaaaagagctgtgtcatatgaaacagcaaaggcatttgctgatgagattggcatcccattcatggagaccagcgcaaagaacgccctgaatgttgaacaggctttcatggccatggctgcttcaatcaaggataggatggcgagccagccagccgcaaacaacgctcgcccagctactgtacagatccgcgggcaacctgtcgagcagaagaccagctgttgctcttcttag

SEQ ID NO: 10937 - protein, 203 aa, Triticum aestivum
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQDSFNNVKQWLNEIDRYASENVNKLLVGNKCDLADKRAVSYETAKAFADEIGIPFMETSAKNALNVEQAFMAMAASIKDRMASQPAANNARPATVQIRGQPVEQKTSCCSS

SEQ ID NO: 10938 - DNA, 645 bp, Triticum aestivum
  CDS (1)..(645)
atggcgccggtggtgtcggcgctggccaagtacaagctggtgttcctcggcgaccaggcggtgggcaagaccgccatcatcacccgcttcatgtacgacaagttcgacgccacctaccaggccaccatcgggatcgatttcctctccaagaccatgtacctcgaggaccgcacggttcgcctgcagctatgggacacggctgggcaggagaggttccggagcctgattccaagctacatcagagactcttcggtcgcggtcatcgtctacgacgtaacagacacgcaatcgtttctgcatacatcgaagtggatcgacgaggtgaacacggcgagaggcaaagatgtgctgatcgtgctcgtcggaaacaaaacagacctcgttgaccagaggcaagtgcccacggacgaaggggaagccaaggccaaggagcacggcgccttgttcatggagaccagcgccaaggccggcttcaacatcaaggcgctgttccgcacgatcgccacgtccctgcctgggatggacgctctcccgtcggccaagcaggaggacatggtggacatcaatctcaggcctgcctccgggccagcaggctcaggcgcgcctgggcagcaggagcagaaagcaggaggatgctcttgctga

SEQ ID NO: 10939 - protein, 214 aa, Triticum aestivum
MAPVVSALAKYKLVFLGDQAVGKTAIITRFMYDKFDATYQATIGIDFLSKTMYLEDRTVRLQLWDTAGQERFRSLIPSYIRDSSVAVIVYDVTDTQSFLHTSKWIDEVNTARGKDVLIVLVGNKTDLVDQRQVPTDEGEAKAKEHGALFMETSAKAGFNIKALFRTIATSLPGMDALPSAKQEDMVDINLRPASGPAGSGAPGQQEQKAGGCSC

SEQ ID NO: 10940 - DNA, 618 bp, Triticum aestivum
  CDS (1)..(618)
atgagcacctccgagtacgactacctcttcaagctgctcctcatcggcgactcctccgtcggcaagtcctgcctcctcctccgcttcgccgacgacgcgtacgtcgacacctacatcagtaccatcggcgttgatttcaaaatccggaccgtcgagctcgatggcaagtcggtgaagctgcagatttgggacacagcaggccaggaaaggttcaggacaataacaagcagttactaccgaggagcgcatggaatcattatcgtatatgatgtgacagatagggaaagcttcaacaacgtcaagcagtggttgagtgagattgataggtatgccagtgacagtgtgtgcaagcttctagtagggaacaagtgtgatttggttgacagtaaggtcgttgatacagaagaggccaaggcttttgcagaatcgttaggaatgaatttccttgagacaagtgcaaaggaatccatcaatgtggagacagctttcttaaccatgtcatcagaaatcaagaacaagatggcgagccaaccaacggcggagaggaaatcgacggtccatgttcacatgaaagggcagcccatacagcagcagaacagcagctgctgctcctcataa

SEQ ID NO: 10941 - protein, 205 aa, Triticum aestivum
MSTSEYDYLFKLLLIGDSSVGKSCLLLRFADDAYVDTYISTIGVDFKIRTVELDGKSVKLQIWDTAGQERFRTITSSYYRGAHGIIIVYDVTDRESFNNVKQWLSEIDRYASDSVCKLLVGNKCDLVDSKVVDTEEAKAFAESLGMNFLETSAKESINVETAFLTMSSEIKNKMASQPTAERKSTVHVHMKGQPIQQQNSSCCSS

SEQ ID NO: 10942 - DNA, 651 bp, Triticum aestivum
  CDS (1)..(651)
atggcgtacagggcggaggacgactacgactacctgttcaaggtggtgctgatcggggactccggggtgggcaagtccaacctgctcacccgcttcacccgcaacgagttcagcctcgagtccaagtccaccatcggcgtcgagttcgccacccgcagcatccacgtcgacgacaaggtcgtcaaggcccagatctgggacaccgccggccaggagaggtaccgggcgatcacaagcgcgtactaccgcggggcggtgggcgccctggtggtctacgacgtcacgaggcacgtcaccttcgagaacgtcgagaggtggctgagggagctcaaggaccacacggacgccaacatcgtgatcatgctcgtggggaacaaggcggacctgcgccacctcaggaccgtcccgtccgaggacgccaaggccttcgccgagcgcgagaacaccttcttcatggagacgtccgccctcgaggcgatgaacgtcgaggacgccttcaccgaggtgctctcgcagatctaccgcgtggtgagcaagaaggccctcgacatcggcgacgaccccgccgcgccccccaagggcaagaccatcaacgtcggctccaaggacgacgtgtccgcggtgaagaaatccaactgttgttcgtcttag

SEQ ID NO: 10943 - protein, 216 aa, Triticum aestivum
MAYRAEDDYDYLFKVVLIGDSGVGKSNLLTRFTRNEFSLESKSTIGVEFATRSIHVDDKVVKAQIWDTAGQERYRAITSAYYRGAVGALVVYDVTRHVTFENVERWLRELKDHTDANIVIMLVGNKADLRHLRTVPSEDAKAFAERENTFFMETSALEAMNVEDAFTEVLSQIYRVVSKKALDIGDDPAAPPKGKTINVGSKDDVSAVKKSNCCSS

SEQ ID NO: 10944 - DNA, 618 bp, Triticum aestivum
  CDS (1)..(618)
atggcggccaacgccggcaacaagatccgcaacgccaaactggttcttcttggagatgtaggcgctggcaaatccagcctggtgcttcggtttgtaaaaggacaatttgttgaattccaggaatcgacaattggagcggctttcttctctcaaaccttggctgttaatgacgagactgtgaagtttgaaatctgggatactgctgggcaggagaggtatcacagcttggcccccatgtactataggggtgctgccgcagctatagttgtctatgacatctcgaaccaggcatccttcacccgagcaaagaaatgggttcaagaacttcaagctcaaggaaaccagaatacagtagtggctcttgctggcaacaaagctgatttgctcgaggcgagggaggttcaaatagaggaagccaagacatatgcgcaggagaatggcctcttcttcatggaaacgtctgctaaaactgcaaccaatgtgaatgacatattttatgagattgcgaagagattgcttcaggggcaggcggcgcagaacccacagacggcggggatggttctctcccagagacccaatgagagagtggtcagcgcggcttcgtgctgctcctcctga

SEQ ID NO: 10945 - protein, 205 aa, Triticum aestivum
MAANAGNKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEAREVQIEEAKTYAQENGLFFMETSAKTATNVNDIFYEIAKRLLQGQAAQNPQTAGMVLSQRPNERVVSAASCCSS

SEQ ID NO: 10946 - DNA, 612 bp, Triticum aestivum
  CDS (1)..(612)
atgaatcccgaatatgactacctcttcaagctgctgctcattggggactcgggcgtggggaagtcttgcctgctgctgaggtttgcggatgattcatatctggagagctatatcagtactattggtgttgacttcaaaatccgcaccgttgagcaagatggaaagacgataaagctgcaaatttgggatactgctggacaagagcgatttgggaccatcacaagcagctactaccgtggtgcccacggcatcattgttgtgtatgatgtgactgaccaggagagcttcaacaacgtcaaacagtggcttaatgaaattgacaggtatgctagtgaaaatgtgaacaagcttttggtggggaacaagtgcgatctagctgagagcagagtggtttcttacgaggctggcaaggcccttgccgatgagattggaataccattcctggaaaccagtgccaaggatgcaacaaatgtggagaaggcatttatgaccatggctgcagagataaagaacaggatggcaagccaaccggctggaaatgccagcaagcctgccaccgtgcaaatgcggggtcagcctgttgcccagcaaaacggatgctgctcgtcttga

SEQ ID NO: 10947 - protein, 203 aa, Triticum aestivum
MNPEYDYLFKLLLIGDSGVGKSCLLLRFADDSYLESYISTIGVDFKIRTVEQDGKTIKLQIWDTAGQERFGTITSSYYRGAHGIIVVYDVTDQESFNNVKQWLNEIDRYASENVNKLLVGNKCDLAESRVVSYEAGKALADEIGIPFLETSAKDATNVEKAFMTMAAEIKNRMASQPAGNASKPATVQMRGQPVAQQNGCCSS

SEQ ID NO: 10948 - DNA, 618 bp, Triticum aestivum
  CDS (1)..(618)
atgagctcctccgagtacgactacctcttcaagctgctcctcatcggcgactcctccgtcggcaagtcctgcctcctcctccgcttcgccgacgatgcgtacgtcgacacctacatcagtaccatcggcgttgatttcaaaatccggaccgttgagctcgatggcaagtcggtgaagctgcagatttgggacacagcaggccaggaaaggttcaggacaataacaagcagttactaccggggagcgcatggaatcattatcgtatatgacgtgacagatagggaaagcttcaacaatgtcaagcagtggttgagtgagatcgataggtatgccagtgacagtgtgtgcaagcttctagtggggaacaaatgtgatttggtcgatagtaaggtcgtcgatacagaggaggccaaggcttttgcagaatcgttgggaatgaattttcttgagacaagtgcaaaggaagccatcaatgtggagacagctttcttaaccatgtcatcagaaatcaagaacaagatggcgagccaaccaacggcggagaggaaatcgacggtccatgttcacatgaaagggcagcccatacagcagcagaacagcagttgctgctcctcataa

SEQ ID NO: 10949 - protein, 205 aa, Triticum aestivum
MSSSEYDYLFKLLLIGDSSVGKSCLLLRFADDAYVDTYISTIGVDFKIRTVELDGKSVKLQIWDTAGQERFRTITSSYYRGAHGIIIVYDVTDRESFNNVKQWLSEIDRYASDSVCKLLVGNKCDLVDSKVVDTEEAKAFAESLGMNFLETSAKEAINVETAFLTMSSEIKNKMASQPTAERKSTVHVHMKGQPIQQQNSSCCSS

SEQ ID NO: 10950 - DNA, 621 bp, Triticum aestivum
  CDS (1)..(621)
atgtcgacctcgcgcaggaggaccctcctcaaggtcatcgtcctgggcgacagcggggtcgggaagacgtcgctcatgaaccaatatgttcacaacaagtttagtcagcagtacaaagctaccattggtgcggatttcgtcaccaaggaggtcctcattgaagacaggcttgtcacattgcagatctgggacacggccgggcaggagagattccagagtcttggtgtcgcattctacagaggggcagactgttgtgtgcttgtttatgatgtcaatgttaacaagtcatttgatacgctcaacacatggcatgatgagttcctcaatcaggctagcccctcagatcccaaaacattcccattcatcctacttgggaacaagattgacgtagatggtggcaaaagcagagtggtttctgagaaaaaagcaatggagtggtgttcttcaaaagggaatattccttattatgaaacttctgcaaaagaagactacaacgtcgatgaagcatttttgtctgttgcaaagcttgctctagagcatgagcgtgatcaggacatctacttccaaacagtcgcagatcctgtccccgagactgaacagagaggcgggtgtgcatgctag

SEQ ID NO: 10951 - protein, 206 aa, Triticum aestivum
MSTSRRRTLLKVIVLGDSGVGKTSLMNQYVHNKFSQQYKATIGADFVTKEVLIEDRLVTLQIWDTAGQERFQSLGVAFYRGADCCVLVYDVNVNKSFDTLNTWHDEFLNQASPSDPKTFPFILLGNKIDVDGGKSRVVSEKKAMEWCSSKGNIPYYETSAKEDYNVDEAFLSVAKLALEHERDQDIYFQTVADPVPETEQRGGCAC

SEQ ID NO: 10952 - DNA, 645 bp, Triticum aestivum
  CDS (1)..(645)
atggcggcgccgccggctagggctcgggccgactacgactacctcatcaagctcctcctcatcggcgacagcggtgttgggaaaagttgtctgcttctgcggttctcagatggctccttcaccactagcttcatcaccactattggtattgacttcaagataaggactgttgagttggatggtaagcggattaagttgcagatctgggatactgctggccaagaacgctttcggactataactactgcctactacaggggagcgatgggcattttacttgtttatgatgtcacggacgaggcgtcattcaataacatcagaaattggatcaaaaacattgaacagcatgcttcagataacgtgagcaaaattttggtggggaacaaagcggatatggatgaaagcaaaagggctgttcccacttcaaagggccaggccctggccgatgaatacgggatccagttctttgaagcgagtgcaaagacaaacatgaatgtcgagcaggttttcttctctatagcaagagacatcaaacagagactctcggaggcagattccaagactgagggggggactatcaagatcaacacggagggtgatgccagtgcagcagcaggacagaagtcggcttgctgtgggtcttga

SEQ ID NO: 10953 - protein, 214 aa, Triticum aestivum
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDEASFNNIRNWIKNIEQHASDNVSKILVGNKADMDESKRAVPTSKGQALADEYGIQFFEASAKTNMNVEQVFFSIARDIKQRLSEADSKTEGGTIKINTEGDASAAAGQKSACCGS

SEQ ID NO: 10954 - DNA, 612 bp, Triticum aestivum
  CDS (1)..(612)
atgaatcctggatatgactacctcttcaagctgctgctcattggggactcgggcgtggggaagtcctgcctgcttctgaggtttgcggatgattcatatctggagagctatatcagtactattggtgttgacttcaaaatccgcaccgttgagcaagatgggaagacgataaagctgcaaatttgggatactgctggccaagagcgatttaggaccatcacaagcagctactaccgcggtgcccatggcatcattgttgtgtatgatgtgactgaccaggagagcttcaacaacgtcaaacagtggcttaatgaaatcgacaggtacgctagtgaaaatgtgaacaagcttttggtggggaacaagtgcgatctagctgagagcagagtggtttcttacgaggctggcaaggcccttgccgatgagattggaataccattcctggaaaccagtgccaaggatgcaacaaatgtggaaaaggcatttatgaccatggccgcagagataaagaacaggatggcaagccagccggctggaaatgccagcaagcctgccacagtgcacccccggggtcagcctgttgctcagcagaacggatgctgctcgtcttga

SEQ ID NO: 10955 - protein, 203 aa, Triticum aestivum
MNPGYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAESRVVSYEAGKALADEIGIPFLETSAKDATNVEKAFMTMAAEIKNRMASQPAGNASKPATVHPRGQPVAQQNGCCSS

SEQ ID NO: 10956 - DNA, 621 bp, Zea mays
  CDS (1)..(621)
atggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaacaactggcgagaagagtttctaattcaggctagcccatcagatcctgataatttcccttttgttctgttgggtaacaaagttgatgtagatggtggcaacagccgcgtggtatctgagaaaaaggcaaaggcatggtgtgcttccaaagggaacatcccgtactttgagacgtctgctaaggacggaacgaacgtggaagacgccttccagtgtatcgtgaagaatgctctgaagaatgagccagaggaagaactgtatgtgccagataccgtggacgtggtgggtggcaaccgggcccagagatcatccgggtgctgttaa

SEQ ID NO: 10957 - protein, 206 aa, Zea mays
MASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAQRSSGCC

SEQ ID NO: 10958 - DNA, 666 bp, Zea mays
  CDS (1)..(666)
atggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtag

SEQ ID NO: 10959 - protein, 221 aa, Zea mays
MALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVTIDMAMQQQHEAELAAAAAQPLPDDDDDLIE

SEQ ID NO: 10960 - DNA, 603 bp, Zea mays
  CDS (1)..(603)
atgggttgctcctcctccgtgccagctagaaatactggagggctgaacactatcagcaacgatagctctccagccaccagttcaaaggacttgcgtgctaagttggtattgctgggagactcaggtgttgggaaaagttgcattgttcttcgttttgttcgtggtcagtttgatcctacttccaaggtaactgttggcgcatcttttttatcacaaacattggcattggaggattcaacaatagtgaagtttgaaatttgggatactgctgggcaagagaggtatgctgccttggcgccactttactacagaggagctgctgctgcaattgttgtctatgatataacaagtccggaatcatttagcaaagcacagtattgggtaaaggaacttcagaagcatggtagtcctggtattgtaatggttttggttggtaataaggctgatctacatgataatcgaagtgtatcctcgcaggatgcgcaggactacgcagagaagaacaatatgtttttcattgagacgtcggccaagacagctgataatataaaccaactgtttgaggaaattgcaaagaggttgcctaggccaacggcatcgtga

SEQ ID NO: 10961 - protein, 200 aa, Zea mays
MGCSSSVPARNTGGLNTISNDSSPATSSKDLRAKLVLLGDSGVGKSCIVLRFVRGQFDPTSKVTVGASFLSQTLALEDSTIVKFEIWDTAGQERYAALAPLYYRGAAAAIVVYDITSPESFSKAQYWVKELQKHGSPGIVMVLVGNKADLHDNRSVSSQDAQDYAEKNNMFFIETSAKTADNINQLFEEIAKRLPRPTAS

SEQ ID NO: 10962 - DNA, 645 bp, Zea mays
  CDS (1)..(645)
atggcggcgccgccggcgagggcccgggccgactacgactacctcatcaagctgctcctcatcggcgatagcggtgttgggaaaagttgtctccttttacggttctcagatggctccttcactactagctttatcaccaccattgggattgacttcaaaataagaacagttgagcttgatggtaagcgcataaagttacagatatgggatactgctggtcaagaacgttttcgaactattacaaccgcctactacaggggtgcaatgggaattttgcttgtctatgatgttactgatgagtcatctttcaataatataagaaactggataaggaacattgagcaacatgcttccgacaatgtgaataaaattttggtaggcaacaaagctgacatggatgaaagcaaacgcgctgtaccgacttcaaaagggcaggctcttgctgacgagtatggcatcaagttttttgaaacgagtgcgaagaccaacctgaatgtggagcaggtttttttctccatagcaagagatatcaagcaaaggctttctgaatctgattcaaagccagaggatcgcacgatcagtattaacagacctgatggcggtgaggcttcggcttcacaaaaatcagcttgctgcggatcgtga

SEQ ID NO: 10963 - protein, 214 aa, Zea mays
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLSESDSKPEDRTISINRPDGGEASASQKSACCGS

SEQ ID NO: 10964 - DNA, 612 bp, Zea mays
  CDS (1)..(612)
atggcggccaacttcgggaacaagatccgcaacgccaagctggttcttcttggagatgtaggcgctggcaaatctagcttggttcttcggtttgtcaagggacagtttgttgaattccaggaatcaacaatcggagcagctttcttttcccagaccttagcggtaaatgatgagactgttaagtttgaaatctgggatactgctgggcaggagaggtatcatagcttggcccccatgtattataggggtgcagccgccgccattgttgtctatgacatcacaaatccggcctccttcacccgtgccaagaaatgggttcaagaacttcaagctcaaggaaatccgaatacaatagtggctcttgctggtaacaaggttgatatgctagatgcgaggcacgtggcagtagaggaagcaaagacgtatgcccaggagaacggtctcttcttcatggagacatctgctaaaactgcaatcaatgtgaatgacatattttatgagattgcaaagagattgcttcaagggcaagaggctccaagtccacaggctggaattgttctgaatcagagaccagatgagaggatggtcagcacttcctcgtgctgctcatga

SEQ ID NO: 10965 - protein, 203 aa, Zea mays
MAANFGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGNKVDMLDARHVAVEEAKTYAQENGLFFMETSAKTAINVNDIFYEIAKRLLQGQEAPSPQAGIVLNQRPDERMVSTSSCCS

SEQ ID NO: 10966 - DNA, 624 bp, Zea mays
  CDS (1)..(624)
atggcgacgcgcaggcgaatgctcctcaaggtcatcatcctcggcgacagcggggtcggcaagacctcgctgatgaaccagtacgtcaacaacaggttcagcaaccagtacaaggccaccatcggcgcggatttcctcaccaaggaggtccagatcgacgaccgcctcttcacactgcagatatgggatacggcaggacaggagcggtttcaaagtcttggtgtggcattttataggggagctgactgctgtgttcttgtatatgatgtcaacgtatccaagtcatttgaaaagctcaacaactggcgtgaggaattcctaattcaagccagcccatcagacccagagaatttcccatttgttgtgcttggtaacaagatcgatgttgatggtggtaacagccggactgtttctgagaagaaggctaaagcatggtgtgcttcaaagggaaacatcccctactttgagacgtcggctaaagagggcttcaatgtagaggctgcatttgagtgtatagcgaggaatgctgtaaaaaatgagccagaagaagatatgtatcttcctgatacgattgatgttgggggcgctggaaggcaacagcgttcgtcaggttgtgaatgctag

SEQ ID NO: 10967 - protein, 207 aa, Zea mays
MATRRRMLLKVIILGDSGVGKTSLMNQYVNNRFSNQYKATIGADFLTKEVQIDDRLFTLQIWDTAGQERFQSLGVAFYRGADCCVLVYDVNVSKSFEKLNNWREEFLIQASPSDPENFPFVVLGNKIDVDGGNSRTVSEKKAKAWCASKGNIPYFETSAKEGFNVEAAFECIARNAVKNEPEEDMYLPDTIDVGGAGRQQRSSGCEC

SEQ ID NO: 10968 - DNA, 645 bp, Zea mays
  CDS (1)..(645)
atggcggcgccgccggcgagggcccgggccgactacgactacctcatcaagctgctcctcatcggcgatagcggtgttgggaaaagttgtctccttttgcggttctcagatggctctttcaccactagctttatcaccaccattgggattgacttcaaaataagaacagttgagcttgatggtaagcgcgtaaagttacagatatgggatactgctggtcaagagcggtttcgaactattacaaccgcctactacaggggtgcaatgggaattttgcttgtctatgatgttactgatgagtcatctttcaataatataagaaactggattaggaacatagagcaacatgcttccgacaatgtgaataaaattttggtaggcaacaaagctgacatggatgaaagcaaacgggctgtgccaacttcaagagggcaggctcttgctgatgagtatggcatcaaattttttgaaacgagtgcgaagacgaacctgaatgtggagcaggttttcttctccatagcaagagatatcaagcaaaggcttgctgaatctgattcaaagccagaggatcgcacgatcagtatcaacagacctgagggtggtgaggcttcagcgtcacaaaaatcagcttgctgcggatcgtga

SEQ ID NO: 10969 - protein, 214 aa, Zea mays
MAAPPARARADYDYLIKLLLIGDSGVGKSCLLLRFSDGSFTTSFITTIGIDFKIRTVELDGKRVKLQIWDTAGQERFRTITTAYYRGAMGILLVYDVTDESSFNNIRNWIRNIEQHASDNVNKILVGNKADMDESKRAVPTSRGQALADEYGIKFFETSAKTNLNVEQVFFSIARDIKQRLAESDSKPEDRTISINRPEGGEASASQKSACCGS

SEQ ID NO: 10970 - DNA, 612 bp, Zea mays
  CDS (1)..(612)
atgaatcccgagtacgactaccttttcaaacttctgcttattggtgattctggtgttgggaaatcatgcttgcttctcagatttgcggatgattcatatttggacagctacatcagcacaattggggttgattttaaaattcggacagtagagcaagatgggaagaccataaaacttcaaatttgggatactgctgggcaagagcgcttcaggaccatcactagcagctactaccgtggagctcatggaatcattattgtatatgacgtgacagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaggcatttgctgatgagatgggcatcccgttcatggagacgagtgccaaaaacgccaccaacgtggagcaggccttcatggctatggctgcatccatcaaggacaggatggccagccaaccagccgcggccaacgcaaggccagcgacggtgcagatccgcgggcaacccgtcaaccagaagacgtcttgctgctcgtcttaa

SEQ ID NO: 10971 - protein, 203 aa, Zea mays
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNATNVEQAFMAMAASIKDRMASQPAAANARPATVQIRGQPVNQKTSCCSS

SEQ ID NO: 10972 - DNA, 618 bp, Zea mays
  CDS (1)..(618)
atgaccaccagcatcgagtacgactatctcttcaagctgctcctcatcggcgactcctccgtcggcaagtcctgcctcctcctccgtttcgccgacgattcgtacgttgacacctacatcagtaccatcggcgttgatttcaaaatccgcaccatcgacctcgatggaaagactgtcaagctacagatttgggacacagcaggccaggaaaggttcaggacaattacgagcagctactaccgaggagctcatggaatcattatcgtgtatgacgtgacagacatggagagcttcaataacatcaagcagtggctgagtgagattgataggtatgccagtgacaacgtatgcaagctcctagttgggaacaagtgtgatttggttgacagtaaggttgttgacactgaaaaggcaaaggattttgcagattcattaggaattccctttattgagacaagcgcaaaggaatccatcaacgtggaggaagctttcctgaccatgtcatcagaaatcaagaaaaggatggcaacccaaccaacggtggagaggagacccacagtccatgttcacatgaaaggacagccaatacagcagaagagcagctgctgctcatcatag

SEQ ID NO: 10973 - protein, 205 aa, Zea mays
MTTSIEYDYLFKLLLIGDSSVGKSCLLLRFADDSYVDTYISTIGVDFKIRTIDLDGKTVKLQIWDTAGQERFRTITSSYYRGAHGIIIVYDVTDMESFNNIKQWLSEIDRYASDNVCKLLVGNKCDLVDSKVVDTEKAKDFADSLGIPFIETSAKESINVEEAFLTMSSEIKKRMATQPTVERRPTVHVHMKGQPIQQKSSCCSS

SEQ ID NO: 10974 - DNA, 603 bp, Zea mays
  CDS (1)..(603)
atgggttgctcctcctccgtgccagctagaaatactggagggctgaacactatcagcaacgatagctctccagacgccagttcaaaggacttgcgtgctaagttggtattgctgggagactcaggtgttgggaaaagttgcattgttcttcgttttgttcgtggtcagtttgatcctacttccaaggtaactgttggcgcatcttttttatcacaaacattggcattggaggattcaacaatagtgaagtttgaaatttgggatactgctgggcaagagaggtatgctgccttggcgccactttactacagaggagctgctgctgcaattgttgtctatgatataacaagtccggaatcatttagcaaagcacagtattgggtaaaggaacttcagaagcatggtagtcctggtattgtaatggttttggttggtaataaggctgatctacatgataatcgaagtgtatcctcgcaggatgcgcaggactacgcagagaagaacaatatgtttttcattgagacgtcggccaagacagctgataatataaaccaactgtttgaggaaattgcaaagaggttgcctaggccaacggcatcgtga

SEQ ID NO: 10975 - protein, 200 aa, Zea mays
MGCSSSVPARNTGGLNTISNDSSPDASSKDLRAKLVLLGDSGVGKSCIVLRFVRGQFDPTSKVTVGASFLSQTLALEDSTIVKFEIWDTAGQERYAALAPLYYRGAAAAIVVYDITSPESFSKAQYWVKELQKHGSPGIVMVLVGNKADLHDNRSVSSQDAQDYAEKNNMFFIETSAKTADNINQLFEEIAKRLPRPTAS

SEQ ID NO: 10976 - DNA, 666 bp, Zea mays
  CDS (1)..(666)
atggcgctgccgaatcagcagggcgtggattaccccagcttcaagctcgtcatcgttggcgacggtggaactggtaaaaccacatttgtgaaaaggcatcttactggcgagtttgagaagaaatatgagcccaccattggtgttgaagttcaccctctggattttagcactaactgtggcaaaattcgcttttattgctgggacactgctgggcaagaaaagttcggtggccttagggatggctactacattcatggtcagtgtgccatcattatgtttgatgtcacttctaggctgacatacaagaatgttccgacatggcacagggatctgtgcagggtctgtgagaacatccccattgttctttgtggtaacaaggttgatgtcaagaacaggcaagtcaaggccaagcaagttacattccaccggaagaagaacttgcagtactatgagatttctgccaagagcaattacaactttgagaagcccttcctttacctcgctaggaagctggcaggggatcagaaccttcactttgttgaagctgttgctctgaagccaccagaagtgcagattgatatggccctgcagcagcagcatgaagctgagcttgcagctgccgctgcgcagcccctccccgatgacgatgatgacctgatcgaatag

SEQ ID NO: 10977 - protein, 221 aa, Zea mays
MALPNQQGVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAVALKPPEVQIDMALQQQHEAELAAAAAQPLPDDDDDLIE

SEQ ID NO: 10978 - DNA, 630 bp, Zea mays
  CDS (1)..(630)
atgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttcaataatgtgaagcaatggttgaacgagatagaccgttatgcaagtgataatgttaacaagctccttgttgggaacaagagtgaccttactgccaacaaagttgtggcaactgagacagcaaaggcgtttgctgatgagatgggcatcccattcatggagacgagtgccaaaaacgccatcaacgtggagcaggccttcatggctatggctgcatccatcaaggataggtacagccaatgtgccaggatggccagccaaccagccgcggccaacgcaaggccagcgaccgtgcagatccgcgggcaacccgtcaaccagaagacgtcttgctgctcgtcctaa

SEQ ID NO: 10979 - protein, 209 aa, Zea mays
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNAINVEQAFMAMAASIKDRYSQCARMASQPAAANARPATVQIRGQPVNQKTSCCSS

SEQ ID NO: 10980 - DNA, 645 bp, Zea mays
  CDS (1)..(645)
atggcagcgccaccggcgagggcccgagccgactacgactacctcatcaaactgctcctcatcggtgacagcggtgttggaaaaagttgtctcctgttacggttttcagatggatcattcaccactagcttcattaccactattggcattgacttcaagataaggactgtcgagttggatggcaaacggattaagttgcagatctgggacactgcaggccaagaacgtttccgcacgattactactgcttactacaggggagcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggctgtgcccacttcaaagggacaagctctcgctgacgaatatgggataaagttctttgaaacgagcgcaaagacaaacctgaacgtcgagcaggttttcttttctatagcaagggatatcaaacagagactttcagagactgattccaagcctgaggatcgaactatcaagatcaaggctgaaggggaagctgatgcagcagaggcgcagaaatcagcttgctgcggctcttga

SEQ ID NO: 10981 - protein, 214 aa, Zea mays
MAAPPARARADYDYLIKLLLIGDSGVGKSCLLLRFSDGSFTTSFITTIGIDFKIRTVELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEQVFFSIARDIKQRLSETDSKPEDRTIKIKAEGEADAAEAQKSACCGS

SEQ ID NO: 10982 - DNA, 627 bp, Zea mays
  CDS (1)..(627)
atggcaccggtgtcggcgctcgccaagtacaagctcgtcttcctgggggaccagtccgtcggcaagaccagcatcatcacccgcttcatgtacgataagttcgacaacacttaccaggctacaattggtattgatttcctgtcaaagacaatgtaccttgaagatagaactgtgagactccaactctgggatacagctggtcaggaaaggttcaggagtttaattccaagctatatcagagactcttcagttgctgtcattgtattcgatgttgcaagcaggcagtctttcttaaatacatccaagtggatagatgaagttcgcactgagaggggcagtgatgttatcattgtgcttgttgggaacaaaactgaccttgttgacaagaggcaagtctcgatagaggaaggagaaggcaaggcaaaggaccttggtgtcatgtttattgaaaccagtgctaaagctgggtttaacattaaggcgctgttccgtaaaattgctgctgcccttcctggtatggagacactctcatcagcgaagcaggaagacatggttgatgtgaacttgaggtctggcaatgcaaactcgtcccagtctcaggctcaggctgggggatgcagttgttag

SEQ ID NO: 10983 - protein, 208 aa, Zea mays
MAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIDEVRTERGSDVIIVLVGNKTDLVDKRQVSIEEGEGKAKDLGVMFIETSAKAGFNIKALFRKIAAALPGMETLSSAKQEDMVDVNLRSGNANSSQSQAQAGGCSC

SEQ ID NO: 10984 - DNA, 22 bp, Artificial sequence
  primer
atgtctgccccagctgctaacg

SEQ ID NO: 10985 - DNA, 26 bp, Artificial sequence
  primer
ttataaatcagcatcatcttcatcag

SEQ ID NO: 10986 - protein, 229 aa, Artificial sequence
  consensus sequence
  Variant (2)..(8): Xaa in position 2 to 8 is any amino acid
  Variant (9)..(34): Xaa in position 9 to 34 is any or no amino acid
  Variant (37)..(39): Xaa in position 37 to 39 is any amino acid
  Variant (41)..(41): Xaa in position 41 is any amino acid
  Variant (43)..(43): Xaa in position 43 is any amino acid
  Variant (45)..(45): Xaa in position 45 is any amino acid
  Variant (48)..(52): Xaa in position 48 to 52 is any amino acid
  Variant (53)..(55): Xaa in position 53 to 55 is any or no amino acid
  Variant (57)..(65): Xaa in position 57 to 65 is any amino acid
  Variant (66)..(69): Xaa in position 66 to 69 is any or no amino acid
  Variant (73)..(81): Xaa in position 73 to 81 is any amino acid
  Variant (82)..(97): Xaa in position 82 to 97 is any or no amino acid
  Variant (105)..(105): Xaa in position 105 is any amino acid
  Variant (107)..(112): Xaa in position 107 to 112 is any amino acid
  Variant (115)..(124): Xaa in position 115 to 124 is any amino acid
  Variant (128)..(133): Xaa in position 128 to 133 is any amino acid
  Variant (134)..(134): Xaa in position 134 is any or no amino acid
  Variant (136)..(138): Xaa in position 136 to 138 is any amino acid
  Variant (139)..(139): Xaa in position 139 is any or no amino acid
  Variant (141)..(154): Xaa in position 141 to 154 is any amino acid
  Variant (155)..(159): Xaa in position 155 to 159 is any or no amino acid
  Variant (161)..(161): Xaa in position 161 is any amino acid
  Variant (165)..(165): Xaa in position 165 is any amino acid
  Variant (167)..(169): Xaa in position 167 to 169 is any amino acid
  Variant (170)..(180): Xaa in position 170 to 180 is any or no amino acid
  Variant (182)..(182): Xaa in position 182 is any amino acid
  Variant (184)..(199): Xaa in position 184 to 199 is any amino acid
  Variant (200)..(215): Xaa in position 200 to 215 is any or no amino acid
  Variant (217)..(217): Xaa in position 217 is any amino acid
  Variant (221)..(223): Xaa in position 221 to 223 is any amino acid
  Variant (225)..(228): Xaa in position 225 to 228 is any amino acid
MXXXXXXXXXXXXXXXXXXXXXXXXXXXXXXXXXKLXXXGXDXGXGKXXXXXXXXRXXXXXXXXXXXXXTIGXXXXXXXXXXXXXXXXXXXXXXXXXWDTAGQEXFXXXXXXYYXXXXXXXXXXDVTXXXXXXXNXXXXWXXXXXXXXXXXXXXXXXXXLXGNKXDXXXXXXXXXXXXXXRXVXXXXXXXXXXXXXXXXXXXXXXXXXXXXXXXXEXSAKXXXNXXXXF

SEQ ID NO: 10987 - protein, 39 aa, Artificial sequence
  protein pattern
  Variant (2)..(5): Xaa in position 2 to 5 is any or no amino acid
  Variant (13)..(13): Xaa in position 13 is Lys or Arg
  Variant (14)..(14): Xaa in position 14 is Phe or Tyr
  Variant (15)..(15): Xaa in position 15 is any amino acid
  Variant (16)..(16): Xaa in position 16 is Ala, Gly, Ser or Thr
  Variant (17)..(17): Xaa in position 17 is Ile or Leu
  Variant (18)..(18): Xaa in position 18 is any amino acid
  Variant (19)..(19): Xaa in position 19 is Asp, Pro, Ser or Thr
  Variant (20)..(20): Xaa in position 20 is any amino acid
  Variant (23)..(24): Xaa in position 23 to 24 is any amino acid
  Variant (25)..(25): Xaa in position 25 is Ala or Gly
  Variant (26)..(26): Xaa in position 26 is any amino acid
  Variant (27)..(27): Xaa in position 27 is Ala, Cys, Gly or Val
  Variant (28)..(28): Xaa in position 28 is Ala, Gly or Ile
  Variant (29)..(29): Xaa in position 29 is any amino acid
  Variant (30)..(30): Xaa in position 30 is Ile, Leu, Met or Val
  Variant (31)..(31): Xaa in position 31 is any amino acid
  Variant (32)..(32): Xaa in position 32 is Phe or Tyr
  Variant (34)..(34): Xaa in position 34 is any amino acid
  Variant (36)..(38): Xaa in position 36 to 38 is any amino acid
  Variant (39)..(39): Xaa in position 39 is Glu, Ser or Thr
IXXXXWDTAGQEXXXXXXXXYYXXXXXXXXXXDXTXXXX

SEQ ID NO: 10988 - protein, 19 aa, Artificial sequence
  protein pattern
  Variant (3)..(3): Xaa in position 3 is Gly, Ser or Val
  Variant (5)..(5): Xaa in position 5 is Ala, Thr or Val
  Variant (8)..(8): Xaa in position 8 is Ser or Thr
  Variant (9)..(9): Xaa in position 9 is Cys, Asn, Ser or Thr
  Variant (10)..(10): Xaa in position 10 is Phe, Ile or Leu
  Variant (11)..(11): Xaa in position 11 is Leu, Met or Val
  Variant (12)..(12): Xaa in position 12 is any amino acid
  Variant (13)..(13): Xaa in position 13 is Gln or Arg
  Variant (14)..(14): Xaa in position 14 is Phe, His or Tyr
  Variant (15)..(18): Xaa in position 15 to 18 is any amino acid
  Variant (19)..(19): Xaa in position 19 is Phe or Tyr
GDXGXGKXXXXXXXXXXXX

SEQ ID NO: 10989 - protein, 11 aa, Artificial sequence
  protein pattern
  Variant (2)..(4): Xaa in position 2 to 4 is any or no amino acid
  Variant (6)..(6): Xaa in position 6 is Ala, Cys or Val
  Variant (10)..(10): Xaa in position 10 is Ala, Cys, Ser, Thr or Val
VXXXLXGNKXD

SEQ ID NO: 10990 - DNA, 1593 bp, Saccharomyces cerevisiae
  CDS (1)..(1593)
atgattagctcagaattaacgaatgatcaaatcatagaccttatatcggattataagaatttcaaaagaattatagaggcctctgtaccagaagatgatagaagaaggaaccaaaaccgccaaaatagaaataaagacctgacaaaattgtcgaatgtacaattttggcaactgacgactgatgtcaacgatgaattgatgaaaagattgacagattcgggtgcggatgcatcactaaatgatcttgatctgaaaagaggtaaagcacaatctaaactgtctcgattgaaggacgcgaagttccataaattgattcttgatattttcacggaaattgaaaggagaaacttacatcatttggatatggggacgcataacaatgggttagacgagggtgatctaaatttctatttaaatgacacattatttgaatccttcaaaataaacgatgattttatgagcgtgaatggtattatatccattgaagtcttccgagaattaaaaactcaatttacactttattttcaaaacacgctccatcgaattgatcctgtggataccaccaccacacgcctgccgattctgcttgagactataattaagatagcaaagttgataggcgatctcttacctgtcctatcatcagtttcactgcaaagttctttagaaaacgaaatagtatacttaaagagtgctttatctcatgctatcacttcaacaagatattttctcacatatggggacctaataccacgaattgtagctcaatcatctatttcggaagtgatttttgcgttctgcaatattgctcagattgtgaagatcaaatccacctcacgtgatgatatatcacgcaatgaaggagaactcagtgatatcgaggcaggtatgaaaccgttgaagattattgaaaaagtgaaaaatgagaaaaacggtaaggatatatcatctctgggtgatagcggtagtactgctgttagttttccatcctctggtaagcccattacaaaaaaatcggacatgccagtggttgtagcatcgccatcaatttccatcatagaaaaatctgaatcttctattcgagagagtgggaaggtacgaaataatacatctggagaaacaaacttagcgtctgtgtcgccgttaaaaaacactaagaattcttcaagaattacgagtgagccatctccgcgagaaggtttgcctctgaaagttgtctcgaactcgagaagtccaagtcctcaaggtaacacattgccgctaattggtaaatttcggcaggattatcaggcatcacctccgaagaaagttatcactaaaccagtggcagaaacggcgaagccgtatgcaaatattccgccagctgcagacgtactttactcgccaaccgtgaccaaaatgaggaaattcagagagaaagtgcagaaatttgctcccaactctggtcttggattaagaatatctacttcagaagaaaacttgaataattctgatgtcaactcaaccacgcacaacgctaacataaataacctcgtcgaatttgttgagagtaaatcaatggttgttcttcctatggcaggcagggcattttga

SEQ ID NO: 10991 - protein, 530 aa, Saccharomyces cerevisiae
MISSELTNDQIIDLISDYKNFKRIIEASVPEDDRRRNQNRQNRNKDLTKLSNVQFWQLTTDVNDELMKRLTDSGADASLNDLDLKRGKAQSKLSRLKDAKFHKLILDIFTEIERRNLHHLDMGTHNNGLDEGDLNFYLNDTLFESFKINDDFMSVNGIISIEVFRELKTQFTLYFQNTLHRIDPVDTTTTRLPILLETIIKIAKLIGDLLPVLSSVSLQSSLENEIVYLKSALSHAITSTRYFLTYGDLIPRIVAQSSISEVIFAFCNIAQIVKIKSTSRDDISRNEGELSDIEAGMKPLKIIEKVKNEKNGKDISSLGDSGSTAVSFPSSGKPITKKSDMPVVVASPSISIIEKSESSIRESGKVRNNTSGETNLASVSPLKNTKNSSRITSEPSPREGLPLKVVSNSRSPSPQGNTLPLIGKFRQDYQASPPKKVITKPVAETAKPYANIPPAADVLYSPTVTKMRKFREKVQKFAPNSGLGLRISTSEENLNNSDVNSTTHNANINNLVEFVESKSMVVLPMAGRAF

SEQ ID NO: 10992 - DNA, 5354 bp, Saccharomyces cerevisiae
  CDS (746)..(5146)
attctgttacttctagaaggagacctcatcgccgatgttacctcaaaattgagtagaatgaaataatacaaaattggaaaaaacgcgaaacttcagtgcagtaacatatcgttccgacattctctgagaagtggtaagattccactgccggggagctacgagtgctcttgcaagtttttagacactgctatatccttcgactacgtaaccccatttttttatttttctatataaaaacatgcactgtatacatataatcacgtaagttcaagtcgtgcttaaaacgggcacagaaaactaactatgagttgccgtaccatacataaactaggagaaggtagcgcagttctttttttttaccaaaggtttgcacaaaaaagatggtctaacgtaagtaagttatcaataaaactgttaaaagtagtataagaatcttgagataggcttattattatgactttttatggcggaaaaggaagaagaaatactgcgccgggtgatgcgtgacgcgtttttggaaacgatgagaataaactttgaagtattttgagaataatattctattatcgagttctttcagcagaaagcaacacatagctacgtatagttcggtaagataaatttggtcagaagcgtgtgaaagacgctgagaaaccacgtgagacgaagattcaaatcaaggcgtgaggaataacgcaatacgagccaccgaaacagaataaacaaaagaaaagaaagagtaaacatgggtacgtcaagcgaggtttctctcgcacatcatagagatatcttccattactacgtctcactgaagacttttttcgaggtgactggcgaaaatcgtgacaggtcaaattcgacacgagctcaaaaggccagagccaagctgttgaagctatcttcttcgcaattttacgagctgagtacagacgtgtccgatgagctgcagaggagaatcggtgaagatgctaaccaaccagattaccttttgccgaaggcaaatttccacatgaaaaggaaccaggctagacagaaactggccaatctatcacaaactcgatttaatgatttgttggacgatatcctttttgagatcaagagaagagggttcgacaaggatttggatgctccacggcccccattaccgcagccgatgaaacaagaggtcagcaaagacagcgatgatactgcaagaacatccacaaattcttcctctgtgactcaagtagctccaaacgtctccgtacaaccttctttggtcattcctaagatggcatctatcgattggtcttctgaggaagaagaagaggagcaagtaaaggagaagccaaatgaaccggagggaaaacaaacaagcatggatgaaaagaaagaggctaaacctgctctaaaccccatagttacagattctgatctgcctgactcccaagtgctcgctcgtgatatcacatcaatggcaaggactccaacaacgacgcataaaaattactgggacgttaatgattctccaattatcaaggtagataaagatatcgataacgaaaagggtcccgaacagttgaagagccctgaagtacaacgggctgagaacaataaccctaactcagagatggaagacaaggttaaagaactgactgatttaaacagcgacttacatttgcaaattgaagatttgaatgctaagttagcatctttaaccagcgagaaggaaaaggagaagaaggaagagaaggaggaaaaagaaaaggaaaagaacttaaagattaactacaccattgatgaaagttttcagaaagaattgctgtcattaaactctcaaatcggtgaattatcaattgagaatgaaaatttgaagcagaaaatttcagaattcgaactgcatcaaaaaaagaatgacaaccataatgatttgaaaatcactgacggttttattagcaagtactcttctgccgatgggctcattccagctcaatacatcttaaacgctaacaacttgataattcaatttactactaggctttccgcagtacccataggcgactccacggcaatttcccatcaaattggcgaagagttatttcaaatattatcccagttatcgaacctaatctcccagctattactatcggccgacctattacagtacaaagatcaggtcattttactgaaggcatcattatcgcatgcgatcacatcgataagatatttctctgtttacggtcccgtattaattccgaaaataactgtgcaagctgctgtttcagaggtttgttttgccatgtgtaatctaattgattcagcgaaaataaaatccgattcaaatggtgagagcaccacctctaatgaaggtaaccgacaggtattagaatattcttcaccaactgctaccaccccaatgacgccaactttcccctcgacttctggaataaatatgaagaaggggtttataaacccaagaaaaccagcatctttcttgaatgatgtggaggaagaagaatctccagtcaagccattgaaaattacacaaaaggcaattaacagtccgatcataagaccgtcatcgtctaatggagttccaacaacctcaagaaaaccttcaggaacggggctatttagtttaatgattgattcatcaattgctaagaatagctcccataaagaggataatgataaatatgtctcgcccataaaggcagtaacatcggcctccaattctgcaagtagcaatatttccgaaattcctaaactaacactacctccacaagccaaaatcggtactgttattccaccgtcagagaatcaagttcccaatattaaaatcgagaatacagaagaggataataaaaggagtgacataacaaatgaaatctctgttaaaccaacttctagcattgctgataaactgaaacaatttgagcaaagttccgaaaagaaatcatcaccaaaggaaaatcctatagcaaaagaagaaatggattcaaaaccaaaactatccaataaatttatcacttcaatgaatgatgtgtccacagatgattcaagctctgatggtaacgaaaatgacgatgcagacgatgatgatgattttacctatatggcattgaaacaaacaatgaagagagaaggttcaaaaattgaaaaaaataatgacagcaaactacctgcaaatatagtggaacttgatttacatgagtcaccggagtccgtgaagattgaatctcctgaatcgataaaggaaatcacgtcatctgaaatgtcttcagaaatgccaagtagttcgctgcctaagagattagtagaggatgttgagccttcagaaatgccagagaagggcgcatctgtagaatcagtcaggaagaaaaattttcaagaaccacttggtaatgtcgaatctccggatatgacgcagaaggtcaagtctttgggtatgacaggaaaggctgtaggcccagaatcagatagtagggtcgaatctccgggcatgacaggacagattaaatctttgaatatggcaggaaaagttgtaggcccagaagcagatagtagggtcgaatctccgggcatgaaagagcagattaagtctttgggtatgacaggaaaaattacagctcaagaatcaatcaagtccccggaagcggctaggaagttggcgtcatcaggagaagttgacaaaattgaatctccaagaatggtaagggaaagcgagtccttggaggcagtaggcaatactatcccctcaaacatgacagtgaaaatggaatccccaaatttaaagggaaatactgtgtctgaacctcaagaaataaggagagacattgcctcctcagagccgatagagaatgttgaccccccaaaagtactaaaaaagattgtctttccaaaggctgttaatagaactggatcaccaaaatcagtcgaaaagactccatcttcagctacactgaaaaagagcgggctcccagaaccgaatagccaaattgtttctcctgaattggcaaaaaattcacctctagcaccgataaagaaaaatgtcgagttacgagaaactaataaaccacatactgagactatcacttctgtggaaccaacaaacaaggatgccaatacttcttggagagacgccgacttaaaccgtacgatcaaacgagaggaggaggacgaagattttgatagagtgaaccacaatatccagatcactggtgcatatacgaaaactggaaaaattgattatcataaaatacctgttgatcgtaaagcaaaaagcgaagcagaagtgcatacttccgaggaagatattgatgaatcaaataatgttaatggaaaaagagctgatgcccaaatacacatcactgaaagaaagcatgctttcgtaaatccaactgaaaattcacaggtaaaaaagacgagccactcaccatttttaaacagtaaaccggttcaatacgagaactcagagtcgaacggcggcattaacaaccacataaagataaaaaatactggagaaactacggcacatgacgagaaacattatagtgatgatgatgattctagctatcaatttgttcccatgaaacatgaagaacaagaacaagaacaaaacagaagtgaggaagaggaaagtgaagatgacgatgaagaggaagaagacagtgattttgatgtggatacatttgacattgaaaatccggataatacactatcagagttactattgtatttagaacatcaaacaatggacgtcatatccacgattcaatcgcttttgacatcgatcaagaaaccacaggtgacgaagggtaatttgaggggagaatcgaatgcaatcaaccaagtcataggtcaaatggtggacgctactagcatatcaatggagcaaagcagaaatgccaatttgaagaaacacggtgattgggtggtgcaaagtctaagagactgttcgcgtagaatgacaattttgtgccaattaactggcgatggaatactagcgaaggaaaagagcgatcaagattatgctgacaaaaacttcaaacagcggttggcagggattgcgtttgatgttgccaaatgtacaaaggagctggtaaaaactgtagaagaggcaagtttgaaggacgaaataaattatttgaattcgaagttgaagtaaagttagtagtatctagaggagaaagaaaaggaagacaaagacaatcaatagaatgtattatgtatgacatataataataataattataataataataataatagtagtagcagtaataataatattattatagtatattaaaacaacaaaaaattagtaaaaatactataaatgtttgaatatgaagatatatatgtaggaagaattt

SEQ ID NO: 10993 - protein, 1466 aa, Saccharomyces cerevisiae
MGTSSEVSLAHHRDIFHYYVSLKTFFEVTGENRDRSNSTRAQKARAKLLKLSSSQFYELSTDVSDELQRRIGEDANQPDYLLPKANFHMKRNQARQKLANLSQTRFNDLLDDILFEIKRRGFDKDLDAPRPPLPQPMKQEVSKDSDDTARTSTNSSSVTQVAPNVSVQPSLVIPKMASIDWSSEEEEEEQVKEKPNEPEGKQTSMDEKKEAKPALNPIVTDSDLPDSQVLARDITSMARTPTTTHKNYWDVNDSPIIKVDKDIDNEKGPEQLKSPEVQRAENNNPNSEMEDKVKELTDLNSDLHLQIEDLNAKLASLTSEKEKEKKEEKEEKEKEKNLKINYTIDESFQKELLSLNSQIGELSIENENLKQKISEFELHQKKNDNHNDLKITDGFISKYSSADGLIPAQYILNANNLIIQFTTRLSAVPIGDSTAISHQIGEELFQILSQLSNLISQLLLSADLLQYKDQVILLKASLSHAITSIRYFSVYGPVLIPKITVQAAVSEVCFAMCNLIDSAKIKSDSNGESTTSNEGNRQVLEYSSPTATTPMTPTFPSTSGINMKKGFINPRKPASFLNDVEEEESPVKPLKITQKAINSPIIRPSSSNGVPTTSRKPSGTGLFSLMIDSSIAKNSSHKEDNDKYVSPIKAVTSASNSASSNISEIPKLTLPPQAKIGTVIPPSENQVPNIKIENTEEDNKRSDITNEISVKPTSSIADKLKQFEQSSEKKSSPKENPIAKEEMDSKPKLSNKFITSMNDVSTDDSSSDGNENDDADDDDDFTYMALKQTMKREGSKIEKNNDSKLPANIVELDLHESPESVKIESPESIKEITSSEMSSEMPSSSLPKRLVEDVEPSEMPEKGASVESVRKKNFQEPLGNVESPDMTQKVKSLGMTGKAVGPESDSRVESPGMTGQIKSLNMAGKVVGPEADSRVESPGMKEQIKSLGMTGKITAQESIKSPEAARKLASSGEVDKIESPRMVRESESLEAVGNTIPSNMTVKMESPNLKGNTVSEPQEIRRDIASSEPIENVDPPKVLKKIVFPKAVNRTGSPKSVEKTPSSATLKKSGLPEPNSQIVSPELAKNSPLAPIKKNVELRETNKPHTETITSVEPTNKDANTSWRDADLNRTIKREEEDEDFDRVNHNIQITGAYTKTGKIDYHKIPVDRKAKSEAEVHTSEEDIDESNNVNGKRADAQIHITERKHAFVNPTENSQVKKTSHSPFLNSKPVQYENSESNGGINNHIKIKNTGETTAHDEKHYSDDDDSSYQFVPMKHEEQEQEQNRSEEEESEDDDEEEEDSDFDVDTFDIENPDNTLSELLLYLEHQTMDVISTIQSLLTSIKKPQVTKGNLRGESNAINQVIGQMVDATSISMEQSRNANLKKHGDWVVQSLRDCSRRMTILCQLTGDGILAKEKSDQDYADKNFKQRLAGIAFDVAKCTKELVKTVEEASLKDEINYLNSKLK

SEQ ID NO: 10994 - DNA, 1986 bp, Saccharomyces cerevisiae
  CDS (1)..(1986)
atgattagctcagaattaacgaatgatcaaatcatagaccttatatcggattataagaatttcaaaagaattatagaggcctctgtaccagaagatgatagaagaaggaaccaaaaccgccaaaatagaaataaagacctgacaaaattgtcgaatgtacaattttggcaactgacgactgatgtcaacgatgaattgatgaaaagattgacagattcgggtgcggatgcatcactaaatgatcttgatctgaaaagaggtaaagcacaatctaaactgtctcgattgaaggacgcgaagttccataaattgattcttgatattttcacggaaattgaaaggagaaacttacatcatttggatatggggacgcataacaatgggttagacgagggtgatctaaatttctatttaaatgacacattatttgaatccttcaaaataaacgatgattttatgagcgtgaatggtattatatccattgaagtcttccgagaattaaaaactcaatttacactttattttcaaaacacgctccatcgaattgatcctgtggataccaccaccacacgcctgccgattctgcttgagactataattaagatagcaaagttgataggcgatctcttacctgtcctatcatcagtttcactgcaaagttctttagaaaacgaaatagtatacttaaagagtgctttatctcatgctatcacttcaacaagatattttctcacatatggggacctaataccacgaattgtagctcaatcatctatttcggaagtgatttttgcgttctgcaatattgctcagattgtgaagatcaaatccacctcacgtgatgatatatcacgcaatgaaggagaactcagtgatatcgaggcaggtatgaaaccgttgaagattattgaaaaagtgaaaaatgagaaaaacggtaaggatatatcatctctgggtgatagcggtagtactgctgttagttttccatcctctggtaagcccattacaaaaaaatcggacatgccagtggttgtagcatcgccatcaatttccatcatagaaaaatctgaatcttctattcgagagagtgggaaggtacgaaataatacatctggagaaacaaacttagcgtctgtgtcgccgttaaaaaacactaagaattcttcaagaattacgagtgagccatctccgcgagaaggtttgcctctgaaagttgtctcgaactcgagaagtccaagtcctcaaggtaacacattgccgctaattggtaaatttcggcaggattatcaggcatcacctccgaagaaagttatcactaaaccagtggcagaaacggcgaagccgtatgcaaatattccgccagctgcagacgtactttactcgccaaccgtgaccaaaatgaggaaattcagagagaaagtgcagaaatttgctcccaactctggtcttggattaagaatatctacttcagaagaaaacttgaataattctgatgtcaactcaaccacgcacaacgctaacataaataacctcgtcgaatttgttgagagtaaatcaatggttgttcttcctatggcacagggcattttgaatgatgttcaagcctctaaatcaaaattgttcaagtccgcaagatcagtttcgagattatgtcaaaattccatcgagattattcctattttggaatcggtgattgatatgactaccaaagcaatggtccaaaaaagttttaaactggatttaggcgagcactgtaaagaaattattgaaaggctcacagattgctcgcaaaagttatcggaattgtgtacttatggatgcgattccacaaagcttgggaagaaacgattctatcaaaaattagcagatatcctgatggaagtaaccaagcgcaccagggaattggttgaatgtgtgaagatggcgaacaggcagactctttcacaggacctctcgtcatttttcaattatagatctgtacagtaa

SEQ ID NO: 10995 - protein, 661 aa, Saccharomyces cerevisiae
MISSELTNDQIIDLISDYKNFKRIIEASVPEDDRRRNQNRQNRNKDLTKLSNVQFWQLTTDVNDELMKRLTDSGADASLNDLDLKRGKAQSKLSRLKDAKFHKLILDIFTEIERRNLHHLDMGTHNNGLDEGDLNFYLNDTLFESFKINDDFMSVNGIISIEVFRELKTQFTLYFQNTLHRIDPVDTTTTRLPILLETIIKIAKLIGDLLPVLSSVSLQSSLENEIVYLKSALSHAITSTRYFLTYGDLIPRIVAQSSISEVIFAFCNIAQIVKIKSTSRDDISRNEGELSDIEAGMKPLKIIEKVKNEKNGKDISSLGDSGSTAVSFPSSGKPITKKSDMPVVVASPSISIIEKSESSIRESGKVRNNTSGETNLASVSPLKNTKNSSRITSEPSPREGLPLKVVSNSRSPSPQGNTLPLIGKFRQDYQASPPKKVITKPVAETAKPYANIPPAADVLYSPTVTKMRKFREKVQKFAPNSGLGLRISTSEENLNNSDVNSTTHNANINNLVEFVESKSMVVLPMAQGILNDVQASKSKLFKSARSVSRLCQNSIEIIPILESVIDMTTKAMVQKSFKLDLGEHCKEIIERLTDCSQKLSELCTYGCDSTKLGKKRFYQKLADILMEVTKRTRELVECVKMANRQTLSQDLSSFFNYRSVQ

SEQ ID NO: 10996 - DNA, 26 bp, Artificial sequence
  primer
atgattagctcagaattaacgaatga

SEQ ID NO: 10997 - DNA, 23 bp, Artificial sequence
  primer
tcaaaatgccctgcctgccatag

SEQ ID NO: 10998 - DNA, 462 bp, Saccharomyces cerevisiae
  CDS (1)..(462)
atgaactctgaacagctgctgcataactatgtttcggattcgctactcactactctgataagttttcaagagttcaagcagcaactacagtcgtacacgagcgacgagcaacaactgcaacattggtacgaattgcttcaggccagggatgcgcgagtgacctctgagttagaagcacgaatcaagcagtttttcataacgttgcgctctagattactgcgatttctggaaagcgagcaactatcacactcccttagcctcgagacactgatcgacgcgctgtacaagattaatgacctgttgcaacagcgtttgcagattctggatgatgctattcaggaaaagacctcggaactagcagaatttgaaaatatggttcgctcaccgagtgcaggagacaatgccattcctggcctattacaaattatacaatcttatattaatctattagaggaaaactag

SEQ ID NO: 10999 - protein, 153 aa, Saccharomyces cerevisiae
MNSEQLLHNYVSDSLLTTLISFQEFKQQLQSYTSDEQQLQHWYELLQARDARVTSELEARIKQFFITLRSRLLRFLESEQLSHSLSLETLIDALYKINDLLQQRLQILDDAIQEKTSELAEFENMVRSPSAGDNAIPGLLQIIQSYINLLEEN

SEQ ID NO: 11000 - DNA, 489 bp, Candida glabrata CBS 138
  CDS (1)..(489)
atgtcttcaacagatttgatcatagcacatttcaatgaattgagattttctgatgttttatcaatagaggactttaaagagatcattatccaaagtaagactgtagaagtgcatgatgaggatgtaaacaaatggtaccaatcgtatctccgagctgagcaaaagaaattgaaactgtttagagagcgattaaggatatttttagcttccatccgtcagcgtgaattacagaagcttgagaaagaacaactatctgaatcctataatttagaagagataatatcatcactttataaactgaatgaagtattcgaaggaatagtcatgaaccagaatgatgaactacgacagaagcaggccgagctagctaacttcaaagatcatctggcagcatctttggattcctctgacagatcgatccttgactcaattaattcgtccatcgaagcaatagagaaatacagaaaggccttggatgaaggctcatga

SEQ ID NO: 11001 - protein, 162 aa, Candida glabrata CBS 138
MSSTDLIIAHFNELRFSDVLSIEDFKEIIIQSKTVEVHDEDVNKWYQSYLRAEQKKLKLFRERLRIFLASIRQRELQKLEKEQLSESYNLEEIISSLYKLNEVFEGIVMNQNDELRQKQAELANFKDHLAASLDSSDRSILDSINSSIEAIEKYRKALDEGS

SEQ ID NO: 11002 - DNA, 24 bp, Artificial sequence
  primer
atgaactctgaacagctgctgcat

SEQ ID NO: 11003 - DNA, 28 bp, Artificial sequence
  primer
ctagttttcctctaatagattaatataa

SEQ ID NO: 11004 - DNA, 603 bp, Saccharomyces cerevisiae
  CDS (1)..(603)
atgaacgatcgattagttacggaagagcaagagttgtttacaaaattgcgcgagattgtaggttcaagtattcgcttttgggaggaacaactgttttatcaagttcaagatgtaagcaccatagaaaaccacgtcattctcagtttaaaatgtacaattttaacggatgctcagataagtacgttcataagcaaacccagagagcttcatacgcatgccaaaggatatcctgaaatctattacctttccgagttatcaacaactgtcaattttttttctaaagagggaaactatgtcgaaataagccaggttattcctcattttaatgaatatttttcctctttaatagtgtctcaattggaatttgaatacccgatggtcttctccatgatttcaaggctccgattgaagtggcaacaaagttcgctcgctccgatatcctacgccctaacgagcaattcagtacttcttccaataatgcttaacatgattgcccaagacaaatcttcaacaaccgcgtatcaaattctgtgtcgaagaagaggtcctccaattcagaattttcaaattttttccttaccggctgtaacgtacaataagtag

SEQ ID NO: 11005 - protein, 200 aa, Saccharomyces cerevisiae
MNDRLVTEEQELFTKLREIVGSSIRFWEEQLFYQVQDVSTIENHVILSLKCTILTDAQISTFISKPRELHTHAKGYPEIYYLSELSTTVNFFSKEGNYVEISQVIPHFNEYFSSLIVSQLEFEYPMVFSMISRLRLKWQQSSLAPISYALTSNSVLLPIMLNMIAQDKSSTTAYQILCRRRGPPIQNFQIFSLPAVTYNK

SEQ ID NO: 11006 - DNA, 795 bp, Saccharomyces cerevisiae
  CDS (1)..(795)
atggcaagagatatcacatttttgaccgtatttttagaaagttgtggcgctgtaaataatgatgaggcaggaaaattgttatctgcttggacttcaaccgtacgcattgagggaccggaatcaaccgactctaattcattatatattccactgctaccacctggaatgttgaaaattaaactgaattttaaaatgaacgatcgattagttacggaagagcaagagttgtttacaaaattgcgcgagattgtaggttcaagtattcgcttttgggaggaacaactgttttatcaagttcaagatgtaagcaccatagaaaaccacgtcattctcagtttaaaatgtacaattttaacggatgctcagataagtacgttcataagcaaacccagagagcttcatacgcatgccaaaggatatcctgaaatctattacctttccgagttatcaacaactgtcaattttttttctaaagagggaaactatgtcgaaataagccaggttattcctcattttaatgaatatttttcctctttaatagtgtctcaattggaatttgaatacccgatggtcttctccatgatttcaaggctccgattgaagtggcaacaaagttcgctcgctccgatatcctacgccctaacgagcaattcagtacttcttccaataatgcttaacatgattgcccaagacaaatcttcaacaaccgcgtatcaaattctgtgtcgaagaagaggtcctccaattcagaattttcaaattttttccttaccggctgtaacgtacaataagtag

SEQ ID NO: 11007 - protein, 264 aa, Saccharomyces cerevisiae
MARDITFLTVFLESCGAVNNDEAGKLLSAWTSTVRIEGPESTDSNSLYIPLLPPGMLKIKLNFKMNDRLVTEEQELFTKLREIVGSSIRFWEEQLFYQVQDVSTIENHVILSLKCTILTDAQISTFISKPRELHTHAKGYPEIYYLSELSTTVNFFSKEGNYVEISQVIPHFNEYFSSLIVSQLEFEYPMVFSMISRLRLKWQQSSLAPISYALTSNSVLLPIMLNMIAQDKSSTTAYQILCRRRGPPIQNFQIFSLPAVTYNK

SEQ ID NO: 11008 - DNA, 498 bp, Candida glabrata CBS 138
  CDS (1)..(498)
atgtattacaacgtcgttgcaagccgaacttctgataattgtggggtagagtgggctctaaaatgccaaatatggactccaaatagggccggaacattaacagagacatcaagagaacattctataggtgctaatatttttccatctgtgaggtgcttagaagaattaaacatttcagttcaactgcacaccaatattagaaaattgagtgacataaaatcacacttctgctcacattttaacgagtatttcatatcaatattggtgtctcaactagagttcaggtttccattggtgttttcctatcctgcaagaacaagattgagggtacaagaaccaaacatcgctccaatatcgtatgctctctctaattcttcagcactaatgctagacttagtatcaatcatggaaaaacagccaactaatactacaatatatcaactaataacatatagaaaggataacgaagtctacaaactgtatcccttagatatttga

SEQ ID NO: 11009 - protein, 165 aa, Candida glabrata CBS 138
MYYNVVASRTSDNCGVEWALKCQIWTPNRAGTLTETSREHSIGANIFPSVRCLEELNISVQLHTNIRKLSDIKSHFCSHFNEYFISILVSQLEFRFPLVFSYPARTRLRVQEPNIAPISYALSNSSALMLDLVSIMEKQPTNTTIYQLITYRKDNEVYKLYPLDI

SEQ ID NO: 11010 - DNA, 25 bp, Artificial sequence
  primer
atgaacgatcgattagttacggaag

SEQ ID NO: 11011 - DNA, 24 bp, Artificial sequence
  primer
ctacttattgtacgttacagccgg

SEQ ID NO: 11012 - DNA, 2217 bp, Saccharomyces cerevisiae
  CDS (1)..(2217)
atgcataaagagagaccacttaataaagctagtatgataagatcaccggtagacgaaatatacatggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatatcctcattgctttgggtgtaaacaaaataggagacagactcaaaattttaaggaagtcaaaatcgttccagagagataaacggattgaacaggtgaatagattgaaaaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggtccaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctattacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaaaattgccacgcccaagaattggttaaaaggtgcttgcattggatcaggcagttttgggagtgtttacttgggcatgaatgctcacactggtgaactaatggcagtaaagcaagtggagataaaaaataataacattggtgttcccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggtccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagaccgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcacacataatttga

SEQ ID NO: 11013 - protein, 738 aa, Saccharomyces cerevisiae
MHKERPLNKASMIRSPVDEIYMEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 11014 - DNA, 1980 bp, Magnaporthe grisea 70-15
  CDS (1)..(1980)
atggctgccttaccacagaaccaagatgtcattcgtgtcatctctacagggggcgtcaccaaggttgtcaagattgccgactgcaacacgtgtgaggaggtgatgcgggtaacattgcgcaaattcgcgctgcgggaggaccacgagaggaattattgcttctgggttctttctggacttgacccagatccgaagcagtgccgtagactgggagacaccgagctttggcgcgtcattaaagaccagaagcgcccggagcgcaaccgacttattcttcgtcgggtaccggctggcgagccaggacagtctgagcttgagagggccgccgcgattgccatggaggaggctcaacaatcgcactcccgcgccatggacaacgttggggcgcgtagccagatcaaggtgcaaaaggttctcggagagaattgggataacctacagcccccgctctctcccgtcttgtaccaggatcgcgagagaaacgtttacaatgctgctcgtgacctagagagacccgaacctctggattccggccggctgcagcctaggagaaaggtcttgaggtcttttggcggtctcaggcctccgagtgaactcattgcttccgacctgaccacttacttccccgaccacccgcgggaggacattgatcggactgcgagactgtctatgcgtaggtctgcacgccttagcaaggttaacagccgccttagcgttgccagcagttttagcatggcctcgagcattcaggatgctcctcccatccctaccatcgccgacagctggctacagtcgacacccttacccaaggctcgcccccgagacctgcagagtaggctgcagcatggctaccgtgattcggtggcgtcgtctatgctagacacgcttcaggaggaagggtctcctatagaaccgaaccgcaagtcctatgtttcattcgccgacagcggctcagattctgctgccgtgagtgtcacggaccccgacggaaacattgtccgccacagctatttcgacgagggtagcaccattggttctggctctggctccggctcgttcggcgatgtcagcaaagctctgaacgaggatggagaggacgccgacgaagatctgcagagctttctctctggcgagtcttgggatgacagcaaatggatgaagggagcactcatcggacagggatcctttggatgtgtctacctcgctctccatgctattacaggcgagctcctcgccgtcaaacaagtcgaggccccatcgcctggtgccaacagccagaacgacgccaggaagaagagcatgattgaggcccttaagcgtgagatcagcttgcttagggatcttcgccaccccaatattgtgcagtacctcggctgtggctcttctgctgaatacctcaacatttttctcgagtatgtccctggtggctcggtccagaccatgctcaactcctatggcgcattgccagagcctctggtccgcagttttgtgagacaaattctgaacggtttgtcgtatctccacgaacgtgagatcatccaccgagacatcaagggtgccaacatccttgtggataacaagggcaccatcaagatctcggactttggtatttcaaagaagatcgaggccaccaacctcctcaacggcgccaacaacaacaaacaccggccctcgctgcagggttcggtgttttggatggcccccgaggttgtcaagcagacaagttatacccgcaaggccgacatctggtcacttggctgcctggtcgtcgaaatgatgacgggtacacacccattcccggactgcacacagctgcaggccatcttcaagatcggtggaggcaaggcaacgccgaccattcccgaggatgcgagcacagaggccaaggctttcctggcccagacttttgagatggatcataacaagcgccccagcgcagatgacctcatgctcagccccttcctgactcctatcacgtaa

SEQ ID NO: 11015 - protein, 659 aa, Magnaporthe grisea 70-15
MAALPQNQDVIRVISTGGVTKVVKIADCNTCEEVMRVTLRKFALREDHERNYCFWVLSGLDPDPKQCRRLGDTELWRVIKDQKRPERNRLILRRVPAGEPGQSELERAAAIAMEEAQQSHSRAMDNVGARSQIKVQKVLGENWDNLQPPLSPVLYQDRERNVYNAARDLERPEPLDSGRLQPRRKVLRSFGGLRPPSELIASDLTTYFPDHPREDIDRTARLSMRRSARLSKVNSRLSVASSFSMASSIQDAPPIPTIADSWLQSTPLPKARPRDLQSRLQHGYRDSVASSMLDTLQEEGSPIEPNRKSYVSFADSGSDSAAVSVTDPDGNIVRHSYFDEGSTIGSGSGSGSFGDVSKALNEDGEDADEDLQSFLSGESWDDSKWMKGALIGQGSFGCVYLALHAITGELLAVKQVEAPSPGANSQNDARKKSMIEALKREISLLRDLRHPNIVQYLGCGSSAEYLNIFLEYVPGGSVQTMLNSYGALPEPLVRSFVRQILNGLSYLHEREIIHRDIKGANILVDNKGTIKISDFGISKKIEATNLLNGANNNKHRPSLQGSVFWMAPEVVKQTSYTRKADIWSLGCLVVEMMTGTHPFPDCTQLQAIFKIGGGKATPTIPEDASTEAKAFLAQTFEMDHNKRPSADDLMLSPFLTPIT

SEQ ID NO: 11016 - DNA, 2550 bp, Gibberella zeae PH-1
  CDS (1)..(2550)
atggccatgttagcttcaaaagcggctttccccgcaggcatgggctcctcctcccacactcctgtcgcatctcagcctgcgatgcctctgccccgaagaactcccatgatgccctcgtcaggtgcttatggtagcccgacagaatccgaattcactgaacacgaccccgccgaatccgtcaaaaactgggacgaggatcaagtgtgcgagtacctgcgaaccgtcaaatgtggcgaatatgaaaagatctttcgaaagaatcacatcaatggcgagaaccttttggagatggacaaggacgtgctgaaagaaatgggtgttgaaaaggtcggcgaccgcgtccgcctgtttctcagcattaagaagctgagaaccagagcgtacgccaacgagaagaagcgcaatcgggattccttcggcggactcgatattcaaatcacagcacccaacgactcgccacgattgcactcgtcgagaggcgttcctgcatcatctagcaagcgttattcaagacaactcgacttgtatggtgctctagacaatggcaagacatcttcgaggcctaattcccctttgcctggtaccgatgttcgaaatctgcgggctcgagggaaaacatatgcctcgatccctgtaaatgctcaagggcaaaggattgtaactacaaacccggatcttccggcaaaccgtctggtaacaacccataccaggaataactccagtatggacggttcactgatggctgccttaccacagggtcaagaagttatccgcgttatatcgactggcggcgttacgaaggtcgtcaagatttccggatgcaacacttgcgaggaggtcatgcgggtgactctccgcaaattcgctttgcgggaggatcatgaaaggaattactgcttttgggtcctggctggtatcgacccagatccaggtcaatgccgacgcctaggcgacacggagctctggcgcatcatcaaagaccaacgacgaccagaacgaaaccgattgatattgcggagagttcccgcaggcgagccaggcgaggcggaattgcaccgcgccgcggccattgccatggaggaggaacagcaaaagcatgctcgagcgctcgagacggtggacaagcgaagatcgcttcgaccatttggaggtcttcgaccacccagcgagttgattgcatctgatcttacatcctacttccccgaccataccagagaggatattgatcgaacagcccggctttctatgcgacggtcaacccgcatgagcaaggtcaacagccggctcagcgtggctagtaacctcagttttgcttctagcatccaagatgcacctcccatccccactattgccgactcctggcttaatgctaacacccaactggccaaggtgagaacacgagactcacatattcgggttcctcaagccgcgtacaatcgcgactcggtcacctcgtcagtcctcgatacactccaagaagagtcgtcgcttgagcctgaccgcaagtcctatgtctcattcaccgagagcggctccgattcagcccctgtcagtgtcaccgaccccgagggcaacaccacagccacaagctactacgatggcgacacctcaacaggttcgggatcattccaggaaattcgacaagctctgacaaacgacggtgacgacgtggacgaggagctacacagtttcttggccggagagtcatggggcgacgacaaatggatgaagggtgcgctcatcggccagggatcattcggctgcgtttacctagctctgcacgccgttacgggcgagctccttgccgtgaagcaggttgagacacctgcacctggagccaacagccaaggcgacaatcgtaagaagggcatgattgatgcactcaagcgagaaataagtcttcttcgcgatcttcgtcaccctaacatcgtgcaatatcttggctgcagttcaacagctgattatcttaacattttcctcgagtatgtgcctggtggctcagtccagacgatgctcaactcgtacggcgctctccccgaaccgctagtgcgcagttttgtgcggcagattctgacgggtctctcgtacttgcacaaccaggacatcattcaccgtgatattaagggcgccaatattttggtcgacaacaaaggaaccattaagatttccgatttcggtatctccaagaagctggaggccaccaacattttgaacggtgccaacaacagcaagcaccgtccttcactgcaaggatccgttttctggatggctcccgaagtagtgaagcagacatcgtatactcgcaaagcggatatttggtcgctcggatgtttggtggtggaaatgatgactggcagtcacccgttccccgattgcagtcagctacaggctatcttcaagattgggggcggaaaagcggcccctacaatccctgagcatgcaagcgaggcagccaaagagtttctcgcgcaaacgtttgaaatcgaccacaacctacgtcctagtgcagatcaactgatactcagccccttcttgatccctatcacgtag

SEQ ID NO: 11017 - protein, 849 aa, Gibberella zeae PH-1
MAMLASKAAFPAGMGSSSHTPVASQPAMPLPRRTPMMPSSGAYGSPTESEFTEHDPAESVKNWDEDQVCEYLRTVKCGEYEKIFRKNHINGENLLEMDKDVLKEMGVEKVGDRVRLFLSIKKLRTRAYANEKKRNRDSFGGLDIQITAPNDSPRLHSSRGVPASSSKRYSRQLDLYGALDNGKTSSRPNSPLPGTDVRNLRARGKTYASIPVNAQGQRIVTTNPDLPANRLVTTHTRNNSSMDGSLMAALPQGQEVIRVISTGGVTKVVKISGCNTCEEVMRVTLRKFALREDHERNYCFWVLAGIDPDPGQCRRLGDTELWRIIKDQRRPERNRLILRRVPAGEPGEAELHRAAAIAMEEEQQKHARALETVDKRRSLRPFGGLRPPSELIASDLTSYFPDHTREDIDRTARLSMRRSTRMSKVNSRLSVASNLSFASSIQDAPPIPTIADSWLNANTQLAKVRTRDSHIRVPQAAYNRDSVTSSVLDTLQEESSLEPDRKSYVSFTESGSDSAPVSVTDPEGNTTATSYYDGDTSTGSGSFQEIRQALTNDGDDVDEELHSFLAGESWGDDKWMKGALIGQGSFGCVYLALHAVTGELLAVKQVETPAPGANSQGDNRKKGMIDALKREISLLRDLRHPNIVQYLGCSSTADYLNIFLEYVPGGSVQTMLNSYGALPEPLVRSFVRQILTGLSYLHNQDIIHRDIKGANILVDNKGTIKISDFGISKKLEATNILNGANNSKHRPSLQGSVFWMAPEVVKQTSYTRKADIWSLGCLVVEMMTGSHPFPDCSQLQAIFKIGGGKAAPTIPEHASEAAKEFLAQTFEIDHNLRPSADQLILSPFLIPIT

SEQ ID NO: 11018 - DNA, 2031 bp, Candida glabrata CBS 138
  CDS (1)..(2031)
atgtcccatattgagtttttagaaagagcaggctgctctcaatatgcagacttgtttgaagaatacagcttgactgacatcaatgacctcatgcacatagatcgagatattttgctcgagattggggtcaagaagcttggtgataggatcagaatcctaaaggaatcaaagaaactgcaagaaccaaaagatgatgcgaagcatgttcaacaactgcaagagctaatttcgaatattagtgaactgtccactaccagtaccaatattaatgaagaagtcataacagagaggcattgtgttatatttatattaaatgatgggtcagccaagaaggttaatattagtggatgcttcaatgcagactctataaagaagcgtttgattaaaaggctaccttctaatcttctggctgttaatacagatgggcaaactactcaagaatcctccgactatgatgtttttatcgttgactattcaaagaacgtgctgagattactctatgatattgaactagttacaatttgccattccaatgaccgtgtagagaagaacaggctgatatttgtgtcaaaggatcagactccgactgatagagcgatcaatgcatcaaagaaattatatctgaaaactataacagcactcaatcatattgaatcctattatgatgcacaatctggcatgccaaacaccccagttactcaggatggtacattaaggatacataaggaaggtaaggataaactacggaaaatatttgaccaaagacctcctagtgagtttatatccacaaatattgcaggatatttcccacatgcggatacaaagaggttagaaaaggccctgagagagtcctaccgtcaatctgctagaataagtatgaaaagcaacaactctagacacatcagttcagaatcaaatcgtgtcggtgacattctattaaagcactccaatgcggttgacatggctctactacaaagcttggacaacaacaatgcaccatcatctaaacctgaagtaataccaccatccacaccacaagaggaggataatgaaggtaagattaaattaatggaagagacagagagtatagacgattattatatgaattctgatgaagagcacggtacagtttctttacctacaaagatagttactccaaaaaactggctcaaaggtgcaagaataggttctggtagttttgggacagtatatcttggtatgaatgcacagactggtgagttaatggccgttaagcaagtcgagattaagccagctattgcagctacagcagatgcaaatgttgaagataagaatgcagagaaaaatgttgcaaaggcaccttcaactaacttgcatcggaaaatgattgatgcgttacagcacgagatgagtttgttgaaagaactgcagcatgaaaatatagtaacatattatgggtcatctcaagaaggtggcaacctgaatattttcttggaatatgttcctggtggttctgtttcatcaatgctaagcaattacgggccctttgaggagccgttgattgtcaattttacaaggcaaatactaattggtgttgcctacttgcataggaaaaatatcatacatcgtgacatcaagggtgccaatattctgattgatatcaagggttgtgtcaagatcacagattttggtatctccaagaaactttcaccactaaaccaggagaatcaagataagaggacctctttgcaagggtctgtgtattggatgtctccagaagttgtaaaacaaactgctactacttcaaaagctgatatatggtcaacgggatgtgttgtaattgagatgtttactggaaagcacccatatccagatttctcacagatgcaggcattattcaagataggtacaaatgtaacaccggagataccatcctgggcctctccacaaggaagggattttatcaggaagaccttcgagcttgattaccagaggagacccactgctatcgaactactccaggaatcttggctcgagagtcatatcatatag

SEQ ID NO: 11019 - protein, 676 aa, Candida glabrata CBS 138
MSHIEFLERAGCSQYADLFEEYSLTDINDLMHIDRDILLEIGVKKLGDRIRILKESKKLQEPKDDAKHVQQLQELISNISELSTTSTNINEEVITERHCVIFILNDGSAKKVNISGCFNADSIKKRLIKRLPSNLLAVNTDGQTTQESSDYDVFIVDYSKNVLRLLYDIELVTICHSNDRVEKNRLIFVSKDQTPTDRAINASKKLYLKTITALNHIESYYDAQSGMPNTPVTQDGTLRIHKEGKDKLRKIFDQRPPSEFISTNIAGYFPHADTKRLEKALRESYRQSARISMKSNNSRHISSESNRVGDILLKHSNAVDMALLQSLDNNNAPSSKPEVIPPSTPQEEDNEGKIKLMEETESIDDYYMNSDEEHGTVSLPTKIVTPKNWLKGARIGSGSFGTVYLGMNAQTGELMAVKQVEIKPAIAATADANVEDKNAEKNVAKAPSTNLHRKMIDALQHEMSLLKELQHENIVTYYGSSQEGGNLNIFLEYVPGGSVSSMLSNYGPFEEPLIVNFTRQILIGVAYLHRKNIIHRDIKGANILIDIKGCVKITDFGISKKLSPLNQENQDKRTSLQGSVYWMSPEVVKQTATTSKADIWSTGCVVIEMFTGKHPYPDFSQMQALFKIGTNVTPEIPSWASPQGRDFIRKTFELDYQRRPTAIELLQESWLESHII

SEQ ID NO: 11020 - DNA, 2193 bp, Kluyveromyces lactis NRRL Y-1140
  CDS (1)..(2193)
atgagcagtgacgtgtcaagccccattagtgaagtgcctttcgttgagaaatttctcggtgaagtagaatgcgaggaatatttacccacatttgagaaattccgtttatttgatgaggataggctatattacttggatcgtgagattctagaagaacttggagtgaagaagattggtgataagatcaagattttgaaacaatctcgtcagcttagaagagacgcttctgggttcaaccccaagaaagaactcgtcgagatcaccgccaaaatcaatgctttgaattcaaatccactgtcgattaatgaggagttggttactgataaacactcggtgattttcattttgaacgatgggtctgcaaagaaagttaacgttaacgggtgtttcaatgcccattcgatcaagaagaaactaatcaaacgtttaccatcggaattcatctctattgatcctgttacaaaggaagccactcattcgtcccaagattacgacgtgtttgtggtggattatgtgaagaacgtgttacatttgctatacgatgtggaactagtcacaatttgtcactcaagcgaccgcttggagaagaacaggttgatatttgtatctaaggatcagactccaagcgagaaagctatcttcacctcgaaaaaagtttatttgaagacattgagtgtcatgcaacagatggggtctcaaccaggagctggaagaccactgttatcaggacctggaaccaatgccttgaggattgagaatagaagcgataatatccgagaaatcttcacacaaagacctcctactgagttgatttctaccaatttacctgaatacttcccacatacagacattaacaggttgaagaagactttaagaaattctatgagacaatcaatccgtgccagtatgattagggggaagaatggctcactagtgtcgttagcaggctctaacaagatcggagacatcttggttaatcaatcacacgccgtcgacagagcattattggaaagtattcaaaatgatgggagcgcatccaattctgcggatcatgccgttcctatgcataatacttcaacaaatgggtcagatgcttctactgcatccctcactcccttgatgaaacgtacgtcgatatccagtaacagtagaaacagcaaatcttcggtacgtggcagatcagggtcagaatctggtacctcagaatccaacgataagatcgagttgtacagcacagataccgatacagaaggcgaagaagatgatgcagaagatactatctcgttacctaccaaagtggaggcaccaaaatcctggctcaaaggtgctagaatcggttctggtagtttcggtagtgtttatttgggtatgaatgcggagaccggtgaattgatggccgttaagcaagtcgaacttaaaccaactgcagtgaccgcaggcgtagtgtcaattgcggatgaatcaaagaaagcacatagtccaggaggtggaaacactgctgtcaagaacacctctcaaattcacaggaagatgattgatgctttacaacacgaaatgaacattttgaaagagttgcatcatgaaaatatcgtcacatactatggatcatctcaagaaggtggcaatttgaacatttttcttgaatatgtgcctggtggttcagtatcttccatgttaaacaactacggccctttcgatgagccattggtaaagaactttacaagacagatcctcattggtttggcatatttacataaaagaaacattattcacagagatatcaagggtgctaatattttaattgatatcaaaggtggtgtcaagatcacagattttggtatctctaagaaactatccccattgaacaaacaacaaaacaagagagcatcattacagggttccgtgtactggatggcaccagaagttgtcaagcaagtcgtcactacagagaaggcagatatctggtctgttggttgcgtgatcgtggaaatgtttacaggtaagcacccattcccagacttctcccaaatgcaagctatcttcaagattggtaccaacatcatccctgagattccatcttgggtatcagaagaggctaaggccttccttttcaagtctttcgaactggactatcgtaagagacctagcagtctagggctactacaggagccttggctgaatacggtactataa

SEQ ID NO: 11021 - protein, 730 aa, Kluyveromyces lactis NRRL Y-1140
MSSDVSSPISEVPFVEKFLGEVECEEYLPTFEKFRLFDEDRLYYLDREILEELGVKKIGDKIKILKQSRQLRRDASGFNPKKELVEITAKINALNSNPLSINEELVTDKHSVIFILNDGSAKKVNVNGCFNAHSIKKKLIKRLPSEFISIDPVTKEATHSSQDYDVFVVDYVKNVLHLLYDVELVTICHSSDRLEKNRLIFVSKDQTPSEKAIFTSKKVYLKTLSVMQQMGSQPGAGRPLLSGPGTNALRIENRSDNIREIFTQRPPTELISTNLPEYFPHTDINRLKKTLRNSMRQSIRASMIRGKNGSLVSLAGSNKIGDILVNQSHAVDRALLESIQNDGSASNSADHAVPMHNTSTNGSDASTASLTPLMKRTSISSNSRNSKSSVRGRSGSESGTSESNDKIELYSTDTDTEGEEDDAEDTISLPTKVEAPKSWLKGARIGSGSFGSVYLGMNAETGELMAVKQVELKPTAVTAGVVSIADESKKAHSPGGGNTAVKNTSQIHRKMIDALQHEMNILKELHHENIVTYYGSSQEGGNLNIFLEYVPGGSVSSMLNNYGPFDEPLVKNFTRQILIGLAYLHKRNIIHRDIKGANILIDIKGGVKITDFGISKKLSPLNKQQNKRASLQGSVYWMAPEVVKQVVTTEKADIWSVGCVIVEMFTGKHPFPDFSQMQAIFKIGTNIIPEIPSWVSEEAKAFLFKSFELDYRKRPSSLGLLQEPWLNTVL

SEQ ID NO: 11022 - DNA, 2454 bp, Debaryomyces hansenii CBS767
  CDS (1)..(2454)
atgaatgaatttccagatgagcatagaaattctactagtttcaccatgcatttgctgggagaccaagttttaggagaattatatcaagattccagagaattaaagcagtggttgatcaaatctaattgccagcatcattacaacaaatttatagaaaatgggataacattcgacctattaaaagagctagatagttcatcgctcaaagagattgggattaataagttaggagatagactaaggttagaattagctatttcaagcatgaagtctgaaaaattagctgataatattacagtggatgagttgtacaaaataatgaatttgcatctgacagacagtattacactgttatctgggggaaatattagtaacggatccgtatccactcctacgaatgaatcaggtaccttgacaactttaactaataacccatatttgcacagtaatgtttcctcctcgtccaatgctgccaataaggatgctaataagaacgtaacgtttattttgcaagatggatctacaaagaaagtgaatgtaactggatgtttcaatgcacaatcgatcaaacgtaaggtattgaaaaggttgggaataaaacaacaggagacattatataatacatatatccacacatcgttaaatagtaagagtaatcctggtgtgaatttactttttgatgttgaattagtgaccatttgttactctcctgacaggttagaaaaacatagaataattttatgtcgcaaggatgaatacccttctgatatggcaattgagagctcaaaaaggcttatggccaaatatgaaagatatagccaaacagattcattgaaaacaaagagccaagacaatttcagtcaatatcatatgccagatcctagaaagacgcatgctagtccaatattgagaaacttctttggacagaggccacctagtgaattgatctcttccaacttggctgaatattttccagaggcacatcaaaaggatttggaagccaccgtacgtaattctgtcagatacagcgttagactttcacgaagatttaacctcccatcttccattctatccggagccagcagtaacatttcgatccacaattcacagaataaaagatcatcaattttaagcaatggaactgtgtctggccccaatggagccccaggaactccatctgtttcatcaatggaccaaaattctgtagcggcaaaaagaaagcctagtgggaggaccattggggaaatgatggtgaataatattaatgcaatcgaccaggcggtgagctcaaatgatgtccagtctgtttttagtaaaccccaatcaattggatcagatatcagcggtccaggccaaggttcatttgaaccaaaatcgatgaaatctcatacttctcctatattgaatagaagttcaattgctgctagctttgttgatccatttcacacagataataatagaaattcacgtatcgaactattaagcattgattctgatgacgatgaagacgattttattgacgaatatggtacatacacaagtggagagcttgaccatgattttaaggataacatgctcgattctatttcagaggatggacctaagaattggttacagggtgctcgtattggtgctggtagttttggtacagtctatttaggaatgaacccactcaccggagagttgatggctgtcaagcaggtaagtttacccgataagaacagtataaataatagtctgcaaacggccatgatcgaggctttacagcacgaaatgacgttgctaaaggaaatcaaccacgaaaatattgtgagatatctaggatcctccacagatgataatttcttgaatattttcttagagtacgttcctggtgggtcggtgcaatcgatgctttcctcgtacggtccatttgaggaacccttgatacggaacttcattcgccagattctcatcggtctaagctatctacacggagaagacatcattcacagagatatcaagggggcaaacattttgattgacatcaagggaaccgttaaaatcagtgattttggaatctccaagaaggtgggaaattccgatgtcgacatggacgacgagacaaatagtcagaaaaaaggcgaaagaagagcctctctacaaggttcggtctactggatggctccagaagttgtgaaacaaactgcctatacaaaaaaggccgatatctggtccgtaggatgtcttattgtggagatgtttacaggtaagcatccatttcctgattttagccagatgcaagctattttcaaaatagggacccacataaccccccaaattccagaatggtgtacttctgaagctaaagactttttgtataagacgttcgagttagactacgagaaacgtcctgacgctattgatatgttagcagaaccgttcctaaacccgttgattatgtctaaacaatga

SEQ ID NO: 11023 - protein, 817 aa, Debaryomyces hansenii CBS767
MNEFPDEHRNSTSFTMHLLGDQVLGELYQDSRELKQWLIKSNCQHHYNKFIENGITFDLLKELDSSSLKEIGINKLGDRLRLELAISSMKSEKLADNITVDELYKIMNLHLTDSITLLSGGNISNGSVSTPTNESGTLTTLTNNPYLHSNVSSSSNAANKDANKNVTFILQDGSTKKVNVTGCFNAQSIKRKVLKRLGIKQQETLYNTYIHTSLNSKSNPGVNLLFDVELVTICYSPDRLEKHRIILCRKDEYPSDMAIESSKRLMAKYERYSQTDSLKTKSQDNFSQYHMPDPRKTHASPILRNFFGQRPPSELISSNLAEYFPEAHQKDLEATVRNSVRYSVRLSRRFNLPSSILSGASSNISIHNSQNKRSSILSNGTVSGPNGAPGTPSVSSMDQNSVAAKRKPSGRTIGEMMVNNINAIDQAVSSNDVQSVFSKPQSIGSDISGPGQGSFEPKSMKSHTSPILNRSSIAASFVDPFHTDNNRNSRIELLSIDSDDDEDDFIDEYGTYTSGELDHDFKDNMLDSISEDGPKNWLQGARIGAGSFGTVYLGMNPLTGELMAVKQVSLPDKNSINNSLQTAMIEALQHEMTLLKEINHENIVRYLGSSTDDNFLNIFLEYVPGGSVQSMLSSYGPFEEPLIRNFIRQILIGLSYLHGEDIIHRDIKGANILIDIKGTVKISDFGISKKVGNSDVDMDDETNSQKKGERRASLQGSVYWMAPEVVKQTAYTKKADIWSVGCLIVEMFTGKHPFPDFSQMQAIFKIGTHITPQIPEWCTSEAKDFLYKTFELDYEKRPDAIDMLAEPFLNPLIMSKQ

SEQ ID NO: 11024 - DNA, 2835 bp, Yarrowia lipolytica CLIB122
  CDS (1)..(2835)
atgtcggagtatctcccgcctccgccgccgctgtcgccgttttcggaatggtttgaattcggcgacacagacctgcaaattgacaaattgcaactggcaccggaccaaagtaccgcgaccgcgccttccacagcaggcacaacctccgcctcagcccccacacaacctccgccaccaccgccagcgccttttatctccgcccgcgagtcttccatgaacgtgggaccccaacatcttcctagagacatgggcagacctccccagcctacacatagtcagtctcaaccatcacattcccagatacacacacagatccctaagcatgctcccccacccattccaacgttaaaaaagccgccaccgcccatccggcactactcgagcccttcgaatggctcctcggcggccaatgccatcccgggagccaatcacccgcccccacaagcccagagccagcattcacaggccgcccaggccgcccaacaagctcatgcggcccttcatgcggcccagagcgcatcggcacccgtctcggccgtctcaccagtgtcaaacactccattggtcacgtcgtgggacaagaccaaggtggccgaatggctgcgatcgcttaagtgtgcagagtacatccccatgtttgagcagaacgaaatctgtggtgaagtgctgctggaaatcgaccagaagctgctcaaggacatgggtgtggtcaaagtgggtgaccgggtaagaatcaatgtggccatcaaggatttgcgaagccaacatagaaaaaccactttgcagaatcagcaacccaccccacaccagcgttcacagcacagaactggaaaaactctgtcatatttggacgagcaatgcgtctccccctttgcaagccatggtcttggcatctcgtcatcgtcaggaaccccagtcaccccagacagagcatctagcgctggatcagacttctccagccaccttagaccccaaacagcgcgggctccttcctccaccacatctactggcgacgttaagggtatcttgtccatggaccaggttcgacagggaactgtcaagttcatctacaccatgggccagagcaagacagttaacatttcaggctgcttcaatgccgaatcaatcattcgcacggcactcaagaagtttgccattaaggattcgcccaacaactggtgtatccatgtttccgataatgcattcgccacatccacccggattgtgtctgacaatgagctggtgaccatctgccactctccttcacgtgctgagcgtcgtcgactcatgctgtgtctcaacgacatgcctcccactcaaaagcagtttgccaagtctcaatctgtgttgctggagtctgtggacacaaacacaaactcgtcttcgtcttccggcaactactcagccaaccagcctaccatttcgcaactctcgggcgactacttttcgtccgacccccaaaaaatggccccgctgccccgatccaatcttccccacaattctcgacgacttcagagattcggtcatcgacctccttcggagctcatttcttccaacctggcagaatattttcctcaggcaggctccaaggtgttggagcagacgatccgaaactcgattcggttttccaaccgaatgtcccgcatgagtaccagtactgcgtccaactaccactacaaccgaatgagtattgcgaccatctcgtcgttcatgaacaacgagggcgggattggctcggaaaacgactcggacaatatccctgctgttccggagattccttcggatctctcgatgccccaaactcttactcgagagtccatgcagcccagccgaacacagtcttcgtctcaggttgagcgtggaagctctctgcgaaagagtacagcatccattcctgctactctcgagactctgagccagcaagaagaggctgcatcagcagcagcttcagcaacagcttctctcgtggaccctccccacagcgctaccccttccgaggatgacatgtcagatgagcagatcattgcaatgcagtctgaggctcccaagaactggatcaagggtacgttgattggccagggctcgtttggatgtgttcatcttggcatgaacagtcttactggagagcttatggccgtcaagcaggtttctctgggcgacttttccaaaacatcgcataagcaggccatggttgacgctcttcagcgtgagatgaatttgctacgggatttccagcatgacaacattgtgcagtatcttggttcgtcttctgacgaggagtatctcaacattttcctcgagtacgttcctggtggttccgtgtcttctatgctgaccaaatatggacagtttgaggaacctcttgtcaaacattttgtgcgccagattcttaagggtctcgattacttgcattctagaaacatcatccatcgagacatcaagggcgccaatgtgctggtggacaacaagggaaatgtgaagatttccgatttcggcatttctaagaagatcgaggcttcatcgtccaaccggcagtctcttcagggctctgtttactggatggcccccgaggttgtcaagcagacgagttacactctcaaggccgacatttggagtttagggtgtctgattgtggaaatgttgaccggctcgcatccgtttcctcaattcagtcagatgcaggccattttcaagattggtaccagtggtagacccgacattcctgaaaactgttctgaggacactaaggacatgcttcggcagacctttgagcaggattacaacaagcgtccgtcggccgcggagttgctggcccacgagtttttgaatacgtga

SEQ ID NO: 11025 - protein, 944 aa, Yarrowia lipolytica CLIB122
MSEYLPPPPPLSPFSEWFEFGDTDLQIDKLQLAPDQSTATAPSTAGTTSASAPTQPPPPPPAPFISARESSMNVGPQHLPRDMGRPPQPTHSQSQPSHSQIHTQIPKHAPPPIPTLKKPPPPIRHYSSPSNGSSAANAIPGANHPPPQAQSQHSQAAQAAQQAHAALHAAQSASAPVSAVSPVSNTPLVTSWDKTKVAEWLRSLKCAEYIPMFEQNEICGEVLLEIDQKLLKDMGVVKVGDRVRINVAIKDLRSQHRKTTLQNQQPTPHQRSQHRTGKTLSYLDEQCVSPFASHGLGISSSSGTPVTPDRASSAGSDFSSHLRPQTARAPSSTTSTGDVKGILSMDQVRQGTVKFIYTMGQSKTVNISGCFNAESIIRTALKKFAIKDSPNNWCIHVSDNAFATSTRIVSDNELVTICHSPSRAERRRLMLCLNDMPPTQKQFAKSQSVLLESVDTNTNSSSSSGNYSANQPTISQLSGDYFSSDPQKMAPLPRSNLPHNSRRLQRFGHRPPSELISSNLAEYFPQAGSKVLEQTIRNSIRFSNRMSRMSTSTASNYHYNRMSIATISSFMNNEGGIGSENDSDNIPAVPEIPSDLSMPQTLTRESMQPSRTQSSSQVERGSSLRKSTASIPATLETLSQQEEAASAAASATASLVDPPHSATPSEDDMSDEQIIAMQSEAPKNWIKGTLIGQGSFGCVHLGMNSLTGELMAVKQVSLGDFSKTSHKQAMVDALQREMNLLRDFQHDNIVQYLGSSSDEEYLNIFLEYVPGGSVSSMLTKYGQFEEPLVKHFVRQILKGLDYLHSRNIIHRDIKGANVLVDNKGNVKISDFGISKKIEASSSNRQSLQGSVYWMAPEVVKQTSYTLKADIWSLGCLIVEMLTGSHPFPQFSQMQAIFKIGTSGRPDIPENCSEDTKDMLRQTFEQDYNKRPSAAELLAHEFLNT

SEQ ID NO: 11026 - DNA, 2661 bp, Aspergillus nidulans FGSC A4
  CDS (1)..(2661)
atgctcacctccaaagcatacgcgggccccctggggctgccttcgtcgcaaacaccgaccgcatcttatcataccacgacgcagaagtcgtcaacattttcggaatcacaaacgggaacagtgtatacgagtccaaccaaatcggagttttctgaagctgacgacggtcttgatgctgtgaggtcttgggatgagaatcaagtgatctcatggctccatagtatcaactgtcaacaatatgagccgttattcagggcgaacaattttaacggcaacaaccttatcgaatgcgaccagaagattctgcaagagatgggcataaagaaaatcggtgatcgggtgcggattttcgttgctatcaagcagcttcgcaacaagtctgtggtcaacaaaaagcaaaagaacctgagacagttggcagctttggaagccgctcaccaacaagcttcacctgattccgcccgctcgtacagcgcacgtcaacaaacatccagtgccggtcatgcatccaggaccggtgattatagctatggcagacctacgtctcgtccagggtctccgctacgtcctcatcgttacgttgctaatagccctatggattcagggcgaaaggattatttatccgcgggctcaggcgccggacgcaatcccggaaccccggttgagcgaattggaacccattcgaggcagaatcctagccttgatgggatgacaatgggctctttgctaagcaatgctcccgtgatcagagtgatttacagcggtgggcaaacgaaagttctggatattaagcactgcaaaacgccggatgagatcatcctttgtgtgttgaagaaattacaacttcccgagcaccagtatcggaattattgtttctacgtccttgatggcttggaccctgacccatcaaattgtcggaggctctctgaccatgagctcatggagatatgcgaaggtttccacaggtcggaacgcggccggcttattcttcgtaaaatccatgctggggaaccggatgctgaggaggtgcaccgtgcggcccagctcgcactggacgagagccaacaggcgcatatgaatgctctcagcagctcgaatgcacggaaccaaatgaaaatacaacaactgactggtgaatcatggcataatataaggcaacccatgtcaccagtttcttctcgtcataacacgactcctagcgaccacgaaataaggcctcctcaagtcagcgaacgtgtctccaagctaagatccttctttggtgcccggccacccagcgagatgattattcatgaaatatcgtcgtacttccctggtcatcagagagaggacattgagaaaacgatgcgcatgtctgttcgcagatcacaacggttgagcagagcagccagtcgattaagcgtcgtcagtaatacaagctatgcttccagcctgcgggatgcaccacccatccctagtatcgccgacacttggcttaataatggcacaccgcccactcgggccgcacggccgctctcggttctttcgacgagacctggtctcccttcaacatcgtatcgggattcaatcgcatccagttccctccatccacttcaggaggaatcacctgttgagccgaatcggaagtcctacgtgtcgttcgatagtggatccgatgaccctaacaattcacgtcacagccttctcgatgagaatgcaagtgttgctgcaacagatggcggctctttcaatgagcgtctgagcgttctcgtggctgaagacggggaggaagaagacgatggattggcagaatttttagctggtaacaacttcgtcaactggatgaaaggctcactgatcggcgagggttcctttggcagtgtgtttttggcacttcactcgattactggtgagcttatggctgtcaaacaagtcgagatcccatcagcaaccaagggcaccgaatttgacaagcgcaagaacagcatggtggaagcgttgaaacacgagatagatcttctacagggtcttcatcatccgaacattgtccagtatctgggaactaccgccgatgatcaatatttgaacattttcttggagtacgttcctgggggctctattgctacaatgctcaagcaatacaacaccttccaggagccattgataaagaatttcgtacggcaaatccttgcgggtctgtcctacctccacagcaaggatattatacaccgtgatattaagggggcgaatgttctcgttgacaacaaaggtggcataaaaatctcggattttggtatctccaaacgagttgaagcatctactgttcttggatcccgagcaagcaatggtgggggccatattcaccggccttcgctgcagggtagcgtttactggatggcgcccgaagtcgttcgtcagacggcgcatacaaagaaggctgacatttggagtctgggatgtctcgtcattgagatgttcatcgggtctcaccctttcccagactgtagccagcttcaagccatatttgcgattggtagcaacaaggctcggcctccagccccagaacatgctagtaaggatgccgttgctttcttggatatgacattccagctcgaccatgagaagcgacctgacgcagacgagttgctcaagtcgcccttccttgctacaacacttacctga

SEQ ID NO: 11027 - protein, 886 aa, Aspergillus nidulans FGSC A4
MLTSKAYAGPLGLPSSQTPTASYHTTTQKSSTFSESQTGTVYTSPTKSEFSEADDGLDAVRSWDENQVISWLHSINCQQYEPLFRANNFNGNNLIECDQKILQEMGIKKIGDRVRIFVAIKQLRNKSVVNKKQKNLRQLAALEAAHQQASPDSARSYSARQQTSSAGHASRTGDYSYGRPTSRPGSPLRPHRYVANSPMDSGRKDYLSAGSGAGRNPGTPVERIGTHSRQNPSLDGMTMGSLLSNAPVIRVIYSGGQTKVLDIKHCKTPDEIILCVLKKLQLPEHQYRNYCFYVLDGLDPDPSNCRRLSDHELMEICEGFHRSERGRLILRKIHAGEPDAEEVHRAAQLALDESQQAHMNALSSSNARNQMKIQQLTGESWHNIRQPMSPVSSRHNTTPSDHEIRPPQVSERVSKLRSFFGARPPSEMIIHEISSYFPGHQREDIEKTMRMSVRRSQRLSRAASRLSVVSNTSYASSLRDAPPIPSIADTWLNNGTPPTRAARPLSVLSTRPGLPSTSYRDSIASSSLHPLQEESPVEPNRKSYVSFDSGSDDPNNSRHSLLDENASVAATDGGSFNERLSVLVAEDGEEEDDGLAEFLAGNNFVNWMKGSLIGEGSFGSVFLALHSITGELMAVKQVEIPSATKGTEFDKRKNSMVEALKHEIDLLQGLHHPNIVQYLGTTADDQYLNIFLEYVPGGSIATMLKQYNTFQEPLIKNFVRQILAGLSYLHSKDIIHRDIKGANVLVDNKGGIKISDFGISKRVEASTVLGSRASNGGGHIHRPSLQGSVYWMAPEVVRQTAHTKKADIWSLGCLVIEMFIGSHPFPDCSQLQAIFAIGSNKARPPAPEHASKDAVAFLDMTFQLDHEKRPDADELLKSPFLATTLT

SEQ ID NO: 11028 - DNA, 2472 bp, Candida albicans SC5314
  CDS (1)..(2472): transl_table=12
atgacagagattaatgattctacagaaaacataacccgaatagatcgaaatgatgcaaaggaattaaaacattggttagccaaggcaaattgccaacatcactattccaagtttattgaaaatggaatcactatggatttactaccggaattggatacaggttcattaaaggaattgggtatttcaaaattaggagaccggttaagattagaaattgctatatccaacttgaaggccgaaaatttgaaggaactaataagtgttgacgaaatatatcaattgttaaatttaaatcctcaaccaagtggatctttgacaaacttgaataacaataataatagtttgttagatgtatccaacagtaacgaaggaacattaacccaactaagtcaaaataactccagtaataatttgcctattagtagcatgaattccagcactaacaatataaatggtaataccatcaatagtagctctggaaacgttgtcggtaatagtgcttccagtaaagattccagtaagaccattacgttcattttacaagatggatcaactaaacgtgtaaatgccactggttgttttaatgcccaagcaattaaaaggagagttttgaagaaattagggttcaagcctgatgaaattcaatttgatacttatgtccattcagttccacacggtgttgaaaatgtattatatgggaaaaccgaacctactattactttattatacgatgttgaattagttaccatttgttattcaccagaacggttggagaaatatcgtataatgttggtacctaaaaatgaacctcctacgccagcagccattgaaacatcgaaaaaaattatgtcaaaatataaaaagcaagtttctggatctaaagctgaattgcaagaagaagttaatcaacttcataccaaagatgttcaagcacatagatcgaccttgagaaatttctttggacaaagacctcctagtgaattgatttcatcgaatttagcagagtatttccctgacacaagacaaaaagatttggaacaaaccgttagaaactctgttagacatagtgttagattatctcgaagatttaatttaccagcgggggcattttcttcaagcgtatattctctcaacaagagacaatctattttgagtaattcaaccggttttccttcaaatcgtacaatgtccatttcttctggtgaacaacaaagtggggtatttaatactagcggaggtggtagtggtgggttaagaagagcacaacgaaccattggggatgtgatggtgaatagtattactgctattgatgaagtagtgaattcaaacgatacattttctgtatttaataaaccttcaacgtcattttcaaatcagccagtacaaccattaaataatcatgattcgagatccataatatcgtcaaaatcattaagtgggggaactgcattgcataggatttctatatctccaaattataacgacaaccctgctcatgatcgccattctacaattgaattattgaatccatctgactcagagggtgaagatggtgaggaagatggagaatttggtatttctgactatgccggattgagttctagttctggggagaatggtccgcctgaaaattggttaaagggggctagaattggttctggtagttttggtacagtgtatttggggatgaatccatttacaggggagttgatggcagtaaaacaaatcccgttagtcaatgagaatgggaataatagtgatactgaaaacatccaaaactccatgcaagaacaacaacgagaaatgatgttattaaaggaattgaatcatgaaaatatagttcgctattttggatctacaaccgatgagaattttttaaatatatttttagaatatgtgcccggaggttcagttcaatcgatgttgaattcatatgggccatttgaagagccattgataagaaattttgttcgacaagtattgattgggttaagttatttgcatggtgaagatattattcatcgagatattaaaggtgccaacatattgattgatatcaaaggtactgtcaaaattggtgattttggtattagtaaaaaagtcagtgccattgatgaagaagatgaagatttcaaaaaaacaggtaaaagagcatctttacaaggatcagtattctggatggcacctgaagtggttaagcaaactacatatactaaaaaagcggatatttggtcagttggatgtttgattgtggaaatgtttactggtagacatccattcccagagttgagtcaaatgcaagcattatttaagattggtaatcatattaccccgcaaattcctgaatggtgtactaatgaagccaaagaatttctaaagaaaacatttgagattaattttgaaatgagaccagatgcaattgaattattagcagaacaatttttaaatccattaattatgtcgaaacaatga

SEQ ID NO: 11029 - protein, 823 aa, Candida albicans SC5314
MTEINDSTENITRIDRNDAKELKHWLAKANCQHHYSKFIENGITMDLLPELDTGSLKELGISKLGDRLRLEIAISNLKAENLKELISVDEIYQLLNLNPQPSGSLTNLNNNNNSLLDVSNSNEGTLTQLSQNNSSNNLPISSMNSSTNNINGNTINSSSGNVVGNSASSKDSSKTITFILQDGSTKRVNATGCFNAQAIKRRVLKKLGFKPDEIQFDTYVHSVPHGVENVLYGKTEPTITLLYDVELVTICYSPERLEKYRIMLVPKNEPPTPAAIETSKKIMSKYKKQVSGSKAELQEEVNQLHTKDVQAHRSTLRNFFGQRPPSELISSNLAEYFPDTRQKDLEQTVRNSVRHSVRLSRRFNLPAGAFSSSVYSLNKRQSILSNSTGFPSNRTMSISSGEQQSGVFNTSGGGSGGLRRAQRTIGDVMVNSITAIDEVVNSNDTFSVFNKPSTSFSNQPVQPLNNHDSRSIISSKSLSGGTALHRISISPNYNDNPAHDRHSTIELLNPSDSEGEDGEEDGEFGISDYAGLSSSSGENGPPENWLKGARIGSGSFGTVYLGMNPFTGELMAVKQIPLVNENGNNSDTENIQNSMQEQQREMMLLKELNHENIVRYFGSTTDENFLNIFLEYVPGGSVQSMLNSYGPFEEPLIRNFVRQVLIGLSYLHGEDIIHRDIKGANILIDIKGTVKIGDFGISKKVSAIDEEDEDFKKTGKRASLQGSVFWMAPEVVKQTTYTKKADIWSVGCLIVEMFTGRHPFPELSQMQALFKIGNHITPQIPEWCTNEAKEFLKKTFEINFEMRPDAIELLAEQFLNPLIMSKQ

SEQ ID NO: 11030 - DNA, 2387 bp, Neurospora crassa
  CDS (232)..(2232)
cttcgcgtatgaccgccagtacgactcacccctgcgacatgtcgaacttcttcgcggcggacttcgccgtcacttagttctgactacaacagacaagcccggcgaggctatgtgcaacaacagggctatggcaatcaacctacacaagctgctccctcgcggttccccatgtctcctcctgagtcccaccccggccgattggtacaagcccacactaggaacaactccagcatggatggttcgctgatggctgcgctgccacagggtcaggatgtcattcgcgtcatctccacaggtggcgtaaccaaggttgttaagattgccgagtgcaacacctgtgaagaggttatgcgtgttaccctacgtaagtttggcctgcgggaggaccatgaaaggaattactgtttctgggtactggccggcgttgatccggacccaaaccaatgccgccgcctcggggatacggagctgtggagagtcatcaaggaccacactcgcccagagcgcaaccgcctgattctcaggcgtgttccttctggagagccgggcaaggcagaactcgaaagagcagctgccattgcgatggaggaagcacagcaaacacataggcctccaattgagcccagcgataagcggagtcagctgaagctgcaaaaggtgctgggagtgggctgggaagacctccaacaacagcctccgctgtctcccatgtcctatcaggaccgagaaagaaacgtctcaaacgctgctagggatctagagcggccagcacctctggaaacccccagggccatgcctcgccgtacacaagcacttcgtcagttcggtgggctgagaccgcctagcgagcttatcgcctcggatcttacgagctactttccagatcactctcgtgaagctattgacaggacggcccgtttgtccatgagacgctcggcacgtctgagtagagtgaaccatcgtctgagtgttgccagcacccttagctttgcctctagcatacaagacgctccgccgatccctaccatcgcagacagctggttgaccgcttccaaccagattgccaaggtacgcccgcgtgatgtgctgccaagggcgcctcacgggtatagagattctgtggcttcatccgtgcttgatacgctacaagaagaaggctccccaaccgagcctaaccggagatcattcgttccattttcggacagcggctcggatacagctgcagttagcgtcattgatcccgatggtaacatagtcagacacagttactacgacagcggcaccaacaactcggccgattccgcggtaatacaggaagcacttgctgaagatggcgaggatgcagctgacaaggagcttcaaacttttctggcgggcgacgcttgggacgacagtatgtggatgaagggttctcttatcggccagggttcatttggctccgtgtacctcgccctacatgccatcactggtgaactgctcgccgtgaagcaggtcgagacacctgcgcctggtgcagacagtaagaacgatgcccgcaagaagagcatgattgaagcgctcaagcgcgagatcaccctccttcgtgacctccaacatcccaatatcgtgcagtacctgggctgcagctcatccgcggaatatctcaacattttcctcgaatacgttcccggtggttccgtgcagaccatgctcgaccaatacggtgccctccctgaatcactcgttcgcagcttcgttcgccaaatcctccagggcctctcctacgtccacaaccgtgacatcattcaccgcgacatcaagggcgccaacatccttgtcgacaacaaaggtaccatcaaaatctccgatttcggcatctccaagaaactcgaagccaccaacatcctcaacggcgccaacaacaacaagcaccgtccctcactgcaaggctccgtcttctggatggctcctgaggtagtcaaacaaaccagttacacccgcaaagccgacatctggtcactcggctgcctggtggtcgagatgatgacgggtacccacccgtttcccgattgcacccagttgcaggccatcttcaagattggcggctccaaggcctcgccgacgatcccggataacgctagcgaggaggctaagcagttccttgcgcagacattcgagattgatcataataagcggccgagcgcagatgagctgatgttgagcccgttcttgacgcctgtgcccgggacataggagtcttccaataaagtgtgagagttttcgtatgtcagaaattgacataagaggaggatttaatcagggcttgaattgtagtgacaaaaaacatgtgtatgtgttgctactcatctgtgaagtttgtctgtctgtcacgctgtctgtttacgctg

SEQ ID NO: 11031 - protein, 666 aa, Neurospora crassa
MDGSLMAALPQGQDVIRVISTGGVTKVVKIAECNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLDQYGALPESLVRSFVRQILQGLSYVHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 11032 - DNA, 2865 bp, Phaeosphaeria nodorum
  CDS (1)..(2865)
atggctatgttagcctcaaagtcgccctaccccacgccctccctgggcggttccagctcacaggcctcggcccagtacaactcgagcatatccagctaccgcaaccacacctcgaatgcacgagcagaccactccatgtttgcctcgcccaccgaatcagagttctccgagatatacgacgccccagacgccgtcaggcactgggacgaagacaaggttgcagactggctgaagcgaatcaactgcagccaatatgtcgacctcttcaagtacaaccacatcaacggcgaaaacctcatggagatggaccaggtccagctcaaggacatgggcatcaagaaagttggcgaccgtgtccgcatcggctcgcaggccaagcaactgcgcaacaaggagtacaaaaaggcctcaagacggacgtcgaataggcaatcattagcaacgcttgacaaagcctccttcactccgccaacctccagctcaccccggcccctgaactcggcacgatcaatacccaccagttcgcgatccgaaaagcgcatgtctcgccaaatcacaaactccgatctcagcagttacgcatacggaagcaaatcgccgtcacggccaggttcccctctggttgaccaggacaatcgtggcctgagaagtgcacggaatggaagcctgaacagccccaaagagcctggaaagaccccgtatggtgcgcacccactgagtgcctccaccgcaaatgtgtcgtctcgcttcgcacagccccaacgaacgactccgaccgagactccccagaccgctagattcgcccaccacgttcgcggtgctccgagtctcgacagcgctacaaacagccaaattctgccgcaagacaaagccctcgtacgtgtcatcttcgacggtggccggacctctgtggtgaacattgagggatgcaagactgccgaggaggtcatgctcaagaccctaagaaagggacatctcaatgaggcacaagtgcgaaactactgcttctacatccttaacagtggcgagccggatccatcgttgtcagaacgcctgagcgacatagagctcttccggttgtgcaaggacgcgaatcgacatgaacgaggacgactcatcctccgaaaggtccacgctggggagcctgacgacgatcagctgaaggcagcggctgccatatacaatcagcagaactttcaacagacgcagaccgtatacttgccgtcaagtaaccggagccagagcaagatcgaaaagttgacaggagagtctcttgctgctgtcagctacccgctctctccctcatcagcgagagaacgagaacggcacatcaactcgactgcccaaaacctcgaggggccggcaggaaagtctctgaaatcaccacagttccaggctcgagaacgcaagctcaagcagttctacggcgccaggccacccagtgaactcatcacttccgacctgacatcatactttccagatgttggaaaggacgagatcgacaagacggtccgcatgtccatccgccgatcgcgtcgattaagtagggctgcgtcgcgtctctcgatggcttccaatttcagtgttgcatcaagcttgaaagatgctccacctctaccatctattgcagacagctggctcgcaggtggcagtaatgcccgtcccctgcgaccattgtcggttatgcgacttggcctaccctcccagtcaaactaccgcgactcgatggcatcgtccgtactggagccacttgacgaagagtcgcccctcgagccaaataggaaatcttacgtctccttcggtgacggcagtggttcggataccctcgctgtcactgaccctgatggcaacaccaccttacagtcttatttcgacgatggtcagagcagtcttacgggaagcagtaccagcaacaccgaaaatggcgattcgctcaacaaacgcctgtccgaggctattgccgaggatgacgaagaggacgatgatgagctgaccgaatatctcgagcaagattcgtgggacaacgtcaagtatatgaagggagcacttattggacaaggttctttcggtagcgtgtatctcgctctacatgctgttaccggtgaactcatggctgtcaagcaggtcgagttgccttccgtaatcggcacctcccagatggaccacaggaagacgaacatggttgaagctctcaagcatgagattggactgctacgagagctcaaacacaacaatatcgtgcagtacctcggctcgaactcagacgaaagccacctcaacattttcctggagtacgttcctggtggttccgttgctaccatgctcatcaactacggcccactgggcgagtcgctcatccagaactttgtacgccagattctgcaaggtctatcttaccttcactcgagcgatattattcaccgagatatcaagggtgccaacattcttgtcgacaacaagggttcagtcaagatttctgattttggtatttccaagcgcatcgaagcatctactctcggtggcagcaagaagggggctcaacgcgtttcgctacaagggtcggtcttctggatggcgccggaagtcgttcgtcagaccgcctatactcggaaagcggacatctggtcactcggttgtctcgtcgtggagatgttcaccggtagccacccgcacccgaactgcacccagctccaggcgatcttcaagattggtggaagtggcgacgcgagtcctacaatccccgagaacgcaggcgatgatgcccgggccttcctggcacaaaccttcctcatcgaccacgagaagcgacccagcgccgatgcattactggacagcccattcatcaagaaccaaggcgctgcttag

SEQ ID NO: 11033 - protein, 954 aa, Phaeosphaeria nodorum
MAMLASKSPYPTPSLGGSSSQASAQYNSSISSYRNHTSNARADHSMFASPTESEFSEIYDAPDAVRHWDEDKVADWLKRINCSQYVDLFKYNHINGENLMEMDQVQLKDMGIKKVGDRVRIGSQAKQLRNKEYKKASRRTSNRQSLATLDKASFTPPTSSSPRPLNSARSIPTSSRSEKRMSRQITNSDLSSYAYGSKSPSRPGSPLVDQDNRGLRSARNGSLNSPKEPGKTPYGAHPLSASTANVSSRFAQPQRTTPTETPQTARFAHHVRGAPSLDSATNSQILPQDKALVRVIFDGGRTSVVNIEGCKTAEEVMLKTLRKGHLNEAQVRNYCFYILNSGEPDPSLSERLSDIELFRLCKDANRHERGRLILRKVHAGEPDDDQLKAAAAIYNQQNFQQTQTVYLPSSNRSQSKIEKLTGESLAAVSYPLSPSSARERERHINSTAQNLEGPAGKSLKSPQFQARERKLKQFYGARPPSELITSDLTSYFPDVGKDEIDKTVRMSIRRSRRLSRAASRLSMASNFSVASSLKDAPPLPSIADSWLAGGSNARPLRPLSVMRLGLPSQSNYRDSMASSVLEPLDEESPLEPNRKSYVSFGDGSGSDTLAVTDPDGNTTLQSYFDDGQSSLTGSSTSNTENGDSLNKRLSEAIAEDDEEDDDELTEYLEQDSWDNVKYMKGALIGQGSFGSVYLALHAVTGELMAVKQVELPSVIGTSQMDHRKTNMVEALKHEIGLLRELKHNNIVQYLGSNSDESHLNIFLEYVPGGSVATMLINYGPLGESLIQNFVRQILQGLSYLHSSDIIHRDIKGANILVDNKGSVKISDFGISKRIEASTLGGSKKGAQRVSLQGSVFWMAPEVVRQTAYTRKADIWSLGCLVVEMFTGSHPHPNCTQLQAIFKIGGSGDASPTIPENAGDDARAFLAQTFLIDHEKRPSADALLDSPFIKNQGAA

SEQ ID NO: 11034 - DNA, 2094 bp, Aspergillus oryzae
  CDS (1)..(2094)
atggagagcgctcgcaaggaacaagggcaaggctacttcagtcacaactcctctggtggttccggtgccactcggaacccatccacccccaacgaggggcagaggagccatttaagacaaaactctagcattgatggcctgacaatggggtctcttccccctaactcgcctgttattagaataatctatactggcggacaaacaaaagtcttaaatatcaagcattgcaagacggctgatgaaattatactgtgcgtgctcaagaagctgcaactccctgagcatcaatatcggaactactgcttctatgtgttagatggcctggaaccagacccgtcgaactgcaggaggctggcggatcatgagcttatggagatttgtgaaagtaaccacaaatctgagcgtggtcgtctcatactacggaagattcatgctggagagccagacacggacgagcttcggcgtgcctctcaactcgccattgatgaaagccaagcgacgcatatcaatgccctgaatagctcaaatccacgcacacagtttaagatccaacaactcaccggcgaaccttggcataatataaaacaaccgatttcacccatgtctgctcggcatcaaaattcgagtgagcacgatttgcaagtgctgaatacggagcgacacgccgtgtccaagttacgatcgttctttggggctcgaccgcctagcgagatgattatccacgagatcacatcttacttccctagtcaccaccgggaagatattgagaagaccatgcgcatgtcaattcggaggtcgcagcgcctaagccgcgcagcaagtcgattgagtgtcgtgagcaatacaagttacgcatccagcttaagagatgcacctcctatccccagtattgctgatacctggcttaatactggtgctcaacccactcgcgcttcgaggcctctttcagtttccaagtttagccttcctcaagcaacatatagagattctatcgcgtcaagctcccttcaaccgcttcaggaagagtcccccattgaaccaaatcgcaaatcatatgtttctttcgatagtggttcggacgatcccagcacatctcgtcagagccttgtggatgagaatgcaagtgttgctgcaactgacggaggctcactcaatgaacgactgagcgttctagttgctgaagatggagaagaggaagatgacggtcttaatgacttcctcgctggaaacaactttgctcctaaaaattggatgaaaggctctttgattggtgaaggatcttttggaagtgtgtttttggcattgcatgcgatcactggtgagcttatggcggtcaaacaagttgagataccatcggcaacaaaaggcacagaattcgacaaacgtaagaacagcatggttacggcactgaaacatgaaattgaactcctgcaaggacttcaccacaaaaatattgtccagtatctgggtaccgctgctgatgaccagtatttgaatattttcctggaatacgttcccggtggatctattgctacaatgctcaagcaatacaacactttccaagagcctttaatcaagaattttgtacgacagattttggcaggcctctcatacctgcacagccgcgatattatacatcgtgacatcaagggtgcgaacattcttgtggacaacaaaggtggtatcaaaatctcggatttcggtatctccaaacgggtggaagcttctacagtccttggctctcgggccagcggcacaggaggtggtcatctacaccgaccgtcgctgcagggtagcgtatattggatggcaccggaagttgttcgacagaccgcccacactaagaaggcagacatttggagcttgggatgcctagtcgtggagatgtttataggcgctcaccctttccctgactgcagtcagctgcaggctattttcgccattggtagcaacaaagccagaccacctgcgccagagcatgcgagcaaggatgctgttgcattcctggacatgacattccaggttgattatgagcaacggccgagtgctgacgagctttcgaagtgtcaattcctcgccacgccaattgcatga

SEQ ID NO: 11035 - protein, 697 aa, Aspergillus oryzae
MESARKEQGQGYFSHNSSGGSGATRNPSTPNEGQRSHLRQNSSIDGLTMGSLPPNSPVIRIIYTGGQTKVLNIKHCKTADEIILCVLKKLQLPEHQYRNYCFYVLDGLEPDPSNCRRLADHELMEICESNHKSERGRLILRKIHAGEPDTDELRRASQLAIDESQATHINALNSSNPRTQFKIQQLTGEPWHNIKQPISPMSARHQNSSEHDLQVLNTERHAVSKLRSFFGARPPSEMIIHEITSYFPSHHREDIEKTMRMSIRRSQRLSRAASRLSVVSNTSYASSLRDAPPIPSIADTWLNTGAQPTRASRPLSVSKFSLPQATYRDSIASSSLQPLQEESPIEPNRKSYVSFDSGSDDPSTSRQSLVDENASVAATDGGSLNERLSVLVAEDGEEEDDGLNDFLAGNNFAPKNWMKGSLIGEGSFGSVFLALHAITGELMAVKQVEIPSATKGTEFDKRKNSMVTALKHEIELLQGLHHKNIVQYLGTAADDQYLNIFLEYVPGGSIATMLKQYNTFQEPLIKNFVRQILAGLSYLHSRDIIHRDIKGANILVDNKGGIKISDFGISKRVEASTVLGSRASGTGGGHLHRPSLQGSVYWMAPEVVRQTAHTKKADIWSLGCLVVEMFIGAHPFPDCSQLQAIFAIGSNKARPPAPEHASKDAVAFLDMTFQVDYEQRPSADELSKCQFLATPIA

SEQ ID NO: 11036 - DNA, 3549 bp, Cryptococcus neoformans var
  CDS (1)..(3549)
atgtttgtgacacgaccaccctcatcctccgtcgaccaccgtgggtcccttttggatggccacacaaaccacacaaatacccctggctcctcccgtgatgatgtgccttcgtcggactctaccagtacggcttttcataagttcaaaaactccagtcgcttttcgccgcattatctcaatattccgccaggacttgcattcaaatcctatctcgagaaatgggggccagagcaagtcattggcttcttggcaatccatgggtgtgaacaccactccggcatctttataaagaatagcattgacggcaagcttctgctcgatcttgatatgggtattcttaccagcctaggaatcacaaaggtcggcgaacgtatcagattgatggctggcatcaagtgtctcagacaacgagtagctcatgaagcagagaagcataatataccttctgcacacttatgcaatggaagtctagaaatggaccgggtgaaagtgatcattcatccaaagttgtcagcttctctgtatgtccaccgccatggcccctttgatagcggtccgattacggcgcgccgttgcccattaacgccgtcgtcttcagctgatccagaaggcgacccatcgccgatgcagcgatctcaagaagttatgaagcattccttcattactagatcttcccggcgacaagtaatcccgcccttgccacctggacagatacacaatcatggtatagacaattcgccaatgccgagtctacgacatattcctcttcgttccggtgtttcttactctgatatagatgtaaaaggaatgccgcccttggttacacagtcgacaaatagcgtcttcaaccatacctttgctgtcactggttcccatgacactacgtcgtgcttgggaggtcatcttcgacgacctgattatttccgttctacgaatgacacttttcaaacgtgcactaagcgtggggacaatactatatctgaactgcctcagagaaaccaagaatccagcccttcaatgtggaaacaaagtggggtgatttgtgaagataaagctatgcggaacggctctctgttcgcacctacgtcccacaaaccatttgccattagtatcacaggggataatgtgatggaatatccgcacaatcttcccataaaaaatggtttaccccttaggtcatttcaatcgccagataaatctgcagatgacgataggttgaatatcaacccgagtgcaccctctttggatgacttacggcgccaattggtcaagttcgtgaatgctgaagatggaacaacaaggacagtcaatgtaatgaaaaccacaagcggggtagaagtgctggaaagagcattgagaaagtttggcaagactggcacaggtcgtgccctgcttttagatgacgaaagccacaacggcggcaaacatgaaggacctttatgtattgatggatggggagtatttgcagaaaatctacagggagaagagatgggacccatgtccgaagaggatttacttgacatctgcgcttcccttcgaaatggagctgcaatgcaacgggacgctttgatcctacgacagacttccaaatcacaaaagcgcaaggatatgcggttctatttgggaagcatgcctgtcctacccaccccggtgaacttgcctatatctttctccagttcacattcaggacaatttgaacaaaactcggctcttcaatatactgctcagcatcagcccttgcggagcaaaaatcgtagtcgtgcgagtatgatgagcattatgtcaggtcttggcgtctcccaccctgatataaaacagccgacacatgacagccttcaaagccccgcttctgtaaccatgcccagcagcaaaaagaagtccatgtataatttcttcggtcatcgaccacctagtgaactcatctcgagtcaccttacggactacttcccttcggccaaaaaacgcgatgtggcgaaagcccgcggtagtatgctccgcttgaacattgcgcattctgcggaacgcaaccccaggagcgttgaaaacctgggtatgattgaagctgacgatgtgcctttttcttccacggaacaaagcttgactgagcagcgtgatcattactttgactcttcaacatgccagccagcagataccagctcgccgggacatgttgatcataatatcaccgaccctgctggcaacagcgagggtaattacagactaccatacgatcaaaaagtattgcccaccccaataactcaggaactacattcagcgaactcagtgaatccaatacttcgaacataccccccaaatctcccatcgacgtatctttcggccagattgaccgatcttcatcgcgactcctttttatctcagcttcaacctttgcaacattcatcttcattatcttccgcgcagccgttctcttctcatcggcggacagtggacgagatcacagctgaaatgcaacatcgccagacaagcctgtcatgtgatcgtcctacgagcacaatagattctgatatatcaggtcctccttgtaatagcgaaataagtctagatcacacttcagaggcatcaggtatttcagaaagcagcagtgaatattgcgatgatcatagttccgtcagctccgaggatagcgaagataattcggctgcgcatactagggcttttaccacaaagcgcaatatcaaatggataaaaggggcgcttatcggcgcgggctcctttggctctgtctttctaggaatggatgcacaatcagggctactgatggcagtaaagcaagtagagctacccagaggaattgcaaagatggaagcaagaaggcgggatatgctctctgctttggaaagagagatagaattgttgaaggatcttcaacatgacaatatagtccagtatctggactcctcgatggatgccaatcatctcaacattttcttggagtacgtgccaggtggatctgttgctgcgttgctcaataattacggtgcctttgaagaagcccttgccggaaatttcgtccggcaaattttaactggacttaactatctgcatgagagagatatcgttcacagggatatcaaaggcgcgaacatactggtagataacaaagggggtatcaaaatctcggacttcgggatcagcaaaaaggtggaaaacagccttttaaacggactacatcccaatcgtccgtctctgcagggttctgttttttggatggccccagaggtggtgaagcaaacatcttacacttctaaagcagacatttggagcgttggttgccttgtcgtggagatgttgactggcactcatccttgggcccgcttgacccagatgcaagctatatttcagatcgggtccatgggtcaacctgagattccttccgacatttctgtacatgctgccgatttcctgagtcgcgcatttgcgttagattacaggatgcggccctcagctgcctctttactcaaacacgcctttatggttcatgatgggaatggaggtaatgatgaaccgatacagaatacctatgcgtaa

SEQ ID NO: 11037 - protein, 1182 aa, Cryptococcus neoformans var
MFVTRPPSSSVDHRGSLLDGHTNHTNTPGSSRDDVPSSDSTSTAFHKFKNSSRFSPHYLNIPPGLAFKSYLEKWGPEQVIGFLAIHGCEHHSGIFIKNSIDGKLLLDLDMGILTSLGITKVGERIRLMAGIKCLRQRVAHEAEKHNIPSAHLCNGSLEMDRVKVIIHPKLSASLYVHRHGPFDSGPITARRCPLTPSSSADPEGDPSPMQRSQEVMKHSFITRSSRRQVIPPLPPGQIHNHGIDNSPMPSLRHIPLRSGVSYSDIDVKGMPPLVTQSTNSVFNHTFAVTGSHDTTSCLGGHLRRPDYFRSTNDTFQTCTKRGDNTISELPQRNQESSPSMWKQSGVICEDKAMRNGSLFAPTSHKPFAISITGDNVMEYPHNLPIKNGLPLRSFQSPDKSADDDRLNINPSAPSLDDLRRQLVKFVNAEDGTTRTVNVMKTTSGVEVLERALRKFGKTGTGRALLLDDESHNGGKHEGPLCIDGWGVFAENLQGEEMGPMSEEDLLDICASLRNGAAMQRDALILRQTSKSQKRKDMRFYLGSMPVLPTPVNLPISFSSSHSGQFEQNSALQYTAQHQPLRSKNRSRASMMSIMSGLGVSHPDIKQPTHDSLQSPASVTMPSSKKKSMYNFFGHRPPSELISSHLTDYFPSAKKRDVAKARGSMLRLNIAHSAERNPRSVENLGMIEADDVPFSSTEQSLTEQRDHYFDSSTCQPADTSSPGHVDHNITDPAGNSEGNYRLPYDQKVLPTPITQELHSANSVNPILRTYPPNLPSTYLSARLTDLHRDSFLSQLQPLQHSSSLSSAQPFSSHRRTVDEITAEMQHRQTSLSCDRPTSTIDSDISGPPCNSEISLDHTSEASGISESSSEYCDDHSSVSSEDSEDNSAAHTRAFTTKRNIKWIKGALIGAGSFGSVFLGMDAQSGLLMAVKQVELPRGIAKMEARRRDMLSALEREIELLKDLQHDNIVQYLDSSMDANHLNIFLEYVPGGSVAALLNNYGAFEEALAGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSRAFALDYRMRPSAASLLKHAFMVHDGNGGNDEPIQNTYA

SEQ ID NO: 11038 - DNA, 2472 bp, Pneumocystis carinii
  CDS (1)..(2472)
atggattatttaaagaaagtgagattatggagtgaggaagaagtgggagaatggcttgagtcgaataattttggagattatatggatatttttaaagaaaacaatattaatggagatattctattagaatgtaatgcggcggtgctgaaggagcttggtgttaagaaactaggggatcgtattaggctttctgtgtgtattaagggattaagggagaaatgtattgaatcggcaagaaaatcgaaaatgagctttttaatgatagataatcagatacaagggttttcatttacattacagagtcctacggatcctttaattccggttaaatcgagtgaattagcgtcgccgacatcaaatttccaacttgataattcatatagcgatgcgtgttgttttgattcattaaacaatttccattcagttctttctaatatatcatgttctactaaaagtataagtagaaattcatctattagtacacaaaaagtttttgaaaaatcacctatatttcttgagacaaatgttatgcaatcagattccattaaaaagaattgtcttaaatttattggagaaaaagggcaaactcgaattgtaaatattagtctttgttatacggcagatgctattttatctaaggcgcttaaaaaattcaatataacagaaaatcctagtgaatggagagtttttattacgaatgaagatggatcatttgaatgtatttctaatgatacgcttttgaccatttctcgtcaattatcaaggccagaaagagagcgacttattttaaaaagaaaaagtgatccattaacacaagaagaatttaaaaaatcacaaacgattgcgagagaacaacgagatgctatatatcatacagctgtaatggcaaaaacgtcaggtaacttgagaaaattggaaacattttttggagaaaaacttgctccgacacttacatcatcttttactacaccattaccttcaccattaccgaaagataataaatatgggaatataacacatataagaaatttttttggtcagcgtcctcctagcgaacttattaattcaaatttagcagagtattttcctggtcatgagaaaaaagttttagaacaaacaattaaaaattctattaaatctaatcatttaaattcttttaaaggatcaaatttcgacacacctagttctactttaacatatgatctttcatctattcctgcagtaggtgaagaacggattcaatatgaaggccgaagattatcaggagttagtcatacactttctttatcacgttttatttctactcgatttcctacattacttgaatcatctattttaagggaaaatagttctcatcatacattatcttcttcatcaaaattgaattcagaaggtaacacacaagatagcaaacctagttttcgaaaaaagttagaagaaaaggcttcttcagatgaaacgtttaaatcagaatcacctaatatgttaatggagccttcaatactttcagatttttatgatgcaagtttggaaacagatagagatctcttggatgataatatttttgaaaataatgaagctaaagactttaatactgaaaaagaaatagaaaataataatagcggccctacaagatggattaagggtgctttaataggaagcggatcttttggaagtgtatttttaggaatgaacgctttaagtggagaattgatggcagtaaaacaagttgaaataccgtctattgatattcaaggatgtaaaagaaaaagggccatgttggatgccttacaaagagagatttcactacttaaagaattgcatcatgaaaatatagttcaatatcttggatcaagcatggacgaaacacatttaaccttctttcttgaatatgttcctgggggatccgttactgcattattaaataattatggggcttttgaagagcctttaattagaaattttgtgcgacaaattcttaaaggattaaactatttacacaacaaaaaaatcattcatagggacattaagggtgccaatattttagttgataacaaaggaggaattaaaatatcagattttggtatatctaaaaaagttgaagctaacctattatctatgacaagaaatcaacgcccatctctacaaggatctgtttattggatggcacctgaagttgtaaaacaaactttatataccagaaaagccgatatatggtcactcggctgtttaatagtagaaatgtttacaggaaaacatccttttccgaaaatgaatcaattacaagccatatttaagattggacaatacgtttcccctgatataccagaacattgtacttcagaagctagacattttttagaaaaaatatttgagccagattatcacgcacgacctactgcagcagatttacttaaatatagttttttaggacctatggtttctagtcctttgactgatgcaaaaaaataa

SEQ ID NO: 11039 - protein, 823 aa, Pneumocystis carinii
MDYLKKVRLWSEEEVGEWLESNNFGDYMDIFKENNINGDILLECNAAVLKELGVKKLGDRIRLSVCIKGLREKCIESARKSKMSFLMIDNQIQGFSFTLQSPTDPLIPVKSSELASPTSNFQLDNSYSDACCFDSLNNFHSVLSNISCSTKSISRNSSISTQKVFEKSPIFLETNVMQSDSIKKNCLKFIGEKGQTRIVNISLCYTADAILSKALKKFNITENPSEWRVFITNEDGSFECISNDTLLTISRQLSRPERERLILKRKSDPLTQEEFKKSQTIAREQRDAIYHTAVMAKTSGNLRKLETFFGEKLAPTLTSSFTTPLPSPLPKDNKYGNITHIRNFFGQRPPSELINSNLAEYFPGHEKKVLEQTIKNSIKSNHLNSFKGSNFDTPSSTLTYDLSSIPAVGEERIQYEGRRLSGVSHTLSLSRFISTRFPTLLESSILRENSSHHTLSSSSKLNSEGNTQDSKPSFRKKLEEKASSDETFKSESPNMLMEPSILSDFYDASLETDRDLLDDNIFENNEAKDFNTEKEIENNNSGPTRWIKGALIGSGSFGSVFLGMNALSGELMAVKQVEIPSIDIQGCKRKRAMLDALQREISLLKELHHENIVQYLGSSMDETHLTFFLEYVPGGSVTALLNNYGAFEEPLIRNFVRQILKGLNYLHNKKIIHRDIKGANILVDNKGGIKISDFGISKKVEANLLSMTRNQRPSLQGSVYWMAPEVVKQTLYTRKADIWSLGCLIVEMFTGKHPFPKMNQLQAIFKIGQYVSPDIPEHCTSEARHFLEKIFEPDYHARPTAADLLKYSFLGPMVSSPLTDAKK

SEQ ID NO: 11040 - DNA, 2593 bp, Schizosaccharomyces pombe
  CDS (571)..(2550)
atctgtacgatccgtcgtgattgtgttacaaaccaaaaatcgctttcagaatgcgcatttgcgggttgctaattttagtgcgcgattcttgccgtcctctgaaaccgattgaaacattgaaattgttaaaacagtactttacgttcgtaccttaaaccagtagtatctgaacggtggttaacgacatttgtattgcagataaagagaaagattattattcacttgctacacatggtttatacgaaagttttagattttaatatctgattacaatttctcgtcgatatttagactccttgtggaactcgtatatgtacgtaagtgcttatttaatagatatctgaatctgtgccgggtgagaattgcaatacctatataaacaagcagcctttacgaattttttggcagcttcattttggtaatgagatttagtgaaactaatatcggttataaagtgtatagttatattgttacgtcaaagagcacgagactaagggaggcaggttaaacgtaaatgctaccaactttgaacttagaagttatacgttgtacaaccactttcctgcatttatggaatattatacctcgaaggaggtagcagaatggttgaaaagtatcggattggagaagtatatcgaacaattttcacaaaataacattgaaggacgacacctaaatcatttaaccttgcctttactgaaagacctaggcattgaaaacaccgccaaaggcaaacaatttttaaaacaaagagactatttacgagagtttccacgtccatgtatactgaggtttattgcctgtaacgggcaaactcgagcagttcaatcacgaggagattaccagaaaacactcgctattgctttgaaaaagtttagccttgaagatgcttcaaaattcattgtatgcgtttcacagagtagtcgaattaagctgattactgaagaagaatttaaacaaatttgttttaattcatcttcaccggaacgcgacaggttaattattgtgccaaaagaaaagccttgtccatcgtttgaagacctccgccgttcttgggagattgaattggctcaaccggcagcattatcatcacagtcctccctttctcctaaactttcctctgttcttcccacgagcactcagaaacgaagtgtccgctcaaataatgcgaaaccatttgaatcctaccagcgacctcctagcgagcttattaattctagaatttccgattttttccccgatcatcaaccaaagctactggaaaaaacaatatcaaactctcttcgtagaaaccttagcatacgtacgtctcaagggcacaatcttggtaattttggtcaagaaattttgccaagaagctctcggcgggctcgcccttccgaattggtttgtcctctttcctctctgaggatttctgttgctgaagatgttaaccgacttcctaggattgataggggatttgatcctccacttactgtatcttctactcagcgtatttctagaccaccatcgcttcaaaaatccataaccatggttggtgtggaacctttataccagtccaacggaaatgaaaaatcgtcgaagtataatgttttttcagaaagcgcgcatggcaaccatcaagtactttccttttcacctggttcatccccatcatttattgagcaaccatccccaatttctccaacttccactacaagtgaggacacaaatacacttgaagaggacactgatgatcagtctatcaaatggatacgtggtgcgttaataggttcaggatcgtttggacaagtttatctcggtatgaatgcatctagtggtgagttgatggctgttaagcaagtgatcttagattctgtttctgaatcaaaagaccgccatgccaaacttttagatgcattagcgggtgaaattgctcttctacaggagttgtctcatgagcatattgtccaatatctcggttctaacttaaattcggaccacttgaacatttttttggaatatgttcctggggggtcggttgccggattgcttacaatgtatggaagctttgaggaaacgctagtcaagaactttattaagcaaacccttaaaggcttagaataccttcattcacgcggcattgtacaccgtgatataaaaggtgcgaacatcttggttgataataaagggaagattaaaatttcggactttgggatatcgaagaaacttgaactaaatagtacctctacgaagacgggtggtgctcgcccttcttttcaaggctcttctttttggatggctcccgaagtggtgaagcaaactatgcatacggagaaaacagatatttggtctttgggatgtttggtaatcgagatgctcactagtaagcacccttatccgaattgtgatcaaatgcaggccattttcagaattggggagaacattctgccggaattcccttctaacatttcttcatcggccatagatttccttgagaaaacgtttgccatagattgtaatcttagacctacagcatcagagttgttgagccacccgttcgtttcataagccggctaagttatgatgaaaacagaaacattattttacgatc

SEQ ID NO: 11041 - protein, 659 aa, Schizosaccharomyces pombe
MEYYTSKEVAEWLKSIGLEKYIEQFSQNNIEGRHLNHLTLPLLKDLGIENTAKGKQFLKQRDYLREFPRPCILRFIACNGQTRAVQSRGDYQKTLAIALKKFSLEDASKFIVCVSQSSRIKLITEEEFKQICFNSSSPERDRLIIVPKEKPCPSFEDLRRSWEIELAQPAALSSQSSLSPKLSSVLPTSTQKRSVRSNNAKPFESYQRPPSELINSRISDFFPDHQPKLLEKTISNSLRRNLSIRTSQGHNLGNFGQEILPRSSRRARPSELVCPLSSLRISVAEDVNRLPRIDRGFDPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 11042 - DNA, 2154 bp, Saccharomyces cerevisiae
  CDS (1)..(2154)
atggaacagacacaaacagcagagggcactgacttactaattggtgacgaaaagaccaacgatttaccttttgtgcagttatttctggaggaaataggatgcactcaatacctggatagctttattcagtgcaaccttgtcacagaagaagaaattaagtatctcgacaaggatatcctcattgctttgggtgtaaacaaaataggagacagactcaaaattttaaggaagtcaaaatcgttccagagagataaacggattgaacaggtgaatagattgaaaaacctgatggaaaaagtaagctctctatccactgctacgctatcgatgaattcagaattgattcctgaaaagcactgtgttatatttatcttaaacgatggttccgctaagaaagttaatgtaaatggttgctttaatgcagattctattaagaaaaggctaatcagaagattgccacatgaattattagccacaaactccaatggagaagtaactaaaatggtccaagattatgatgtgtttgtcttagattataccaagaacgtactgcatttgctatatgacgtggaattagtcactatttgccacgcaaatgatcgtgttgagaaaaataggctaatttttgtttccaaagaccaaacaccaagtgataaagctatatccacatccaaaaaactatatctaagaacgttgagtgcattgagccaggttgggccatcctcgtcaaatttgttggcacagaacaaggggatttcgcataacaatgctgaagggaaactccggatcgacaacacagaaaaggacagaattagacagatttttaatcagaggcctcctagcgaatttatttctaccaatttggccggatattttcctcatacagacatgaagcggttgcaaaagacgatgagagagtcatttcgccattcagcaaggctaagcattgctcaaagaagacctttaagtgcagaatcaaataatatcggtgacatactattgaaacactcaaacgctgttgatatggccctattacaaggattagatcagacaagattaagcagtaaacttgacacaactaaaattccgaagcttgcccataaaaggccagaagataatgatgccatatctaaccagttagaactattaagtgtagagtctggtgaagaagaagatcacgatttctttggggaggacagtgacattgtttcattaccgacgaaaattgccacgcccaagaattggttaaaaggtgcttgcattggatcaggcagttttgggagtgtttacttgggcatgaatgctcacactggtgaactaatggcagtaaagcaagtggagataaaaaataataacattggtgttcccacagacaacaataaacaagccaattctgatgagaataatgagcaggaggaacaacaagagaaaatagaagatgttggggcggtaagtcatccaaaaaccaatcaaaatattcacagaaagatggttgatgctttacagcatgaaatgaatttattgaaggagttacatcatgagaacattgttacttattatggtgcttctcaagaaggcggaaatttaaatatttttcttgaatacgttcctgggggttcggtttcctccatgctgaataattacggtccatttgaggaatcactgattactaatttcactaggcaaatactgattggggttgcgtatttgcataagaagaacattattcacagagatatcaagggtgcaaatattttgattgatatcaaaggttgcgtaaaaattactgattttggtatttcaaaaaaattatcacctttgaataaaaaacaaaataagagagcttctttgcaaggttccgtattctggatgtcaccagaggtggtcaaacagaccgctactactgctaaagcggatatatggtctacaggatgtgttgtcattgaaatgtttaccggtaagcatcctttcccagatttttctcaaatgcaagcgatcttcaaaataggcacaaacacgacccccgagataccttcctgggctacgtcagaaggaaagaatttcttaagaaaggcatttgagttggattatcaatacaggcctagtgcccttgaattgctgcagcatccatggctggatgcacacataatttga

SEQ ID NO: 11043 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 11044 - DNA, 26 bp, Artificial sequence
  primer
atgcataaagagagaccacttaataa

SEQ ID NO: 11045 - DNA, 25 bp, Artificial sequence
  primer
tcaaattatgtgtgcatccagccat

SEQ ID NO: 11046 - protein, 1129 aa, Artificial sequence
  consensus sequence
  Variant (2)..(12): Xaa in position 2 to 12 is any amino acid
  Variant (14)..(30): Xaa in position 14 to 30 is any amino acid
  Variant (31)..(31): Xaa in position 31 is any or no amino acid
  Variant (33)..(35): Xaa in position 33 to 35 is any amino acid
  Variant (37)..(49): Xaa in position 37 to 49 is any amino acid
  Variant (50)..(344): Xaa in position 50 to 344 is any or no amino acid
  Variant (346)..(348): Xaa in position 346 to 348 is any amino acid
  Variant (350)..(351): Xaa in position 350 to 351 is any amino acid
  Variant (352)..(354): Xaa in position 352 to 354 is any or no amino acid
  Variant (356)..(359): Xaa in position 356 to 359 is any amino acid
  Variant (361)..(396): Xaa in position 361 to 396 is any amino acid
  Variant (397)..(420): Xaa in position 397 to 420 is any or no amino acid
  Variant (422)..(422): Xaa in position 422 is any amino acid
  Variant (425)..(426): Xaa in position 425 to 426 is any amino acid
  Variant (428)..(432): Xaa in position 428 to 432 is any amino acid
  Variant (433)..(435): Xaa in position 433 to 435 is any or no amino acid
  Variant (437)..(437): Xaa in position 437 is any amino acid
  Variant (439)..(440): Xaa in position 439 to 440 is any amino acid
  Variant (444)..(449): Xaa in position 444 to 449 is any amino acid
  Variant (450)..(454): Xaa in position 450 to 454 is any or no amino acid
  Variant (456)..(494): Xaa in position 456 to 494 is any amino acid
  Variant (495)..(553): Xaa in position 495 to 553 is any or no amino acid
  Variant (559)..(559): Xaa in position 559 is any amino acid
  Variant (561)..(566): Xaa in position 561 to 566 is any amino acid
  Variant (570)..(578): Xaa in position 570 to 578 is any amino acid
  Variant (580)..(580): Xaa in position 580 is any amino acid
  Variant (582)..(582): Xaa in position 582 is any amino acid
  Variant (584)..(584): Xaa in position 584 is any amino acid
  Variant (586)..(586): Xaa in position 586 is any amino acid
  Variant (588)..(588): Xaa in position 588 is any amino acid
  Variant (590)..(590): Xaa in position 590 is any amino acid
  Variant (592)..(687): Xaa in position 592 to 687 is any amino acid
  Variant (688)..(819): Xaa in position 688 to 819 is any or no amino acid
  Variant (821)..(821): Xaa in position 821 is any amino acid
  Variant (824)..(825): Xaa in position 824 to 825 is any amino acid
  Variant (828)..(828): Xaa in position 828 is any amino acid
  Variant (833)..(833): Xaa in position 833 is any amino acid
  Variant (835)..(835): Xaa in position 835 is any amino acid
  Variant (837)..(841): Xaa in position 837 to 841 is any amino acid
  Variant (852)..(864): Xaa in position 852 to 864 is any amino acid
  Variant (865)..(901): Xaa in position 865 to 901 is any or no amino acid
  Variant (903)..(904): Xaa in position 903 to 904 is any amino acid
  Variant (907)..(908): Xaa in position 907 to 908 is any amino acid
  Variant (910)..(911): Xaa in position 910 to 911 is any amino acid
  Variant (914)..(915): Xaa in position 914 to 915 is any amino acid
  Variant (917)..(917): Xaa in position 917 is any amino acid
  Variant (919)..(919): Xaa in position 919 is any amino acid
  Variant (923)..(923): Xaa in position 923 is any amino acid
  Variant (925)..(925): Xaa in position 925 is any amino acid
  Variant (927)..(933): Xaa in position 927 to 933 is any amino acid
  Variant (947)..(948): Xaa in position 947 to 948 is any amino acid
  Variant (951)..(952): Xaa in position 951 to 952 is any amino acid
  Variant (955)..(957): Xaa in position 955 to 957 is any amino acid
  Variant (959)..(959): Xaa in position 959 is any amino acid
  Variant (961)..(963): Xaa in position 961 to 963 is any amino acid
  Variant (965)..(965): Xaa in position 965 is any amino acid
  Variant (970)..(970): Xaa in position 970 is any amino acid
  Variant (973)..(973): Xaa in position 973 is any amino acid
  Variant (977)..(979): Xaa in position 977 to 979 is any amino acid
  Variant (992)..(992): Xaa in position 992 is any amino acid
  Variant (994)..(994): Xaa in position 994 is any amino acid
  Variant (997)..(998): Xaa in position 997 to 998 is any amino acid
  Variant (1001)..(1001): Xaa in position 1001 is any amino acid
  Variant (1009)..(1015): Xaa in position 1009 to 1015 is any amino acid
  Variant (1016)..(1028): Xaa in position 1016 to 1028 is any or no amino acid
  Variant (1030)..(1030): Xaa in position 1030 is any amino acid
  Variant (1037)..(1037): Xaa in position 1037 is any amino acid
  Variant (1048)..(1049): Xaa in position 1048 to 1049 is any amino acid
  Variant (1051)..(1051): Xaa in position 1051 is any amino acid
  Variant (1058)..(1058): Xaa in position 1058 is any amino acid
  Variant (1061)..(1063): Xaa in position 1061 to 1063 is any amino acid
  Variant (1066)..(1066): Xaa in position 1066 is any amino acid
  Variant (1069)..(1069): Xaa in position 1069 is any amino acid
  Variant (1072)..(1072): Xaa in position 1072 is any amino acid
  Variant (1074)..(1076): Xaa in position 1074 to 1076 is any amino acid
  Variant (1078)..(1078): Xaa in position 1078 is any amino acid
  Variant (1083)..(1083): Xaa in position 1083 is any amino acid
  Variant (1086)..(1089): Xaa in position 1086 to 1089 is any amino acid
  Variant (1090)..(1091): Xaa in position 1090 to 1091 is any or no amino acid
  Variant (1093)..(1093): Xaa in position 1093 is any amino acid
  Variant (1096)..(1104): Xaa in position 1096 to 1104 is any amino acid
  Variant (1107)..(1109): Xaa in position 1107 to 1109 is any amino acid
  Variant (1111)..(1112): Xaa in position 1111 to 1112 is any amino acid
  Variant (1114)..(1116): Xaa in position 1114 to 1116 is any amino acid
  Variant (1119)..(1119): Xaa in position 1119 is any amino acid
  Variant (1121)..(1122): Xaa in position 1121 to 1122 is any amino acid
  Variant (1124)..(1128): Xaa in position 1124 to 1128 is any amino acid
LXXXXXXXXXXXFXXXXXXXXXXXXXXXXXXLXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXGXXXXXVXXXXCXXXXXXXXXXXXXXXXXXXXXXXXXXXXXXXXXXXXXXXXXXXXXXXXXXXXXXXXXXXXDXELXXIXXXXXXXXRXEXXRLIXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRPPSEXIXXXXXXYFPXXXXXXXXXTXRXSXRXSXRXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXKGXXIGXGSFGXVXLXXXXXTGELMAVKQVXXXXXXXXXXXXXXXXXXXXXXXXXXXXXXXXXXXXXXXXXXXXXXXXXXMXXALXXEXXLLXXLXHXNIVXYXGXXXXXXXLNIFLEYVPGGSVXXMLXXYGXXXEXLXXXFXRQILXGLXYLHXXXIIHRDIKGANILXDXKGXXKIXDFGISKKXXXXXXXXXXXXXXXXXXXXRXSLQGSVXWMAPEVVKQTXXTXKADIWSXGCXXXEMXTGXHPXPXXXQXQAIFXIGXXXXXXPXIPXXXXXXXXXFLXXXFXXDXXXRPXAXXLXXXXXL

SEQ ID NO: 11047 - protein, 60 aa, Artificial sequence
  protein pattern
  Variant (2)..(2): Xaa in position 2 is any amino acid
  Variant (3)..(3): Xaa in position 3 is any or no amino acid
  Variant (10)..(10): Xaa in position 10 is Phe or Tyr
  Variant (13)..(13): Xaa in position 13 is Ala or Ser
  Variant (18)..(18): Xaa in position 18 is Lys or Arg
  Variant (21)..(22): Xaa in position 21 to 22 is any amino acid
  Variant (24)..(24): Xaa in position 24 is any or no amino acid
  Variant (26)..(26): Xaa in position 26 is any or no amino acid
  Variant (32)..(32): Xaa in position 32 is any amino acid
  Variant (35)..(35): Xaa in position 35 is Leu or Val
  Variant (36)..(37): Xaa in position 36 to 37 is Ile or Val
  Variant (40)..(40): Xaa in position 40 is Phe, Leu or Met
  Variant (41)..(41): Xaa in position 41 is any amino acid
  Variant (43)..(43): Xaa in position 43 is any amino acid
  Variant (46)..(46): Xaa in position 46 is Phe, His or Tyr
  Variant (48)..(49): Xaa in position 48 to 49 is any amino acid
  Variant (50)..(50): Xaa in position 50 is Asn, Ser or Thr
  Variant (52)..(52): Xaa in position 52 is Leu or Met
  Variant (55)..(55): Xaa in position 55 is Ile or Leu
  Variant (57)..(57): Xaa in position 57 is any amino acid
  Variant (60)..(60): Xaa in position 60 is Gly, Asn, Gln, Ser or Thr
RXXSLQGSVXWMXPEVVXQTXXTXKXADIWSXGCXXXEMXXGXHPXPXXXQXQAXFXIGX

SEQ ID NO: 11048 - protein, 59 aa, Artificial sequence
  protein pattern
  Variant (10)..(10): Xaa in position 10 is Ala, Gln, Ser or Thr
  Variant (11)..(11): Xaa in position 11 is Ala, Ser or Thr
  Variant (12)..(12): Xaa in position 12 is Leu or Met
  Variant (14)..(15): Xaa in position 14 to 15 is any amino acid
  Variant (18)..(18): Xaa in position 18 is any amino acid
  Variant (19)..(19): Xaa in position 19 is Phe or Leu
  Variant (20)..(20): Xaa in position 20 is any amino acid
  Variant (22)..(22): Xaa in position 22 is Ala, Pro or Ser
  Variant (24)..(24): Xaa in position 24 is Ala, Ile or Val
  Variant (25)..(26): Xaa in position 25 to 26 is any amino acid
  Variant (28)..(28): Xaa in position 28 is any amino acid
  Variant (31)..(31): Xaa in position 31 is Ile or Val
  Variant (33)..(33): Xaa in position 33 is any amino acid
  Variant (35)..(35): Xaa in position 35 is Leu or Val
  Variant (36)..(36): Xaa in position 36 is Ala, Asp, Asn or Ser
  Variant (38)..(38): Xaa in position 38 is Leu or Val
  Variant (40)..(42): Xaa in position 40 to 42 is any amino acid
  Variant (44)..(44): Xaa in position 44 is Ile or Val
  Variant (53)..(53): Xaa in position 53 is Ile or Val
  Variant (55)..(55): Xaa in position 55 is Ile or Val
  Variant (57)..(57): Xaa in position 57 is any amino acid
LEYVPGGSVXXXLXXYGXXXEXLXXXFXRQXLXGXXYXHXXXIXHRDIKGANXLXDXKG

SEQ ID NO: 11049 - protein, 36 aa, Artificial sequence
  protein pattern
  Variant (2)..(2): Xaa in position 2 is Ile, Leu or Met
  Variant (3)..(3): Xaa in position 3 is any amino acid
  Variant (5)..(5): Xaa in position 5 is Ala, Ser or Thr
  Variant (6)..(6): Xaa in position 6 is any amino acid
  Variant (9)..(9): Xaa in position 9 is Ala, Glu, Gln or Ser
  Variant (14)..(14): Xaa in position 14 is any amino acid
  Variant (16)..(16): Xaa in position 16 is Phe, His or Tyr
  Variant (18)..(18): Xaa in position 18 is Ala or Gly
  Variant (19)..(19): Xaa in position 19 is Leu or Met
  Variant (20)..(20): Xaa in position 20 is any amino acid
  Variant (21)..(21): Xaa in position 21 is Ala, Pro or Ser
  Variant (22)..(22): Xaa in position 22 is any amino acid
  Variant (23)..(23): Xaa in position 23 is Ser or Thr
  Variant (27)..(27): Xaa in position 27 is Leu or Met
  Variant (33)..(35): Xaa in position 33 to 35 is any amino acid
  Variant (36)..(36): Xaa in position 36 is Ala, Asp, Asn, Pro or Ser
WXXGXXIGXGSFGXVXLXXXXXXGELXAVKQVXXXX

SEQ ID NO: 11050 - protein, 26 aa, Artificial sequence
  protein pattern
  Variant (2)..(2): Xaa in position 2 is Ile, Leu or Val
  Variant (3)..(3): Xaa in position 3 is Asp, Glu or Thr
  Variant (6)..(6): Xaa in position 6 is any amino acid
  Variant (7)..(7): Xaa in position 7 is His or Arg
  Variant (9)..(9): Xaa in position 9 is Ile or Met
  Variant (10)..(10): Xaa in position 10 is Asp, Glu, Gly, Asn, Ser or Thr
  Variant (11)..(11): Xaa in position 11 is Ile or Leu
  Variant (13)..(13): Xaa in position 13 is any amino acid
  Variant (14)..(14): Xaa in position 14 is Asp, Glu or Gly
  Variant (15)..(15): Xaa in position 15 is Phe, Ile or Leu
  Variant (16)..(16): Xaa in position 16 is any amino acid
  Variant (18)..(18): Xaa in position 18 is any amino acid
  Variant (22)..(22): Xaa in position 22 is any amino acid
  Variant (24)..(24): Xaa in position 24 is any amino acid
  Variant (26)..(26): Xaa in position 26 is Ala, Cys, Ser or Thr
MXXALXXEXXXLXXXXHXNIVXYXGX

SEQ ID NO: 11051 - protein, 42 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is any amino acid
  Variant (8)..(8): Xaa in position 8 is any or no amino acid
  Variant (12)..(12): Xaa in position 12 is Ser or Thr
  Variant (14)..(14): Xaa in position 14 is Phe, Leu or Met
  Variant (16)..(17): Xaa in position 16 to 17 is any amino acid
  Variant (18)..(18): Xaa in position 18 is Asp, Glu or Asn
  Variant (19)..(19): Xaa in position 19 is Ile or Leu
  Variant (20)..(20): Xaa in position 20 is Ala, Pro, Ser or Thr
  Variant (21)..(21): Xaa in position 21 is Glu, Gly, Ser or Thr
  Variant (25)..(30): Xaa in position 25 to 30 is any amino acid
  Variant (31)..(31): Xaa in position 31 is Ile or Leu
  Variant (32)..(33): Xaa in position 32 to 33 is any amino acid
  Variant (34)..(34): Xaa in position 34 is Ala or Thr
  Variant (35)..(35): Xaa in position 35 is any amino acid
  Variant (36)..(36): Xaa in position 36 is Lys or Arg
  Variant (37)..(37): Xaa in position 37 is any amino acid
  Variant (39)..(39): Xaa in position 39 is any amino acid
  Variant (40)..(40): Xaa in position 40 is Lys or Arg
  Variant (41)..(41): Xaa in position 41 is any amino acid
  Variant (42)..(42): Xaa in position 42 is Asn or Ser
RXXXFXXXRPPXEXIXXXXXXYFPXXXXXXXXXXXXXSXXXX

SEQ ID NO: 11052 - protein, 39 aa, Artificial sequence
  protein pattern
  Variant (2)..(3): Xaa in position 2 to 3 is any amino acid
  Variant (5)..(7): Xaa in position 5 to 7 is any amino acid
  Variant (8)..(8): Xaa in position 8 is any or no amino acid
  Variant (10)..(13): Xaa in position 10 to 13 is any amino acid
  Variant (14)..(14): Xaa in position 14 is any or no amino acid
  Variant (16)..(16): Xaa in position 16 is Ile or Leu
  Variant (17)..(19): Xaa in position 17 to 19 is any amino acid
  Variant (21)..(21): Xaa in position 21 is Ala, Glu or Gln
  Variant (22)..(22): Xaa in position 22 is any amino acid
  Variant (24)..(26): Xaa in position 24 to 26 is any amino acid
  Variant (29)..(29): Xaa in position 29 is Asp, Ser or Thr
  Variant (30)..(30): Xaa in position 30 is Ala or Ser
  Variant (31)..(31): Xaa in position 31 is any amino acid
  Variant (32)..(32): Xaa in position 32 is Asp, Glu, Gly, Gln or Ser
  Variant (33)..(33): Xaa in position 33 is Leu or Met
  Variant (34)..(37): Xaa in position 34 to 37 is any amino acid
  Variant (38)..(38): Xaa in position 38 is Phe or Trp
  Variant (39)..(39): Xaa in position 39 is Leu, Met or Val
PXXPXXXXSXXXXXFXXXXFXXDXXXRPXXXXXXXXXXX

SEQ ID NO: 11053 - protein, 13 aa, Artificial sequence
  protein pattern
  Variant (3)..(3): Xaa in position 3 is Ser or Thr
  Variant (10)..(10): Xaa in position 10 is Lys or Arg
  Variant (11)..(11): Xaa in position 11 is Ile, Leu or Val
  Variant (12)..(12): Xaa in position 12 is Glu or Ser
  Variant (13)..(13): Xaa in position 13 is Ala, Leu or Pro
KIXDFGISKXXXX

SEQ ID NO: 11054 - DNA, 237 bp, Saccharomyces cerevisiae
  CDS (1)..(237)
atgttgtgccaacagatgattagaacgacagctaagagaagtagcaatatcatgaccagacctattatcatgaagaggtcagtacacttcaaagacggtgtgtatgaaaatatcccattcaaagtcaaaggaagaaagacaccttacgccttatctcatttcgggttcttcgctattggatttgctgttccatttgttgcctgctatgttcaattgaaaaagtcaggtgctttttaa

SEQ ID NO: 11055 - protein, 78 aa, Saccharomyces cerevisiae
MLCQQMIRTTAKRSSNIMTRPIIMKRSVHFKDGVYENIPFKVKGRKTPYALSHFGFFAIGFAVPFVACYVQLKKSGAF

SEQ ID NO: 11056 - DNA, 222 bp, Kluyveromyces lactis NRRL Y-1140
  CDS (1)..(222)
atgttttcccaagttaccagactagccaccagaagagccttctctgccacttccaagcaatgtggtgcccacttcaaggaaggtgtttactcgaacatcccagttaagattcacaacagaaagatcccatacgctttcatccacttcggtttctttgctctaggttttgctgttccattcatctcttcttacgtgcaattgaagaagtttggtgctttctaa

SEQ ID NO: 11057 - protein, 73 aa, Kluyveromyces lactis NRRL Y-1140
MFSQVTRLATRRAFSATSKQCGAHFKEGVYSNIPVKIHNRKIPYAFIHFGFFALGFAVPFISSYVQLKKFGAF

SEQ ID NO: 11058 - DNA, 246 bp, Debaryomyces hansenii CBS767
  CDS (1)..(246)
atgttagctagatcaaagttgattactcaaaaggtttccaccagaaacttccaaacttcagccagaagcttcaacgacatttttggaagtccaaaatccggtgtttactcaaacattcctttcaaggtcaagaacagaaagattcctattagtttttggttctggggtatcacaggtagtttatttgcattcccattcgttagtacttactggcatttaaagaaggctggttcattcatggaataa

SEQ ID NO: 11059 - protein, 81 aa, Debaryomyces hansenii CBS767
MLARSKLITQKVSTRNFQTSARSFNDIFGSPKSGVYSNIPFKVKNRKIPISFWFWGITGSLFAFPFVSTYWHLKKAGSFME

SEQ ID NO: 11060 - DNA, 225 bp, Yarrowia lipolytica CLIB122
  CDS (1)..(225)
atgttccgagctaccgtccgatccgccaacaccgtggccaagcgaaacttctccaccaccaaggtgcgatctgtccactaccccgagggcccttaccataacctgcccttcaaggtccacaaccgaaagatcccctacgccttcctgcattttggtttcttccttgctggattccttgcccccttcggcattgtgtacgtccacaacaagcgagcccgaggctag

SEQ ID NO: 11061 - protein, 74 aa, Yarrowia lipolytica CLIB122
MFRATVRSANTVAKRNFSTTKVRSVHYPEGPYHNLPFKVHNRKIPYAFLHFGFFLAGFLAPFGIVYVHNKRARG

SEQ ID NO: 11062 - DNA, 25 bp, Artificial sequence
  primer
atgttgtgccaacagatgattagaa

SEQ ID NO: 11063 - DNA, 27 bp, Artificial sequence
  primer
ttaaaaagcacctgactttttcaattg

SEQ ID NO: 11064 - protein, 74 aa, Artificial sequence
  consensus sequence
  Variant (2)..(27): Xaa in position 2 to 27 is any amino acid
  Variant (28)..(33): Xaa in position 28 to 33 is any or no amino acid
  Variant (35)..(35): Xaa in position 35 is any amino acid
  Variant (37)..(37): Xaa in position 37 is any amino acid
  Variant (39)..(39): Xaa in position 39 is any amino acid
  Variant (41)..(41): Xaa in position 41 is any amino acid
  Variant (43)..(45): Xaa in position 43 to 45 is any amino acid
  Variant (48)..(48): Xaa in position 48 is any amino acid
  Variant (50)..(55): Xaa in position 50 to 55 is any amino acid
  Variant (57)..(61): Xaa in position 57 to 61 is any amino acid
  Variant (63)..(64): Xaa in position 63 to 64 is any amino acid
  Variant (67)..(69): Xaa in position 67 to 69 is any amino acid
  Variant (71)..(73): Xaa in position 71 to 73 is any amino acid
MXXXXXXXXXXXXXXXXXXXXXXXXXXXXXXXXGXYXNXPXKXXXRKXPXXXXXXGXXXXXFXXPFXXXYXXXK

SEQ ID NO: 11065 - protein, 44 aa, Artificial sequence
  protein pattern
  Variant (2)..(2): Xaa in position 2 is Pro or Val
  Variant (4)..(4): Xaa in position 4 is any amino acid
  Variant (6)..(6): Xaa in position 6 is Ile or Leu
  Variant (8)..(9): Xaa in position 8 to 9 is any or no amino acid
  Variant (11)..(12): Xaa in position 11 to 12 is any amino acid
  Variant (13)..(14): Xaa in position 13 to 14 is any or no amino acid
  Variant (17)..(17): Xaa in position 17 is any amino acid
  Variant (19)..(19): Xaa in position 19 is any amino acid
  Variant (20)..(20): Xaa in position 20 is Ala or Ser
  Variant (21)..(21): Xaa in position 21 is Phe or Leu
  Variant (22)..(22): Xaa in position 22 is any amino acid
  Variant (23)..(23): Xaa in position 23 is Phe or His
  Variant (24)..(24): Xaa in position 24 is Phe or Trp
  Variant (26)..(26): Xaa in position 26 is Phe or Ile
  Variant (27)..(27): Xaa in position 27 is any amino acid
  Variant (28)..(28): Xaa in position 28 is Ala, Gly or Leu
  Variant (29)..(29): Xaa in position 29 is any amino acid
  Variant (30)..(30): Xaa in position 30 is Gly or Leu
  Variant (32)..(32): Xaa in position 32 is Ala or Leu
  Variant (33)..(33): Xaa in position 33 is any amino acid
  Variant (36)..(36): Xaa in position 36 is Gly, Ile or Val
  Variant (37)..(37): Xaa in position 37 is any amino acid
  Variant (38)..(38): Xaa in position 38 is Cys, Ser, Thr or Val
  Variant (40)..(42): Xaa in position 40 to 42 is any amino acid
  Variant (44)..(44): Xaa in position 44 is Lys or Arg
GXYXNXPXXVXXXXRKXPXXXXXXGXXXXXFXXPFXXXYXXXKX

SEQ ID NO: 11066 - DNA, 858 bp, Saccharomyces cerevisiae
  CDS (1)..(858)
atgaaaatcaatgtatcccgtccattacagtttttacaatggagttcatatattgttgttgcatttctgatacaattgctaatcattcttcctttatcgatcttaatatatcacgatttttacctaagactattacctgccgattcctctaacgtagtcccccttaatacgttcaacattttaaatggcgtacaatttggtacaaaattcttccaatctattaaaagcattccggtaggtacagatctgccgcaaacaatagacaatggcttatcacagttaatccccatgcgtgacaacatggaatacaagctcgatctaaacctacagctttattgccagagcaaaactgaccatttaaatttagacaatttgttaattgatgtttacagaggtccaggcccgctattgggtgctcctggaggaagtaacagcaaagatgaaaaaatctttcacacttctagacctattgtctgcctcgcactgacggattccatgtcgcctcaggagatcgaacaactaggcccatcacgtctagacgtttacgatgaagaatggctaaatacaataagaatagaggacaaaatatcgttagagtcttcatatgaaacaatctcggtgttcttgaaaacggagattgcccaaagaaatctaataatacatccagaaagtgggattaagtttaggatgaattttgagcagggattaagaaacttgatgcttcgaaaaagatttttatcttatattattggcatttcaattttccattgcataatatgtgtacttttttttatcacaggttgcactgcattcatttttgttagaaagggtcaggaaaaatccaagaaacatagctga

SEQ ID NO: 11067 - protein, 285 aa, Saccharomyces cerevisiae
MKINVSRPLQFLQWSSYIVVAFLIQLLIILPLSILIYHDFYLRLLPADSSNVVPLNTFNILNGVQFGTKFFQSIKSIPVGTDLPQTIDNGLSQLIPMRDNMEYKLDLNLQLYCQSKTDHLNLDNLLIDVYRGPGPLLGAPGGSNSKDEKIFHTSRPIVCLALTDSMSPQEIEQLGPSRLDVYDEEWLNTIRIEDKISLESSYETISVFLKTEIAQRNLIIHPESGIKFRMNFEQGLRNLMLRKRFLSYIIGISIFHCIICVLFFITGCTAFIFVRKGQEKSKKHS

SEQ ID NO: 11068 - DNA, 822 bp, Candida glabrata CBS 138
  CDS (1)..(822)
atgaaatttaaccttacaagaccattacagattgcacaatgggtgagttatatccttggagttggtattcttcaaattgttgtaattcttcccctggctgtgttactgtttcatgatttctatacaaggttactaccgtcggattcctctgtatgggtgccattggataattttaatagcaatgcatccgggttaaacacgaggtttaaacaagggattgtttgtgtttctccggataaacagttaccgggattgaaaccgaatggcttgagtcagccaatagcgttgagatgccatacaaattacaaactagatatgaaactagagttctattgtcattctttggatgccattggcaacagtaaagggacagatttacaatacgcagttgtgtccctgagtgatgactccaacttgttttacagatataggcagccagtgatttgcagaaaccaaggagcaacaaacgtcctagaaggaaataatcatgctaaatcccggatggaagttctgaggaatgaatggttaaatagtttatctttggaagacatcgcagatatttcacctcaactggaaaacattgaaatatcgatcgatcttccaaactcaaacggtgagatccttctagaacccactagcggtatcttgttaagaagatcatttgagcaaggattaaggaattggatgctacgcagatggagaactacctatattataggaacagctgtattctatattagtttaagttttatcttcgtgatcacgtgtatggcaactttcctcatatttacaaaggtatatggtaagcatcaaaagcaatag

SEQ ID NO: 11069 - protein, 273 aa, Candida glabrata CBS 138
MKFNLTRPLQIAQWVSYILGVGILQIVVILPLAVLLFHDFYTRLLPSDSSVWVPLDNFNSNASGLNTRFKQGIVCVSPDKQLPGLKPNGLSQPIALRCHTNYKLDMKLEFYCHSLDAIGNSKGTDLQYAVVSLSDDSNLFYRYRQPVICRNQGATNVLEGNNHAKSRMEVLRNEWLNSLSLEDIADISPQLENIEISIDLPNSNGEILLEPTSGILLRRSFEQGLRNWMLRRWRTTYIIGTAVFYISLSFIFVITCMATFLIFTKVYGKHQKQ

SEQ ID NO: 11070 - DNA, 699 bp, Kluyveromyces lactis NRRL Y-1140
  CDS (1)..(699)
atgaagataaacgtatccattccacttcaggcagcaagatggttttcttatttgcttatacttatatgcattgagattatcttcattttaccattatcgaatcttttatggatagattttatcaataggttgattccaaacaacagaatgcatgttatacctttgagcaacatggctaattcttggacagttccatttgatttgcgggtcattgccaatgttacatcaactaaagagaatgaaatacgatcagacatacctttagatgttaccttaaatttggggatttattgtacttctcaccgaccaattgaggccgtgactttatcaatagatgacaatcccagaaagttacctcttgtatgttttgataacttgaattttctctcttcaagattcaatgggttcgattcagtgtcaaaaactgtcaagaaagatgtcatcaatgactttaagtttggatttcctgtaaatcctgataacaagaggatcaggatagatttaaaggactatactgaggactaccttttaagttacatcaatgtccaattttcagtgaaatataccggattccgaaagtttttactaagctggagaagaacttgtcatctattgggcactttattatttgctagtttgatttctagttgcttcctattatcttttactggtgtcttcagctatattgtaatggcataa

SEQ ID NO: 11071 - protein, 232 aa, Kluyveromyces lactis NRRL Y-1140
MKINVSIPLQAARWFSYLLILICIEIIFILPLSNLLWIDFINRLIPNNRMHVIPLSNMANSWTVPFDLRVIANVTSTKENEIRSDIPLDVTLNLGIYCTSHRPIEAVTLSIDDNPRKLPLVCFDNLNFLSSRFNGFDSVSKTVKKDVINDFKFGFPVNPDNKRIRIDLKDYTEDYLLSYINVQFSVKYTGFRKFLLSWRRTCHLLGTLLFASLISSCFLLSFTGVFSYIVMA

SEQ ID NO: 11072 - DNA, 25 bp, Artificial sequence
  primer
atgaaaatcaatgtatcccgtccat

SEQ ID NO: 11073 - DNA, 25 bp, Artificial sequence
  primer
tcagctatgtttcttggatttttcc

SEQ ID NO: 11074 - DNA, 552 bp, Saccharomyces cerevisiae
  CDS (1)..(552)
atgggttcttcattcgtaatagatcgatcctcttcgtcaccagcgccaccacggggacccgccccgaaattgagtgcacatgctcgcaagataatatgcaaaatatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttgcatagctcatctacgtgtaggctgccaaattgtacccatatttccttatggtgcttttctgaagactccttacaataggtgcgccggaaacaaagtcagtgaaagtacgcatcgtagagctgtcgttcggcctagcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaacaagatactttga

SEQ ID NO: 11075 - protein, 183 aa, Saccharomyces cerevisiae
MGSSFVIDRSSSSPAPPRGPAPKLSAHARKIICKISPNRSFLFIISLHICEKYFISMGLRGHRSRFSRSVSTFFSPGKLACIAHLRVGCQIVPIFPYGAFLKTPYNRCAGNKVSESTHRRAVVRPSTRYFVTTFQDTETQLIIVSSVEVKKRKGIVILSIEFQSMHLKQRVDHQVDFLGNKIL

SEQ ID NO: 11076 - DNA, 612 bp, Saccharomyces cerevisiae
  CDS (1)..(612)
atgggttcttcattcgtaatagatcgatcctcttcgtcaccagcgccaccacggggacccgccccgaaattgagtgcacatgctcgcaagataatatgcaaaatatcacccaatcggtcctttttgttcatcatatcgttacatatctgtgaaaagtactttatctcaatgggtttacgtgggcatagatcacgcttcagccgctctgtgtcgactttcttttcgccaggtaaacttgcttgcatagctcatctacgtgtaggctgccaaattgtacccatatttccttatggtgcttttctgaagactccttacaataggtgcgccggaaacaaagtcagtgaaagtacgcatcgtagagctgtcgttcggcctagcactcgctatttcgtgacaacgttccaggacacggaaactcaactcattatagtatcctctgttgaggtaaaaaagagaaagggtatcgtaatcctttctattgaatttcaaagtatgcacttgaaacaacgtgtagaccatcacgtggtttgtttgaagggattggtccgccctggaaatctggttcgtcttcaacaaacgtcaggaacttttttacatttttcccgaccatga

SEQ ID NO: 11077 - protein, 203 aa, Saccharomyces cerevisiae
MGSSFVIDRSSSSPAPPRGPAPKLSAHARKIICKISPNRSFLFIISLHICEKYFISMGLRGHRSRFSRSVSTFFSPGKLACIAHLRVGCQIVPIFPYGAFLKTPYNRCAGNKVSESTHRRAVVRPSTRYFVTTFQDTETQLIIVSSVEVKKRKGIVILSIEFQSMHLKQRVDHHVVCLKGLVRPGNLVRLQQTSGTFLHFSRP

SEQ ID NO: 11078 - DNA, 25 bp, Artificial sequence
  primer
atgggttcttcattcgtaatagatc

SEQ ID NO: 11079 - DNA, 26 bp, Artificial sequence
  primer
tcaaagtatcttgttcccaagaaaat

SEQ ID NO: 11080 - DNA, 564 bp, Saccharomyces cerevisiae
  CDS (1)..(564)
atgtctatagcaagttatgcccaagagttgaagttggctttacatcaatatccaaacttccctagtgaaggcattctcttcgaagatttcttacccattttcaggaacccaggtcttttccagaagttgatcgatgctttcaaactgcatttagaagaagcttttccagaagttaaaattgattatatcgtcgggttggaatcccgtgggttcttgttcggaccaactttagctttggccctaggtgttggtttcgttccagtcaggaaggcaggtaagctacctggcgaatgttttaaggctacgtacgaaaaggagtacggttctgatctttttgagatacagaaaaacgctattccagcaggttccaacgttatcattgttgatgacattattgccactggtggttctgctgctgcagccggcgaattagttgaacaactcgaagccaaccttttggaatataactttgttatggagttggatttcttgaaaggcaggagtaagttgaatgctccagtgttcactttactgaacgctcaaaaggaagcgttgaaaaaatga

SEQ ID NO: 11081 - protein, 187 aa, Saccharomyces cerevisiae
MSIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 11082 - DNA, 540 bp, Bradyrhizobium sp. ORS278
  CDS (1)..(540): transl_table=11
atgacgttcgatctggacatcaagaacacggtccgcaccattccggactatcccaagcccggcatcctgttccgggacatcacgaccttgctggcggacgcccgcgcgttccgccgcgcggtcgacgagctggtgcatccctgggccggctcgaagatcgacaaggtcgcgggcatcgaggcgcgcggcttcatcctcggcggcgcggtcgcgcaccagctttcggccggcttcgtgccgatcaggaaaaaaggcaagctgccgcacaagacggtcagcatgtcctacgcgctggaatacggcaccgacgagatggagatgcatgtcgacgcggtgcagcccggcgagcgggtcatcctggttgacgacctcatcgccaccggcggcacggccgagggcgcggtgaagctgctgcgccagatcggcgccaccgttgtggccgcctgcttcatcatcgacctgccggatctcggcggcgccgccaagctgcgcgcgctcgacgtgccggtgcgctcgctgatcgcgttcgatggacactga

SEQ ID NO: 11083 - protein, 179 aa, Bradyrhizobium sp. ORS278
MTFDLDIKNTVRTIPDYPKPGILFRDITTLLADARAFRRAVDELVHPWAGSKIDKVAGIEARGFILGGAVAHQLSAGFVPIRKKGKLPHKTVSMSYALEYGTDEMEMHVDAVQPGERVILVDDLIATGGTAEGAVKLLRQIGATVVAACFIIDLPDLGGAAKLRALDVPVRSLIAFDGH

SEQ ID NO: 11084 - DNA, 525 bp, Dichelobacter nodosus VCS1703A
  CDS (1)..(525): transl_table=11
atgaacatggactggaaaaatctcattattaatattcccgattatcctaaagccggcattaattttaaggatattacgccgctgcttgctaacggtgcgggttttaaagcagcaattgaagaaatggcgatgatttgcgagcgccaaaatgcgattcccgatgtgcttgcttgtccggaagcgcgcggttttatttttgctgcagctttggcgcatcgtttaggaatcggatttattccgctgcgtaaaccgcataaattgccgcgggaagtcgcgcacattaattatggtttggaatacggcgaagattgtttggaagtgcataaacaagacattaaaaaaggcatgcgcattatgatggttgacgacgttttggcaaccggcggcacgatgcacgcgtgtatgaatttactgcaatctttgggcgcggaaattatcggcgcgatgtttttactcgaattgacggcattaaaaggacgcgaaaagttgggaacggctgccgtgtattctttaattcaagattaa

SEQ ID NO: 11085 - protein, 174 aa, Dichelobacter nodosus VCS1703A
MNMDWKNLIINIPDYPKAGINFKDITPLLANGAGFKAAIEEMAMICERQNAIPDVLACPEARGFIFAAALAHRLGIGFIPLRKPHKLPREVAHINYGLEYGEDCLEVHKQDIKKGMRIMMVDDVLATGGTMHACMNLLQSLGAEIIGAMFLLELTALKGREKLGTAAVYSLIQD

SEQ ID NO: 11086 - DNA, 642 bp, Oryza sativa (japonica cultivar-group)
  CDS (1)..(642)
atgggcgaggaggccaaggccgccgccgcctgggctgagatcgccgtcaccgacgccgcggcggtgccaaagccgacgccgccgcctgcggccgtggccgtcgacccccggcttcagggcatctccgacgccatccgcgtcgtcccccacttccccaagcaaggcatcatgttcaacgacatcacgccgctgctgctgcgcccgggggtgttcaaggacgccgtcgacatcttcgtcgagcgctaccgcggcatggccatcgccgccgtcgccgggattgaggctagggggttcatatttggcccggcgatcgcgctggcaattggcgccaaattcataccgttgcgtaagcccaagaaactcccaggcgaggtgatttctgagacgtatgttctcgagtacgggaccgattgcttgcagatgcatgttggcgccattgaacctggtgagcgtgtgctgatcgttgatgatctggttgcaactggtgggacactttgtgctgctataaggcttcttgaacgcgctggagctgacgttgttgagtgcgcgtgtctcattgggctcccaaaatttaaggatttctacaagctcaatggcaaaccagtttatgtgctggtggagtcccgcgaatatgaaaaataa

SEQ ID NO: 11087 - protein, 213 aa, Oryza sativa (japonica cultivar-group)
MGEEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 11088 - DNA, 639 bp, Oryza sativa (japonica cultivar-group)
  CDS (1)..(639)
atgggggaagaggatatcagcaacgacagcaagagcagctgcggctgcgaggacggcacggtggaggctccggcggctgcggcgccgaaggagaacggccgagccgcggacccgcgcctccaggccatctccgacgccatccgcgtcgtcccgcacttccccaagccagggatcatgttcaacgacatcacggcgctgctgctccggcccgccgcgttcaaggacgccgtggacatgttcgtcgagcgctaccgcggcatgcgcatcgcggccgtcgcaggtattgaagccagaggattcatatttggcccagcgatcgcactagcaattggagcaaaattcataccgttgcgcaaacctaagaaactcccaggtgaggtaatttctgagacctatatacttgagtatgggacggattgtttggagatgcatgttggagctactgaacctggtgagcgcgtagtggtcgttgatgatttagttgcaaccggtggaacactttgtgctgcaataaaacttcttgaacgagctggagctgacgtagttgagtgtgcatgcctcattggccttcctaagtataagaatttctacaagctcaatggaaaaccagtttatatactggtggagtctcgcaaatag

SEQ ID NO: 11089 - protein, 212 aa, Oryza sativa (japonica cultivar-group)
MGEEDISNDSKSSCGCEDGTVEAPAAAAPKENGRAADPRLQAISDAIRVVPHFPKPGIMFNDITALLLRPAAFKDAVDMFVERYRGMRIAAVAGIEARGFIFGPAIALAIGAKFIPLRKPKKLPGEVISETYILEYGTDCLEMHVGATEPGERVVVVDDLVATGGTLCAAIKLLERAGADVVECACLIGLPKYKNFYKLNGKPVYILVESRK

SEQ ID NO: 11090 - DNA, 564 bp, Oryza sativa (japonica cultivar-group)
  CDS (1)..(564)
atggcagggtctgaggagaagaaggagatgcaagaccccaggacacaggccatagcatccaccattagagttgtgcccaacttccctaagccaggaataatgttccaagatatcacgaccctacttctaaatccccctgtgttcaaggacaccatcgacttgttcgttgaacggtacactggcaaaggcatctccgttgttgctggggtcgaagctagagggtttattttcggtcctcccatagcgctcgctattggtgcaaaatttatcccactaagaaaacctaacaaacttccaggtgaggtgatgtcaaaggagtacgagctggagtatggcgccgactgcttggaaatgcacgtcggcgcggtacagcccggcgagcgagcactcgtcgtcgacgacctcgtcgccaccggcggcacgctctgtgccgccatcgtcttgcttgagcgtgctggtgcagaagtggtggagtgtgcatgtgtgattgagctcccggaactgaagggtcgtgagaggctcaatgggaagccactgtacgttctggtggagtctcactcctag

SEQ ID NO: 11091 - protein, 187 aa, Oryza sativa (japonica cultivar-group)
MAGSEEKKEMQDPRTQAIASTIRVVPNFPKPGIMFQDITTLLLNPPVFKDTIDLFVERYTGKGISVVAGVEARGFIFGPPIALAIGAKFIPLRKPNKLPGEVMSKEYELEYGADCLEMHVGAVQPGERALVVDDLVATGGTLCAAIVLLERAGAEVVECACVIELPELKGRERLNGKPLYVLVESHS

SEQ ID NO: 11092 - DNA, 723 bp, Oryza sativa (japonica cultivar-group)
  CDS (1)..(723)
atgacctcgccgccgccgccgccgtcgtcgttgctccgccgcctcccgaccacgcgctgctgctgctttgcctccgcgtcgagcggctggagcgcgagtgcgagcgtgcggctcggatccctcggcgggaagcagcggcgggggcatcgcggcgtggcggtgatggcggcggcggcggcagggggaggaggcttcgaggcgcgcgtggcgcggatcgcgtccaccatccgcgtcatccccgacttccccaagccagggattatgtttcaagatatcacaacaatgcttctcaagccagatgcatttcgtgacacgatcgagctcttcgttgagcgatacaaggacaaagggatcactgtaattgctggtgttgaagctagaggattcatttttggtccgcccattgctttagcactaggtgcaaaatttgttccattgaggaagccaaaaaagttacctggtgaggtgatctcggaagaatattctttggaatatggtacagataaaatagaaatgcatgtaggagctgtggagccaaatggccgggccgttgttgttgatgatctaatcgctacaggtggaaccttatctgcagccgttaaacttattgagcgtgctggagcagaggttgttgagtgcgcatgtgtcattgaactaccagaactgaagggtcgggacaagctggggaacaagccagtttttgtccttgtgaaggcagactaa

SEQ ID NO: 11093 - protein, 240 aa, Oryza sativa (japonica cultivar-group)
MTSPPPPPSSLLRRLPTTRCCCFASASSGWSASASVRLGSLGGKQRRGHRGVAVMAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 11094 - DNA, 546 bp, Saccharomyces cerevisiae
  CDS (1)..(546)
atgtctatttctgaatcttacgcaaaggaaataaaaactgcatttaggcagttcactgactttcccatagagggtgagcaatttgaggattttttacctattattggcaaccccacgctattccaaaagttggtacacacgttcaagacgcatttagaagaaaagttcggcaaagaaaagatcgactttattgcaggtatagaagctagaggccttctatttgggccatccctagcactggcattgggagttggatttgttccaataaggagagttggaaaattgccgggtgagtgtgcttctataacattcacaaaattagaccatgaagaaatttttgaaatgcaggttgaagccattccctttgattccaacgtggttgtcgtggatgatgttctcgccaccggtggaacggcatatgctgcgggcgaccttatcagacaagtgggtgctcatattctggaatatgactttgtgctagtgttagatagtctacatggtgaggagaaattatctgctcctattttttccatattgcactcctga

SEQ ID NO: 11095 - protein, 181 aa, Saccharomyces cerevisiae
MSISESYAKEIKTAFRQFTDFPIEGEQFEDFLPIIGNPTLFQKLVHTFKTHLEEKFGKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 11096 - DNA, 549 bp, Arabidopsis thaliana
  CDS (1)..(549)
atgtctgagaacgaagtcaaggatcctcgtatcgatggtatcaaaactaagatccgtgtcgttccagattttcccaagaaaggtataatgttccaagacataacaacactgctgctagatcctaaagcctttaaagacaccattgatctgtttgttgagaggtatcgagacatgaacatctcggtggttgcaggtatagaggctcgcggtttcatattcggttcacccatcgcattagccatcggagcaaaatttgttcctcttcgtaaaccaaagaaattgccgggccaaataatatttgaagagtatgagttggagtacggaagtgaccggttggaaatgcatgttgaagctgtagattccggtgatagagcattggtcgtagatgatctgattgctaccggcgggactctttgtgctgccatgaatttgctcaagcgagttggagcagaagtaattgaatgtgcatgtgtcatcgagttacctgaactaaagggaagggagagattagaagggaagccattgtatgtgctcgttgagtatcgatga

SEQ ID NO: 11097 - protein, 182 aa, Arabidopsis thaliana
MSENEVKDPRIDGIKTKIRVVPDFPKKGIMFQDITTLLLDPKAFKDTIDLFVERYRDMNISVVAGIEARGFIFGSPIALAIGAKFVPLRKPKKLPGQIIFEEYELEYGSDRLEMHVEAVDSGDRALVVDDLIATGGTLCAAMNLLKRVGAEVIECACVIELPELKGRERLEGKPLYVLVEYR

SEQ ID NO: 11098 - DNA, 552 bp, Arabidopsis thaliana
  CDS (1)..(552)
atgtcgggaaacaaagaagaagaggatcctcgtatccatggaatcaaaactaagatccgtgtcgttccagattttcccaagaaaggaataatgtttcaagacataacaacagtgttgttggatccgaaagccttcaaagacacaattgatctgtttgtggagaggtacagagacaagaacatctcagtggttgcaggaatagaggctcgtggtttcctattcggtccaccgatcgcgctagccattggagcaaaatttgttcctctgcgcaaacccaagaaactacctggtgaaacaatatttgaggaatacgagttggaatatggaaatgaccgcctagagatgcacataggagccgtcgaggctggcgatcgagctttggtcgttgatgatcttatcgcgactggtggtactctctgcgctgccattaacttgctcgagagggttggagcagaagttgtggaatgtgcatgtgtgatcgagttacccgaattaaagggaaggcagagacttaaggggaagccactatgtatgcttgtggagtaccgatga

SEQ ID NO: 11099 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRALVVDDLIATGGTLCAAINLLERVGAEVVECACVIELPELKGRQRLKGKPLCMLVEYR

SEQ ID NO: 11100 - DNA, 576 bp, Arabidopsis thaliana
  CDS (1)..(576)
atgtttgcggcggagaatggtctcaaaggagatccaaggcttgaagctatatcagcagccattagggttgtccctaatttccctaagaaagggattatgtttcaggacataactacgttgttactggatcacaaggcgtttaaacacacaattgatatcttcgtagatcgttacaaagacatgcaaatctctgtcgttgctggagttgaagcaagaggtttcttgtttggtccttccattgcattagccatcggcgcaaagtttatccctttgcgtaaaccaggaaaattaccagggaaagtgatatcggagtcttatgagctcgagtatgggcatgaccgtttagagatgcatgttggcgctgttgagccacgcgaacgcgtcattatcattgatgatcttgttgctactggcggcactctttctgccgcaatgagcctattggagagccaaggagctgaagttgttgagtgtgcttgtgttattggcttgcctgaagtcaaggggcaacacaagctcaaagggaagccgctttatgtgttggtggagcctagtggattagatgagttctgttag

SEQ ID NO: 11101 - protein, 191 aa, Arabidopsis thaliana
MFAAENGLKGDPRLEAISAAIRVVPNFPKKGIMFQDITTLLLDHKAFKHTIDIFVDRYKDMQISVVAGVEARGFLFGPSIALAIGAKFIPLRKPGKLPGKVISESYELEYGHDRLEMHVGAVEPRERVIIIDDLVATGGTLSAAMSLLESQGAEVVECACVIGLPEVKGQHKLKGKPLYVLVEPSGLDEFC

SEQ ID NO: 11102 - DNA, 558 bp, Lactococcus lactis subsp. lactis Il1403
  CDS (1)..(558): transl_table=11
atgttagaaaaaaggagcactgacaattctgtcagtaacaaaaacatggaattaaaagactatattgcaacaattgaaaactatcctaaagaaggcgtagtttttcgcgacatcagccctttgatggcagacggaaatgcctataactatgctgctaccgaaattgttcagtatgcaagagataaagaaatagatatggttgtaggtccagaagcacgtggtttcatcattggatgtccagttgcttttgcacttggtgtaggatttgccccagttcgtaagcctggtaaattacctcgtgaagtcattgaagcaacttacgaaaaagaatacggaacagacacactcacaatgcattcagatagcatcaaaccaggacaacgtgtcttgattgttgatgatttgcttgcaactggtggaacaattgccgctacaattgaacttgttgaaaaaatgggtggaattgttgttggatgtgcattccttatcgaacttgatgaacttaaaggtcgcgaaaaaatcggagattacgattataaagttctaatgcactattaa

SEQ ID NO: 11103 - protein, 185 aa, Lactococcus lactis subsp. lactis Il1403
MLEKRSTDNSVSNKNMELKDYIATIENYPKEGVVFRDISPLMADGNAYNYAATEIVQYARDKEIDMVVGPEARGFIIGCPVAFALGVGFAPVRKPGKLPREVIEATYEKEYGTDTLTMHSDSIKPGQRVLIVDDLLATGGTIAATIELVEKMGGIVVGCAFLIELDELKGREKIGDYDYKVLMHY

SEQ ID NO: 11104 - DNA, 600 bp, Neisseria meningitidis Z2491
  CDS (1)..(600): transl_table=11
atggcgttaaaaacatcaaacttggaacacgcaatgctggttcatcccgaagctatgagtgtcggtgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttggttgccacgggcggcacgatgcttgccggactggagctgatccgcaaactcggcggggaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 11105 - protein, 199 aa, Neisseria meningitidis Z2491
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 11106 - DNA, 597 bp, Agrobacterium tumefaciens str. C58
  CDS (1)..(597): transl_table=11
ttgatagggtggcccgaacttcctgatccatttcccattttaactggaaataccatgaccgttatcgcttcggagctttccgctgccatccgttccattcccgactatccgaagccgggcatcatcttccgggacatcacgacgctgctcggcaacccgcgcgcatttcgccgcgccgtcgatgaactcgtgcagccctatgcgggaacgaagatcgacaagatcgccggcatggaagcgcgcggcttcattctgggcggggcggtggcgcatcagctttcggccggtttcgtgccgatccgcaagaagggcaagctgccgcacaccaccgtgcgggtcgcctacagcctggaatatggtgtcgacgaaatggagatgcatgtggatgccgtacagccgggcgagaaggtcattcttgtcgacgacctgatcgccaccggcggcaccgccgaaggtgccgtgaagctcttgcgacagatgggtgcggaaatcgtatccgcctgcttcgtcatcgacctgcctgatctcggcggccgcaagaagctggaagatcttggcgtcgacgtgcgcacgctggtagaattttctggccattga

SEQ ID NO: 11107 - protein, 198 aa, Agrobacterium tumefaciens str. C58
MIGWPELPDPFPILTGNTMTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 11108 - DNA, 531 bp, Streptococcus pneumoniae R6
  CDS (1)..(531): transl_table=11
ttgaaagaaagaaaaaagatgaatttaaaagattacattgcaacaattgaaaattatccaaaggaaggcattaccttccgtgatattagtcctttgatggctgatggaaatgcttatagctacgctgttcgtgaaatcgttcagtatgctactgacaagaaagtcgacatgatcgtgggacctgaagctcgtggatttatcgtgggttgtccagttgcctttgagttgggaattggttttgcgcctgttcgtaagccaggtaaattgccacgcgaagttatttctgctgactatgaaaaagagtacggtgtcgataccttgactatgcacgcggatgccattaagccaggtcaacgtgttcttattgtagatgaccttttggcgacaggtggaactgttaaggcaactatcgagatgattgaaaaacttggtggtgttatggcaggttgtgccttccttgttgaattggatgaattgaacggccgtgaaaaaattggtgactacgactacaaagttcttatgcattattaa

SEQ ID NO: 11109 - protein, 176 aa, Streptococcus pneumoniae R6
MKERKKMNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 11110 - DNA, 696 bp, Ralstonia solanacearum GMI1000
  CDS (1)..(696): transl_table=11
atggcggctgccgtgcaccgtgcctgccgcattgtggtgcggcgccatccgggccgggtggtagccggctaccgcatcgccttttctctttctgtttcagcaatgaccgacgccagcatctctccgtcctcgcccgttcctgcctcgaccgaactgggcgatgtgacgcgctacctgcgcgagcgcatccgcaccgtgcccgactggccgcagctgggggtgatgttccgcgacatcacgccgctgctgcaggacccgaagagcctgcgcgtgctggtggacgtgttcgtccatcgctatatgggacaggggctgaacctggtggcgggcatcgatgcgcgcggcttcatcctcggctccatcgtcgcgtacgagctgaacctgggcttcgtgccgatccgcaagaagggcaagctgccgttcaccaccgtggccgaggagtacatgctggagtacggcagcgccacggtggagatccacgccgacgcctgcaagcccggcgaccgcgtgctgctgatcgacgacctgatcgccaccggcggcaccatgatggccggcaagcgcctgctggagcggctgggcgcgacggtggtggagggcgcggccatcgtcgacctgcccgaactgggtggctcgcgcctgctgatggacggcggcctgccgctctttaccgtgtgccgcttcgacgggcattga

SEQ ID NO: 11111 - protein, 231 aa, Ralstonia solanacearum GMI1000
MAAAVHRACRIVVRRHPGRVVAGYRIAFSLSVSAMTDASISPSSPVPASTELGDVTRYLRERIRTVPDWPQLGVMFRDITPLLQDPKSLRVLVDVFVHRYMGQGLNLVAGIDARGFILGSIVAYELNLGFVPIRKKGKLPFTTVAEEYMLEYGSATVEIHADACKPGDRVLLIDDLIATGGTMMAGKRLLERLGATVVEGAAIVDLPELGGSRLLMDGGLPLFTVCRFDGH

SEQ ID NO: 11112 - DNA, 555 bp, Rhizobium etli
  CDS (1)..(555): transl_table=11
atgattgtagctgttccaaatagcggggcgtcacggattaaccaatccggtgtagaagcattacgagaatttcctaactttccgataggcgggatcttgttcaaggatatagcgcctatgctggctggtagaggtgcattgggcgaagtcgtttctaccgtcgcaagccaagtgtcgggaacagaaatcgatgccattttggcggttgatgcgcgtggtttcatcttgggcgcctcattggctgataggctcggttgcggtttcatcatggtaaggaaacccggtaaactgccgggggacgtcctctcatttgaatacagctgtgaatactgctccggaaccctggaggtaactgccggcctcatcggtgacggcctgcgatgcctgattgctgatgaccttctagcgacgggtggcactgctcgggcgactgggaattttgtcaagtcccaaggcggagagatcgccggatacgcattcatactcgaaatcgaagttttgaaaggcaggcgtcaattggacgacgcaccagtgatcagtgcgatgacgtgctag

SEQ ID NO: 11113 - protein, 184 aa, Rhizobium etli
MIVAVPNSGASRINQSGVEALREFPNFPIGGILFKDIAPMLAGRGALGEVVSTVASQVSGTEIDAILAVDARGFILGASLADRLGCGFIMVRKPGKLPGDVLSFEYSCEYCSGTLEVTAGLIGDGLRCLIADDLLATGGTARATGNFVKSQGGEIAGYAFILEIEVLKGRRQLDDAPVISAMTC

SEQ ID NO: 11114 - DNA, 561 bp, Brucella suis 1330
  CDS (1)..(561): transl_table=11
ttgaaaggactgaaaatggaatccgggtttaaggtcaccttgaaggatgcgatcagaaccattccggattatccgaaacccggcgttcaattccgcgacgtcaccacgctcatgggcaatgcgcaggcctttcgccgcgccgtcgatgaactggtctatccctatgcgggtaacaggattgacaaggtggcggggatcgaggcgcgcggttttattcttggcggtgcaattgctcaccagctttcggcgggcttcgtgccaatccgcaagaagggcaagctgccgcgcgatacggtgcgcatcgcatacagtcttgaatatggcgtcgatgaaatggaaatgcatcgtgacgccattgaaaagggtgagcgtgtcgttctcgtggatgatctgattgcaacgggtggaacggcggaagctgctgccaagcttctgctccagatgggagcggaaattgttgccgcctgctttatcattgacctgccggacttaggcgggcgaaagaagctggaggcgcttggcctgccggtgcgcacccttgtcgcgtttgaaggcgattga

SEQ ID NO: 11115 - protein, 186 aa, Brucella suis 1330
MKGLKMESGFKVTLKDAIRTIPDYPKPGVQFRDVTTLMGNAQAFRRAVDELVYPYAGNRIDKVAGIEARGFILGGAIAHQLSAGFVPIRKKGKLPRDTVRIAYSLEYGVDEMEMHRDAIEKGERVVLVDDLIATGGTAEAAAKLLLQMGAEIVAACFIIDLPDLGGRKKLEALGLPVRTLVAFEGD

SEQ ID NO: 11116 - DNA, 594 bp, Corynebacterium efficiens YS-314
  CDS (1)..(594): transl_table=11
gtgaccgaaaccgacatggatagcggtagggacagcggcaacgacagcggcagtgtcaacatggccagggcgcgtgtcgccctcaccgagcacacccgctatgtgcacgatttccctgcagagggtgtcctgttcgaggatctcaccccggtactggccaatgccgaggccttcgccgctgtggtggatgcacaggcggaggccgccgaggagctcggggccgagatcatcggcgggttggatgcccgtggattccttctgggttcggccgtggcctacaagctgggtctcggtgtgatcgccatccgtaagaagggcaagctgcccccgccggtggtcacccaggattatgacctggagtacggttccgcggcgttggagctgcccgcggaggggttggatcttgagggtcggagggttgtgctcatcgatgatgtgctcgccaccggcgggacactcgcggcagcacgtaaactgattgaaacatgtggtggcaatgtcaccggttatgttctcgccattgaggtcggtggcctcggtggtcgggaacgtctgggagacatcccggtccatgtgatcagggatccgcagtag

SEQ ID NO: 11117 - protein, 197 aa, Corynebacterium efficiens YS-314
MTETDMDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 11118 - DNA, 606 bp, Escherichia coli CFT073
  CDS (1)..(606): transl_table=11
ttgatacgttcaaaacgcgccgtgagtaccaccgtaacaagcaggcatacacttatgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagtggtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggaaatccacgttgatgccatcaaaccgggcgacaaagttctggtggtggacgatctgctggcaaccggcggcactatcgaagcgaccgttaaactgatccgtcgtctgggtggtgaagtagctgacgctgcgttcattatcaacctgttcgatctcggcggcgaacagcgtctcgaaaaacagggcattaccagctacagccttgtcccgttcccgggccattaa

SEQ ID NO: 11119 - protein, 201 aa, Escherichia coli CFT073
MIRSKRAVSTTVTSRHTLMTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 11120 - DNA, 552 bp, Arabidopsis thaliana
  CDS (1)..(552)
atggcgactgaagatgtgcaagatcccagaatcgctaagattgcctcttccattagagtcatccccgacttccctaaaccaggaatcatgtttcaggacataacgacgcttcttctcgacactgaggcctttaaggatactattgctttgtttgttgatagatacaaagataaaggcatatctgttgttgcaggtgttgaagctagaggtttcatttttggccctcctattgcgttggctattggtgccaaatttgttcccatgaggaagcccaagaagctacctgggaaggttatttcggaggagtattcgttggagtatggaacagatacgattgagatgcacgtaggtgcagtagagcctggtgagcgtgctattattattgatgacctcattgccacgggtgggactctcgctgctgcaatccgactacttgaacgagtaggagtgaagattgttgaatgtgcttgcgtaattgagttaccagagcttaagggaaaggagaaactaggagagacgtcgctatttgttcttgtaaagtcggctgcttaa

SEQ ID NO: 11121 - protein, 183 aa, Arabidopsis thaliana
MATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 11122 - DNA, 651 bp, Magnaporthe grisea 70-15
  CDS (1)..(651)
atgtcctccaccgatcccaccacaaccggccaaaccgcccaagatgcctcgcgacagcagcccaccgccgccgcctcctcctcctccgaactcgccagtgctaagataaccttgtacaaggtgctgcggcgctttgccgacttccccatcgagggcatcgtctttattgacattatgcccatctttatcgacccgaaagcccacctcgccctcctccgcgccctcgagcttcaggtcctttcgtcctttgcacccgctaccgccaagcccgacgtcgtcgtcggtctcgatgcgcgcggcttcctgttcggcccctcgctggccctgaagctcgacgcttcctttgtgcccgtccgcaaaaagggcaagctgcccgggccctgcgtcacggctacatacgagaaggagtatggccaggactttttccagatgcaggagggtgccatcaagccaggacaaaaggttctggtcgtggacgacatcattgcaactggtggctcggctgctgctgctggtgagcttgtcaagaagcttggcggcgagctcatgggctacttgttcctcctcgagattgcacctctcaagggaagggaaaagctcggtggcgtccccgtagtcactttgctcgaggaggccgactatccccactaa

SEQ ID NO: 11123 - protein, 216 aa, Magnaporthe grisea 70-15
MSSTDPTTTGQTAQDASRQQPTAAASSSSELASAKITLYKVLRRFADFPIEGIVFIDIMPIFIDPKAHLALLRALELQVLSSFAPATAKPDVVVGLDARGFLFGPSLALKLDASFVPVRKKGKLPGPCVTATYEKEYGQDFFQMQEGAIKPGQKVLVVDDIIATGGSAAAAGELVKKLGGELMGYLFLLEIAPLKGREKLGGVPVVTLLEEADYPH

SEQ ID NO: 11124 - DNA, 648 bp, Gibberella zeae PH-1
  CDS (1)..(648)
atgagcgcccaagatcccctctcctctaccaacccatcgtcagtgacaaacaacactcaagatgcctcgggacgacagccctcctccgccgccgccggttcctccgaactctccagtgcaaagataagcctgcgcaagtcgctgcgcagcttccccgacttccctatcccgggaatcaactttgtcgacattatgcctcttttcgccgacccaactgctcatgccacccttgtcgaggctctcgaactccagatcgccgaggctttccctaccaagcctgatgttatcgttggcctcgacgcccgtggcttcctattcggtcctggacttgcgctccgtctcggcgttcctttcgctgccgttcgcaagcagggcaagcttcccggtccctgcgttactgctgagtacatcaaggagtacggcaaggatcttttccaaatgcaggaagacgctgtccgcgagggccagaaggtcctgattgtggacgatatcattgccaccggcggttccgcaaaggctgcagctgaactcgtccaacagcttaagggcgaggtcatgggatacttgttcatccttgaaatccctggactcaacggtcgtgataagcttggtgcccctcctaccaagattctccttgaagacgcatag

SEQ ID NO: 11125 - protein, 215 aa, Gibberella zeae PH-1
MSAQDPLSSTNPSSVTNNTQDASGRQPSSAAAGSSELSSAKISLRKSLRSFPDFPIPGINFVDIMPLFADPTAHATLVEALELQIAEAFPTKPDVIVGLDARGFLFGPGLALRLGVPFAAVRKQGKLPGPCVTAEYIKEYGKDLFQMQEDAVREGQKVLIVDDIIATGGSAKAAAELVQQLKGEVMGYLFILEIPGLNGRDKLGAPPTKILLEDA

SEQ ID NO: 11126 - DNA, 573 bp, Candida glabrata CBS 138
  CDS (1)..(573)
atgtctattgaatcatatgccaaggacttgaaggctgcccttcatcaatacccaaacttcccttctgaaggtattttgtttgaggatttcctaccaatcttcagagaaccacaactattccagaagttggtcgacgcattcaagatgcacctggaagagacattcactgaaaagaaggtcgattacatcgtcggtctggagtctcgtgggttcttgttcggcccaagcttggctttagccatgggcatcggctttgtcccagttagaaaagctggtaagctgcctggtgaatgtgtcaaggctgtttacgaaaaggaatacggttctgatgaattcgaaatgcaaaagcatgctatcccagccggtgctaacgttgtcattgttgatgatattatcgctaccggtggttctgctggtgccgctgaagaactgatcaagaagattggtgctaacgttctagaatacgacttcgtaatggaattggatttcctaaagggcagagataagctaaacgccccagttttcaccttgttgagctctcaaaaggaagctcttcaaaagccatctgcttaa

SEQ ID NO: 11127 - protein, 190 aa, Candida glabrata CBS 138
MSIESYAKDLKAALHQYPNFPSEGILFEDFLPIFREPQLFQKLVDAFKMHLEETFTEKKVDYIVGLESRGFLFGPSLALAMGIGFVPVRKAGKLPGECVKAVYEKEYGSDEFEMQKHAIPAGANVVIVDDIIATGGSAGAAEELIKKIGANVLEYDFVMELDFLKGRDKLNAPVFTLLSSQKEALQKPSA

SEQ ID NO: 11128 - DNA, 591 bp, Candida glabrata CBS 138
  CDS (1)..(591)
atggagatggaggaagtgtctgttgtggaagaatgtaggcgggaactacgatctgcgttacaccagtatccgaactttcctacacaaggtgttctcttcgaggattttatgactatatttcagaatccctcattatttaaaactctaattaatacattgaaaagccatttgaatgaagagttccccaatggcgagatagattacattgttggtattgagtcccggggatttttatttggaccgactctcgcattagcaatggatgtaggtttcgtgcccataagaaaagctggcaagctgcccggtgagcttgttagagctgattgtgagaaagaatatggatctgcaacatatgagctacaaaaagaggcgataccgaagggttccaatgtagttcttatagatgatgtcctggcaaccggtggatccgcaactgctgcaactcaattattaatgagtgtcggatcaaatatattagagtattgtttcttaatggaactggatttcctgaagggtaaattgaaattgaatgatgctccagttttctctcttctacatactcaggaagaaggcctaaagaggagcccatga

SEQ ID NO: 11129 - protein, 196 aa, Candida glabrata CBS 138
MEMEEVSVVEECRRELRSALHQYPNFPTQGVLFEDFMTIFQNPSLFKTLINTLKSHLNEEFPNGEIDYIVGIESRGFLFGPTLALAMDVGFVPIRKAGKLPGELVRADCEKEYGSATYELQKEAIPKGSNVVLIDDVLATGGSATAATQLLMSVGSNILEYCFLMELDFLKGKLKLNDAPVFSLLHTQEEGLKRSP

SEQ ID NO: 11130 - DNA, 645 bp, Aspergillus nidulans FGSC A4
  CDS (1)..(645)
atgtcccaacataccgcttccacatcccccgatgcctcctccaccacccaagtcgccggacacccctcctccgctacctcccgcgccgccgaactcgccagtcttaaggtaaagctgcgcggtgcgctgcgccagtttcctgacttcccgtcccccggcatcctcttcgaagatatccttcccatcttctccgatcactccacccacgaagccctcgttcgctgccttgagctccacatcctagaaactcttgcggatgagaagcccgatgttatcgtcggcctagaggcccgaggattcctcatgggccctagcctcgctctaaaactcggcgccggttttgtccctgttcgcaagcggggcaagcttccgggtccatgcgagacgcagggctacgagaaggaatatggtcaggacttcttccagatgcagtccgatgctatcaagcctggccagaaggtgatcgtgattgacgatatcatcgcaacaggcggctcggcttacgcagcgggagagctcattaagaaaatgggtggtaatgtgctgggatttgtcttcttgctcgaactggaattccttcacggccgggacaagctgtctgcgcccgttcacaccctgctcactggccaggaaacgaaagcgtaa

SEQ ID NO: 11131 - protein, 214 aa, Aspergillus nidulans FGSC A4
MSQHTASTSPDASSTTQVAGHPSSATSRAAELASLKVKLRGALRQFPDFPSPGILFEDILPIFSDHSTHEALVRCLELHILETLADEKPDVIVGLEARGFLMGPSLALKLGAGFVPVRKRGKLPGPCETQGYEKEYGQDFFQMQSDAIKPGQKVIVIDDIIATGGSAYAAGELIKKMGGNVLGFVFLLELEFLHGRDKLSAPVHTLLTGQETKA

SEQ ID NO: 11132 - DNA, 648 bp, Ustilago maydis 521
  CDS (1)..(648)
atggctcttcacattggaactctgctcgcattgttgctgatcattctccatctttggttggctgtgatctcaggtttctacgacgactaccccaagaagggcattcgattctgcgacattcttcccgtccttcgcgatccgttggcgttcgaattgctcctcaccaacattgtctcgcacatctttacgcacaccatcccttcgctcgacgacgacacgccagcgcctgctgcgcccacccctctcgaaccgggtgccaagtcgtacggcaaccgcaagatcgatgcagtcgtaggtctcgacgctcgaggcttcttgctcggccccgccatcgcccagcgactcgggtgtggattcgtccccgtccgcaaagtcggcaagcttcccggcgagtgcgtccaggcttcctaccaaaaggaatacggagaggacgtgttcgaaatgcaaaaggaagccttggctcccaactcgcgcgtattggtcattgacgatctcatcgctaccggcggttcggcaaaggctgctggagaactggtcaacaagtgcggaagcaaggtggtcgagtacgtcttcgtcgtagccattcctttcctcaagggagctgaccagctcgatgctccttcgtatcaccttgtcgaagtcgactaa

SEQ ID NO: 11133 - protein, 215 aa, Ustilago maydis 521
MALHIGTLLALLLIILHLWLAVISGFYDDYPKKGIRFCDILPVLRDPLAFELLLTNIVSHIFTHTIPSLDDDTPAPAAPTPLEPGAKSYGNRKIDAVVGLDARGFLLGPAIAQRLGCGFVPVRKVGKLPGECVQASYQKEYGEDVFEMQKEALAPNSRVLVIDDLIATGGSAKAAGELVNKCGSKVVEYVFVVAIPFLKGADQLDAPSYHLVEVD

SEQ ID NO: 11134 - DNA, 537 bp, Cryptococcus neoformans var. neoformans B-3501A
  CDS (1)..(537)
atgtctgacgtagcgtacatcaagtctcttctcggtgtccaccccgacttccccaagaagggcatcaccttccttgacatcttccccatccttcgcgaccctatcgcctttgagaccctcattactcatttcgtgtctcacatcttcaacacccacaaagtgaagcccgatgtcatcgtgggtcttgatgcccgaggcttcctcctcggtcccgtcatcgctatgcgtttgggtgctgcttttgtccctgtgagaaaggccggcaagttgcctggttctgtcgaggttgtaacgtatgagaaggagtacggagtggaccagtttgagatgcagtctgatgctgttacccccggacaaaaattcatcatcatcgatgacttgattgcaaccggtggatcagcagccgctgctggagagcttgtcaagaaatctggaggcgaaacccttgaatacctcttcatcgtcggcttgcccttcctcaaaggtcatgaaaagcttgatgccccggtctactccatgatcgaagccgaggactaa

SEQ ID NO: 11135 - protein, 178 aa, Cryptococcus neoformans var. neoformans B-3501A
MSDVAYIKSLLGVHPDFPKKGITFLDIFPILRDPIAFETLITHFVSHIFNTHKVKPDVIVGLDARGFLLGPVIAMRLGAAFVPVRKAGKLPGSVEVVTYEKEYGVDQFEMQSDAVTPGQKFIIIDDLIATGGSAAAAGELVKKSGGETLEYLFIVGLPFLKGHEKLDAPVYSMIEAED

SEQ ID NO: 11136 - DNA, 513 bp, Prochlorococcus marinus str. AS9601
  CDS (1)..(513): transl_table=11
atgaaaaaattagaagatttgattctcacttataaggattttccaaaaaaagggattgaatttaaggacgttctcgaaattcttcaatatccagatatttttcaggacataattttaaaaatgtcttcaaatcaattcctaaaaaaagctgaagcaataatttccatagatgcgaggggatttatttttggttcagcagttgctctagaatcatctaaacctatgattgtggcacgtaaacctgggaaactaccaggacagttattaacaagagaatatgatttggaatatgggaaaaattctctttcaatacaagttaatgccctgaaaaaatttaattcttttgtaatcgtagatgatttattagctacaggaggaacagttaaatctgtatcaaggttgattcgtgatcaaaagaagaaaatattgggattaataactgttgttgaattgaagagtttaaaaggcaaatctaagttggattttccagtacactcaatagttaccttatag

SEQ ID NO: 11137 - protein, 170 aa, Prochlorococcus marinus str. AS9601
MKKLEDLILTYKDFPKKGIEFKDVLEILQYPDIFQDIILKMSSNQFLKKAEAIISIDARGFIFGSAVALESSKPMIVARKPGKLPGQLLTREYDLEYGKNSLSIQVNALKKFNSFVIVDDLLATGGTVKSVSRLIRDQKKKILGLITVVELKSLKGKSKLDFPVHSIVTL

SEQ ID NO: 11138 - DNA, 516 bp, Prochlorococcus marinus str. MIT 9515
  CDS (1)..(516): transl_table=11
atggagaataagcttatagagttgattgaaacatataatgattttcctagaaaaggaattgaattcaaagatgttttaggaattattcaagaaccaaagatatttaaagaacttattttaaagatgtcatctagtcaaatcattagaaatgctgaggcaataatttctatagatgctaggggttttatttttggttctgcaatatccctggaagcctcaaaaccaatgatcgtagcaagaaagcctggtaagctcccaggagaactttcaaaaaaaaaatacagtttagaatatggtgagaattcactttcaatacaaaaaaaatgccttcagaaatataactcatatgcgattgttgatgatttattggctactggtggaacggtgagttgtgtttctaaattacttgagagtaatggtaaagaagttttaggattattagttgtcgttgaattgatgaagttgaaaggaagatttaaattgaagtttcctgttgaatcatcgataactttttga

SEQ ID NO: 11139 - protein, 171 aa, Prochlorococcus marinus str. MIT 9515
MENKLIELIETYNDFPRKGIEFKDVLGIIQEPKIFKELILKMSSSQIIRNAEAIISIDARGFIFGSAISLEASKPMIVARKPGKLPGELSKKKYSLEYGENSLSIQKKCLQKYNSYAIVDDLLATGGTVSCVSKLLESNGKEVLGLLVVVELMKLKGRFKLKFPVESSITF

SEQ ID NO: 11140 - DNA, 519 bp, Prochlorococcus marinus str. NATL1A
  CDS (1)..(519): transl_table=11
atggatcacttaaagaaatacattacagaaataaatgattacccgaaaaagggaatcgtcttcaaagacttaaacccaatatataaagagccaaaggcatggaaagaattaatgtttcctcttcagaacctgatatctactaaaaaacctgattatattgctggcatagaatcaagaggatttatttctgcatctgcattggcatttaagcttgagataggtttaattactattagaaaacctaataaattacctggagaagtaataggtactaattataagcttgagtacggtgaagacagattagaaatccagcaaaatataattgaaaaggatagtaagatactattatttgatgatttactagctacaggaggaacagcaggagcagctggtaaattgatcaaaaaagcaggtggtaatttaattggatatgcttttcttgtagagctaactgaacttaaagggagagaaaatttagattcaaatttattggtagaaaccctaataaagtattaa

SEQ ID NO: 11141 - protein, 172 aa, Prochlorococcus marinus str. NATL1A
MDHLKKYITEINDYPKKGIVFKDLNPIYKEPKAWKELMFPLQNLISTKKPDYIAGIESRGFISASALAFKLEIGLITIRKPNKLPGEVIGTNYKLEYGEDRLEIQQNIIEKDSKILLFDDLLATGGTAGAAGKLIKKAGGNLIGYAFLVELTELKGRENLDSNLLVETLIKY

SEQ ID NO: 11142 - DNA, 582 bp, Prochlorococcus marinus str. MIT 9303
  CDS (1)..(582): transl_table=11
gtggttgttgcattgaccatggctgcgatgatgccaggcctaaggcccctgcgtcaccactccttggatcttcgccacctcattcaagacataccagactttccaaaacctggaattctctttcgggacatcagtcccctgctgcgtgatcccgatggctggggtgaagtgatgcgacagctaggagatctctgcacagaattcaaacccgatttaattgtcggaatcgaatcacgtggattcattgtgggaacagctttagcaacgaatcggaaaatcggctttgttccggttaggaagcctggcaaattgcctggtgatgttcttggcatcgactattccctggagtacggcagcgatcggctcgagattcatgcggatgctctgcaaggtcatccccgtgtcttaatggtggacgaccttctggcgactggaggaactgcaaaagccacagtcgagttaatcgagcaggctggtggtgatctggtgggatgtggttttgtgatcgaattagccgctctcggcgggcgtcagcaacttccagttgagataccagtgaaatcactgattatctactcctga

SEQ ID NO: 11143 - protein, 193 aa, Prochlorococcus marinus str. MIT 9303
MVVALTMAAMMPGLRPLRHHSLDLRHLIQDIPDFPKPGILFRDISPLLRDPDGWGEVMRQLGDLCTEFKPDLIVGIESRGFIVGTALATNRKIGFVPVRKPGKLPGDVLGIDYSLEYGSDRLEIHADALQGHPRVLMVDDLLATGGTAKATVELIEQAGGDLVGCGFVIELAALGGRQQLPVEIPVKSLIIYS

SEQ ID NO: 11144 - DNA, 516 bp, Clostridium thermocellum ATCC 27405
  CDS (1)..(516): transl_table=11
atggatttaaaagctaaactaagagaagtgccggatttcccgaaggaaggtataaactttattgatattaccaccgtacttcaggatcctgaggctctaaaagagtgcattgattccatgaaaaagaaggtagagtcctttggggagtttgacattattgttggagctgaatccagaggattcatctttggggcaccgctggcatatgcattgggaaaaggttttgtacctatcaggaaaaagggaaagcttccgtacaagacaatcagtgttgaatatgagcttgagtatggcacggacatacttgagatgcatatagatgcaattaaaaagggtcaaagggtggttatcgtagatgaccttcttgcaacgggaggaactacaaaatcgaatataaagcttgtggaacagttgggaggagaaattctgggaatagtttattttgttgaacttactttcttaaacggaagagaaaaattgaaaggctacaatgttgagtccatagtccaatattaa

SEQ ID NO: 11145 - protein, 171 aa, Clostridium thermocellum ATCC 27405
MDLKAKLREVPDFPKEGINFIDITTVLQDPEALKECIDSMKKKVESFGEFDIIVGAESRGFIFGAPLAYALGKGFVPIRKKGKLPYKTISVEYELEYGTDILEMHIDAIKKGQRVVIVDDLLATGGTTKSNIKLVEQLGGEILGIVYFVELTFLNGREKLKGYNVESIVQY

SEQ ID NO: 11146 - DNA, 513 bp, Clostridium difficile 630
  CDS (1)..(513): transl_table=11
atggatttaaaaaactttataaggaatattgatgatttcccaaagccaggcatagattttaaagatgtgacaactctatttaaagatggagatgcatttaaatatgcagtggattctatagttgaagaattgaaagataaagatgtagatttagtaataggaccagaagcaagaggatttttgatgggtacacctgtagcatatgctttaggagtaggatttgttccaattagaaaacctggaaagttaccaggtgaagttgagagttatgagtatggattagagtatggtacagatactttagagatacataaggatgcaattaaaaagggtcaaaaagtagcaatagtagatgatttattggctactggtggaactatggaagccgctgccaagcttgtagaaaaattaggtggagaagtagtttctatgcaatttttgattgagctaaaattcttaaatgggagagaaaagttgtctaactatgatgttaattctcttataaaatactag

SEQ ID NO: 11147 - protein, 170 aa, Clostridium difficile 630
MDLKNFIRNIDDFPKPGIDFKDVTTLFKDGDAFKYAVDSIVEELKDKDVDLVIGPEARGFLMGTPVAYALGVGFVPIRKPGKLPGEVESYEYGLEYGTDTLEIHKDAIKKGQKVAIVDDLLATGGTMEAAAKLVEKLGGEVVSMQFLIELKFLNGREKLSNYDVNSLIKY

SEQ ID NO: 11148 - DNA, 519 bp, Prochlorococcus marinus str. MIT 9301
  CDS (1)..(519): transl_table=11
atgcttgaaaaaaatcttaaaaatactattaaaagttatccagattttcctaaaaagggaattttatttagggatatacttccggtttttcaaaatccaagtatttttaataaactgattgaatcaatgatagataaaaaaatttatcgaaaatctgaagctattttagcaattgatgctagaggttttttatttggatctgttatcgcatataagctatcaaaaccacttatcttggcaagaaagcctggtaaattaccaggcaaactatcaacttataaatatgatctagagtatggttctaattctctttctcttcaagatgattccataagaaatcttgataattttgtcattgttgacgacttattagctacaggaggcacagtaaatagtgtaagcaaaattttaaaagataaagataaaaatgttttaggtttaagtgttgttgttgaattaaaagatttaaatggaagatccaaacttaatttccctgtagaatcagaaattatttactag

SEQ ID NO: 11149 - protein, 172 aa, Prochlorococcus marinus str. MIT 9301
MLEKNLKNTIKSYPDFPKKGILFRDILPVFQNPSIFNKLIESMIDKKIYRKSEAILAIDARGFLFGSVIAYKLSKPLILARKPGKLPGKLSTYKYDLEYGSNSLSLQDDSIRNLDNFVIVDDLLATGGTVNSVSKILKDKDKNVLGLSVVVELKDLNGRSKLNFPVESEIIY

SEQ ID NO: 11150 - DNA, 567 bp, Burkholderia vietnamiensis G4
  CDS (1)..(567): transl_table=11
atgccgcattcgtcgtcgggcgcgccgctcgatccggtcgccttcatccacagccagatccgcacggtgcccgactggccgcagccgggcgtgatgttccgcgacatcacgacgctgctgcagagcccgaaggcgctgcgcatcctcgtcgacctgttcgtcgagcgctatgtcgatgcgaagctcgactacgtcgccggcctcgacgcgcgcggcttcatcatcgcgccgatcgtcgcttatgagctgagcgtcggcttcgtgccgatccgcaaggtcggcaagctgccgtacaagacgtgctcggaatcgtacgacctcgaatacggcagcgcgacggtcgagatccacgaggacgcgtgccgccccggcgaccgcgtgatcatcatggacgacctgatcgcgaccggcggcacgatgatggcgggacgcaacctgctgcagcggctcggcgcggtcgtcgtcgaaggcgcggcgatcatcgacctgccggacctcggcggctcgacgctgctgcgcaacgcagggctgccgatctacaccgtcaccgaattcgccggccactga

SEQ ID NO: 11151 - protein, 188 aa, Burkholderia vietnamiensis G4
MPHSSSGAPLDPVAFIHSQIRTVPDWPQPGVMFRDITTLLQSPKALRILVDLFVERYVDAKLDYVAGLDARGFIIAPIVAYELSVGFVPIRKVGKLPYKTCSESYDLEYGSATVEIHEDACRPGDRVIIMDDLIATGGTMMAGRNLLQRLGAVVVEGAAIIDLPDLGGSTLLRNAGLPIYTVTEFAGH

SEQ ID NO: 11152 - DNA, 519 bp, Streptococcus pyogenes str. Manfredo
  CDS (1)..(519): transl_table=11
atggatttaacaaattatattgcatcgatcaaagattaccctaaagctggtattacgtttcgagatatctcacctttaatggctgacggtaaagcatatagctatgctattcgtgaaatagcacagtacgcttgtgataaagatattgatatggttgttggacctgaagcgcgtggttttatcattggttgtcctgttgcagttgagttaggaattggttttgctcccgttcgtaaaccaggaaaactgccaagagatgttgtctctgccgattacgaaaaagaatatggtcttgataccttaactatgcatgcagatgctattaagcctggacaacgtgttttgattgtcgatgatttactagcgactggcggtacggtaaaagcaactattgaaatgattgaaaaacttggtggtattgtagctggttgtgcctttcttattgaattaaaaggtttaaatggacgccatgctattaggaactatgactataaagtcttaatgcagtttcctgggtaa

SEQ ID NO: 11153 - protein, 172 aa, Streptococcus pyogenes str. Manfredo
MDLTNYIASIKDYPKAGITFRDISPLMADGKAYSYAIREIAQYACDKDIDMVVGPEARGFIIGCPVAVELGIGFAPVRKPGKLPRDVVSADYEKEYGLDTLTMHADAIKPGQRVLIVDDLLATGGTVKATIEMIEKLGGIVAGCAFLIELKGLNGRHAIRNYDYKVLMQFPG

SEQ ID NO: 11154 - DNA, 600 bp, Neisseria gonorrhoeae FA 1090
  CDS (1)..(600): transl_table=11
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggctga

SEQ ID NO: 11155 - protein, 199 aa, Neisseria gonorrhoeae FA 1090
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 11156 - DNA, 537 bp, Bacteroides fragilis NCTC 9343
  CDS (1)..(537): transl_table=11
atgattatgagcaaagaaaagcttatcaaaagcatccgtgaggtacccgattttccaatccccggaatcctgttctacgatgtaaccacactattcaaagattcggaacgccttcaggaactttcggatattatgtacgaaatgtacaaggataaaggaatcaccaaggtagtaggcatcgaatcgagaggcttcattatgggaccgattcttgccacccgcttaggggcaggatttatccccatccgtaaacccggcaaactccctgccgaaacaatggaagaaagttacgataaagaatatggcaaagacaccgtgcagatacacaaagatgcattgaacgagaacgacgtcgtattgctgcacgatgacttactggctaccggaggtactatgaaagccgcctgcaacctcgtgaaaaagctccatccgaaaaaggtatacgtaaacttcatcattgagttaaaggaactgaacggaaaacaagtatttgaaaacgaccaagacgtagatatacaatcagtattgtcgttataa

SEQ ID NO: 11157 - protein, 178 aa, Bacteroides fragilis NCTC 9343
MIMSKEKLIKSIREVPDFPIPGILFYDVTTLFKDSERLQELSDIMYEMYKDKGITKVVGIESRGFIMGPILATRLGAGFIPIRKPGKLPAETMEESYDKEYGKDTVQIHKDALNENDVVLLHDDLLATGGTMKAACNLVKKLHPKKVYVNFIIELKELNGKQVFENDQDVDIQSVLSL

SEQ ID NO: 11158 - DNA, 549 bp, Pseudomonas fluorescens Pf-5
  CDS (1)..(549): transl_table=11
atggccttcgattccttcgacatcaaatccctgatccgccccgtcatcgacttcccgaaaccgggcgtgatcttccgcgacatcacccccctgttccagtctccccgggccctgcgcctggtggcggacagcttcgcccagcgttatgtcgaagaagacttcagccacatcggcgccatggacgcacggggttttctgatcggctcgatcatcgcctaccagttgaacaagccgctgatcctgttccgcaaacagggcaagctgccggccgacatcctggccgagggctaccggaccgagtacggcgaagccttcattgaagtccacgccgacagcttgtgtgaaggcgactcggtgctgttgatcgatgacctgatcgccaccggtggcaccctgatcgccgccgccaatctggtacggcgcatgggggcgaaggtctatgaagccgcggcgatcatcgacctgccggaactgggcggctcgcagaagctgcaggacatggggatcccgaccttctgcctgacccagttttccctgaccgaacgctag

SEQ ID NO: 11159 - protein, 182 aa, Pseudomonas fluorescens Pf-5
MAFDSFDIKSLIRPVIDFPKPGVIFRDITPLFQSPRALRLVADSFAQRYVEEDFSHIGAMDARGFLIGSIIAYQLNKPLILFRKQGKLPADILAEGYRTEYGEAFIEVHADSLCEGDSVLLIDDLIATGGTLIAAANLVRRMGAKVYEAAAIIDLPELGGSQKLQDMGIPTFCLTQFSLTER

SEQ ID NO: 11160 - DNA, 570 bp, Psychrobacter arcticus 273-4
  CDS (1)..(570): transl_table=11
atgagcgcaaacaccgctgttacggcagctgatactgcaacagagtcatcgaatacgctcaatagcgatcatccattttggcaaatcattcgcacagtaccagacttccccaaaatcggcattgatttttatgatattacaccgttactacgcagtcacattaatgaagtcattgatgcgctgcttgctgtattacctaaaggcataatggacgaggtagattgtctgggtgctgttgaagcccgcggattcgtgtttgcaagtttgttggcaggacgtttgggtaaaggtatgattttactacgcaaacccggcaagctaccgccgcctgttgccaataaagcctatgtgttagagtacggtaaagatacccttgagatgcaaaacaatttgccaccagagcgcgtgctattggttgatgatattttggcgacgggcggcacactgaccaccgcttatgagctatgtcaatcagtcaatcatacggtagtgggggcattggtcttattggatttggtgaatttacatggcgattttccagtgcctgtttatacggtattaaaggcgtaa

SEQ ID NO: 11161 - protein, 189 aa, Psychrobacter arcticus 273-4
MSANTAVTAADTATESSNTLNSDHPFWQIIRTVPDFPKIGIDFYDITPLLRSHINEVIDALLAVLPKGIMDEVDCLGAVEARGFVFASLLAGRLGKGMILLRKPGKLPPPVANKAYVLEYGKDTLEMQNNLPPERVLLVDDILATGGTLTTAYELCQSVNHTVVGALVLLDLVNLHGDFPVPVYTVLKA

SEQ ID NO: 11162 - DNA, 546 bp, Colwellia psychrerythraea 34H
  CDS (1)..(546): transl_table=11
atgaataaaacacagcaacaactacttatcaatgcaatccacactattccagattaccctgttgaaggcatcatgtttcgtgatgttactagtctattagaagacgccgaagcttttaagcttgtaatggagcttttagaaaacaaatataaaggtagaggctttactaaaatcgttggcacagaagctcgtggtttcctttttggtgcgccgttagcgttagccttgaatattggttttattccggtcagaaagccagggaagctcccccgtcctacctactctcaagcttatcagttagagtatggtgaagatattctagaaattcatcaagatgcattaacccctgaagataatgtattgattattgatgatttattggcgacgggtggtaccattgaggcgacaactaaactaattcgccgtctaggtgcacaagtgcaagaagcaggttttgttatctctttacctgatttaggtggagaggaacgtcttgcagagctaaatattactccttattctttgatacaatatcaaggtgaatag

SEQ ID NO: 11163 - protein, 181 aa, Colwellia psychrerythraea 34H
MNKTQQQLLINAIHTIPDYPVEGIMFRDVTSLLEDAEAFKLVMELLENKYKGRGFTKIVGTEARGFLFGAPLALALNIGFIPVRKPGKLPRPTYSQAYQLEYGEDILEIHQDALTPEDNVLIIDDLLATGGTIEATTKLIRRLGAQVQEAGFVISLPDLGGEERLAELNITPYSLIQYQGE

SEQ ID NO: 11164 - DNA, 549 bp, Pseudomonas syringae pv. phaseolicola 1448A
  CDS (1)..(549): transl_table=11
atgactttcgatcaatcgaacttcaagtccctgatacgcccggtcatagactttcccaagccgggcgtggtctttcgcgacatcacccccctctttcagtcgcccaaggctacccgtcaggtaatcgacagcttcgtgcagcgctatatagaagccgatttcagccatatcggcgtcatggacgcgcgtggttttctgattggttcggtggtggcgtatcaactcaacaagccgctggtgctgtttcgcaaacaaggcaaattgcctgccgacgtactctccgaggcctatcagaccgaatacggcgaagcgtatctggaagtgcatgccgacagtctgtgcgaaggtgactcagtcatcatgttcgatgacctgatcgcgacgggaggcacgctgatcgccgccgccaacctcatccgccgcatgggcgccgaggtacatgaagccgttgcgatcatcgacctgccggaactgggtggctccaagcgtcttaacgacctgaagatcccgacgttctgtctgaccgagtttgcgctggacgagcagtaa

SEQ ID NO: 11165 - protein, 182 aa, Pseudomonas syringae pv. phaseolicola 1448A
MTFDQSNFKSLIRPVIDFPKPGVVFRDITPLFQSPKATRQVIDSFVQRYIEADFSHIGVMDARGFLIGSVVAYQLNKPLVLFRKQGKLPADVLSEAYQTEYGEAYLEVHADSLCEGDSVIMFDDLIATGGTLIAAANLIRRMGAEVHEAVAIIDLPELGGSKRLNDLKIPTFCLTEFALDEQ

SEQ ID NO: 11166 - DNA, 531 bp, Thermobifida fusca YX
  CDS (1)..(531): transl_table=11
atgagcaccgacgtcagcacgctgatcgaccgctacgtccgtgacatccccgactatccgcagcccggggtggtcttcaaggacatcaccccgctgctgtcccaccccaccgcgctgcgcaccgccatcgacgcgctcgctgaacccctgctcggcagcgagatcgacctggtcgccggcttggaagcacgcggtttcatcttcgctgcccctgtcgcggtgcgcctaggggcggggttcgtcccgctgcgcaaagccgggaaactgcccgcggagactctcgccgagtcctatgatctggagtacggtactgccaccgtcgagatgcacgccgacgcggtacccccggggagccgagtgctgatcgtcgacgatgtgctcgcgaccgggggcacaggacgggccgcggtggaccttatccggcgagcgggtggtaccgtcgttggactctcagttcttctggaactcgggttcctcaagggacgcgagaaactggccgacgtcgaactgcgggcactggctactgtctga

SEQ ID NO: 11167 - protein, 176 aa, Thermobifida fusca YX
MSTDVSTLIDRYVRDIPDYPQPGVVFKDITPLLSHPTALRTAIDALAEPLLGSEIDLVAGLEARGFIFAAPVAVRLGAGFVPLRKAGKLPAETLAESYDLEYGTATVEMHADAVPPGSRVLIVDDVLATGGTGRAAVDLIRRAGGTVVGLSVLLELGFLKGREKLADVELRALATV

SEQ ID NO: 11168 - DNA, 519 bp, Prochlorococcus marinus str. NATL2A
  CDS (1)..(519): transl_table=11
atggatcacttaaaaaaatacattacagaaataaatgattacccgaaaaagggaattgtcttcaaagacttaaacccaatatataaagagcccaagatatggaaagaattaatgtttcctcttcagaacctgatatctactaaaaaacctgattatattgctggcatagaatcaagaggatttatttctgcatctgcattggcatttaagcttgagataggtttaattactattagaaaacctaataaattacctggagaagtaataggtactaattataagcttgaatacggtgaagacagattagaaatccagcaaaatataatggaaaaggatagtaagataatgttatttgatgatttactagctacaggaggaacagcaggtgcagcaggtaacttgatcaaaaaagcaggtggtaatttaattggatatgcttttcttgtagagctaactgaacttaaagggagagaaaatttagattcaaatttatttgtagaaaccctaataaagtattag

SEQ ID NO: 11169 - protein, 172 aa, Prochlorococcus marinus str. NATL2A
MDHLKKYITEINDYPKKGIVFKDLNPIYKEPKIWKELMFPLQNLISTKKPDYIAGIESRGFISASALAFKLEIGLITIRKPNKLPGEVIGTNYKLEYGEDRLEIQQNIMEKDSKIMLFDDLLATGGTAGAAGNLIKKAGGNLIGYAFLVELTELKGRENLDSNLFVETLIKY

SEQ ID NO: 11170 - DNA, 618 bp, Ralstonia eutropha JMP134
  CDS (1)..(618): transl_table=11
atgcgatgtgccggcgcgtggcgcaaccttcatttcaagatttccatggcagattccctcatccagtcccccgatctcggcgatgtcaccggatacctgcgcgaccgcatccgtaccgtgccggactggcccatgcccggcgtgcagttccgcgacatcacgccgctgctgcagaaccccaagacgctgcgcgtgctgatcgacgtcttcgtgcaccgctacatggacgcgcagctcgacctggtcgcgggcatcgacgcgcgcggtttcattctcggcgcgatcgtcgcgtacgaactgaacctcggcttcgtgccgatccgcaagaagggcaagctgccattccagaccgtggccgaggaatacgagctcgaatacggcagcgccacggtcgagatccacgccgacgcctgcaagcccggcgaccgcgtgctgctgatcgacgacctgatcgccaccggcggcaccatgatggccggccgcaagctgctcgagcgcctgggcgccaccgtggtggaaggcgcggcgatcgtcgacctgcccgaactgggcggttcgaagctgctgcagaatgcgggtttgcctctgttcacggtgtgccggttcgatggccactaa

SEQ ID NO: 11171 - protein, 205 aa, Ralstonia eutropha JMP134
MRCAGAWRNLHFKISMADSLIQSPDLGDVTGYLRDRIRTVPDWPMPGVQFRDITPLLQNPKTLRVLIDVFVHRYMDAQLDLVAGIDARGFILGAIVAYELNLGFVPIRKKGKLPFQTVAEEYELEYGSATVEIHADACKPGDRVLLIDDLIATGGTMMAGRKLLERLGATVVEGAAIVDLPELGGSKLLQNAGLPLFTVCRFDGH

SEQ ID NO: 11172 - DNA, 519 bp, Anabaena variabilis ATCC 29413
  CDS (1)..(519): transl_table=11
atggatttaaaatctctcattcgtgacatccctgattttcctaagcccggaattttatttcgagatatcactactctactgcgcgatcgccaaggattacgatatactattgactttttagcggaaaaatgctttgaagcaaacttagatatagattacgttattggtatggagtcacgggggtttatttttggtactcccttagcctataaattaggggctggttttattcctgtccgcaaaaaaggcaagttacccgcagcagttcactcgattgaatatgaactagagtatggcactgactgtttagaagtgcatcgggatgctttacatccagatagtcgagtattaattgtagatgatttaattgccacaggtggcacagccagcgccacagccaaactagtgcagcaaatcggctgcgaattagtggggtttgggtttattatcgagctacgggatttacaagggcgaaaacatctgcctgatgtacccattatttccttagtggaatattag

SEQ ID NO: 11173 - protein, 172 aa, Anabaena variabilis ATCC 29413
MDLKSLIRDIPDFPKPGILFRDITTLLRDRQGLRYTIDFLAEKCFEANLDIDYVIGMESRGFIFGTPLAYKLGAGFIPVRKKGKLPAAVHSIEYELEYGTDCLEVHRDALHPDSRVLIVDDLIATGGTASATAKLVQQIGCELVGFGFIIELRDLQGRKHLPDVPIISLVEY

SEQ ID NO: 11174 - DNA, 519 bp, Streptococcus agalactiae A909
  CDS (1)..(519): transl_table=11
atggatttaaataattacatcgcttcaattgaaaactatcctcaagaaggaattactttccgtgatatctccccattaatggctgatggtaaagcatatagctatgctgttcgtgaaattgtacaatatgctgctgataaagatattgatatgattgttggaccagaagctcgtggctttattgttggttgcccagttgcttatgctcttggtattggttttgctccagtccgtaaaccaggtaaattaccacgcgaagttatttcagctaactatgaaaaagaatatggtcttgatacattgacaatgcacgcagatgctattaaaccaggtcaacgtgttttaattgttgatgaccttttagctactggtggaacagtaaaagcgacaattgaaatgattgaaaaactcggtggcgttgtcgcaggctgtgctttcctagttgaacttgatggattaaatggccgtaaagctattgaaggttatgatactaaggtattgatgaactttccaggataa

SEQ ID NO: 11175 - protein, 172 aa, Streptococcus agalactiae A909
MDLNNYIASIENYPQEGITFRDISPLMADGKAYSYAVREIVQYAADKDIDMIVGPEARGFIVGCPVAYALGIGFAPVRKPGKLPREVISANYEKEYGLDTLTMHADAIKPGQRVLIVDDLLATGGTVKATIEMIEKLGGVVAGCAFLVELDGLNGRKAIEGYDTKVLMNFPG

SEQ ID NO: 11176 - DNA, 537 bp, Rhodobacter sphaeroides 2.4.1
  CDS (1)..(537): transl_table=11
atgacccacaagtcggtccgcgactatatccgcaccatcgtggacttcccgcacgaggggatcctgttccgcgacgtgaccacgctgtttgccgacccgcgcggcttccgcatcgccatcgaccagcttctggcgccctacgccgggatgcggttcgacaaggtggcggggctcgaggcccgcggcttcatcctcggcggcgcggtggcgcaccggctctcgacgggcttcgtgccgatccggaagaagggcaagctgcccggccgcaccatctcggtcagctaccagctcgaatatggcgaggcggtggtcgaggtgcatgacgacgcgatccaggcaggcgagaaggtgcttctggtcgacgatcttctggcgaccggcgggacggccgaggctgggatcaagctcatcgagcagctgggcggacaggtggtgggctgcgccttcgtggtcgatctgcccgacctcggcggccgcaagcggctcgaggcgatggggatggaggtccatgccctctgcgccttcgagggcctctga

SEQ ID NO: 11177 - protein, 178 aa, Rhodobacter sphaeroides 2.4.1
MTHKSVRDYIRTIVDFPHEGILFRDVTTLFADPRGFRIAIDQLLAPYAGMRFDKVAGLEARGFILGGAVAHRLSTGFVPIRKKGKLPGRTISVSYQLEYGEAVVEVHDDAIQAGEKVLLVDDLLATGGTAEAGIKLIEQLGGQVVGCAFVVDLPDLGGRKRLEAMGMEVHALCAFEGL

SEQ ID NO: 11178 - DNA, 513 bp, Carboxydothermus hydrogenoformans Z-2901
  CDS (1)..(513): transl_table=11
atggacctgaaaaaatacatttatgatattccggattttccaagtccggggattatctttcgggatattactccattgctgcaaaatcccgaaacttttcgccgaaccgtagaattattggccgaaaaggtagtagatttaaggcctacccacgtggtagcgattgagtcccggggatttatgtttggggctcctttagcttataagctgggacttggttttgtaccggtgcgcaaggaaggaaagttgccccgggaaagtattagtgtttcctatgatttggagtacggaaacaatactctggaaattcataccgatgcgttaaaaccgggggatcgagtggtaattgttgatgacgtcttagctaccggcggtacgatgaaagctaccgtggagctttgtgaacgattaggagccaaggtagaagcccttttgtttgtaattgaacttttagctctcgaagggcggaaaaaacttaccgggaaaaaggtaatctcgcttgttcaatattag

SEQ ID NO: 11179 - protein, 170 aa, Carboxydothermus hydrogenoformans Z-2901
MDLKKYIYDIPDFPSPGIIFRDITPLLQNPETFRRTVELLAEKVVDLRPTHVVAIESRGFMFGAPLAYKLGLGFVPVRKEGKLPRESISVSYDLEYGNNTLEIHTDALKPGDRVVIVDDVLATGGTMKATVELCERLGAKVEALLFVIELLALEGRKKLTGKKVISLVQY

SEQ ID NO: 11180 - DNA, 567 bp, Burkholderia sp. 383
  CDS (1)..(567): transl_table=11
atgccgcattcgtcgtcgggcgcaccgctcgatccggtcgccttcatccacagccagatccgcacggtgcccgactggccgcagccgggcgtgatgtttcgcgacatcacgacgctgctgcagagcccgaaggcgctgcgcatcctcgtcgacctgttcgtcgagcgctatgtcgatgcgaagctcgactatgtcgcgggcctcgatgcgcgcggcttcatcatcgcgccgatcgtcgcgtacgagctgagcgtcggcttcgtgccgatccgcaaggtcggcaagctgccgtacaagacgcgctcggaatcgtacgacctcgaatacggcagcgcgacggtcgagatccacgaagacgcatgccgccccggcgaccgcgtgatcatcatggacgacctgatcgcgaccggcggcacgatgatggcggggcgcaacctgctgcagcggctcggcgcggaagtcgtcgaaggcgcggcgatcatcgacctgcccgatctcggcggctcggcgctgctgcgcaacgcgggactgccggtttataccgtcaccgaattcgccggccactga

SEQ ID NO: 11181 - protein, 188 aa, Burkholderia sp. 383
MPHSSSGAPLDPVAFIHSQIRTVPDWPQPGVMFRDITTLLQSPKALRILVDLFVERYVDAKLDYVAGLDARGFIIAPIVAYELSVGFVPIRKVGKLPYKTRSESYDLEYGSATVEIHEDACRPGDRVIIMDDLIATGGTMMAGRNLLQRLGAEVVEGAAIIDLPDLGGSALLRNAGLPVYTVTEFAGH

SEQ ID NO: 11182 - DNA, 519 bp, Synechococcus sp. CC9605
  CDS (1)..(519): transl_table=11
ttggatcttcagtcgcacattcgctcaattccagactttcccaagcctggaattctgtttcgggacatcaacccgctcctgcggtcgcccgaggccatggccgaggtgatcagccagttcggccggatctgcgaccaggtgaagcctgatctgatcgtggggatcgaatcccgggggttcattttcggggcacctttggccagcgaccgacggcttggcttcgtgcctgtgcggaagcccggaaagctgcccggtgaggtggtcggtctggattacgccttggagtacggcaccgatcggctcgagattcaagccgatgcccttgaacattcaccccgggtcctggtggtggacgacttgctagccaccggtggaacggctgcagcgacgggacagctggtggagcaggccggtggttgcttggtgggcttcgcctttgtgatcgagctggaggggttcggaggccgtcgggcgttgcctgcgggccaacccgtggaagcgttgttgcgctacggctga

SEQ ID NO: 11183 - protein, 172 aa, Synechococcus sp. CC9605
MDLQSHIRSIPDFPKPGILFRDINPLLRSPEAMAEVISQFGRICDQVKPDLIVGIESRGFIFGAPLASDRRLGFVPVRKPGKLPGEVVGLDYALEYGTDRLEIQADALEHSPRVLVVDDLLATGGTAAATGQLVEQAGGCLVGFAFVIELEGFGGRRALPAGQPVEALLRYG

SEQ ID NO: 11184 - DNA, 516 bp, Geobacter metallireducens GS-15
  CDS (1)..(516): transl_table=11
atggatgaactcaaaaatataatacgtgacatacccgatttccccaaaaaagggattgtctttaaggatatcacgacgcttctcgcagatgcgaagtcgtttcagcgtatggttgatctgctggcgcaccgctacgtgggggagaagatagacaaggtggtgggggttgaggcccgggggttcatcctgggtgcagcccttgcgtacaagcttggggctggagtggttcttgtgcgcaaaccggggaaacttccttccgaaaccttcagtaaaacatatcagcttgaatatggcactgactccctggaaattcatactgacgccatccgaaagggagagaaagtgctcattgccgacgacgttcttgctactggagggactatgtccgctgttgttgagatggtcagggaccttggcggtgaaattgtagaatgctgctttttggcagaactcgattttcttggtggaagaaagaaactgccggacgggaaggtcttttcactccttacgttttga

SEQ ID NO: 11185 - protein, 171 aa, Geobacter metallireducens GS-15
MDELKNIIRDIPDFPKKGIVFKDITTLLADAKSFQRMVDLLAHRYVGEKIDKVVGVEARGFILGAALAYKLGAGVVLVRKPGKLPSETFSKTYQLEYGTDSLEIHTDAIRKGEKVLIADDVLATGGTMSAVVEMVRDLGGEIVECCFLAELDFLGGRKKLPDGKVFSLLTF

SEQ ID NO: 11186 - DNA, 513 bp, Prochlorococcus marinus str. MIT 9312
  CDS (1)..(513): transl_table=11
atggaaaaacttgagaaattgatttctacttatgaaaactatccaaaagccggggtgagttttaaggatgttattgaaattgttcaacacccttcaatttttcgacaattaattttagaaatggcgaaaagtaaaatcataaaagaagctgaagcattaatttctatagacgcaagaggttttatttttggttccgcaatatctatacaggctgcaaaaccaatgatagttgcaagaaaacctggcaaacttccaggagaattagttacaaaaaaatatagtttagagtatggcgagaattccctttcaattcagaaaaaagcacttaaaaaatataactcttttgcaattattgatgatctattagcaactgggggaacagttaattgcgtttctgagctaataaataataataataagaaagttgtaggtcttttagtagtggctgaattaagcaagtttgatggaagatcgagatttaatttcccagtcgaatcatcaattcttttttga

SEQ ID NO: 11187 - protein, 170 aa, Prochlorococcus marinus str. MIT 9312
MEKLEKLISTYENYPKAGVSFKDVIEIVQHPSIFRQLILEMAKSKIIKEAEALISIDARGFIFGSAISIQAAKPMIVARKPGKLPGELVTKKYSLEYGENSLSIQKKALKKYNSFAIIDDLLATGGTVNCVSELINNNNKKVVGLLVVAELSKFDGRSRFNFPVESSILF

SEQ ID NO: 11188 - DNA, 516 bp, Rhodospirillum rubrum ATCC 11170
  CDS (1)..(516): transl_table=11
atgaaccttaaggaccatattcgtgaagtccccgattttcccaagccggggattctcttttacgatatctcgacgttgctggccgatcccgacgcctggcaggtcaccatggggcgaatggccaaagtggtcgccccgcgcctgcccgatgttctggccggcatcgaatcccgcggcttcctggtcgccgccccgctcgccctcaagcttgggctgggcttcgtcatggtccgcaagaagggcaaactgcccggcgccaccgtccgccacgaatacgccctggaatatggcaccgacaccgtcgaggtccaggaaggcgccgttctgcccggccaacgcgtggtgatcctcgatgacctgctggccaccggcggcacgctcaacgccgcctcggaattgcttggcaagatgggcgccaatgtcgtcggcgccgcctgcatcatcgagctgagtttcctcaagggccgcgagcgcaccaaggttcccatcgacagcctcgtcgcctacgactcctaa

SEQ ID NO: 11189 - protein, 171 aa, Rhodospirillum rubrum ATCC 11170
MNLKDHIREVPDFPKPGILFYDISTLLADPDAWQVTMGRMAKVVAPRLPDVLAGIESRGFLVAAPLALKLGLGFVMVRKKGKLPGATVRHEYALEYGTDTVEVQEGAVLPGQRVVILDDLLATGGTLNAASELLGKMGANVVGAACIIELSFLKGRERTKVPIDSLVAYDS

SEQ ID NO: 11190 - DNA, 567 bp, Burkholderia thailandensis E264
  CDS (1)..(567): transl_table=11
atgatgtccacatcgtcggacgcgcagctcgatcccgtcgagttcattcacagccgcatccgcacggtgccgaactggccgcagccgggcgtgatgttccgcgacatcacgccgctcctgcaaagcgcgaaggcgatgcgcgtgctcgtcgacctgttcgtcgagcgctatgtcgacgcgaagctcgactacatcgcgggcctcgacgcgcgcggcttcatcatcgcgcccatcgtcgcgtacgagctgtccgtcggcttcgtgccgatccgcaaggtcggcaagctgccgtacaagacgcagcgcgaatcgtacgcgctcgaatacggcaccgcgaccgtcgagatccacgaagacgcgtgcaagccgggcgaccgtgtggtgatcgtcgacgacctgatcgcgacgggcggcacgatgatggcgggcaagaacctgctcgatcggctgggcgccgtcgtcgtggaaggcgcggcgatcgtcgatttgccggatctcggcggctcggcgctgctgcgcggggccggcctgtcgctctatacggtcaccgaattcgccggacactga

SEQ ID NO: 11191 - protein, 188 aa, Burkholderia thailandensis E264
MMSTSSDAQLDPVEFIHSRIRTVPNWPQPGVMFRDITPLLQSAKAMRVLVDLFVERYVDAKLDYIAGLDARGFIIAPIVAYELSVGFVPIRKVGKLPYKTQRESYALEYGTATVEIHEDACKPGDRVVIVDDLIATGGTMMAGKNLLDRLGAVVVEGAAIVDLPDLGGSALLRGAGLSLYTVTEFAGH

SEQ ID NO: 11192 - DNA, 567 bp, Frankia sp. CcI3
  CDS (1)..(567): transl_table=11
atgacgagcatcgacgacgcaccgcagcggtccgccgcgcacgacgcggtcgccgaggtcctgcgtggccacatccgcgacattcccgactggccgcagccaggggtcgtgttcaaagacatcaccccgctgctcgcgacgccgaccgccttcggggtggtcatcggtgcgctggcggacgcggcccgggcgctgggggccaccacgatcgccggcatcgaggcgcggggcttcctgctagccgcgccggtcgcggaccggctgggcaccggcctcgtgccgatccgtaagcagggcaagctgccggggccgacccgaagcgcctcctacgacctggagtacggcgccgccacgatcgagatccacgccgacgcggtgcacgacggcgaccgggtcctgctcgttgacgacgtgttggccaccggtggcaccgcggccgccgcacacagcctgctcgcggctggtggcggggaggtcgtggggctggcggtcctcatggagctgtccttcctaccgggccgtgatcgggtcgcgccgctcgatgtcgtctcccttctgacgatttga

SEQ ID NO: 11193 - protein, 188 aa, Frankia sp. CcI3
MTSIDDAPQRSAAHDAVAEVLRGHIRDIPDWPQPGVVFKDITPLLATPTAFGVVIGALADAARALGATTIAGIEARGFLLAAPVADRLGTGLVPIRKQGKLPGPTRSASYDLEYGAATIEIHADAVHDGDRVLLVDDVLATGGTAAAAHSLLAAGGGEVVGLAVLMELSFLPGRDRVAPLDVVSLLTI

SEQ ID NO: 11194 - DNA, 537 bp, Novosphingobium aromaticivorans DSM 12444
  CDS (1)..(537): transl_table=11
atgaccaccgacgatctcaagcgacttgtccgtaccgtcccggatttcccctcccccggaatcctgttccgcgacatcacgaccctgatcgcgcatggcgaaggtctctcggcctgcatcgaccacctcgcccacaaggcacgcgcggccggggcacaggccgttgcgggaatggaggcgcgcggcttcatcttcggcgcggcggtggctgcaaggatgggactgggcttcattccggtgcgcaagccgggcaagcttccggtcaagaccatcggcatcgactatgcactggaatacgggcgcgaccggctggagatcgatcccaccgccattcgcgaaggccagcgcgttgtgatcgtcgacgacctcatcgcgaccggcggcactgccctggccgcggccgaactgctccgcatggcgggcgcacatgtcacgcacgccctcttcgtgatcgacctgcccgaactgcatggcgccgaacgacttcgcggtgctggtttgaccgtcgaagcgctcatggactttccagggcactga

SEQ ID NO: 11195 - protein, 178 aa, Novosphingobium aromaticivorans DSM 12444
MTTDDLKRLVRTVPDFPSPGILFRDITTLIAHGEGLSACIDHLAHKARAAGAQAVAGMEARGFIFGAAVAARMGLGFIPVRKPGKLPVKTIGIDYALEYGRDRLEIDPTAIREGQRVVIVDDLIATGGTALAAAELLRMAGAHVTHALFVIDLPELHGAERLRGAGLTVEALMDFPGH

SEQ ID NO: 11196 - DNA, 528 bp, Francisella tularensis subsp. holarctica
  CDS (1)..(528): transl_table=11
atgaacttagattttattaagagtaagattgcagctgtgcctgattttccaaaaccaggaattatgtttcgcgacattactcctttgcttgcagatccacaaggactcagaaaaactgctgaggcaatggcacaagagttaaaaaacaaaggtatccaaccaactattattgctggtacagaaagtagaggttttatctttggtgttgctcttgctgaagtattaggtctgggctttgtacctgtcagaaagcctggcaagctaccaagagcaacttatagcgttaagtatgacctagaatatggcagtgatagtcttgaaatacatcaagatgcctttaaagttacagatgaggtattggtggttgatgatttattggcaactggtggtactgcaaaagcaacagtagatcttatagaaaaaacccaagcaaaagtcgcaggacttatatttgtgatggagcttgatagtttgggtggtagagaagtacttgctggatacaatgtttcagcattaataaaattctag

SEQ ID NO: 11197 - protein, 175 aa, Francisella tularensis subsp. holarctica
MNLDFIKSKIAAVPDFPKPGIMFRDITPLLADPQGLRKTAEAMAQELKNKGIQPTIIAGTESRGFIFGVALAEVLGLGFVPVRKPGKLPRATYSVKYDLEYGSDSLEIHQDAFKVTDEVLVVDDLLATGGTAKATVDLIEKTQAKVAGLIFVMELDSLGGREVLAGYNVSALIKF

SEQ ID NO: 11198 - DNA, 522 bp, Desulfitobacterium hafniense Y51
  CDS (1)..(522): transl_table=11
gtgaaggcattggattttgataagtacatacgcgttattgatgatttccccaaacccggtatttctttcaaggatattactaccctgttaaaggatggagaagcttatcgggcagcggttgatgccatcgttgagcgggtcagggaatctcaaccggatctgattgtgggaccggaagcccgcggctttttgctgggagctccggtagcttatgccttgggcattggctttgttccggtgcgtaaaccgggcaaacttccgggtaaaacagtgagcgaaacctatgaacttgaatatggtagtgatacgttagaagttcacgctgatgccattcaaccgggacaacggatcgcgattgtcgatgatttgctggcgaccggcggcacgacttccgccacagcccgtttaattgaaaagaccggcgcccaggtggcaggaatgagttttttgattgaattgggctttctggaaggccgtaagagactggaagggtatgaggtattttctttaattaagtattaa

SEQ ID NO: 11199 - protein, 173 aa, Desulfitobacterium hafniense Y51
MKALDFDKYIRVIDDFPKPGISFKDITTLLKDGEAYRAAVDAIVERVRESQPDLIVGPEARGFLLGAPVAYALGIGFVPVRKPGKLPGKTVSETYELEYGSDTLEVHADAIQPGQRIAIVDDLLATGGTTSATARLIEKTGAQVAGMSFLIELGFLEGRKRLEGYEVFSLIKY

SEQ ID NO: 11200 - DNA, 531 bp, Methylobacillus flagellatus KT
  CDS (1)..(531): transl_table=11
atgaatatcaagtcgctcatccgcaccatccccgactatcccaagcccggcatccagttccgcgacatcaccacgctgctcaaggatgctagtggcttgcggcaggtggtggatgcattggttgaacgctatgcgggtgccaaggtcgacaaagtggtgggcatcgagtcgcgcggtttcattgtcggcgcagcagtggcatacgagctcggtgtcggcttcgtgccggtgcgcaagaagggcaagctgccgggcgacgtgctgggccatgactatgccctggaatatggtactgaccgtgtggagatccacagcgatgccatcagcccggatgaacacgtattgttgctggatgacctgattgccactggcggtactgcggaagcggctgcgatattgattgagaaactcggcggccatgtgctggagtgtgcattcatcatcggcttgcccgatctgggcggtgaacggaaattgcgtgtattgggctacaagacattcagcctgtgccagttcgaggacagtgagtga

SEQ ID NO: 11201 - protein, 176 aa, Methylobacillus flagellatus KT
MNIKSLIRTIPDYPKPGIQFRDITTLLKDASGLRQVVDALVERYAGAKVDKVVGIESRGFIVGAAVAYELGVGFVPVRKKGKLPGDVLGHDYALEYGTDRVEIHSDAISPDEHVLLLDDLIATGGTAEAAAILIEKLGGHVLECAFIIGLPDLGGERKLRVLGYKTFSLCQFEDSE

SEQ ID NO: 11202 - DNA, 567 bp, Burkholderia xenovorans LB400
  CDS (1)..(567): transl_table=11
atgtccaacgcgcttccgagcgcgccgctcgatgcggccgattacatcaaaagccacatccgcacggtgcccgactggccggagccgggcgtgcagttccgcgatatcacgccgctgctgcaggagccgaagtcgctgcgcgtgctgatcgatctgttcgtgcagcgctatatcgacgcgaagctcgactacattgccgggctggacgcgcgcgggttcatcatcgggccgattctcgcgtatgagctgaacctcggcttcattccgatccgcaaggcgggcaagctgccctacaaccggctcgcgcaatcttatgaactcgaatacggctgcgcaaccgtcgagattcacgaagacgcctgcaagcccggcgaccgcgtggtcatcatcgacgacctgatcgccacgggcggcacgatgatggccggcaagatcctgctcgaacggctcggcgcggtcgtggtggaaggcgcggcgatcatcgatctgcccgaactcggcggttcgaagctgctgcgcgacagtgggctggcgctctatacggtgaccggattcgagggtcactga

SEQ ID NO: 11203 - protein, 188 aa, Burkholderia xenovorans LB400
MSNALPSAPLDAADYIKSHIRTVPDWPEPGVQFRDITPLLQEPKSLRVLIDLFVQRYIDAKLDYIAGLDARGFIIGPILAYELNLGFIPIRKAGKLPYNRLAQSYELEYGCATVEIHEDACKPGDRVVIIDDLIATGGTMMAGKILLERLGAVVVEGAAIIDLPELGGSKLLRDSGLALYTVTGFEGH

SEQ ID NO: 11204 - DNA, 573 bp, Ralstonia metallidurans CH34
  CDS (1)..(573): transl_table=11
atgtcgaactccatcatccagtcccccgatcttggcgatgtcaccggttacctgcgtgaccgcatccgcaccgtgccggactggccgcagccgggcgtgatgttccgcgacatcacgccgctgctgcagaaccccaagacgctgcgcgtgctgatcgacgtcttcgtgcaccgctacatggaccagaacctggacctcgtggctggcatcgacgcgcgcggcttcatcctcgggtcgatcatcgcgtacgagctgaacctgggcttcgtgccgatccgcaagaagggcaagttgccgttccagacggtggccgaggaatacgagctcgagtatggcagcgccaccgtggagatccatgccgatgcctgcaagccgggagaccgcgtgctgctgatcgacgacctgatcgccacgggtggcacgatgatggcgggacgcaagctgctggagcgtcttggcgcaacggtggtggaaggcggggcgatcgtcgacctgcctgagctcggcggctccaagcttttgcaagccagcggcctgtcgctgttcacggtctgcaatttcgacggccactag

SEQ ID NO: 11205 - protein, 190 aa, Ralstonia metallidurans CH34
MSNSIIQSPDLGDVTGYLRDRIRTVPDWPQPGVMFRDITPLLQNPKTLRVLIDVFVHRYMDQNLDLVAGIDARGFILGSIIAYELNLGFVPIRKKGKLPFQTVAEEYELEYGSATVEIHADACKPGDRVLLIDDLIATGGTMMAGRKLLERLGATVVEGGAIVDLPELGGSKLLQASGLSLFTVCNFDGH

SEQ ID NO: 11206 - DNA, 549 bp, Acidobacteria bacterium Ellin345
  CDS (1)..(549): transl_table=11
atgtccgagagcacgactggcccctgccacgactccctgaaagcttacgttcgcgagattccggattatccgaagccgggcatactcttctacgacatcaccacgctaatcaaagaaccggttgggttggcgcgcacgattgacggcatcaccgagcacttcctcaacaagaatattgaccttgtcgtcggcatggaagcgcgcggatttatctttgggccggcggtggcgtatcggctgaacgccggatttattccgatccgcaagccgcgcaaacttcccggcgaaaccgtgaagcacacctacaaactggagtacggcgaagacacgctcgagatccacaaagacgcaatccagaaggcgcagcgcgtgttggttgtggatgacctactcgcgaccggcggaaccgcagtcgccgcgaccgagctggtgaagcaacttggcggagagatttgcggcatcgcgttcgtgatcgagttggactttttgaatgggcgcgagcggttgaaggattacgacgtgtattcgctgctgcattacgacaagtag

SEQ ID NO: 11207 - protein, 182 aa, Acidobacteria bacterium Ellin345
MSESTTGPCHDSLKAYVREIPDYPKPGILFYDITTLIKEPVGLARTIDGITEHFLNKNIDLVVGMEARGFIFGPAVAYRLNAGFIPIRKPRKLPGETVKHTYKLEYGEDTLEIHKDAIQKAQRVLVVDDLLATGGTAVAATELVKQLGGEICGIAFVIELDFLNGRERLKDYDVYSLLHYDK

SEQ ID NO: 11208 - DNA, 540 bp, Silicibacter sp. TM1040
  CDS (1)..(540): transl_table=11
atgagcacctccaaaaccgtcaaggactacatccgcaccatcgtcgatttcccccatgaggggatcatgttccgcgatgtgaccacattgtttgccgacccgcgcgggtttcgcatggccgtggaccagatgctgcacccctatgcgggccagcgcatcgacaaggtcgtggggcttgaggcgcgggggttcatccttggcggcgccatcgcgcatcaactgggcactgggtttgtgcctgtgcgcaaaaagggcaaactgcccggcgccacgatttcgcaggaatacaagctcgaatacggcgaggcggtggtggagcttcacaaggatgccatccaaccgggtgaaaagatcctcgtggtggatgatcttctggccaccggcggcaccgcgggtgcgggcatcaaactgatcgaaaaactcggcggagagatcatctcctgctctttcatcatcgacctgccggaacttggcgggcgcaagcatctccaaagccttggcatggacgtgcatgttctgtgcgaattcgaggggctctga

SEQ ID NO: 11209 - protein, 179 aa, Silicibacter sp. TM1040
MSTSKTVKDYIRTIVDFPHEGIMFRDVTTLFADPRGFRMAVDQMLHPYAGQRIDKVVGLEARGFILGGAIAHQLGTGFVPVRKKGKLPGATISQEYKLEYGEAVVELHKDAIQPGEKILVVDDLLATGGTAGAGIKLIEKLGGEIISCSFIIDLPELGGRKHLQSLGMDVHVLCEFEGL

SEQ ID NO: 11210 - DNA, 555 bp, Myxococcus xanthus DK 1622
  CDS (1)..(555): transl_table=11
atgcacccgcccgtcccgagcctgaccgacaccaccctcgtcgccgacctgaatgcccggctccgggacgtaccggacttccccaagcccggcatcgtcttcaaggacatcacccccgtgctggcggacccgcgcctgttcggccgcgtcatcgacgccatgtcggcgcccttccggggccagcacgtcacgaaggtggtgggcgtggaggcccgaggcttcctgctgggcgcccccatcgcgctggcgctcaacgcgggcttcgtgccggcgcgcaagcctgggaagctgcctcaccgctcggtggtggagcgctactcgctggagtacggctctgacggcgtggagatgcacgaggacgccatcctccagggggagcgggtgctcgtcgtggatgacgtgctggccacgggaggcacggcggaggccaccgcgaggctcgtgtcccggctcggcggcgagttggtgggcttctgcttcctcctcagcctggacttcctcgaaggccccaaccgcctcgggcgcgagcgcgtgacgacgctgctgaccttctga

SEQ ID NO: 11211 - protein, 184 aa, Myxococcus xanthus DK 1622
MHPPVPSLTDTTLVADLNARLRDVPDFPKPGIVFKDITPVLADPRLFGRVIDAMSAPFRGQHVTKVVGVEARGFLLGAPIALALNAGFVPARKPGKLPHRSVVERYSLEYGSDGVEMHEDAILQGERVLVVDDVLATGGTAEATARLVSRLGGELVGFCFLLSLDFLEGPNRLGRERVTTLLTF

SEQ ID NO: 11212 - DNA, 558 bp, Rubrobacter xylanophilus DSM 9941
  CDS (1)..(558): transl_table=11
gtgaacatcaccgagcgcaccatccaggtcatacgcaacaggatccggtctgtccccgactacccgagccccggggtggtcttccgggacatcacgcccctgatggaggacgggccctccctgcacgcggcggtggacgcgctcgcggaggccacgaggagcctggactacgaccgggtgatctccgcggaggcccgcggcttcgtcttcggcaccgcgctcgcctaccgctcgcgcaagggcctcgtcctcgccagaaagcccggcaagctgccgcgggaggtgatctcggtctcctacgagctggagtacggcacggactccctggaggtccacgcggacgccataccgcccggaacccgcgtgctcgtcgccgacgacctgctggccacgggcggcaccgcccgggcgatgtgcgagctggtggagaagtccggggggagcgtggccggctgcgccttcctcatagagctcggcttcctcgagggccgcaagaagctccttgcgggatacgacgtgatctcccttatcaactaccatgaccctgcggcagagtag

SEQ ID NO: 11213 - protein, 185 aa, Rubrobacter xylanophilus DSM 9941
MNITERTIQVIRNRIRSVPDYPSPGVVFRDITPLMEDGPSLHAAVDALAEATRSLDYDRVISAEARGFVFGTALAYRSRKGLVLARKPGKLPREVISVSYELEYGTDSLEVHADAIPPGTRVLVADDLLATGGTARAMCELVEKSGGSVAGCAFLIELGFLEGRKKLLAGYDVISLINYHDPAAE

SEQ ID NO: 11214 - DNA, 546 bp, Mesorhizobium sp. BNC1
  CDS (1)..(546): transl_table=11
atgaaacagtcgcttgaagataccctactggccgccatccgcaccattcccgactatccgaggccgggaatcctctttcgcgacatcactacgctgcttggtgacgcacgcgccttccgccgggccgtggatgaactcgtccatccctatgccggcgcgaagatagacaagatcgcaggtatcgaggcgcgcggcttcatcctgggcggtgccattgcccatcagctctcctcgggctttatccccatccgcaagaagggcaagctcccgcacgagaccgtgcgcgtcgcctacagcctggaatacgggctcgacgagatggagatgcacatcgatgccgtctcgccgggcgagaaagtcatccttgtcgacgatctgattgcgacgggcgggacggcggaggctgccgtgaggctcttgcggcagatgggagcggagattgtggctgcatgcttcgtcatcgacctgccggatctcggcggccgtgcaaagctggaagcggaaggcgtggatgtgcgcacgctggtttcgttcgaggggcattga

SEQ ID NO: 11215 - protein, 181 aa, Mesorhizobium sp. BNC1
MKQSLEDTLLAAIRTIPDYPRPGILFRDITTLLGDARAFRRAVDELVHPYAGAKIDKIAGIEARGFILGGAIAHQLSSGFIPIRKKGKLPHETVRVAYSLEYGLDEMEMHIDAVSPGEKVILVDDLIATGGTAEAAVRLLRQMGAEIVAACFVIDLPDLGGRAKLEAEGVDVRTLVSFEGH

SEQ ID NO: 11216 - DNA, 546 bp, Cytophaga hutchinsonii ATCC 33406
  CDS (1)..(546): transl_table=11
atggctacatccgaagaaattttagaacagacaataaaatcaaccattcgcgacattgttgattttcctgaaccgggtattatttttaaggacattactccattattaaaagacccgcaattatgtaaagcaatcgttcaatctattactgatcaattacggccgttacagccggatgcactggcttgtctggacagcagaggcttctggttcgggttatccattgccatggaattgggtataccgatgataccaatccgtaaaaaaggaaaactgccttatgaaaccgtatacgaagaatatgccttggaatatgggaccaatacaattgaaatgcatacagacgctgttcagcccggatgccgggtagctattcacgatgatattttagctaccggcggcacagcagaggctacatctaagctgatcaaaaaagcgaagggtgaaattattgcttactcatttttaattgaactggactttctcaaaggcaaagataaactggccccttactgtacaaccattcaatcgctgatcaactattga

SEQ ID NO: 11217 - protein, 181 aa, Cytophaga hutchinsonii ATCC 33406
MATSEEILEQTIKSTIRDIVDFPEPGIIFKDITPLLKDPQLCKAIVQSITDQLRPLQPDALACLDSRGFWFGLSIAMELGIPMIPIRKKGKLPYETVYEEYALEYGTNTIEMHTDAVQPGCRVAIHDDILATGGTAEATSKLIKKAKGEIIAYSFLIELDFLKGKDKLAPYCTTIQSLINY

SEQ ID NO: 11218 - DNA, 534 bp, Rhodococcus sp. RHA1
  CDS (1)..(534): transl_table=11
gtgatcgaccattcttcggcccgtgacgccgtcacccggctcacccgatgggccgacgactttccgcaacccggggtgcggttcgccgacctgacgccggttttttccgatgcggacggtttccgtgtcgtcgtcgacgcgctcgccgcctgcgccccggaggcggatgtgattgccgccgtcgacgcccgagggttcctcctcggcggcggcgtcgcccgggaactgggctccggtgtggtggccgtgcggaagtcgggcaaactgccgccgccggtgctgtcgcagtcgtacaccctcgaatacggtacggccacgctggagattccggccggctcgatcggtctggacgggcgctccgtgctcgtcgtcgacgacgtgctggccaccggtggaaccctcgacgccacggcgcgactggtggaatccgcaggtgcccgggtgatcggtgtcgccgtggtcctggagatcgccgcgctgggcggtcgggagcggctcggaaagtacccgctcacgtccctcgtcacggtctga

SEQ ID NO: 11219 - protein, 177 aa, Rhodococcus sp. RHA1
MIDHSSARDAVTRLTRWADDFPQPGVRFADLTPVFSDADGFRVVVDALAACAPEADVIAAVDARGFLLGGGVARELGSGVVAVRKSGKLPPPVLSQSYTLEYGTATLEIPAGSIGLDGRSVLVVDDVLATGGTLDATARLVESAGARVIGVAVVLEIAALGGRERLGKYPLTSLVTV

SEQ ID NO: 11220 - DNA, 525 bp, Haemophilus somnus 129PT
  CDS (1)..(525): transl_table=11
ttgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagtcggggatttatttttggggcgcctgttgctttggcgttaaatgttccctttattttggtacgcaaaccgggcaaattacctcgtgaaactatcgcacaatcttaccagttggaatatgggcaagacaccttagaaatgcatgtaagttctattcaagccggagataatgtacttgtgattgatgatttattagcaactggtggaactattgaagcgactgtaaaactggtagagcgtttacaaggtcaagttaagcatgccgcctttgttattagtttgccggatctcggtggtgaggttcgtttacgtgaacttggtgtggagccatttactttagtcgaattttcaggtcattaa

SEQ ID NO: 11221 - protein, 174 aa, Haemophilus somnus 129PT
MIKSSIKSIPNHPKEGIIFRDITSLTEVPEAFQATIDLIIERYKSKGITKVIGTESRGFIFGAPVALALNVPFILVRKPGKLPRETIAQSYQLEYGQDTLEMHVSSIQAGDNVLVIDDLLATGGTIEATVKLVERLQGQVKHAAFVISLPDLGGEVRLRELGVEPFTLVEFSGH

SEQ ID NO: 11222 - DNA, 513 bp, Trichodesmium erythraeum IMS101
  CDS (1)..(513): transl_table=11
atggaactaaaaaatttaatccgcgaaatcccaaatttccctaaatctggaattatattccgagatattactactcttttaagcaatacagatggtctacattacactattgacattttgacagaaaaatgcttagaatttaaaccagactatgtagtaggcatcgaatccagagggtttatttttggtatgcctttagcttatcagttgaatgtaggctttattccagttcgcaaacccggaaagctacccgcagaagtttactcagtttcttatgatttagagtatggccaagacagtctagaggtacaccaagatgcaatgccagcaggtagtagagttttagtaattgacgatctgctggcaacgggtggaactgcaggagctacaactcaattaattgaaaaagcaaagtgtaatttagtgggttttgcttttgttattgagttaaaggaattaggtggccgtgaaaaattaccaaaagtgccaattattagtttaattgaatactag

SEQ ID NO: 11223 - protein, 170 aa, Trichodesmium erythraeum IMS101
MELKNLIREIPNFPKSGIIFRDITTLLSNTDGLHYTIDILTEKCLEFKPDYVVGIESRGFIFGMPLAYQLNVGFIPVRKPGKLPAEVYSVSYDLEYGQDSLEVHQDAMPAGSRVLVIDDLLATGGTAGATTQLIEKAKCNLVGFAFVIELKELGGREKLPKVPIISLIEY

SEQ ID NO: 11224 - DNA, 519 bp, Synechococcus sp. CC9311
  CDS (1)..(519): transl_table=11
ttggatcttcatcactacgttcaagatattccggactttccaaaaccaggaattctgttccgcgacatatccccgatgttgcgtgatcccgtgggctgggccgaggtgatggatcgtttaggtgtgctgtgcgattcgttgaagccagacctgattgtgggaatagaagccaggggtttcatcgtgggaatgggtttggcaacgcataagaagcttgggtttgttccagtccgcaaaccagggaaactccccggcaaggtctatggaattgattacgccctggaatacggaactgatcggctcgagattcatgccgacgccatgagaggccaaccaagaattctggtcgttgatgatctgttagcaacaggagggaccgcctcggccacggctgatttggtcaaacaggctggcggtcaactcgttggttgtgccttcatcgtggaactcacagaattaaaaggacgaggacgccttcccggtgatatccaggttgaatcactcattcactactcctga

SEQ ID NO: 11225 - protein, 172 aa, Synechococcus sp. CC9311
MDLHHYVQDIPDFPKPGILFRDISPMLRDPVGWAEVMDRLGVLCDSLKPDLIVGIEARGFIVGMGLATHKKLGFVPVRKPGKLPGKVYGIDYALEYGTDRLEIHADAMRGQPRILVVDDLLATGGTASATADLVKQAGGQLVGCAFIVELTELKGRGRLPGDIQVESLIHYS

SEQ ID NO: 11226 - DNA, 552 bp, Shewanella sp. MR-7
  CDS (1)..(552): transl_table=11
atggctatgaatacagaaaccttatccttgataaagcaaagcattaaaacgattcctaattatcctaaggaagggattctatttcgcgatgtgaccagtctgctggaaaatgccgtggcctataaagcgactatcgatttattagttgagcaatatcgcaataaaggctttaccaagattgtgggcaccgaagcccgtggtttcttgtttggtgcgcctttagcgctggaattaggcattggttttgtgcctgtacgtaagccaggtaagttaccacgtgcgaccattagccaaagctatgagctggaatatggccacgatagccttgaaatccataccgatgcgattaccgcgaatgacaaagtattagtggttgacgatttgctggccactggcggcactatcgaagccacagtcaaacttatccgccaactgggcggtgaagtgcaagatgcggcttttgtgatttcattacccgatctcggtggcgaagcccgcttaacggccttaggtcttgagttggttaaactttgtgagtttgaaggcgaataa

SEQ ID NO: 11227 - protein, 183 aa, Shewanella sp. MR-7
MAMNTETLSLIKQSIKTIPNYPKEGILFRDVTSLLENAVAYKATIDLLVEQYRNKGFTKIVGTEARGFLFGAPLALELGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 11228 - DNA, 543 bp, Rhizobium leguminosarum bv. viciae 3841
  CDS (1)..(543): transl_table=11
atgaacaatacgatttcggagctcgcagccagcatccgctccattcccgactatcccaagccgggcatcatcttccgcgacatcaccacgctgctcggcaaccctcgggctttccgccgggcggtcgacgaactcgtgcagccctatgccggcacgaagatcgacaagatcgccggcatggaggcgcgcggcttcatcctcggcggcgcggtggcgcaccagctttcttcaggcttcgtaccgatccgcaagaaaggcaagctgccgcacgagaccgtgcgcatcgcctacagcctggaatatggcgtcgacgagatggagatgcatcgcgatgctgtccagcccggcgagaaggtgatcctggtcgacgacctaatcgccaccggcggcacggcggtcggcgcgacgaggctattgcgccagatcggtgcggaagtggtcggcgcctgtttcgtcatcgacctgccggatcttggcggccgcaggaagctggaagaactcggcgtcgtcgtgcacacgctggtcgaattctccggccactga

SEQ ID NO: 11229 - protein, 180 aa, Rhizobium leguminosarum bv. viciae 3841
MNNTISELAASIRSIPDYPKPGIIFRDITTLLGNPRAFRRAVDELVQPYAGTKIDKIAGMEARGFILGGAVAHQLSSGFVPIRKKGKLPHETVRIAYSLEYGVDEMEMHRDAVQPGEKVILVDDLIATGGTAVGATRLLRQIGAEVVGACFVIDLPDLGGRRKLEELGVVVHTLVEFSGH

SEQ ID NO: 11230 - DNA, 519 bp, Pediococcus pentosaceus ATCC 25745
  CDS (1)..(519): transl_table=11
atgacattagacttacatgactacgttgcaagtattcaagatttcccagaaaaaggtgtaacattccgtgatatttctcctttaatggaaaatggtgaggcgtatcgtcaagcaacaaatgcaatcattaaatttgctagagataaaggcgttgaaatgattgtgggacctgaagcacgaggatttatcgtgggatgcccggttgcctatgaaatgggaattggttttgcaccagcacgtaaaaaaggaaaacttccccgagaaaccgttaaagctacttacggtctagaatatggaaaatcagaattgtatcttcaaaaggatgcgatcaaacccggacaaaaggttttaattactgatgatttactagcaacgggtggaacaatcgctgctacgattgaattagttgaaaaattaggtggtatagttgtgggaactgccttctttatcgaattaaaagacctcaatggccgtgaaaaaattaaagactatgatacattaagtttgatggaatattaa

SEQ ID NO: 11231 - protein, 172 aa, Pediococcus pentosaceus ATCC 25745
MTLDLHDYVASIQDFPEKGVTFRDISPLMENGEAYRQATNAIIKFARDKGVEMIVGPEARGFIVGCPVAYEMGIGFAPARKKGKLPRETVKATYGLEYGKSELYLQKDAIKPGQKVLITDDLLATGGTIAATIELVEKLGGIVVGTAFFIELKDLNGREKIKDYDTLSLMEY

SEQ ID NO: 11232 - DNA, 528 bp, Oenococcus oeni PSU-1
  CDS (1)..(528): transl_table=11
atggatattgatttacatgattatattgcgactactcctgattttcctgaaaaaggagtaatgtttcgagacattaatcctttgataggtaatggccccgcctatcgacaggcaattaatgaattgattgatttcgctcgtccgttaaaacctgatattatcgcaggtccggaagcccgtggtttcgtcgttggatcaccgatggcctatgcattgggaatcggttttgttccggcacgcaaatacggaaaacttcctcgaaagtctgttagttccagttacagcttggagtacggaaaaaatgaattgcagatgcatgttgattctatcaaaccgggtcagcgggtctttattgtcgatgatttgctggcaaccggaggaacgatcacagcgacaatggatttggttcgccaattgggtggccaagttgtcggaacaggcttctttatcgagttggcggatcttcagggccgaaaaaagataatggaagttgaaaatgttccttttaagtctttgctggaatattaa

SEQ ID NO: 11233 - protein, 175 aa, Oenococcus oeni PSU-1
MDIDLHDYIATTPDFPEKGVMFRDINPLIGNGPAYRQAINELIDFARPLKPDIIAGPEARGFVVGSPMAYALGIGFVPARKYGKLPRKSVSSSYSLEYGKNELQMHVDSIKPGQRVFIVDDLLATGGTITATMDLVRQLGGQVVGTGFFIELADLQGRKKIMEVENVPFKSLLEY

SEQ ID NO: 11234 - DNA, 531 bp, Leuconostoc mesenteroides subsp. mesenteroides ATCC 8293
  CDS (1)..(531): transl_table=11
atgacagtagatttacatgattttgttgcaacagttgaagattaccccgaaccaggtgttagttttcgtgatatttcaccattgatgggtgatggtgtggcctataagcaagcagtagatgctattgctgattttgctaaacatttaaacgttgatttaattgctggtcctgaatcacgtggatttattgtaggttcaccgctggcgtatgcgatgaatatcggctttgttccagctcgtaaaggtggcaaattacctcgtgaagctgtatcagcatcatacacattagagtatggtggtgttaatgagctagaaattcataaagatgctattaagccaggacaacgtgtgctgattgttgatgatttactagcgacaggcggcactattaatgctacacgtgaaattattgaaaaacttggtggcatcgttgctggtgtagcttttattatagaattagaaagcttgcaaggccgtgaaaaaattatgaaagctggcgaagtgccattcctagctttaatggaatattaa

SEQ ID NO: 11235 - protein, 176 aa, Leuconostoc mesenteroides subsp. mesenteroides ATCC 8293
MTVDLHDFVATVEDYPEPGVSFRDISPLMGDGVAYKQAVDAIADFAKHLNVDLIAGPESRGFIVGSPLAYAMNIGFVPARKGGKLPREAVSASYTLEYGGVNELEIHKDAIKPGQRVLIVDDLLATGGTINATREIIEKLGGIVAGVAFIIELESLQGREKIMKAGEVPFLALMEY

SEQ ID NO: 11236 - DNA, 522 bp, Solibacter usitatus Ellin6076
  CDS (1)..(522): transl_table=11
atgccagatctcaagtcactcatccgcgaggtgcccgacttccccaagccgggcattctcttctacgacatcaccacgctgctcaaggaccctagcggttttcacggcgtcatcgacggccttaaggaccactaccgcgatatcaaggtcgataccgtgcttggcatcgaagcccgcggcttcattttcgcccctgccttggcctatgccctaggcgccggcttcgtgccggtgcgcaaaccgaaaaagctccccgccgaatgcgtccgtatcacatatgacctggagtacggcacggacacgctggagatgcacaaggatgctattggcaatggccaccgcgttcttatcgtcgatgatctgctggccaccggcggcaccgcttccgccgcagcccgcatggtgcaggatgccggcggcatcgtagtcggactcggcttcgtgatcgagttgaccttcctggccggccggcagcgcctcaacggccacgacgtcttctctctgttgcagtacgacaaatga

SEQ ID NO: 11237 - protein, 173 aa, Solibacter usitatus Ellin6076
MPDLKSLIREVPDFPKPGILFYDITTLLKDPSGFHGVIDGLKDHYRDIKVDTVLGIEARGFIFAPALAYALGAGFVPVRKPKKLPAECVRITYDLEYGTDTLEMHKDAIGNGHRVLIVDDLLATGGTASAAARMVQDAGGIVVGLGFVIELTFLAGRQRLNGHDVFSLLQYDK

SEQ ID NO: 11238 - DNA, 552 bp, Shewanella sp. ANA-3
  CDS (1)..(552): transl_table=11
atggctatgaatacagaaaccttatccttgataaagcaaagcattaaaacgattcctaattatcctaaggaagggattctatttcgcgatgtgaccagtctgctggaaaatgccgcggcctataaagcgactatcgatttattagttgagcaatatcgtaataaaggctttaccaagattgtgggcactgaagcccgtggtttcttgtttggtgcgcctttagcactggaattaggcattggttttgtgcctgtacgtaagcctggtaaattgccacgcgcgaccattagccaaagctatgagctggaatatggccacgatagccttgaaatccataccgatgcgatcaccgcgaatgataaagtattagtggttgacgatttgctggcaactggtggcactatcgaagccacagtcaaacttatccgccaactgggtggtgaagtgcaagatgcagcctttgtgatttcattaccagatctcggtggcgaagcccgtttaactgccttaggtcttgagttggttaaactttgtgagtttgaaggcgaataa

SEQ ID NO: 11239 - protein, 183 aa, Shewanella sp. ANA-3
MAMNTETLSLIKQSIKTIPNYPKEGILFRDVTSLLENAAAYKATIDLLVEQYRNKGFTKIVGTEARGFLFGAPLALELGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 11240 - DNA, 543 bp, Mycobacterium avium 104
  CDS (1)..(543): transl_table=11
atgacggacgccggcgaagcgacgccggtcgcggagctgatcgcgtcgctgacccggcaggtgcccgatttccccaagcccggcatccagttcaaggacctcaccccgctgttcgccgacgcgacggcgatgacggccgtcaccggcgcgctggcccggcacgcgtccggcgccgacctggtggccggcatcgactcgcgcgggttcctggtcgcggcggccgtggccgaccggctgcacaccggggtgctggccatccgcaagggcggcaaactgccgccgccggtgcacgccgagcgctacgacctggaatacggcagcgccaccctggagatccccgccgacggcatcgacctgcgtgggcggcgcatcgtgatcatcgacgacgtgctggccaccggcggtaccctggccgcggcggcccgactgctgcggcgcaccggcgccaccgtgaccgcggcggcggtggtgttcgaactcggtgcgctgggcgggcgggcggcgctggcgccgttgccggtgcacaggctgacttgccagtag

SEQ ID NO: 11241 - protein, 180 aa, Mycobacterium avium 104
MTDAGEATPVAELIASLTRQVPDFPKPGIQFKDLTPLFADATAMTAVTGALARHASGADLVAGIDSRGFLVAAAVADRLHTGVLAIRKGGKLPPPVHAERYDLEYGSATLEIPADGIDLRGRRIVIIDDVLATGGTLAAAARLLRRTGATVTAAAVVFELGALGGRAALAPLPVHRLTCQ

SEQ ID NO: 11242 - DNA, 543 bp, Mycobacterium smegmatis str. MC2 155
  CDS (1)..(543): transl_table=11
atgacccagcaccacgacacggccgaggtgtcgcgggtgatcgcgacgctcacccgcgaggtcgccgacttccccgaaccgggcatccagttcaaggacctcacgccgcttctcgccgatgcgcgcggtctgcgcgtggtcaccgacgcgctggccgacatcgcctcgggcgcggatctggtcgcgggtctggatgcgcgcggtttcctgctgggcgcggcggtggccacccggctgggcaccggtgtgctggcggtccgcaagggcggcaagctgccgcctccggtccacggagcgacgtaccaattggagtacggcacggcgaccctggagatccccgccgaaggaattgacatcgccgggcgcaacgttgtgatcatcgacgatgtgctcgccaccggcgggacgctggccgcggcggccaggctgctcggcgactgtggcgccaacgtgaccggcgccggagtggttctcgagctcgaagccctccgcggacgcgaagcggtggcaccattgggcgtacgaagcctgcacatcatctga

SEQ ID NO: 11243 - protein, 180 aa, Mycobacterium smegmatis str. MC2 155
MTQHHDTAEVSRVIATLTREVADFPEPGIQFKDLTPLLADARGLRVVTDALADIASGADLVAGLDARGFLLGAAVATRLGTGVLAVRKGGKLPPPVHGATYQLEYGTATLEIPAEGIDIAGRNVVIIDDVLATGGTLAAAARLLGDCGANVTGAGVVLELEALRGREAVAPLGVRSLHII

SEQ ID NO: 11244 - DNA, 558 bp, Nocardioides sp. JS614
  CDS (1)..(558): transl_table=11
gtgacgctgcccgggccggaggcaccggggctctccgaggcgctcgccctgatcgccgacgtccccgacttcccccagcccgggatcctcttcaaggacatcacgccgctgctggccgagcacgcggcgctcgaggcggtcgtcgcggccctcgccgcacccgggcgcgatcagaccggtgccccggtcgtcgacaaggtgctggggatggagtcgcgcggcttcatcctgggcgcgccggtcgcgctggccctcggcgtggggttcgtcccggtccgcaaggccggcaagctgccgcgagcgacgtacgccgtctcctacgcgctggagtacggcgaggccacgctcgaggtgcaccaggacgcactcgagccgggggaccgggtgctgctcgtcgacgacgtgctcgccaccggcgggaccgcgcgggcgacgatcgacctggtcgagaagtgcggtgccagcgtgcacgccgtcgcgatcctcatggagctcggcttcctgcccggccgcgaggcgctcggtacggtgcccctgaccacgctcctcaccgtctga

SEQ ID NO: 11245 - protein, 185 aa, Nocardioides sp. JS614
MTLPGPEAPGLSEALALIADVPDFPQPGILFKDITPLLAEHAALEAVVAALAAPGRDQTGAPVVDKVLGMESRGFILGAPVALALGVGFVPVRKAGKLPRATYAVSYALEYGEATLEVHQDALEPGDRVLLVDDVLATGGTARATIDLVEKCGASVHAVAILMELGFLPGREALGTVPLTTLLTV

SEQ ID NO: 11246 - DNA, 525 bp, Mycobacterium sp. KMS
  CDS (1)..(525): transl_table=11
gtgaccgacatctcgaaggtgatcgcgtcactgatgcgcgaggtgcccgacttccccgaacccggaatccagttcaaggatctgacgccgctgctcgccgacgccgaggggctgatggcggtcaccgatgcgctggccgccacggccgaaggggccgacctggtggccggcatcgacgcccgcggattcctgctgggcgccgcggtggcgctgcggctgggcaccggtgtcctcgcggtgcgcaaggggggcaagctgccgcccccggtgcattcacagacttacaacctcgaatacgggtcggccacactggagatccccgccgacgggctcgacatcgccgggcgcagcgtcgtgatcatcgacgacgtgctggcgacaggcggaaccgtggcggccacgcatcggctcctcaccagcggcggcgccaccgtgctccacgccgcagtggtgctggaactgaccgcccttggcgggcgtgaggtggtgcaaccgctgtctgtcagcagcctgtacacggtgtga

SEQ ID NO: 11247 - protein, 174 aa, Mycobacterium sp. KMS
MTDISKVIASLMREVPDFPEPGIQFKDLTPLLADAEGLMAVTDALAATAEGADLVAGIDARGFLLGAAVALRLGTGVLAVRKGGKLPPPVHSQTYNLEYGSATLEIPADGLDIAGRSVVIIDDVLATGGTVAATHRLLTSGGATVLHAAVVLELTALGGREVVQPLSVSSLYTV

SEQ ID NO: 11248 - DNA, 600 bp, Neisseria meningitidis FAM18
  CDS (1)..(600): transl_table=11
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccatctcaacgtcggttttgtccccatccgcaaaaaaggcaagctgccttttgaaaccgtatcgcaaagctacgcgctcgaatacggggaagctgcggtggaaatccacaccgatgccgtcaaacccggttcgcgcgtgctgctggtcgatgatttggttgccacgggcggcacaatgcttgccgggctggaactgatccgcaaactcggcggagaaattgtcgaagctgccgctattttggaatttaccgaccttcaaggcggcaagaatatccgtgcaagcggcgcgcccttatttaccctgcttcaaaacgaaggctgtatgaagggctga

SEQ ID NO: 11249 - protein, 199 aa, Neisseria meningitidis FAM18
MALKTSNLEHAMLVHPEAMSVGALADKIRKIENWPQKGILFHDITPVLQSAEYFRLLVDLLVYRYMDQKIDIVAGLDARGFIIGAALAYHLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 11250 - DNA, 555 bp, Acidovorax sp. JS42
  CDS (1)..(555): transl_table=11
atgacagcccttagcgtcaacgactacctgcgccagcacatccgcaccgtccctgactggccggcgccgggggtgcagttccgcgacatcacgcccctgctgcaaaaccccaaagtgttccgcgtgctgatcgacgccttcgtgcaccgctacatggaccgcgcgctgcgccccgacgtggtggccggactggacgcccgcggcttcatcctgggcgcggtggtggcctatgagttgaatgtgggcttcgttcccatccgcaagaagggcaagctgcctttcaccaccgtcgaggaaacctacgaactcgagtacggcagcgcgaccgtggaactgcacgcggacgcggtccagcccggcgaccgggtgctgctgatcgacgacctgatcgccaccggcggcacgatgatggccggcaagaaactgctggaaaaactgggcgcgaccgtcatggaaggcgccgccatcgtggatttgccggaactcggcggctcggaacgcctgcgtgccagcggactgccgctgtacacgctggtggacttcagcggccactag

SEQ ID NO: 11251 - protein, 184 aa, Acidovorax sp. JS42
MTALSVNDYLRQHIRTVPDWPAPGVQFRDITPLLQNPKVFRVLIDAFVHRYMDRALRPDVVAGLDARGFILGAVVAYELNVGFVPIRKKGKLPFTTVEETYELEYGSATVELHADAVQPGDRVLLIDDLIATGGTMMAGKKLLEKLGATVMEGAAIVDLPELGGSERLRASGLPLYTLVDFSGH

SEQ ID NO: 11252 - DNA, 546 bp, Magnetospirillum magnetotacticum MS-1
  CDS (1)..(546): transl_table=11
atggaagcccgccgccactccgccctcaaggactcggtccgctcgattcccgattatccgaaaccgggcatcatcttccgcgacatcaccactctgctcagcgatccgcgctcgttccgccgggcggtcgattcgctggtgcatcccttcgcgggcgggcggatcgatcaggtcgcgggcatcgaggcgcggggcttcatcctcggcggcgccgtggcgcaccagctttcctcgggcttcgtcccgatccgcaagaagggcaagctgcctcacaagaccgtctcgaccgcctacgcgctggaatacggcactgacgagatcgagatccatgtcgatgcgatccgtccgggcgatcgggtgattctggtcgatgacctcatcgccaccggcggcaccgcgacggcggcggtcaatctcctgcgccagctcggcgccgaggtggtggccgcctgcttcgtgatcgacctgccggaaatcggtggcgctcagcgcctgcgggatctcggcgtgaccgtgcgcacgctgatggaattcgaggggcactga

SEQ ID NO: 11253 - protein, 181 aa, Magnetospirillum magnetotacticum MS-1
MEARRHSALKDSVRSIPDYPKPGIIFRDITTLLSDPRSFRRAVDSLVHPFAGGRIDQVAGIEARGFILGGAVAHQLSSGFVPIRKKGKLPHKTVSTAYALEYGTDEIEIHVDAIRPGDRVILVDDLIATGGTATAAVNLLRQLGAEVVAACFVIDLPEIGGAQRLRDLGVTVRTLMEFEGH

SEQ ID NO: 11254 - DNA, 525 bp, Magnetospirillum magnetotacticum MS-1
  CDS (1)..(525): transl_table=11
atgaatatcaaggaccacatccgcggcgttccggatttccccaagccgggcatcctgttctacgacatctccaccctgctggcccatcccgatgcctggcaggtggccatgggccgcatggcccgcgagatcatcaagttccagcccgacgtgctggctggcatcgaatcgcgcggcttcctggtggcggcgccgctggcgctgaaactgggctgcggcttcgtcatgctgcgcaagaacggcaagctgccgggcgagaccatccgtcacgattacgaactggaatacggcaccgacaccatcgagatccagaagaacgccatcgccgagggaagccgcgtggtgattctggacgatctgctggccaccggcggcaccatggcggcgggcgtccaactactgcgcaagatcggcgcccatgtgacgggcgcaggcaccatcatcgacctggccttcctgcccggcaaacagcgcctcaaggaactggacgtcccctttacctgcctcgcatcctacgacgattag

SEQ ID NO: 11255 - protein, 174 aa, Magnetospirillum magnetotacticum MS-1
MNIKDHIRGVPDFPKPGILFYDISTLLAHPDAWQVAMGRMAREIIKFQPDVLAGIESRGFLVAAPLALKLGCGFVMLRKNGKLPGETIRHDYELEYGTDTIEIQKNAIAEGSRVVILDDLLATGGTMAAGVQLLRKIGAHVTGAGTIIDLAFLPGKQRLKELDVPFTCLASYDD

SEQ ID NO: 11256 - DNA, 519 bp, Nostoc punctiforme PCC 73102
  CDS (1)..(519): transl_table=11
atggatttgaagtctctcgttcgtgacattccagattttcccaaacccggaattttatttcgggatattactacattactgcgcgatccagagggattgcgctacactattgactttttaacacaaaaatgcaaagaagctgaaataaagccagattatgtaattggtatagagtcaagaggatttatttttggctcacctctggcttatcaattaggggctggttttattcccattcgcaaaagaggtaagttaccagcagcagttcactcaattgaatacgatctagagtatggtactgactgtctggaagtgcatcaagacgctttacgtcacagtagccgagttttgattgtggacgatttgattgctacgggtggaactgcgagtgcaacagcaaagttagtgcagaaaattggctgcgaattagtaggatttgggtttattatcgagctacgggacttagaagggcgtaaatatttgccggacgtgccgattatctctctaattgaatattag

SEQ ID NO: 11257 - protein, 172 aa, Nostoc punctiforme PCC 73102
MDLKSLVRDIPDFPKPGILFRDITTLLRDPEGLRYTIDFLTQKCKEAEIKPDYVIGIESRGFIFGSPLAYQLGAGFIPIRKRGKLPAAVHSIEYDLEYGTDCLEVHQDALRHSSRVLIVDDLIATGGTASATAKLVQKIGCELVGFGFIIELRDLEGRKYLPDVPIISLIEY

SEQ ID NO: 11258 - DNA, 582 bp, Bifidobacterium longum DJO10A
  CDS (1)..(582): transl_table=11
atggcacagtcggacatcaccatcgacgcattgagcaaggtagggcaacaggacgccgaatatctggtgtccttggtgcgttccgtaccggggtttcccaaggaaggcatcatcttccgtgatttcatgccagtgctcgccgaccccaagggcttgaagattctgctcaaagcacttgaagaggccctgccggtgtccccgagcgaattcgactccattgccggtctcgaatcgcgcgggttcctgttcggcccggccatggccgcccatttgggcaagggtttcatcgccgtgcgtaaggccggcaagttgccgcctgaaaccatcggtgaatcctatgacctcgaatacggcacggccagtgtcgaaatcgaaaccgacgccgtacaggcagggaagcgagtgctcatcgtcgatgacctcatcgccacgggcggcaccgccaaagccgccaccgaccttatcgaaaaggccggtggcaccgtggtgggcttcagtttcgtgatgcggctcgatggcctcgacggtctggataagctcgacggcaagcccagcagctcgctgatcgcgatgccggcctga

SEQ ID NO: 11259 - protein, 193 aa, Bifidobacterium longum DJO10A
MAQSDITIDALSKVGQQDAEYLVSLVRSVPGFPKEGIIFRDFMPVLADPKGLKILLKALEEALPVSPSEFDSIAGLESRGFLFGPAMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 11260 - DNA, 540 bp, Haemophilus somnus 2336
  CDS (1)..(540): transl_table=11
atgaataaattagaattgattaaatcctctattaaatctattccaaatcaccccaaagaaggaattattttccgtgatattaccagccttactgaagtacctgaggcatttcaagcaacaattgacttaattattgagcgatataaaagtaaaggaattactaaagtgatcggtactgagagtcggggatttatttttggggcgcctgttgctttggcgttaaatgttccctttattttggtacgcaaaccgggcaaattacctcgtgaaactatcgcacaatcttaccagttggaatatgggcaagataccttagaaatgcatgtaagttctattcaagccggtgataatgtacttgtgattgatgatttattagcaactggtggaactattgaagcgactgtaaaactggtagagcgtttacaaggtcaagttaagcatgccgcctttgttattagtttgccggatctcggtggtgaggttcgtttacgtgaacttggtgtggagccatttactttagtcgaattttcaggtcattaa

SEQ ID NO: 11261 - protein, 179 aa, Haemophilus somnus 2336
MNKLELIKSSIKSIPNHPKEGIIFRDITSLTEVPEAFQATIDLIIERYKSKGITKVIGTESRGFIFGAPVALALNVPFILVRKPGKLPRETIAQSYQLEYGQDTLEMHVSSIQAGDNVLVIDDLLATGGTIEATVKLVERLQGQVKHAAFVISLPDLGGEVRLRELGVEPFTLVEFSGH

SEQ ID NO: 11262 - DNA, 513 bp, Fusobacterium nucleatum subsp. vincentii ATCC 49256
  CDS (1)..(513): transl_table=11
atggatttaaaaaattatgtagcaacaatagaaaattatccaaaagaagggatattatttagagatataacaccacttatgaataatggggaagcatataaatatgcaacagaaaaaatagttgaatttgcaaaagaacatcatattgatatagttgtaggtccagaagcaagaggttttatttttgggtgtcctgtatcttatgctttggggataggctttgcaccagttagaaaaccagggaaattaccccgtgaagtgatagaatattcttatgatttagaatatggttcaaataaattatgtctacataaagattcaataaagcctggtcaaaaagtattagtggttgatgatttacttgcaactggtggaacagttgaagctacaacaaaattagtagaagaattaggtggagttgtagcaggtttagcatttttaatagaacttgttgatttaaaaggaagagagagattaagtaaatatcctatgattacattaatgcagttttaa

SEQ ID NO: 11263 - protein, 170 aa, Fusobacterium nucleatum subsp. vincentii ATCC 49256
MDLKNYVATIENYPKEGILFRDITPLMNNGEAYKYATEKIVEFAKEHHIDIVVGPEARGFIFGCPVSYALGIGFAPVRKPGKLPREVIEYSYDLEYGSNKLCLHKDSIKPGQKVLVVDDLLATGGTVEATTKLVEELGGVVAGLAFLIELVDLKGRERLSKYPMITLMQF

SEQ ID NO: 11264 - DNA, 543 bp, Haemophilus influenzae R2846
  CDS (1)..(543): transl_table=11
atgactacacaacttgatttaattaaatcttctatcaaatcaattcctaactatccaaaagaaggcattatcttccgcgacattacgacccttttagaagttccagcagcttttaaagcaacaatagatcttattgtggaacaatatcgagacaaaggaatcacaaaagtacttggaactgaatctcgtggttttatttttggtgcaccggtagctttagccttaggattgccttttgaattagtgcgtaaacctaaaaaattaccacgtgagactatttcgcaatcttatcaattagaatatggtcaagatactttagaaatgcacgttgatgcaatttcacaaggagataatgttttaattattgatgatttattagcaacaggtggcaccgttgaagcaacagtaaaattagtgcaacgtttaggtggaactgtaaaacacgctgcatttgtgattaatttacctgaattaggtggcgaaaaacgcttaaatcatttaggtgttgattgccatacactcgtcaattttgaaggtcactaa

SEQ ID NO: 11265 - protein, 180 aa, Haemophilus influenzae R2846
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISQGDNVLIIDDLLATGGTVEATVKLVQRLGGTVKHAAFVINLPELGGEKRLNHLGVDCHTLVNFEGH

SEQ ID NO: 11266 - DNA, 519 bp, Crocosphaera watsonii WH 8501
  CDS (1)..(519): transl_table=11
atggatcttaaagctttaattcgtgatattcctgattttcctaaacagggtattgtttttcgagatattaccaccttactcagtgatgcggaaggtttacgttataccattgacaccttgaaggaaaaatgtttgagtgctaatttatcccctgattatattgtggggatggagtcccgtggttttctatttggagctcctttagcctatcaattaaatgcagggtttgttcctgtgagaaaaccaggtaagttacctgctgctgtgcataaggtagagtacgagttagaatacggtacggatagtttagaaattcatcaagatgctttagaggatcatcataatgttttaatagtagacgatttaatggcaacaggaggaacggcaaaagcaacggcagagttattggaaaaaattggttgtaatgttttgggctttgcctttattattgaattaaaagccttagaaggtcgtaaaaagctgcctgatgttcccattattactctgatagaatattaa

SEQ ID NO: 11267 - protein, 172 aa, Crocosphaera watsonii WH 8501
MDLKALIRDIPDFPKQGIVFRDITTLLSDAEGLRYTIDTLKEKCLSANLSPDYIVGMESRGFLFGAPLAYQLNAGFVPVRKPGKLPAAVHKVEYELEYGTDSLEIHQDALEDHHNVLIVDDLMATGGTAKATAELLEKIGCNVLGFAFIIELKALEGRKKLPDVPIITLIEY

SEQ ID NO: 11268 - DNA, 519 bp, Exiguobacterium sibiricum 255-15
  CDS (1)..(519): transl_table=11
atggagttcaaacagcatataaaagaggtcgaaaactggccgaaagaaggaatcagtttcaaagatatcacatccctgatgcagaacggtcctgcttataagcagtcagtcgatgcattgatcgactatgcccgtaagcaaggcgcggacgtcatcgccggaccggaagcacgcggattcgttgtcggatgcccagcagcatacgcgatggaaatcggatttgttccagttcgtaaagaaggaaaattaccgcgtgagacagtccgtgtcgagtatggtcttgagtacgggaaagatgtcttgacgatgcaccacgatgcaatccaaccaggacaacgcgtcgtcattctcgatgacctactggcaacaggcggcacgatcgaagcgacaatcaaaatgattgagcaactcggtggaacggttgccggaatcggattcctgattgaacttgacggtttaggcggacgtgaaaaattagaaggatacgatattttatccttgattcgttacgcagattaa

SEQ ID NO: 11269 - protein, 172 aa, Exiguobacterium sibiricum 255-15
MEFKQHIKEVENWPKEGISFKDITSLMQNGPAYKQSVDALIDYARKQGADVIAGPEARGFVVGCPAAYAMEIGFVPVRKEGKLPRETVRVEYGLEYGKDVLTMHHDAIQPGQRVVILDDLLATGGTIEATIKMIEQLGGTVAGIGFLIELDGLGGREKLEGYDILSLIRYAD

SEQ ID NO: 11270 - DNA, 534 bp, Prosthecochloris aestuarii DSM 271
  CDS (1)..(534): transl_table=11
atgcctatcaaatcccgtatccggaccattccggattatccgaaaaagggaatcatgttccgcgacattaccaccctcctcaaggacccggtaggtttcaggctcgtgattgaccagattacccagcactacctggaaaacggcatcaatttcgatatgatcatcggtatggaagcccgaggattcattatcggcggtgcactctcctacacgcttggcaaagggtttgtcccgatcagaaaacccggcaagctgcccggcgaaacggtcaatcaggaataccagcttgagtacggtaccgataaggttgagatgcatatcgacgctctcgaaaaaggtactcgcgttctgcttgtcgacgatcttcttgccaccggaggcaccgctcttgccggcgcagcgctcatagaaaaagtcggcggggttgttgcagatatggccttcatcgtcaatcttcctgatatcggcggccagaaaaagcttgaggagaaaggctatagcctcttctctctcactgagttcgaaggagactga

SEQ ID NO: 11271 - protein, 177 aa, Prosthecochloris aestuarii DSM 271
MPIKSRIRTIPDYPKKGIMFRDITTLLKDPVGFRLVIDQITQHYLENGINFDMIIGMEARGFIIGGALSYTLGKGFVPIRKPGKLPGETVNQEYQLEYGTDKVEMHIDALEKGTRVLLVDDLLATGGTALAGAALIEKVGGVVADMAFIVNLPDIGGQKKLEEKGYSLFSLTEFEGD

SEQ ID NO: 11272 - DNA, 558 bp, Kineococcus radiotolerans SRS30216
  CDS (1)..(558): transl_table=11
gtgagcgacctgctcgtcgtgcccgacgccgagcgcgtcgcggccaccgtcgtcgcggggttccgcgacgtggtggacttcccccagccgggcgtggtcttcaaggacatcaccccgctgctggccgacgcccgcgccttcgccaccgtcgtcgaggcgctggcggcgctggcccgggcgagcggggcgagcgcggtggcggggatcgaggcccgcgggttcatgctcgccgcccccgcggcggaacgggccgggctggggttctggcccgtgcgcaaggccgggaagctgcccgcccccgtcctgcggcgggagtacgccctcgagtacggcaccgcggccctggagctgtcggccgggacggtcggagcgggcgagcgggtcctcgtcgtcgacgacgtcctcgccaccggcggcaccgcgcgcgcggcctgcgaactgctggaggaggccggggcgcaggtcgtggccctggccgtcctgctcgagctcgcccccctcggcggccgcccccggctgggggaccggccggtcgtggcgctgcacacccagacctga

SEQ ID NO: 11273 - protein, 185 aa, Kineococcus radiotolerans SRS30216
MSDLLVVPDAERVAATVVAGFRDVVDFPQPGVVFKDITPLLADARAFATVVEALAALARASGASAVAGIEARGFMLAAPAAERAGLGFWPVRKAGKLPAPVLRREYALEYGTAALELSAGTVGAGERVLVVDDVLATGGTARAACELLEEAGAQVVALAVLLELAPLGGRPRLGDRPVVALHTQT

SEQ ID NO: 11274 - DNA, 522 bp, Croceibacter atlanticus HTCC2559
  CDS (1)..(522): transl_table=11
atgaaaacttttaatttagaagaatatatacgtgatgtaaaagactttcctaaagaaggtgttctttttaaagatattacacctttattaaaccatcctcaagctagcgaacaatgtttgcaagagttactggatttaataggagatctaaagatagataaggttgtgggaattgagtcgcgtggctttttttacggaacattattagctaaagaattaaatgctggttttgtgccagttaggaaaccaggtaagttgccatataatacaaattctgaaacctatgatttagaatatggtacagataccttagagattcataaggatgccattaaaaaaggtgacaaggtattgttgcatgatgatgttctagcaactggaggaactgctaaagctgtagttaatctcattgaaagcttgggtggggaaattgtacaatgtaacttcttaatgattataggctttttaaagggtagtgagaagcttaaagactataatgtagcttctgtacttagttactaa

SEQ ID NO: 11275 - protein, 173 aa, Croceibacter atlanticus HTCC2559
MKTFNLEEYIRDVKDFPKEGVLFKDITPLLNHPQASEQCLQELLDLIGDLKIDKVVGIESRGFFYGTLLAKELNAGFVPVRKPGKLPYNTNSETYDLEYGTDTLEIHKDAIKKGDKVLLHDDVLATGGTAKAVVNLIESLGGEIVQCNFLMIIGFLKGSEKLKDYNVASVLSY

SEQ ID NO: 11276 - DNA, 531 bp, Sulfitobacter sp. EE-36
  CDS (1)..(531): transl_table=11
atgaaacaggttcaagattacatccgtaccattgtcgatttcccccacgaagggatcatgtttcgcgatgtgaccacgcttttcgccgacccgcgcgggttccgtatggccatcgaccagatgctgcacccctatgccggcatcgacatcgacaaggtcgtcgggcttgaggcgcgcggctttattctgggtggcgcgatcgcgcatcagctgtccgtcggctttgtacctattcgcaagaagggcaagctgcccggacgcaccatctctcaggattacaagctggaatacggcgaggcgattgtggagctgcacgacgacgcgatcaaacccggtgagaaggtgttggttgtcgacgatctactggccaccggtggcaccgccgaggcggggatcaagctgatccagcgtttgggcggcgagatcgtgtcctgcgcctttatcatcgacctgccggaacttggcgggcgcaagcggctggaagcgatggggatggaggtcaacgcgctctgtgcctttgaaggcgcgtaa

SEQ ID NO: 11277 - protein, 176 aa, Sulfitobacter sp. EE-36
MKQVQDYIRTIVDFPHEGIMFRDVTTLFADPRGFRMAIDQMLHPYAGIDIDKVVGLEARGFILGGAIAHQLSVGFVPIRKKGKLPGRTISQDYKLEYGEAIVELHDDAIKPGEKVLVVDDLLATGGTAEAGIKLIQRLGGEIVSCAFIIDLPELGGRKRLEAMGMEVNALCAFEGA

SEQ ID NO: 11278 - DNA, 531 bp, Roseovarius nubinhibens ISM
  CDS (1)..(531): transl_table=11
atgaaaaccgtcaaagactatatccgcaccatcccgaatttcccccatgaggggatcatgttccgcgatgtgaccacgctgttcggcgatggcgcaggcttttccctcgccgtcgatcagatggtcgaggccgcccaaggccgcgacatcgacaaggtcgcaggtctcgaagcccgcggcttcatcctcggcggtgccatcgcgcatcggctgggctgtggcttcgtgccgatccgcaaggccggcaaactccccggcagcaagatttccgaggcctatctgctcgaatatggcgaggccgtggtcgagatccacgaagacgcgatcgaacccggcgaacgggtgctgctggtcgatgacctgctggccaccggcggcaccgccgaggccggcatccgcctcatcgagcggctcggcggtcaggtggtcggctgcagctttgccgttgacctgccggaactcggcggcgcggcccggctgcgcgccatggggatggatgtcgacatgctctgcgccttcgacggcgcctga

SEQ ID NO: 11279 - protein, 176 aa, Roseovarius nubinhibens ISM
MKTVKDYIRTIPNFPHEGIMFRDVTTLFGDGAGFSLAVDQMVEAAQGRDIDKVAGLEARGFILGGAIAHRLGCGFVPIRKAGKLPGSKISEAYLLEYGEAVVEIHEDAIEPGERVLLVDDLLATGGTAEAGIRLIERLGGQVVGCSFAVDLPELGGAARLRAMGMDVDMLCAFDGA

SEQ ID NO: 11280 - DNA, 552 bp, Prochlorococcus marinus str. MIT 9211
  CDS (1)..(552): transl_table=11
ttgaagtggacaattaatgatcaaaataaaacaatgatgtcaaattatcttagccaactaatcagtcaacataaagactttcctaagaaaggaattgtcttcaaagatgttttaccacttctacaacatccaaatgaattagaggggctaattcagggcatgtctacaggtcaaatatttgaatcatcagatgcaattgtctccattgatgcaagaggttttatttttggaactgcaatatcaatgaaattatctaaaccaatgattgttgccaggaaacctggcaagttacctggggaacttataacgcattcctatgaactggaatatggccagaactcactttcaatccaaaaaaaagcaatagaaaattaccagtcatttgtaattgttgatgatttattagctactggtgggacagcaatgtgcgtttcagaaatgctgaaagaggcaggcaaagacataacaggtttatcagtggttgttgagttgggccaactcaacgctagagcttatctaccattccctgtagaatcacaaataattttctag

SEQ ID NO: 11281 - protein, 183 aa, Prochlorococcus marinus str. MIT 9211
MKWTINDQNKTMMSNYLSQLISQHKDFPKKGIVFKDVLPLLQHPNELEGLIQGMSTGQIFESSDAIVSIDARGFIFGTAISMKLSKPMIVARKPGKLPGELITHSYELEYGQNSLSIQKKAIENYQSFVIVDDLLATGGTAMCVSEMLKEAGKDITGLSVVVELGQLNARAYLPFPVESQIIF

SEQ ID NO: 11282 - DNA, 537 bp, Erythrobacter sp. NAP1
  CDS (1)..(537): transl_table=11
atgacacctgaggcgctgaaggcgctggttcggacagtgcccgactttcccgaacccggcatccagttccgcgatatcaccacgctgatcggacatgctgaggggctgtcggccagcgtcgagcatcttgctgcaaaggcttgcgcaggcggcgcacagaaaatcgcaggaatggaagcgcgcggtttcatcttcggtgcggctgtcgccgcagcgctcggcatcggcttcgttccgattcgcaagcccggcaagctcccgatcgacaccatcggcatcgactacgcccttgaatacgggaccgaccgtctcgaaatggacccgcaagcggttgccgctggagagagggtcgtcatcgtcgacgatctgattgcgaccggcggcacggcgctcgccgctgcagagctcattcgcatggcgggagcggtggtggagcaagcgcttttcgtcatcgacctgcccgatctgggcggcgcggaaaaattgcgtggagccaaagtggcggttgaagcgttgatgcacttcgaaggcgagtga

SEQ ID NO: 11283 - protein, 178 aa, Erythrobacter sp. NAP1
MTPEALKALVRTVPDFPEPGIQFRDITTLIGHAEGLSASVEHLAAKACAGGAQKIAGMEARGFIFGAAVAAALGIGFVPIRKPGKLPIDTIGIDYALEYGTDRLEMDPQAVAAGERVVIVDDLIATGGTALAAAELIRMAGAVVEQALFVIDLPDLGGAEKLRGAKVAVEALMHFEGE

SEQ ID NO: 11284 - DNA, 564 bp, Synechococcus sp. RS9917
  CDS (1)..(564): transl_table=11
atggctgcgatgatgacagggctctggcctttacgtcacctctccttggatcttcgccagctcatccgggacattcccgattttcctaaacctggaattctgtttcgggacatcagccccctgctgcgggacccggcgggatggtcggaggtgatgcggcgcctcggtggtgtgtgcgaccagttgcagccggatctgatcgtggggatcgaatcccggggcttcatcgtgggcaccgccctcgccaccgatcggaaactgggtttcgtgccggtgcgcaagccgggcaaattgcccggtgaggtgattgcgatcgactactcgctggaatatggcagcgatcgccttgaaatgcatgccgatgccctgcgggacggggcacgggtgttgattgtggatgacctgctcgccaccggcggcacagccagcgccaccgccagcctcgtgcaacaggccggcggtcagttggtgggctgcggctttgttgtggagctggctggtctggatggacgccgtcgcctgcccgatcagaccccggtggaatccctgatcatctacagctga

SEQ ID NO: 11285 - protein, 187 aa, Synechococcus sp. RS9917
MAAMMTGLWPLRHLSLDLRQLIRDIPDFPKPGILFRDISPLLRDPAGWSEVMRRLGGVCDQLQPDLIVGIESRGFIVGTALATDRKLGFVPVRKPGKLPGEVIAIDYSLEYGSDRLEMHADALRDGARVLIVDDLLATGGTASATASLVQQAGGQLVGCGFVVELAGLDGRRRLPDQTPVESLIIYS

SEQ ID NO: 11286 - DNA, 558 bp, Synechococcus sp. WH 5701
  CDS (1)..(558): transl_table=11
atggccctgagcaccacagtccccgagttgggcgagcccattgatctgcggggactggtcagggatgtgcccgatttccccaagcccggcatcctcttccgcgacctcactccgctgatgcgtgacccccggggctggaaggaagtggtgcgcctgttggcgggggtttgcgcgcagctgcgcccggatctgatcgtgggcatcgaatcccggggcttcatcgtgggcacggccctggccacgaccgtggagatcggcttcgtgccggtgcgcaagcccggcaagctgcccggccaggtgcgcgccgtggactacgccctggaatacggccacgaccgcctcgagatccagcacgacgctctggcgggcgggccgcgggtgttgatcgtcgacgacctgctggccacgggcggcaccgccgcggcctgtgcccagctggtgaccgaggccggcggcgacctctgcggctttggcttcgtggcggagctggcggacctcggcgggcgctcgcgcctgccaggagaccatccagtggagtccctgatcgtctacgcctga

SEQ ID NO: 11287 - protein, 185 aa, Synechococcus sp. WH 5701
MALSTTVPELGEPIDLRGLVRDVPDFPKPGILFRDLTPLMRDPRGWKEVVRLLAGVCAQLRPDLIVGIESRGFIVGTALATTVEIGFVPVRKPGKLPGQVRAVDYALEYGHDRLEIQHDALAGGPRVLIVDDLLATGGTAAACAQLVTEAGGDLCGFGFVAELADLGGRSRLPGDHPVESLIVYA

SEQ ID NO: 11288 - DNA, 519 bp, Synechococcus sp. WH 7805
  CDS (1)..(519): transl_table=11
gtggatcttcgtcagtacgttcgcgatattcccgacttccctaagcccggaatcttgttccgagacatcgcccccttgcttcgagaacccaccggctgggctgaggtgatccgacgcctgattgctgtgtgtgagcgatggcaaccggatctgatcgtgggcatcgaatccagggggttcattgttggaacggcgctggcaacccagctgcagaaggggtttgtacccgttcgcaagccaggcaaattgcctggtgaagtgatcggaatcgattacaccctcgagtacggcagtgatcgactggagattcacgcggatgctctgactgatcatccgagggtgatgcttgttgacgacctgctggccaccggggggactgcctcggcctcggctgaattggtgaccaaggccggcggagtgctcgtcggttgcggtttcgtgattgaactagcggaacttgatgggcgcaggaagctgccagctggtgttcctgtcgaatctctgattatttacgagtga

SEQ ID NO: 11289 - protein, 172 aa, Synechococcus sp. WH 7805
MDLRQYVRDIPDFPKPGILFRDIAPLLREPTGWAEVIRRLIAVCERWQPDLIVGIESRGFIVGTALATQLQKGFVPVRKPGKLPGEVIGIDYTLEYGSDRLEIHADALTDHPRVMLVDDLLATGGTASASAELVTKAGGVLVGCGFVIELAELDGRRKLPAGVPVESLIIYE

SEQ ID NO: 11290 - DNA, 546 bp, Pseudoalteromonas tunicata D2
  CDS (1)..(546): transl_table=11
atgacacagtcaacccttgactatattaaggccagtattgctaccgtgcctaattatcctaaagccggaattatgttccgtgatgtaacgagcttaattgccgatcctgtggcatttaaagctgttattgatgcttttgttgcagcttatcaggcgcaaggttttgataaaattattggcactgaatcgcgagggtttatttttggtgctccgcttgctattgcactgggaattccttttattccggtacgtaaaccaggtaaattaccacgtgaagtcattagccaagcgtaccaattagaatatggcgaagatgtgctcgaaatccataccgatgcgatttcacaaggcgataaagtattattagttgatgacttattagcgacgggtggtacgatagaagccacaattaaattggtagaacgcttaggtggtcatgcatctgatgcggcgtttgttgtgtcgttacctgagttaggtggtgagcaacgcctagaaaagttaggcatcaatattctaaaattagtcgagtttgaaggcgaataa

SEQ ID NO: 11291 - protein, 181 aa, Pseudoalteromonas tunicata D2
MTQSTLDYIKASIATVPNYPKAGIMFRDVTSLIADPVAFKAVIDAFVAAYQAQGFDKIIGTESRGFIFGAPLAIALGIPFIPVRKPGKLPREVISQAYQLEYGEDVLEIHTDAISQGDKVLLVDDLLATGGTIEATIKLVERLGGHASDAAFVVSLPELGGEQRLEKLGINILKLVEFEGE

SEQ ID NO: 11292 - DNA, 546 bp, Photobacterium sp. SKA34
  CDS (1)..(546): transl_table=11
atgaaccaagaaacacttaacttgattaaaaatagtattaaatcaattcaagattacccaaaaccgggtatcttattccgtgatgtgacgagcttgatggaacaaccagaagcttaccgtgcaacgattgctattttagctgaaaagtataaagatcaggggattacaaaaattatcggaactgaagcgcgcggttttttgtttggtgcaccattagcattagaactgggtgttggttttgtgcctgttcgtaagccaggtaaactaccgcgtgaagtgattgctgaaagttacgagttagaatacggcaaagatacactagaaattcataaagatgcgattaaacctggcgatcgcgtattgcttgttgatgatttattggcaacaggtggcaccattgaagcgacaacgaatttagtgcgtcgtttaggtggtattgtcgatgatgctgcttttgttattaacttgcctgacattggcggtgaagcgcgtctgcaaggtttaggcttaaatgtgtatgctatttgtgactttccaggtcactaa

SEQ ID NO: 11293 - protein, 181 aa, Photobacterium sp. SKA34
MNQETLNLIKNSIKSIQDYPKPGILFRDVTSLMEQPEAYRATIAILAEKYKDQGITKIIGTEARGFLFGAPLALELGVGFVPVRKPGKLPREVIAESYELEYGKDTLEIHKDAIKPGDRVLLVDDLLATGGTIEATTNLVRRLGGIVDDAAFVINLPDIGGEARLQGLGLNVYAICDFPGH

SEQ ID NO: 11294 - DNA, 543 bp, Oceanospirillum sp. MED92
  CDS (1)..(543): transl_table=11
atgtcatatgacgagtgttatgtgaagtctgtcatcagaactattccagactggcctgaaccgggcgttcagttcagagacatcactccgctgtttaaagaccccaaagctctacgcatgatctccgatgcgtttatccagcgctatatcgatagtgaaatcactcatattgccagtatcgatgctcgtggtttcctgatcagctctatcatggcttaccatctgaatattccgttagtactggtacgtaaaaaaggcaaactgccaggtgagactattcaccaggagtacaaacttgaatacggtacagctgcggttgagatgcaactagatgcagtaactgaaggcgataaagtgctcgtctttgatgatctgatcgccactggcggaacaattctggccgcatgcagcctgattaaagagttgggagctgaggtttacgaagcagcagcgctgattgatcttcctgacctgcaaggctccagcaagattcaagacgcaggtgtacctgttcacagcctcctagcttttgaaggcatctaa

SEQ ID NO: 11295 - protein, 180 aa, Oceanospirillum sp. MED92
MSYDECYVKSVIRTIPDWPEPGVQFRDITPLFKDPKALRMISDAFIQRYIDSEITHIASIDARGFLISSIMAYHLNIPLVLVRKKGKLPGETIHQEYKLEYGTAAVEMQLDAVTEGDKVLVFDDLIATGGTILAACSLIKELGAEVYEAAALIDLPDLQGSSKIQDAGVPVHSLLAFEGI

SEQ ID NO: 11296 - DNA, 522 bp, Flavobacteria bacterium BBFL7
  CDS (1)..(522): transl_table=11
atgaataatgaatttatagaatcccacatacacgacatcccagatttccctaaagaaggaattgtttttaaggatatttctccattactcgcttccgcgaaagcgagatccatcaccacagaactactcgttagagactttagaggtcaaactattgatgtggtagtaggtattgaatctagaggctttctttttggaatgctactagcagatgcactcaacgcaaaatttgtaatgttgcgtaagcctggcaaattacctggagccattatttcacaaaagtatgagctagaatatggtacagatactctagaactacaggaaaatgcaatttcacctggtgattgtgtattgatacacgatgatgtgttggctactggcggcactgcaatagccgcagctcaaatcattcaaaaagctggtgggaaagtagaaggttttaactttgttattgaactagactttattaatggccgcgaaaaaattaaagattataagatcgcatcagtacttcactattaa

SEQ ID NO: 11297 - protein, 173 aa, Flavobacteria bacterium BBFL7
MNNEFIESHIHDIPDFPKEGIVFKDISPLLASAKARSITTELLVRDFRGQTIDVVVGIESRGFLFGMLLADALNAKFVMLRKPGKLPGAIISQKYELEYGTDTLELQENAISPGDCVLIHDDVLATGGTAIAAAQIIQKAGGKVEGFNFVIELDFINGREKIKDYKIASVLHY

SEQ ID NO: 11298 - DNA, 543 bp, Oceanobacter sp. RED65
  CDS (1)..(543): transl_table=11
atgtctgcatacgaaaacgaaattaagcaagcggttcgaacgatagagaactggccagatgaaggtgtgatgtttcgcgatatcatgcccttgctgcaagacgcccatatttttagaaaactaatcgatagctttgtacaccgttaccaaaaagaaactgtggatgcggtcgctgccattgatgcccgtggctttatccttggtgcgcctttagcatatgagttgggagtaccgttggtgccggtgcgtaaaaaaggaaaactcccttacgaaaccgtgagccaaagctacaaactcgagtacggcgaagcagagatcgagctgcacacagatgctctaaaagccggcgataacgtagtggtaatggatgatttaatcgcaactgggggaaccatgctagcggcctgcgagctgatcaagaagctggatgcgaatgtattggaagtagcggctatcattgatctaccagacctaaagggcagtgagcgcctgagggacgctggctttaatatctacagcatttgccagtttgatggtctgtga

SEQ ID NO: 11299 - protein, 180 aa, Oceanobacter sp. RED65
MSAYENEIKQAVRTIENWPDEGVMFRDIMPLLQDAHIFRKLIDSFVHRYQKETVDAVAAIDARGFILGAPLAYELGVPLVPVRKKGKLPYETVSQSYKLEYGEAEIELHTDALKAGDNVVVMDDLIATGGTMLAACELIKKLDANVLEVAAIIDLPDLKGSERLRDAGFNIYSICQFDGL

SEQ ID NO: 11300 - DNA, 513 bp, Desulfitobacterium hafniense DCB-2
  CDS (1)..(513): transl_table=11
ttggattttgataagtacatacgcgttattgatgatttccccaaacccggtatttctttcaaggatattactaccctgttaaaggatggagaagcttatcgggcagcggttgatgccatcgttgagcgggtcagggaatctcaaccggatctgattgtgggaccggaagcccgcggctttttgctgggagctccggtagcttatgccttgggcattggctttgttccggtgcgtaaaccgggcaaacttccgggtaaaacagtgagcgaaacctatgaacttgaatatggtagtgatacgttagaagttcacgctgatgccattcaaccgggacaacggatcgcgattgtcgatgatttgctggcgaccggcggcacgacttccgccacagcccgtttaattgaaaagaccggcgcccaggtggcaggaatgagttttttgattgaattgggctttctggaaggccgtaagagactggaagggtatgaggtattttctttaattaagtattaa

SEQ ID NO: 11301 - protein, 170 aa, Desulfitobacterium hafniense DCB-2
MDFDKYIRVIDDFPKPGISFKDITTLLKDGEAYRAAVDAIVERVRESQPDLIVGPEARGFLLGAPVAYALGIGFVPVRKPGKLPGKTVSETYELEYGSDTLEVHADAIQPGQRIAIVDDLLATGGTTSATARLIEKTGAQVAGMSFLIELGFLEGRKRLEGYEVFSLIKY

SEQ ID NO: 11302 - DNA, 564 bp, Synechococcus sp. RS9916
  CDS (1)..(564): transl_table=11
atggctgcgatgatgccagcactgaggcctccgcgtcacccttcgttggatctaaaaccactaattcgcgacattcctgatttccccaagcctggaattctgtttcgcgacatcactcctttgctgcgtgatcccgaggggtggcgcgctgtgatgaatcagatgggggccatttgtgagcgacttcaacccgacctgatcgtgggcatcgaatcccgaggcttcattgtcggcaccgccctagcaacagaccgcaagttgggatttgtgccagtgcgcaaacccgggaaattaccgggtgagatcctcggcatcgactacgccctggaatacggcaccgatcgcctcgagattcatgccgatgcccttcaagggggagccaaggtgttgttggtggacgacttgctggcaacaggaggcacagcagcagcagcagctcagctgatcagccaggcaggcggagacttggtgggttgcagctttgtgatcgaactcgccgcactggcggggcgagaaaaattgccgcaggccactccagtggaatccctggtgatttattcctga

SEQ ID NO: 11303 - protein, 187 aa, Synechococcus sp. RS9916
MAAMMPALRPPRHPSLDLKPLIRDIPDFPKPGILFRDITPLLRDPEGWRAVMNQMGAICERLQPDLIVGIESRGFIVGTALATDRKLGFVPVRKPGKLPGEILGIDYALEYGTDRLEIHADALQGGAKVLLVDDLLATGGTAAAAAQLISQAGGDLVGCSFVIELAALAGREKLPQATPVESLVIYS

SEQ ID NO: 11304 - DNA, 546 bp, Vibrio sp. Ex25
  CDS (1)..(546): transl_table=11
atgactacagaaacaatttcactgatcaaatctagcatcaaaagcatccaagactacccaaagccaggcattctatttcgtgatgtgacgagccttcttgaagacgcaaaagcataccaagcgacgatcaacttacttgttgaacgttacaaagatatgggctttaccaaggttgtgggtacggaagctcgtggctttttatttggtgcgcctttagcgcttgagctaggtgttggttttgtaccagtacgtaaaccaggcaagctaccacgtcctactgttgctcaatcttatgagcttgaatacggcgttgatacactagaaatccatacagatgccatcgttgaaggcgacaaagtactggttgtcgacgatttattggcaacgggcggtactattgaagcgacgactaagctgattcgccaactgggcggtgaagttgagcacgctgcgttcgttatcaacctaccagaaatcggtggtgataaacgtttagaagcactaggtctaaacgtatacagcatttgcgattttgaaggacattaa

SEQ ID NO: 11305 - protein, 181 aa, Vibrio sp. Ex25
MTTETISLIKSSIKSIQDYPKPGILFRDVTSLLEDAKAYQATINLLVERYKDMGFTKVVGTEARGFLFGAPLALELGVGFVPVRKPGKLPRPTVAQSYELEYGVDTLEIHTDAIVEGDKVLVVDDLLATGGTIEATTKLIRQLGGEVEHAAFVINLPEIGGDKRLEALGLNVYSICDFEGH

SEQ ID NO: 11306 - DNA, 546 bp, Alteromonadales bacterium TW-7
  CDS (1)..(546): transl_table=11
atgactcaagtaacaccagcaattattaaaaacagcattgcaacaattgctgattatcctaaagcgggcattatgtttcgcgatgtaactacattaatggccaaccctgaagcgttcaaggctactattgatgcgtttataaccgaatataaagaccaaggttttacaaaaattattggcacagaatcacgtggctttatttttggtgcgcctttatcttatgctttaggtattccttttattccagtgcgtaagcctggcaaattaccgcgcgaagttattcgccaagattacctactagaatacggtgaagacacgctagaacttcatgttgatgcaattgtacccggtgacaaagtacttcttgttgatgaccttctagccactggcggtactattgaagcgactgctaaactagttaataagttaggcggtgaggctactgatgcagcatttgttgtatcactgcctgaattaggtggcgaacaacgcattgaaaaaatgggtatcaaaatcttaaagttggttgaattcgaaggcgaataa

SEQ ID NO: 11307 - protein, 181 aa, Alteromonadales bacterium TW-7
MTQVTPAIIKNSIATIADYPKAGIMFRDVTTLMANPEAFKATIDAFITEYKDQGFTKIIGTESRGFIFGAPLSYALGIPFIPVRKPGKLPREVIRQDYLLEYGEDTLELHVDAIVPGDKVLLVDDLLATGGTIEATAKLVNKLGGEATDAAFVVSLPELGGEQRIEKMGIKILKLVEFEGE

SEQ ID NO: 11308 - DNA, 522 bp, Candidatus Desulfococcus oleovorans Hxd3
  CDS (1)..(522): transl_table=11
atggatctgaaagcaaccatacgcaccctgcccaactggcccatcgaaggggtaatgttccgggacatcaccaccctgcttcaggacccggccgccttcaaggaggccatcaaccgtttttacgaccgataccggacaatgaagatcgataaaatcgtgggcatcgacgcccggggcctgatcttcggcgcgcccctggcctacaagctggaggtggggtttgttccggttcgaaaaaaggggaaaatcccctttcgcaccatcggcgcggcctactccctggagtacggggagagcatggtggaaattcatgaagacgccattctaaaaggggaaagggtcgttgttgttgacgacctgatcgctaccggcggtacagtgaaagccaccatcgacctggtggaaaagttggggggcgaggtggtggagtgcgcctttgtcattgacctgcccgacctgaaaggccgggaaaaaattcgtgattacaaaatgtttgcattgatggaatttgaaggtgagtag

SEQ ID NO: 11309 - protein, 173 aa, Candidatus Desulfococcus oleovorans Hxd3
MDLKATIRTLPNWPIEGVMFRDITTLLQDPAAFKEAINRFYDRYRTMKIDKIVGIDARGLIFGAPLAYKLEVGFVPVRKKGKIPFRTIGAAYSLEYGESMVEIHEDAILKGERVVVVDDLIATGGTVKATIDLVEKLGGEVVECAFVIDLPDLKGREKIRDYKMFALMEFEGE

SEQ ID NO: 11310 - DNA, 543 bp, Marinobacter sp. ELB17
  CDS (1)..(543): transl_table=11
atggattacttttcccagagcatcaagcaggctatccgcacggttccggactggccgaaacccggtgtcactttccgcgacatcacgacggtgctgcagaacaaaaccgcgtttcgcaaactgattgatgcctttgtacaccgctaccacgaccagcatatagacgcgattgctgcggtagatgcccgtggctttatcattggctctgctctggcgtatgaactgaacgcctcgttggtgttgattcgcaagaaaggcaagctgccgtttgataccttagtggaagactacgaactggaatacggcaccgcctcggtggagctgcacaaagacgccctcaaacccggcgacaaagtggtgctggtcgatgatctgatcgccaccggtggcacgatgctggccgcctcccggctgattcgcaggattggcgccgaaattgtagaagtcgcagcgatgattgatctgcccgacctgggcggttctgacaagctgcgagccgaaggcttaacggtttatactgtatgctcattcgagggagaataa

SEQ ID NO: 11311 - protein, 180 aa, Marinobacter sp. ELB17
MDYFSQSIKQAIRTVPDWPKPGVTFRDITTVLQNKTAFRKLIDAFVHRYHDQHIDAIAAVDARGFIIGSALAYELNASLVLIRKKGKLPFDTLVEDYELEYGTASVELHKDALKPGDKVVLVDDLIATGGTMLAASRLIRRIGAEIVEVAAMIDLPDLGGSDKLRAEGLTVYTVCSFEGE

SEQ ID NO: 11312 - DNA, 537 bp, Riemerella anatipestifer
  CDS (1)..(537): transl_table=11
atggcaactcaagaactcattaaaaaattagaaaaaaccattgataatatcccaaacttccctaaagaagggatacagtttaaggatatcacacctattttccttaatccagaactttacgaagaggtcatagatgatttggtggcgtttagtaaaggtaaggtagatgtagtctgtggtatagaaagcagaggcttcctttttggaatagctgtggcggtaaagttaggagttccttttgtgttaattcgtaagaaaggtaaacttccgcctccgtttatttctcaaaaatacgatttggagtacggctcatcagagatagaaatgaaagaggggcaattaaaagctggtgatagagttctaattcacgatgaccttttagcaacaggcggaactactgaagctgcagcaaaactagtggagaaacaaggagcaaaagcagcacagtttagtttcttaattgggcttaaggctcttggaggagaggcgaaattaaagaaattcaattcagaaatttatcagttattagaatactaa

SEQ ID NO: 11313 - protein, 178 aa, Riemerella anatipestifer
MATQELIKKLEKTIDNIPNFPKEGIQFKDITPIFLNPELYEEVIDDLVAFSKGKVDVVCGIESRGFLFGIAVAVKLGVPFVLIRKKGKLPPPFISQKYDLEYGSSEIEMKEGQLKAGDRVLIHDDLLATGGTTEAAAKLVEKQGAKAAQFSFLIGLKALGGEAKLKKFNSEIYQLLEY

SEQ ID NO: 11314 - DNA, 519 bp, Lactobacillus reuteri
  CDS (1)..(519): transl_table=11
atggctttagacctttataaatacgtagctagtgttcctgattatccagaaaagggtattatttttcgggatattttaccgttaatggctgatggagctgcatttaagcaagctactgacgaattagttgattatgctaaggataaaaaggtagatatggtagtaggaccagaagcgcgaggctttattgttgggtgtcctattgctcgtgaactgggtgttggatttgctccggcacgtaaaaagggtaagttgccaagaaaagcaattagtgcatcttatgacttagaatacggaacagctaccttgcaaatggaagccgatgcaattaaaccgggacaacgggttcttgttgtggatgatctcttagctacaggtggaacaatctctgcaacaattgatatggttgaacaaatgggtggtattgttgttggctgtgcattcttaatcgaattaaaagatcttcatggtcgcgataagcttaaagattacgatatgaaggcattaatggaattttaa

SEQ ID NO: 11315 - protein, 172 aa, Lactobacillus reuteri
MALDLYKYVASVPDYPEKGIIFRDILPLMADGAAFKQATDELVDYAKDKKVDMVVGPEARGFIVGCPIARELGVGFAPARKKGKLPRKAISASYDLEYGTATLQMEADAIKPGQRVLVVDDLLATGGTISATIDMVEQMGGIVVGCAFLIELKDLHGRDKLKDYDMKALMEF

SEQ ID NO: 11316 - DNA, 753 bp, Phaeosphaeria nodorum
  CDS (1)..(753)
atgtccgccccctccgacactcccacgcactctgcccacccgctaaacactacgactacggccaatacaccgctcaagggcgacgcaactgctgcccaccccccgcagggcaaacccgatccgaccctcgagtctaacagcaatgccgccaaaggaggactcgccgccccccatgcctcccccgccgccgaactcgcccgtcttaagatagacttgaaaaagtcgctgaagcaattcccagactttcctgaaccaggcattttgtttgaagacatactgcccatctttgccaaccccacgctccacgaggggctcatccggtcgctcgagctcgccgtgaccaaggaattcagcggcaagcccgatgtcgttgttggcctcgatgcgcgcggattcttgttcggcccaagtcttgcgctgagactgggcgcggcgtttgtgccggtgcgcaagaggggaaagctcccggggccgtgcgagacggccgagtacatgaaggagtatggtagcgatttcttccagatgcaggagggcgttgtgaagagtggacaaaaggtgttgattgtcgatgatatcatcgctactggtggctcagcatctgcagccggctccctcgtgaagaagctcggcggctcaataatgggctacgtattcatcctcgagctcgacttcctcaagggccgcgacaagctcgatgcgcccgtatacacgctcctagcgagtcaggaggagaagatggagagcgagaagtag

SEQ ID NO: 11317 - protein, 250 aa, Phaeosphaeria nodorum
MSAPSDTPTHSAHPLNTTTTANTPLKGDATAAHPPQGKPDPTLESNSNAAKGGLAAPHASPAAELARLKIDLKKSLKQFPDFPEPGILFEDILPIFANPTLHEGLIRSLELAVTKEFSGKPDVVVGLDARGFLFGPSLALRLGAAFVPVRKRGKLPGPCETAEYMKEYGSDFFQMQEGVVKSGQKVLIVDDIIATGGSASAAGSLVKKLGGSIMGYVFILELDFLKGRDKLDAPVYTLLASQEEKMESEK

SEQ ID NO: 11318 - DNA, 513 bp, Spiroplasma citri
  CDS (1)..(513): transl_table=4
atggatctaaaaaaatttattgttgatattcctaattatccagagagaggtgttatttttcgtgatattactccgttgttaaataatgccttagcttttacaacagtgattaatcaattagcagcttatgctgttgcccaaaaagcaaccgtaattattgctcctgaagcacgtggctttttgtttgggccagctgttagttattctaccaatttacgatttattcctgtgcgaaaagtaggaaaattaccacgaccagttattaatgtaaagtatagttacgaatatgcggaaaatcaattagaaattcatgctggagatttacagccaagtgatcgtgtgttaattgttgatgatgttttagcatcgggaggaacagctcgggcaatgtgtcaattagttaaccaagagcaagcaacagttgctggattggcatttgtgattgatttaacatatttaaatggtaaaaaagatttagattcatatccaattaaaaccctgattgaatattaa

SEQ ID NO: 11319 - protein, 170 aa, Spiroplasma citri
MDLKKFIVDIPNYPERGVIFRDITPLLNNALAFTTVINQLAAYAVAQKATVIIAPEARGFLFGPAVSYSTNLRFIPVRKVGKLPRPVINVKYSYEYAENQLEIHAGDLQPSDRVLIVDDVLASGGTARAMCQLVNQEQATVAGLAFVIDLTYLNGKKDLDSYPIKTLIEY

SEQ ID NO: 11320 - DNA, 516 bp, Candidatus Kuenenia stuttgartiensis
  CDS (1)..(516): transl_table=11
atggaatatttaaaaaaattaattcgcgatgtaccggatttcccgaaagtgggagtactatttaaagacataacgcctcttcttcaagacgcaaagggtttgaaagattcgatagcgtgtattgccagctacgttgaaaacaaaaaaatagatattgttgtcggcgcggaggcgagaggcttcatactagcgacaacggttgctttttcaatcggtacaggttttgttcccatcagaaaaccagggaagcttccctatgaaaaagcaagcatgacgtacaaccttgaatacgggacagatacactggaaatacacaaagatggtattaaaaagggacaacaggttctcatggtagatgatcttttggctactggtggcacaatgaatgcatgttgcaagctggttgagtcgcttggcggcaatattgttggttgtgcttttttaattgaattaggttttttgaacggaagggatatcttgagtaaatatgacctgttttcattaataaaatactga

SEQ ID NO: 11321 - protein, 171 aa, Candidatus Kuenenia stuttgartiensis
MEYLKKLIRDVPDFPKVGVLFKDITPLLQDAKGLKDSIACIASYVENKKIDIVVGAEARGFILATTVAFSIGTGFVPIRKPGKLPYEKASMTYNLEYGTDTLEIHKDGIKKGQQVLMVDDLLATGGTMNACCKLVESLGGNIVGCAFLIELGFLNGRDILSKYDLFSLIKY

SEQ ID NO: 11322 - DNA, 534 bp, uncultured bacterium
  CDS (1)..(534): transl_table=11
atgaccttcgacctcaaggacacgatccgcacgatacccgattacccgaaacaaggcatcatgttccgggacatcacgacgcttctcggcgacgcccgcgcgtttcgccgcgcgatcgacgaattggtgcagccctgggccggaaccaagatcgacaaggtcgcagggatcgaagcgcgcgggttcatcctgggcggcgcggtcgcgcatcagctctcggccggcttcgtaccgatccgcaagaaaggcaagctgccgtacaccaaggtctcgattgcctattcactcgaatatggtctcgacgagatggagatgcacaaggatgccgtggcgcccggagaaagagtgatcctcgtcgacgatctcattgcgaccggcggctcggcggagggcgcggttgggctgttgaaaaaaatcggcgccgatgtggtggcggcctgtttcgtgatcgatcttccggatctcgacggcgccaaaaaaatcaaggccctcggcgtgccggtcagaacgctgatgtcttttgggggacattag

SEQ ID NO: 11323 - protein, 177 aa, uncultured bacterium
MTFDLKDTIRTIPDYPKQGIMFRDITTLLGDARAFRRAIDELVQPWAGTKIDKVAGIEARGFILGGAVAHQLSAGFVPIRKKGKLPYTKVSIAYSLEYGLDEMEMHKDAVAPGERVILVDDLIATGGSAEGAVGLLKKIGADVVAACFVIDLPDLDGAKKIKALGVPVRTLMSFGGH

SEQ ID NO: 11324 - DNA, 651 bp, Magnaporthe grisea
  CDS (1)..(651)
atgtcctccaccgatcccaccacaaccggccaaaccgcccaagatgcctcgcgacagcagcccaccgccgccgcctcctcctcctccgaactcgccagtgctaagataaccttgtacaaggtgctgcggcgctttgccgacttccccatcgagggcatcgtctttattgacattatgcccatctttatcgacccgaaagcccacctcgccctcctccgcgccctcgagcttcaggtcctttcgtcctttgcacccgctaccgccaagcccgacgtcgtcgtcggtctcgatgcgcgcggcttcctgttcggcccctcgctggccctgaagctcgacgcttcctttgtgcccgtccgcaaaaagggcaagctgcccgggccctgcgtcacggctacatacgagaaggagtatggccaggactttttccagatgcaggagggtgccatcaagccaggacaaaaggttctgctcgtggacgacatcattgcaactggtggctcggctgctgctgctggtgagcttgtcaagaagcttggcggcgagctcatgggctacttgttcctcctcgagattgcacctctcaagggaagggaaaagctcggtggcgtccccgtagtcactttgctcgaggaggccgactatccccactaa

SEQ ID NO: 11325 - protein, 216 aa, Magnaporthe grisea
MSSTDPTTTGQTAQDASRQQPTAAASSSSELASAKITLYKVLRRFADFPIEGIVFIDIMPIFIDPKAHLALLRALELQVLSSFAPATAKPDVVVGLDARGFLFGPSLALKLDASFVPVRKKGKLPGPCVTATYEKEYGQDFFQMQEGAIKPGQKVLLVDDIIATGGSAAAAGELVKKLGGELMGYLFLLEIAPLKGREKLGGVPVVTLLEEADYPH

SEQ ID NO: 11326 - DNA, 1097 bp, Triticum aestivum
  CDS (79)..(744)
aagcaacattaactcacttgttgagctccacactccagctccagcgcagcctcagagtgcagaggagagtgagtgggcatgggcgaggaggccaattgcgacgccgtgatggaggccggcaacggcaacggcaaggccaaggtgaacggccacgccacagccgttttggccatgccggacgtcaaggccgacgacgccgtggtggcgcccgccgaccctcgcctgcagggcatctccgacgccatccgcgtcgtcccgcacttccccaagccagggatcatgttcaacgacatcacggcgctgctgctgcggccgggcgtgttcaaggacgccgtggacatgttcgtggagcgctaccgcggcatgggcatcgcggccgtcgcaggtattgaagcgagagggttcatattcggcccggcgatcgcgctggctatcggagccaaattcataccgctgcgcaaacccggcaaactcccaggtgaggtgatttccgagaattatacgctcgagtatgggacggattgcttggagatgcatgttggagccgtcgagcccggagaccgtgtggtggtggtggatgatctggttgcaaccggtgggacactttcagcagccataaaacttcttgaacgcgccgcagctgacgttgttgagtgtgcatgcctcattggccttcctaagtttaaggatttctacaagctcgatggaaagccagtttacatactggtggagtcccgcaaataaaatgtaaaatgatgatgattgatcagaaaaaggatcacagcttcattcgtttgcaagcgcgcatggtggatgtgtattgataactctgcagtacactgttaggggcagctgctattgctaagtgtctttcttggtggagagggtgagatagatgagatgtagtcttcctagcactagttttccagtagtggagtatttgatgagagcttgtagttatttctgtcgggaatcatcaccgttagccgcaaagaaaagaaccatcctgttgttcaggttcttctacgagatttttcctgtgtatctcaacattagtttattccattgtctcgaaaaaaaaaaaaaaaaaaaaaaaa

SEQ ID NO: 11327 - protein, 221 aa, Triticum aestivum
MGEEANCDAVMEAGNGNGKAKVNGHATAVLAMPDVKADDAVVAPADPRLQGISDAIRVVPHFPKPGIMFNDITALLLRPGVFKDAVDMFVERYRGMGIAAVAGIEARGFIFGPAIALAIGAKFIPLRKPGKLPGEVISENYTLEYGTDCLEMHVGAVEPGDRVVVVDDLVATGGTLSAAIKLLERAAADVVECACLIGLPKFKDFYKLDGKPVYILVESRK

SEQ ID NO: 11328 - DNA, 717 bp, Oryza sativa subsp
  CDS (1)..(717)
atgggcgaggaggccaattgcaacgtcgcgatggagtccgctgcgcccaaggagaacggccacaccaccggtggcgccgcggcggaggccaaggccgccgccgcctgggctgagatcgccgtcaccgacgccgcggcggtgccaaagccgacgccgccgcctgcggccgtggccgtcgacccccggcttcagggcatctccgacgccatccgcgtcgtcccccacttccccaagcaaggcatcatgttcaacgacatcacgccgctgctgctgcgcccgggggtgttcaaggacgccgtcgacatcttcgtcgagcgctaccgcggcatggccatcgccgccgtcgccgggattgaggctagggggttcatatttggcccggcgatcgcgctggcaattggcgccaaattcataccgttgcgtaagcccaagaaactcccaggcgaggtgatttctgagacgtatgttctcgagtacgggaccgattgcttgcagatgcatgttggcgccattgaacctggtgagcgtgtgctgatcgttgatgatctggttgcaactggtgggacactttgtgctgctataaggcttcttgaacgcgctggagctgacgttgttgagtgcgcgtgtctcattgggctcccaaaatttaaggatttctacaagctcaatggcaaaccagtttatgtgctggtggagtcccgcgaatatgaaaaataa

SEQ ID NO: 11329 - protein, 238 aa, Oryza sativa subsp
MGEEANCNVAMESAAPKENGHTTGGAAAEAKAAAAWAEIAVTDAAAVPKPTPPPAAVAVDPRLQGISDAIRVVPHFPKQGIMFNDITPLLLRPGVFKDAVDIFVERYRGMAIAAVAGIEARGFIFGPAIALAIGAKFIPLRKPKKLPGEVISETYVLEYGTDCLQMHVGAIEPGERVLIVDDLVATGGTLCAAIRLLERAGADVVECACLIGLPKFKDFYKLNGKPVYVLVESREYEK

SEQ ID NO: 11330 - DNA, 1202 bp, Zea mays
  CDS (169)..(813)
acgcggggaaagcgacaggtggagatcggagggaggaagaagaactgagctgcggatcgagggaagggaacaagcaagcagccagagccaggtcgtggaggagccggcggcagtgatcttcttgcgtcgaaggcgaggccggagcgtcggtttgagcgctcgtgcgatatgggggagcaggagaacaacaagatcggcggcagcggcaacgacaacgccatggcggtggacgaagcgggcgcgggcgcggccgcgaacaaggggaagagcctcggcgccgcggacccgcgcctgcaggccatttccgacgccatccgcgtcgtcccccacttccccaagccagggatcatgttcaacgacatcacggagctgctgctgcggccgggcgtgttcagggacgccgtggacatgttcgtcgagcgctaccgcggcatgggcatcgcggccgccgcaggcattgaagctagaggattcatctttgggccagccattgcgctagccataggagcaaagttcataccactacgtaaacctaagaagcttccaggtgaggtattttctgaaagttatgtacttgagtatgggatggattgtttggagatgcatgttggagctattgaacccggggagcgcgtagtggttgtcgatgatttggttgcaactggtggaactctttctgctgcaataagacttctcgagcgcgcaggagctaacgtggctgagtgtgcatgcctcattgggcttcccaaatttaaggatttctataagctcaacgggaaaccggtttacatcctggtggagtcccgcaaataggacgcagtaaatggccagacaaaaaagctttctagcttcccgtccaaagaagctcacaactccactcattggcacgcgcaagcaaggtggtatgggggcaccgagaaactccgcagtaatctgtgttgaggccacggccagatgatgctatgtatcttcatggagagggtgatggactgggtgaaacgtagtcactgtacttttgtagcacgtcatgtctagtgtttcttagtagccatggctgaagagagtttgtagctattcccggcttcctgcagccaggaacatcagtgttagccagaggaggaaaaggatcttatgttgctgctcagttttctatcagaatcgtcttcctttttttcaaaaaaaaaaaaaaaaaaaaaaaaaaa

SEQ ID NO: 11331 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMGIAAAAGIEARGFIFGPAIALAIGAKFIPLRKPKKLPGEVFSESYVLEYGMDCLEMHVGAIEPGERVVVVDDLVATGGTLSAAIRLLERAGANVAECACLIGLPKFKDFYKLNGKPVYILVESRK

SEQ ID NO: 11332 - DNA, 519 bp, Staphylococcus aureus subsp
  CDS (1)..(519)
atggatttaaagcaatacgtatcagaagttcaagattggccgaaaccaggtgttagtttcaaggatattactacaattatggataatggtgaagcatatggctatgcaacagataaaattgtagaatacgcaaaagacagagatgttgatatcgttgtaggacctgaagcgcgtggctttatcattggctgtcctgtagcttattcaatggggattggctttgcaccttttagaaaagaagggaaattacctcgtgaagtcattcgttatgagtatgacctagaatatggtacaaatgttttaacaatgcacaaagatgcaattaaaccaggtcaacgtgtgttaattacagatgatttattagctactggtggtacgattgaagcagcaataaaattagttgaaaaattaggcggtatcgtagtaggtattgcatttataattgaattgaaatatttaaatggtattgaaaaaattaaagattacgatgttatgagtttaatctcatacgacgaataa

SEQ ID NO: 11333 - protein, 172 aa, Staphylococcus aureus subsp
MDLKQYVSEVQDWPKPGVSFKDITTIMDNGEAYGYATDKIVEYAKDRDVDIVVGPEARGFIIGCPVAYSMGIGFAPFRKEGKLPREVIRYEYDLEYGTNVLTMHKDAIKPGQRVLITDDLLATGGTIEAAIKLVEKLGGIVVGIAFIIELKYLNGIEKIKDYDVMSLISYDE

SEQ ID NO: 11334 - DNA, 847 bp, Arabidopsis thaliana
  CDS (154)..(705)
atgactgcttcactttctctttctcttttgttcaagtagtttgggagagagaagagaagaagaagacaccctttaagcaaaacagaggattttcattctctgttctgtttgaattattactaatctatcatcttgttgttctcttcgtcgacaatgtcgggaaacaaagaagaagaggatcctcgtatccatggaatcaaaactaagatccgtgtcgttccagattttcccaagaaaggaataatgtttcaagacataacaacagtgttgttggatccgaaagccttcaaagacacaattgatctgtttgtggagaggtacagagacaagaacatctcagtggttgcaggaatagaggctcgtggtttcctattcggtccaccgatcgcgctagccattggagcaaaatttgttcctctgcgcaaacccaagaaactacctggtgaaacaatatttgaggaatacgagttggaatatggaaatgaccgcctagagatgcacataggagccgtcgaggctggcgatcgatctttggtcgttgatgatcttatcgcgactggtggtactctctgcgctgccattaacttgctcgagagggttggagcagaagttgtggaatgtgcatgtgtgatcgagttacccgaattaaagggaaggcagagacttaaggggaagccactatgtatgcttgtggagtaccgatgatgattttagctttacttatttggataaaattattcggttaattaatttatgctccgaaaattcggattatgcagacttcttattattggattctacaatattttgatttaaattctagcggattagctggaagaaataatcc

SEQ ID NO: 11335 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRSLVVDDLIATGGTLCAAINLLERVGAEVVECACVIELPELKGRQRLKGKPLCMLVEYR

SEQ ID NO: 11336 - DNA, 975 bp, Hordeum vulgare
  CDS (181)..(726)
agaggcatgctcccttctcgcttcctccccatcccgcactgccccaccgcgccggccccgtctccgactccgacaccccccggcggcgcgcgctcgccgagctcggtcgcgctgcggttcggatcccccggaggcacaggcgtgcggcttcggcgccggcgagggtcggcggcggtcgcgatggcatccgacgggcgcgtggagcggatcgcgtccagcatccgcgccatccccaacttccccaagccagggattttgtttcaggacatcacaaccttgcttctcgatccacaggcattccgtgacaccacagacctctttgtggagcggtacaaggacaaaagcataactgtagttgctggtgttgaagccagaggattcatttttggcccccctattgcattagccataggtgcgaagtttgttccaataaggaagccgaaaaaactacctggtgaggtgatatcggaagaatattctctggaatatggcactgacaaaatcgaaatgcacgtaggagctgtgcagcccaatgaccgggtccttattgtggatgatctaattgccacagggggaaccctttgtgccgctgccaaacttattgagcgtgttggagcaaaggtggttgagtgtgcttgtgttattgaactgccagagttgaagggccgggacaagttgggggacttgccagtttttgtccttgtgcaggcagacgaatcagtatgaaacaagttgtgactcttgagttgttccaatgatgtttcccttctggaactatactggaagcagcaaagatatctgttacaatcttagctagttcctatctggagctgctcaataaaagttccatctttaaatttgtcctcctggaactgtttgggaatgcagacttgattgttgttccctgtaatacgtggcttatttctgtcaaaaacagtgcaaattattcatgtcaatgaaggatagtctgtattg

SEQ ID NO: 11337 - protein, 181 aa, Hordeum vulgare
MASDGRVERIASSIRAIPNFPKPGILFQDITTLLLDPQAFRDTTDLFVERYKDKSITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDLPVFVLVQADESV

SEQ ID NO: 11338 - DNA, 845 bp, Triticum aestivum
  CDS (48)..(593)
ccggaggcgtgcggcttcgtcgcgggcgagggtcggcggcggttgcgatggcatccgacgggcgcgtggagcggatcgcgtccagcatccgcgccatccccaacttccccaagccagggattttgtttcaggacatcacaaccttgcttctcgatccgcaggcattccgtgacaccactgacctctttgtcgagcggtacaaggacaaagacataactgtagttgctggtgttgaagccagaggattcatttttggtcctcccattgcattagccataggtgcaaagtttgttccaataaggaagccgaaaaaattacctggtgaggtgatatcggaagaatattctctggaatatggcactgacaaaatcgaaatgcacgtaggagctgtgcagcccaatgaccgagtccttattgtggatgatctaattgccacagggggaaccctttgtgccgctgccaaacttattgagcgtgttggagcaaaggtggttgagtgtgcctgtgttattgaactgccagagctgaagggccgggacaagttgggggacatgccagtttttgtcctagtgcaggcagacgaatcagtatgaaacaagttgtgactcttgagttgttccaatgatgttccccttctggaactatactggaagcagcaaagatatccgttacaatcttagctagttcctatctggagctgctcaataaaagtttcatttttaaatttgtccttctggaactgtttgggaatggagacttgattgttgttccctgtaatacgtggcttatttctgtcaaaaacagtgcaaattattcatgtcaatgaaggatgatagtctgtactg

SEQ ID NO: 11339 - protein, 181 aa, Triticum aestivum
MASDGRVERIASSIRAIPNFPKPGILFQDITTLLLDPQAFRDTTDLFVERYKDKDITVVAGVEARGFIFGPPIALAIGAKFVPIRKPKKLPGEVISEEYSLEYGTDKIEMHVGAVQPNDRVLIVDDLIATGGTLCAAAKLIERVGAKVVECACVIELPELKGRDKLGDMPVFVLVQADESV

SEQ ID NO: 11340 - DNA, 579 bp, Arabidopsis thaliana
  CDS (1)..(579)
atgtttgccgtggagaatgggttgcagggagacccgagattaaaggccatctccgacgccattcgtgtcattcctcacttccccaagactgggatcatgtttcaggacataacaacgttgttgctggatccagttgcctttaaacatgtcgtcgacatcttcgttgatcgttacaagcacatgaacatctctctcgtcgccggagtagaggcgagaggattcatatttggacctcccatcgcgttagccataggtgccaagttcgttccactacgcaaaccgggaaaactacccgggagagtgataagcgaagagtacgaacttgagtatggaagagattgtctagagatgagtgtagaagccgtcaaatcggaggaacgagctctcatcatcgacgatttagttgccactggtgggacactctctgcttccattaacctcttggagcgtgccggggccgaagttgtagagtgtgcatgcgttgttggtttgcctaagtttaaggggcagtgtaagctgaagggaaagcctttgtacgttctggtggaaccaaaccagtttgatgaattaaccttataa

SEQ ID NO: 11341 - protein, 192 aa, Arabidopsis thaliana
MFAVENGLQGDPRLKAISDAIRVIPHFPKTGIMFQDITTLLLDPVAFKHVVDIFVDRYKHMNISLVAGVEARGFIFGPPIALAIGAKFVPLRKPGKLPGRVISEEYELEYGRDCLEMSVEAVKSEERALIIDDLVATGGTLSASINLLERAGAEVVECACVVGLPKFKGQCKLKGKPLYVLVEPNQFDELTL

SEQ ID NO: 11342 - DNA, 519 bp, Methanococcus maripaludis
  CDS (1)..(519): transl_table=11
atggatttaagaaaaaaaataagaattgtagaaaattttccaatagaaggaataagctttaaagatgtaactccgattttaaaagacccaaaagcaatgaaacatacgacaaaagagattgcaaaatacctcgaagataaaaatgtcgatgttgtagtcggtcctgaagcacgcggttttttatttggtgttcctgttgctcatgaacttgatatcgggtttgttccagttcgaaaaccaggaaaattaccgtacaaaactttttcagttgattacgcacttgaatatgggtcagacagccttgaaattcacagcgacggaattgaaaaaggtcaaaacgttgcaatagttgacgaccttcttgcaacaggcggaactgttttgggtgtttccaaactcgtagaaaaactgggcggacacgtttcagcacttaactttgtaatcgaactcacagaactaaaaggaagagataaattaaaaggatacgacatacagtcgcttgttaaatacgatttataa

SEQ ID NO: 11343 - protein, 172 aa, Methanococcus maripaludis
MDLRKKIRIVENFPIEGISFKDVTPILKDPKAMKHTTKEIAKYLEDKNVDVVVGPEARGFLFGVPVAHELDIGFVPVRKPGKLPYKTFSVDYALEYGSDSLEIHSDGIEKGQNVAIVDDLLATGGTVLGVSKLVEKLGGHVSALNFVIELTELKGRDKLKGYDIQSLVKYDL

SEQ ID NO: 11344 - DNA, 1022 bp, Saccharomyces cerevisiae
  CDS (295)..(840)
tcgcgattctttttcaattttttctttttatttttttccagttttttcgtctctgcgatggaaaattgttgaagttctcttgattagcaagtagttcttacatcgcaggaatcttatgttgcatagctcaatttacccaaataacaaggataaatatatatatatacgcatatactttttgggtgttaaagtaaattttgcacccgttcataccaatcgttcagataattttcgctccttaaaaaaagagagtgcgtgtgtatatgcctgttcattgcctgtccgcctctcattatgtctatttctgaatcttacgcaaaggaaataaaaactgcatttaggcagttcactgactttcccatagagggtgagcaatttgaggattttttacctattattggcaaccccacgctattccaaaagttggtacacacgttcaagacgcatttagaagaaaagttcgccaaagaaaagatcgactttattgcaggtatagaagctagaggccttctatttgggccatccctagcactggcattgggagttggatttgttccaataaggagagttggaaaattgccgggtgagtgtgcttctataacattcacaaaattagaccatgaagaaatttttgaaatgcaggttgaagccattccctttgattccaacgtggttgtcgtggatgatgttctcgccaccggtggaacggcatatgctgcgggcgaccttatcagacaagtgggtgctcatattctggaatatgactttgtgctagtgttagatagtctacatggtgaggagaaattatctgctcctattttttccatattgcactcctgatttaaatttgttctctgcctcctccttcaattattttcctttccttcgcatattgctactttttagcttgaacttcttttgttaatataaactggtactttactttttaggtacctggtccacggcgccttatccttcttttaattcatattattacctactcttattctctccctttctat

SEQ ID NO: 11345 - protein, 181 aa, Saccharomyces cerevisiae
MSISESYAKEIKTAFRQFTDFPIEGEQFEDFLPIIGNPTLFQKLVHTFKTHLEEKFAKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 11346 - DNA, 543 bp, Agrobacterium tumefaciens
  CDS (1)..(543): transl_table=11
atgaccgttatcgcttcggagctttccgctgccatccgttccattcccgactatccgaagccgggcatcatcttccgggacatcacgacgctgctcggcaacccgcgcgcatttcgccgcgccgtcgatgaactcgtgcagccctatgcgggaacgaagatcgacaagatcgccggcatggaagcgcgcggcttcattctgggcggggcggtggcgcatcagctttcggccggtttcgtgccgatccgcaagaagggcaagctgccgcacaccaccgtgcgggtcgcctacagcctggaatatggtgtcgacgaaatggagatgcatgtggatgccgtacagccgggcgagaaggtcattcttgtcgacgacctgatcgccaccggcggcaccgccgaaggtgccgtgaagctcttgcgacagatgggtgcggaaatcgtatccgcctgcttcgtcatcgacctgcctgatctcggcggccgcaagaagctggaagatcttggcgtcgacgtgcgcacgctggtagaattttctggccattga

SEQ ID NO: 11347 - protein, 180 aa, Agrobacterium tumefaciens
MTVIASELSAAIRSIPDYPKPGIIFRDITTLLGNPRAFRRAVDELVQPYAGTKIDKIAGMEARGFILGGAVAHQLSAGFVPIRKKGKLPHTTVRVAYSLEYGVDEMEMHVDAVQPGEKVILVDDLIATGGTAEGAVKLLRQMGAEIVSACFVIDLPDLGGRKKLEDLGVDVRTLVEFSGH

SEQ ID NO: 11348 - DNA, 564 bp, Ashbya gossypii
  CDS (1)..(564)
atgtccatcaacgaatatgcaaaggaattgaaggcggctttggctcagtacccaaatttccccaaggaaggcgttctattcgaggattttttgcctatcttcagatcccctcaactctttcagaagcttatcgatgcattcaagatgcacctggcggaggcctttcctgagacaaagatagactacttggtggggctggagtcgcgtggatttttatttgggccttctctagcgctggcaattggcgcagggtttgttcctgtacgcaaagcgggcaagcttcctgggcaggttgtgaagactacgtatgtgaaagaatacgaggaggacgtatttgagatgcaggttgattccatccctgtgggcgctactgttgttgttgttgacgatattcttgccacgggtggttcagcaggcgctgctggggaccttattaagcagctaggggctacaattctggaatttatcttcgtaatggagcttgatttcctgaaaggtagagaaaagctgcaggcgcctgtcttcacgttgctgcagggccaggaggaagctcttggaaactga

SEQ ID NO: 11349 - protein, 187 aa, Ashbya gossypii
MSINEYAKELKAALAQYPNFPKEGVLFEDFLPIFRSPQLFQKLIDAFKMHLAEAFPETKIDYLVGLESRGFLFGPSLALAIGAGFVPVRKAGKLPGQVVKTTYVKEYEEDVFEMQVDSIPVGATVVVVDDILATGGSAGAAGDLIKQLGATILEFIFVMELDFLKGREKLQAPVFTLLQGQEEALGN

SEQ ID NO: 11350 - DNA, 513 bp, Bacillus anthracis
  CDS (1)..(513): transl_table=11
atggatttcaagcaacatatcgcaattgtaccggactatccaaaagaaggtatcgtgtttaaagacattacaccgttaatgaacgacggtaaagcatacaaagcagcaacagatgcaatcgttgagtatgcaaaagagagagacatcgaccttgtagtaggtccagaagctcgtggttttattattggttgcccagtttcttacgcattagaagtaggatttgcgccagttcgtaaattaggaaaattaccacgtgaagtaattacagttgactacggtaaagaatatggtaaagatgttttaacaatccataaagatgcaattaaaccaggccaacgcgtattaattacagatgatctattagctacaggtggaacaatcgaagcgacaattaagctagttgaagagctaggcggagttgtagcaggaattgcattcttagtagaacttacttacttagatggtcgtaaaatgttagatggttacgatgtattagtattagaaaaatactaa

SEQ ID NO: 11351 - protein, 170 aa, Bacillus anthracis
MDFKQHIAIVPDYPKEGIVFKDITPLMNDGKAYKAATDAIVEYAKERDIDLVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 11352 - DNA, 513 bp, Bacillus cereus
  CDS (1)..(513): transl_table=11
atggatttcaagcaacatatcgcaattgtaccggactatccaaaagaaggtatcgtgtttaaagacattacaccgttaatgaacgacggtaaagcatacaaagcagcaacagatgcaatcgttgagtatgcaaaagagagggacatcgacgttgtagtaggtccagaagctcgtggctttattattggttgcccagtttcttacgcattagaagtaggatttgcgccagttcgtaaattaggaaaattaccacgtgaagtaattacagttgactacggtaaagaatatggtaaagatgttttaacaatccataaagatgcaattaagccaggccaacgcgtattaattacagatgatctattagctacaggtggaacaatcgaagcgacaattaagctagttgaagagctaggcggagttgtagcaggaattgcattcttagtagaacttacttacttagatggtcgtaaaatgttagatggttacgatgtattagtattagaaaaatactaa

SEQ ID NO: 11353 - protein, 170 aa, Bacillus cereus
MDFKQHIAIVPDYPKEGIVFKDITPLMNDGKAYKAATDAIVEYAKERDIDVVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 11354 - DNA, 537 bp, Bacteroides fragilis
  CDS (1)..(537): transl_table=11
atgattatgagcaaagaaaagcttatcaaaagcatccgtgagatacccgattttccaatccccggaatcctgttctacgatgtaaccacactattcaaagattcggaacgtcttcaggaactttcggatattatgtacgaaatgtacaaggataaaggaatcaccaaggtagtaggcatcgaatcgagaggcttcattatgggaccgattcttgccacccgcttaggggcaggatttatccccatccgtaaacccggcaaactccctgccgaaacaatggaagaaagctacgataaagaatatggcaaagacaccgtgcagatacacaaagatgcattgaacgagaacgacgtcgtattgctgcacgatgacttactggctaccggaggtactatgaaagccgcctgcaacctcgtgaaaaagctctatccgaaaaaggtatacgtaaacttcatcattgagttaaaggaactgaacggaaaacaagtatttgaaaacgaccaagacgtagatatacaatcagtattgtcgttataa

SEQ ID NO: 11355 - protein, 178 aa, Bacteroides fragilis
MIMSKEKLIKSIREIPDFPIPGILFYDVTTLFKDSERLQELSDIMYEMYKDKGITKVVGIESRGFIMGPILATRLGAGFIPIRKPGKLPAETMEESYDKEYGKDTVQIHKDALNENDVVLLHDDLLATGGTMKAACNLVKKLYPKKVYVNFIIELKELNGKQVFENDQDVDIQSVLSL

SEQ ID NO: 11356 - DNA, 516 bp, Bacillus halodurans
  CDS (1)..(516): transl_table=11
atggattttaaacagcatattacaattgtagaaaactttccaaaagaaggcattcgatttaaagatattacaacattgatgcaaaacggcgaagtgtacaagcgagcaattgacgaaatggcacgatttgcaaaggaaaaggaagtggatctggtcgttggacccgaagctcgaggatttgtggttggctgtccaattgcctatgcgattggcaaagggtttgttcctgtaagaaaggctggaaaattgccacgcgaagtcatttctgtggattacggactagagtacggaaaggatcgtttaacgattcatcgagatgccattcagaaaggtcaacgcgtgttaattgccgatgatttgcttgcaaccggcgggacgatcgaggcgaccgttcaaatggtagagcaacttggcggtgaagttgtcgggattgcgttcatgatagagcttggttatttaaatggccgtgataaattggtaacgtacgatgtgttctcacttacaacatatgaataa

SEQ ID NO: 11357 - protein, 171 aa, Bacillus halodurans
MDFKQHITIVENFPKEGIRFKDITTLMQNGEVYKRAIDEMARFAKEKEVDLVVGPEARGFVVGCPIAYAIGKGFVPVRKAGKLPREVISVDYGLEYGKDRLTIHRDAIQKGQRVLIADDLLATGGTIEATVQMVEQLGGEVVGIAFMIELGYLNGRDKLVTYDVFSLTTYE

SEQ ID NO: 11358 - DNA, 513 bp, Bacillus licheniformis
  CDS (1)..(513): transl_table=11
atggatttgaagaagtatgtgacaattgtgccggattacccgaaggaaggcgtacaatttaaagatattacaacattgatggacaaaggcgacgtctatcgctacgcgacagatcaaattgtaacgtatgcgaaggaaaaagagatcgatctcgtcgtgggacctgaagcgagaggatttatcatcggctgccctgtcgcatatgcgcttggggtagggtttgcgcctgtccgcaaagaaggcaaactgccgcgcgaagtcatcaaagtcgattacggattggaatatggaaaagatgtcctgaccatccataaagatgccattaaaccggggcagcgcgtcttgatcactgacgacctgcttgcaaccggcgggacgattgaagcaacgatcaagcttgttgaagagctcggcggcgtcgtggccggaatcgctttcctgatcgaactgacatatcttgaaggaagaaataaactggacggatatgatattttaaccttgatgcaatactaa

SEQ ID NO: 11359 - protein, 170 aa, Bacillus licheniformis
MDLKKYVTIVPDYPKEGVQFKDITTLMDKGDVYRYATDQIVTYAKEKEIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELTYLEGRNKLDGYDILTLMQY

SEQ ID NO: 11360 - DNA, 516 bp, Bacillus clausii
  CDS (1)..(516): transl_table=11
atggattataaacaatatataacaattgtcgaagattggccgcaagagggcatacgctttaaagacattacgacgttgatgcaaaacggcacagcctacaagcgcgccgttgaagaacttgccgtttatgcaaaagaaaaacaagcagacgtcattgtcggccctgaagcacgtggctttgttgttggttgcccaatcgcgactgaacttgaaatcggttttgtccctgttaggaaaaaaggcaaattgcctcgggaagtcattgaagccaactatggtcttgaatatggaaaagactgtttaaccatccataaagacagcatccagccaggccaacgcgtcgtcattaccgatgacctcctcgcaacagggggtacgattgaggcaacggctaaaatggtagagcaacttggcgggaaagtggtcgggattgccttcttgatcgaattggcttatataggcggccgcgataaactaaagcagtacgacttgttttcattaatgtcttacgaataa

SEQ ID NO: 11361 - protein, 171 aa, Bacillus clausii
MDYKQYITIVEDWPQEGIRFKDITTLMQNGTAYKRAVEELAVYAKEKQADVIVGPEARGFVVGCPIATELEIGFVPVRKKGKLPREVIEANYGLEYGKDCLTIHKDSIQPGQRVVITDDLLATGGTIEATAKMVEQLGGKVVGIAFLIELAYIGGRDKLKQYDLFSLMSYE

SEQ ID NO: 11362 - DNA, 513 bp, Bacillus subtilis
  CDS (1)..(513): transl_table=11
atggatttaaaacaatacgtaacaattgtaccggattacccgaaagagggcgtgcaatttaaagatattacgacactgatggataaaggcgatgtataccgctatgccacagatcaaattgttgaatatgcgaaagaaaagcaaattgatttggtcgttggccctgaagcgcgcggctttattatcggctgtcccgttgcttacgcgcttggcgtaggttttgcgccggtccgcaaagaaggcaagttgcctcgtgaagtaatcaaagtggattatggcttggaatacggaaaagacgtattaacgatccacaaagatgcgattaagcctggtcagcgtgtgcttattacagatgacctgcttgcgacaggcggcacaattgaagcgacaatcaaacttgttgaagaacttggcggcgttgttgctggtatcgctttcttaatcgagctttcttaccttgacggcagaaataagctcgaagattacgacatcttaacattgatgaaatactaa

SEQ ID NO: 11363 - protein, 170 aa, Bacillus subtilis
MDLKQYVTIVPDYPKEGVQFKDITTLMDKGDVYRYATDQIVEYAKEKQIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELSYLDGRNKLEDYDILTLMKY

SEQ ID NO: 11364 - DNA, 531 bp, Bacteroides thetaiotaomicron
  CDS (1)..(531): transl_table=11
atgattatgagcaaagaaacgctaattaaaagcatccgggaaattcccgattttccgatccccggaatccttttctacgatgtcaccaccctgtttaaagacccttggtgcttgcaagaattatcgaacatcatgttcgaaatgtacaaggataaaggtatcaccaaagtagtaggtatagaatccagaggattcatcatggggcctatcctagctacccgactgaacgcaggttttattcctatccgcaagccgggcaaacttcccgcagaggtgatcgaagaaagctacgacaaagaatatggcacggacactgtgcagattcataaggacgcactcgatgaaaacgacgtagttttactacacgacgacctgctggcaacgggaggaactatgaaagcagcctgcgaactggtgaagaaactgaagcctaaaaaggtatatgtaaacttcattatcgaattgaaagacctgaatggcaaatccgtattcggagatgacgtagaagtagaatccgtattgactttataa

SEQ ID NO: 11365 - protein, 176 aa, Bacteroides thetaiotaomicron
MIMSKETLIKSIREIPDFPIPGILFYDVTTLFKDPWCLQELSNIMFEMYKDKGITKVVGIESRGFIMGPILATRLNAGFIPIRKPGKLPAEVIEESYDKEYGTDTVQIHKDALDENDVVLLHDDLLATGGTMKAACELVKKLKPKKVYVNFIIELKDLNGKSVFGDDVEVESVLTL

SEQ ID NO: 11366 - DNA, 582 bp, Bifidobacterium longum
  CDS (1)..(582): transl_table=11
atggcacagtcggacatcaccatcgacgcattgagcaaggtagggcaacaggacgccgaatatctggtgtccttggtgcgttccgtaccggggtttcccaaggaaggcatcatcttccgtgatttcatgccagtgctcgccgaccccaagggcttgaagattctgctcaaagcacttgaagaggccctgccggtgtccccgagcgaattcgactccattgccggtctcgaatcgcgcgggttcctgttcggcccggtcatggccgcccatttgggcaagggtttcatcgccgtgcgtaaggccggcaagttgccgcctgaaaccatcggtgaatcctatgacctcgaatacggcacggccagtgtcgaaatcgaaaccgacgccgtacaggcagggaagcgagtgctcatcgtcgatgacctcatcgccacgggcggcaccgccaaagccgccaccgaccttatcgaaaaggccggtggcaccgtggtgggcttcagtttcgtgatgcggctcgatggcctcgacggtctggataagctcgacggcaagcccagcagctcgctgatcgcgatgccggcctga

SEQ ID NO: 11367 - protein, 193 aa, Bifidobacterium longum
MAQSDITIDALSKVGQQDAEYLVSLVRSVPGFPKEGIIFRDFMPVLADPKGLKILLKALEEALPVSPSEFDSIAGLESRGFLFGPVMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 11368 - DNA, 552 bp, Blochmannia floridanus
  CDS (1)..(552): transl_table=11
atgataagtcatacagatcatcaattaactttgattaaagaaaatataaaatttattccaaattatccaaagcaaggaattttatttcgtgatatcactgctttactagaaaatcctcatgcatattctgcatgtattaaattattagcagatcattataagaaccatcaattaactaaaatagtgggtgtagaagctcgtggatttttatttggatcgcctttagcattgatattaaagttaggatttattcctgccagaaaagctggtagattaccacgtaatacgattagtgaatcatacgttttagaatatggtactggatgtttagaaatgcataatgattcaattataccaggtgatagagttttaattgtagatgatttattagctaccggtggtactatcaaagctgtggtaaaattaattcgaagattaggtggtgaagtatatcatgctgcatttgtaatagatttagaaaaattaggaggtaaattgttattagaaaaaattggagtgcatccttatagtttagtaatattttctgattaa

SEQ ID NO: 11369 - protein, 183 aa, Blochmannia floridanus
MISHTDHQLTLIKENIKFIPNYPKQGILFRDITALLENPHAYSACIKLLADHYKNHQLTKIVGVEARGFLFGSPLALILKLGFIPARKAGRLPRNTISESYVLEYGTGCLEMHNDSIIPGDRVLIVDDLLATGGTIKAVVKLIRRLGGEVYHAAFVIDLEKLGGKLLLEKIGVHPYSLVIFSD

SEQ ID NO: 11370 - DNA, 531 bp, Borrelia burgdorferi
  CDS (1)..(531): transl_table=11
atgaaaaataagacagagtattatgatcagtttatttcaaaaatacccaattttcctaaaaagggtgttcttttttatgatattactagcgttttgctaaaacccgaagtttatagttcattaataaatgaagtatattctttttataattttaaaaagatcgattgcattgcagttgttgagtctaggggatatttaataggtgctcctttgtctttaaaaatgcagctaccccttgttttaattcgaaaagagggtaaattgcccagagaggtttttagtgaagagtatgagcttgaatatggttttgggagaatagaggtgcacaaagacgatgttaggacgtattccaatattcttttaatagatgacatattagctaccggtggaactttaaagtcgtctgcaattttgctagagagagccgggggcaaggttaaggatattttttgttttattgagctttgcgctattaatggtagacaaagtcttgaaagttatgaagtcaattcccttgtaaggtataattaa

SEQ ID NO: 11371 - protein, 176 aa, Borrelia burgdorferi
MKNKTEYYDQFISKIPNFPKKGVLFYDITSVLLKPEVYSSLINEVYSFYNFKKIDCIAVVESRGYLIGAPLSLKMQLPLVLIRKEGKLPREVFSEEYELEYGFGRIEVHKDDVRTYSNILLIDDILATGGTLKSSAILLERAGGKVKDIFCFIELCAINGRQSLESYEVNSLVRYN

SEQ ID NO: 11372 - DNA, 531 bp, Borrelia garinii
  CDS (1)..(531): transl_table=11
atgaaaaataaaacagagtattatgatcagtttattgcaaaagtacccgatttccctaaaaagggtgttcttttttacgatattactagtgttttgttaaaaccggaagtttatacttcattaataaatgaggcatattctttttataatcttaaaaagattgattgcattgctgttgttgagtcccgggggtatttaataggtgctcctttgtctttaaaaatgcaacttcctcttgttttaattcgaaaagagggtaaattgcccagagaggtttttggcgaagagtatgagcttgaatatggctttgggaaaatagaagtacacaaagatgatgttaggatgtattccaatattcttttaatagatgatatattggctaccggtggaactttaaagtcgtctgcaattttgctagagagagctgggggcagggttaaggatattttttgttttattgagctttgtggtattaatggtagacgcattcttgaagactatgatgttaattctcttgtaaggtacaattaa

SEQ ID NO: 11373 - protein, 176 aa, Borrelia garinii
MKNKTEYYDQFIAKVPDFPKKGVLFYDITSVLLKPEVYTSLINEAYSFYNLKKIDCIAVVESRGYLIGAPLSLKMQLPLVLIRKEGKLPREVFGEEYELEYGFGKIEVHKDDVRMYSNILLIDDILATGGTLKSSAILLERAGGRVKDIFCFIELCGINGRRILEDYDVNSLVRYN

SEQ ID NO: 11374 - DNA, 549 bp, Bordetella pertussis
  CDS (1)..(549): transl_table=11
atgcagaccgattacgccgaactggtccggcgcaccatccgcagcgtccccgattggcccacgcccggcgtgacgtttcgcgacatcacgcccgtgctgcaggacccgcgcacgttccgcgtcctgatcgacctgttcgtctatcgctatatgcgccagcgcctcgacctggtggccggcgtcgatgcgcgcggcttcatcgtgggcgcggtgctggcgcacgaactgaacctcggcttcgtgccggtgcgcaagaagagcaagctgccgtaccgtaccgtggccgaggaatattcgctggaatatggcaatgccgcggtcgagatgcataccgattcggtgcgcaccggccagcgcgtgttgctggtcgacgacctgatcgacaccggcggcaccatgctggcggccatcaagctgctgcagcggctgggcgccaacgtggtcgaggccgcggccatcatcgacctgccctacctgggcggctcggcccagatcacggccacgggcacgccgctgtacaccgtgtgccagtaccaggaaggcgactga

SEQ ID NO: 11375 - protein, 182 aa, Bordetella pertussis
MQTDYAELVRRTIRSVPDWPTPGVTFRDITPVLQDPRTFRVLIDLFVYRYMRQRLDLVAGVDARGFIVGAVLAHELNLGFVPVRKKSKLPYRTVAEEYSLEYGNAAVEMHTDSVRTGQRVLLVDDLIDTGGTMLAAIKLLQRLGANVVEAAAIIDLPYLGGSAQITATGTPLYTVCQYQEGD

SEQ ID NO: 11376 - DNA, 540 bp, Bradyrhizobium japonicum
  CDS (1)..(540): transl_table=11
atgacctttgaccacgacctgaaggcgagcgttcgcaccattcccgactatcccaagccggggatcatgttccgcgacatcacgaccctgctcgcggatgcgcgcgcattccgccgcgccgtggacgagctcgtgaacccctgggccggcaacaagatcgacaaggtcgccggcatggaggcgcggggcttcatcatcggcggcgcggtggcgcaccagctctccgccggcttcgtgccgatccgcaagaagggcaagctgccgcacaccactgtgcgcatcgcctattcgctggaatacggcatcgacgagatggagatgcatgtcgacgccatccagcccggcgagcgtgtcatcctggtcgacgacctcatcgccaccggcggcaccgcggaaggtgcggtgaagctgctgcgccagatcggcgccaatgtcgtcgccgcctgcttcatcatcgacctgcccgagctcggcggcgccgccaagctgcgcgccatggacgtgccggtgcgcacgctgatgacgttcgaggggcattga

SEQ ID NO: 11377 - protein, 179 aa, Bradyrhizobium japonicum
MTFDHDLKASVRTIPDYPKPGIMFRDITTLLADARAFRRAVDELVNPWAGNKIDKVAGMEARGFIIGGAVAHQLSAGFVPIRKKGKLPHTTVRIAYSLEYGIDEMEMHVDAIQPGERVILVDDLIATGGTAEGAVKLLRQIGANVVAACFIIDLPELGGAAKLRAMDVPVRTLMTFEGH

SEQ ID NO: 11378 - DNA, 546 bp, Brucella melitensis
  CDS (1)..(546): transl_table=11
atggaatccgggtttaaggtcaccttgaaggatgcgatcagaaccattccggattatccgaaacccggcgttcaattccgcgacgtcaccacgctcatgggcaatgcgcaggcctttcgccgcgccgtcgatgaactggtctatccctatgcgggtaacaggattgacaaggtggcggggatcgaggcgcgcggttttattcttggcggtgcaattgctcaccagctttcggcgggcttcgtgccaatccgcaagaagggcaagctgccgcgcgatacggtgcgcatcgcatacagtcttgaatatggcgtcgatgaaatggaaatgcatcgtgacgccattgaaaagggtgagcgggtcgttctcgtggatgatctgattgcaacgggtggaacggcggaagctgctgccaagcttctgctccagatgggagcggaaattgttgccgcctgctttatcattgacctgccggacttaggcgggcgaaagaagctggaggcgcttggcctgccggtgcgcacccttgtcgcgtttgaaggcgattga

SEQ ID NO: 11379 - protein, 181 aa, Brucella melitensis
MESGFKVTLKDAIRTIPDYPKPGVQFRDVTTLMGNAQAFRRAVDELVYPYAGNRIDKVAGIEARGFILGGAIAHQLSAGFVPIRKKGKLPRDTVRIAYSLEYGVDEMEMHRDAIEKGERVVLVDDLIATGGTAEAAAKLLLQMGAEIVAACFIIDLPDLGGRKKLEALGLPVRTLVAFEGD

SEQ ID NO: 11380 - DNA, 564 bp, Burkholderia pseudomallei
  CDS (1)..(564): transl_table=11
atgatgtccacgtcggacgcgccgctcgatcccgtcgagttcattcacagccgcatccgcacggtgccggactggccgcagcccggcgtgatgtttcgcgacatcacgccgctgctgcaaagcgcgaaggcgttgcgcgtgctcgtcgacctgttcgtcgagcgctatgtcgacgcgaagctcgactacatcgcgggcctcgatgcgcgcggcttcatcatcgcgccgatcgtcgcgtacgagctgtccgtcggcttcgtgccgatccgcaaggtcggcaagctgccgtacgcgacgcagcgcgaatcgtatgcgctcgagtacggcaccgcgaccgtcgagattcacgaggacgcgtgcaagccgggcgatcgcgtcgtgatcgtcgacgatctgatcgcgacgggcggcacgatgatggcgggcaagaacctgctcgagcggctgggcgccgtcgtcgtcgaaggcgcggcgatcgtcgatctgccggatctcggcggctcggcgctgctgcgcggagccggcctgccgctctacacggtcaccgaattccccgggcactga

SEQ ID NO: 11381 - protein, 187 aa, Burkholderia pseudomallei
MMSTSDAPLDPVEFIHSRIRTVPDWPQPGVMFRDITPLLQSAKALRVLVDLFVERYVDAKLDYIAGLDARGFIIAPIVAYELSVGFVPIRKVGKLPYATQRESYALEYGTATVEIHEDACKPGDRVVIVDDLIATGGTMMAGKNLLERLGAVVVEGAAIVDLPDLGGSALLRGAGLPLYTVTEFPGH

SEQ ID NO: 11382 - DNA, 543 bp, Butyrivibrio fibrisolvens
  CDS (1)..(543): transl_table=11
atgaaaaaagtagaagattacataagaactattccggattttccagaaccaggcattatgtttagagatgtcacaagcattcttcaggatgcagagggcttcaagctcgctatcgacgagatgattaagcttcttgatggagttgattgtgatgttatagcaggagcagagagccgcggatttatctttggtgcacctcttgcttacgcacttggcaagccttctgtacttgttcgcaagaagggtaagcttccatgtgagacaatcgagaagacatatgacttggagtatggtacagctacaatcgagatgcacaaggatgctattaagccaggtcagaaggtagttgtagtcgatgatcttatcgctacaggtggtactattgaggcagcatgccagcttatcgaggagcttggcggcgaggtttctaagatcgtcttccttatggagcttgcaggtcttaatggacgtgagaagcttaagtatgacgtagcttcagtttgttacttacgagggaaaataattacagattttttagggtag

SEQ ID NO: 11383 - protein, 180 aa, Butyrivibrio fibrisolvens
MKKVEDYIRTIPDFPEPGIMFRDVTSILQDAEGFKLAIDEMIKLLDGVDCDVIAGAESRGFIFGAPLAYALGKPSVLVRKKGKLPCETIEKTYDLEYGTATIEMHKDAIKPGQKVVVVDDLIATGGTIEAACQLIEELGGEVSKIVFLMELAGLNGREKLKYDVASVCYLRGKIITDFLG

SEQ ID NO: 11384 - DNA, 549 bp, Campylobacter jejuni
  CDS (1)..(549): transl_table=11
atgataaaactaacacaagaagaacaaaaatacctgcttgatagcattaggattattcctgattttccaaaaaaaggaattatttttagagatattaccactctactaaataacaaagaggctttaaattttctacttaaacatttaaaagaacgctacaaagattacaatctagacttcatagcaggaacagaaagcagaggatttatctttgcatctatgatttgtgcaaaacttaatcttccttttgtgcctattagaaaacctggaaaactcccttttgaaacctttagctgcgaatacgatcttgaatatggcagcgataaagtagaacttcataaagatgcatttaaaaatattcaaaatgcaagagttttacttgtagatgatttaatagcaactggcggaacagctatagcttcatatgaactcattcaaaaagctggagcaaaatgtgttgaagcttgttttttaataaatcttaaagatttaaatggagcaaataaacttgaaaaacttacttcagtttatagtgttttagaaatttaa

SEQ ID NO: 11385 - protein, 182 aa, Campylobacter jejuni
MIKLTQEEQKYLLDSIRIIPDFPKKGIIFRDITTLLNNKEALNFLLKHLKERYKDYNLDFIAGTESRGFIFASMICAKLNLPFVPIRKPGKLPFETFSCEYDLEYGSDKVELHKDAFKNIQNARVLLVDDLIATGGTAIASYELIQKAGAKCVEACFLINLKDLNGANKLEKLTSVYSVLEI

SEQ ID NO: 11386 - DNA, 549 bp, Campylobacter jejuni
  CDS (1)..(549): transl_table=11
atgataaaactaacacaagaagaacaaaaatacctgcttgatagcattaggattattcctgattttccaaaaaaaggaattatttttagagatattaccactctactaaataacaaagaggctttaaattttctacttaaacatttaaaagaacgctacaaagattacaatctagacttcatagcaggaacagaaagcagaggatttatctttgcatctatgatttgtgcaaaacttaatcttccttttgtgcctattagaaaacctggaaaactcccttttgaaacctttagctgcgaatacgatcttgaatatggcagcgataaagtagaacttcataaagatgcatttaaaaatattcaaaatgcaagagttttacttgtagatgatttaatagcaactggcggaacagctatagcttcatatgaactcattcaaaaagctggagcaaaatgtgttgaagcttgttttttaatgaatcttaaagatttaaatggagcaaataaacttgaaaaacttacttcagtttatagtgttttagaaatttaa

SEQ ID NO: 11387 - protein, 182 aa, Campylobacter jejuni
MIKLTQEEQKYLLDSIRIIPDFPKKGIIFRDITTLLNNKEALNFLLKHLKERYKDYNLDFIAGTESRGFIFASMICAKLNLPFVPIRKPGKLPFETFSCEYDLEYGSDKVELHKDAFKNIQNARVLLVDDLIATGGTAIASYELIQKAGAKCVEACFLMNLKDLNGANKLEKLTSVYSVLEI

SEQ ID NO: 11388 - DNA, 567 bp, Candida albicans
  CDS (1)..(567): transl_table=12
atgtctgatagagtattagaaatcaatgccttggccaaagaattgaaggctaacttgaaacaattccctaacttcccaaaagaaggaattttatttgaagatttcttaccaattttcactaagccagacttgtttaataaattagtcaaagctttcaaattacacgttggcgaacaaaaaatcgattatgtcattgggttagaaagtagaggatttttatttggtccaactttagctttggctttgaatgctgggtttgttccagttagaaaaccaggtaaattaccaggtcctaccttcaaagtcgaattccaaaaagaatacggttctgatgaattcgaaatccaacaggacgttatccctaagggtgcaaaagttttgattgtcgatgatattttagctactggtggaagtgcttttggtgctggtgaattggctaagaaaacaggagcagaaattgttgaatacttgtttgtcatggaattggatttcttaaaaggtagagataagttagatgctccagtgtatactttgtttggtggacaagaagaaaagtttactgagtaa

SEQ ID NO: 11389 - protein, 188 aa, Candida albicans
MSDRVLEINALAKELKANLKQFPNFPKEGILFEDFLPIFTKPDLFNKLVKAFKLHVGEQKIDYVIGLESRGFLFGPTLALALNAGFVPVRKPGKLPGPTFKVEFQKEYGSDEFEIQQDVIPKGAKVLIVDDILATGGSAFGAGELAKKTGAEIVEYLFVMELDFLKGRDKLDAPVYTLFGGQEEKFTE

SEQ ID NO: 11390 - DNA, 534 bp, Chlorobium tepidum
  CDS (1)..(534): transl_table=11
atgcccatcaaatccagaatccgtactgttcccgattatccgaaaaaagggatcatgttccgtgacattaccacccttatcaaggatccggtcggattccgtctggtgatcgacaacatgacccagcattatctgtccaacggagtcgattttgatgcgatcgtgggtattgagtccaggggtttcattctcggtggcgcgcttgcctatacgcttggcaagggattcgtgccagtcaggaagccaggcaaactgccggcggatgtggtgcagctcgaatacgaactcgagtatggtaccgacaagatcgagatgcatactgacgctcttgttcaagggcagcgcgtgcttctggttgatgatcttcttgctacgggcggcacggctcttgccgctgccggactggtcgagaagctcggcggtgtcgtggcaagcatggccttcatcgtcaatctgcccgatattggcggcgaaaagaagattcgtgaaaaaggctataacatctacttcctgacagagttcgaaggtgattga

SEQ ID NO: 11391 - protein, 177 aa, Chlorobium tepidum
MPIKSRIRTVPDYPKKGIMFRDITTLIKDPVGFRLVIDNMTQHYLSNGVDFDAIVGIESRGFILGGALAYTLGKGFVPVRKPGKLPADVVQLEYELEYGTDKIEMHTDALVQGQRVLLVDDLLATGGTALAAAGLVEKLGGVVASMAFIVNLPDIGGEKKIREKGYNIYFLTEFEGD

SEQ ID NO: 11392 - DNA, 519 bp, Clostridium acetobutylicum
  CDS (1)..(519): transl_table=11
atggatttaaaagatagtataagagttatagatgggtttccaaaagaaggaataagcttcaaggatgttactacccttattcaagataaagaagcatataaatattccgtagataagattggagagtatcttaaggataagaacgtagatttaatagttgcacccgaagcaagaggatttttattcggagctcctgtagcttacaaaataggagcgggttttataccagttagaaaaaaaggtaagcttccatgtgagacagttgaggttacatacgagcttgagtatggagaagatattttggaaatgcacaaggatgcaattaaaaagggccaaagagttgcaatagttgatgatcttcttgcaacaggtggtacgattaactcagttgcaaaacttgtagaagctcttggtggagaggttgtagcggcatgttttgttgtagagcttacagatttgaatggaaaagataagcttggagattatgatacaatgtcattagttaagtacaatgtatag

SEQ ID NO: 11393 - protein, 172 aa, Clostridium acetobutylicum
MDLKDSIRVIDGFPKEGISFKDVTTLIQDKEAYKYSVDKIGEYLKDKNVDLIVAPEARGFLFGAPVAYKIGAGFIPVRKKGKLPCETVEVTYELEYGEDILEMHKDAIKKGQRVAIVDDLLATGGTINSVAKLVEALGGEVVAACFVVELTDLNGKDKLGDYDTMSLVKYNV

SEQ ID NO: 11394 - DNA, 519 bp, Clostridium perfringens
  CDS (1)..(519): transl_table=11
atgagtttaaaggataaaataagagttatagaagattttcctaagaagggaataagctttaaagatataactactttaatagcagatggagaaggcttaagagattcagttgaccaaatggcagaattcttcaaagataagaatattgacgttgtagttggaccagaagctagaggatttatatttggagttcctgtagcctatgctttaggtgttggatttattccagtaagaaagccaggcaaacttccaggggacacagttagagtagaatatgatttagagtatggaaaagatgctttagaaatacacaaagatgctataaaaccaggtatgagagttgctatagttgacgatcttttagctactggtggtacaatagctgctgttgctaaattagtagaacaagctggtggagaagttgctggattagcatttactattgagttaacagaattaaaaggaagagataaattaaaaggatacgaagtaacatcattagttgattatgatgtttaa

SEQ ID NO: 11395 - protein, 172 aa, Clostridium perfringens
MSLKDKIRVIEDFPKKGISFKDITTLIADGEGLRDSVDQMAEFFKDKNIDVVVGPEARGFIFGVPVAYALGVGFIPVRKPGKLPGDTVRVEYDLEYGKDALEIHKDAIKPGMRVAIVDDLLATGGTIAAVAKLVEQAGGEVAGLAFTIELTELKGRDKLKGYEVTSLVDYDV

SEQ ID NO: 11396 - DNA, 519 bp, Clostridium tetani
  CDS (1)..(519): transl_table=11
atggatttaaaggacaaaattcgagtaatacaaggatttcctaaagaaggcattagcttcaaagatgtaaccactatattacaggaaaaagaagcttttaaatatacaatagacactttggttgaagaacttaaagataaaaatgttgatgttgtagtaggacctgaagctagaggttttttatttggtgcacctttagcctatgcattaggtgcaggttttgtaccagttagaaaaaaaggaaaacttccaagtactactattagctctaaatatgaattagaatatggtagtgatgaattagaaatgcacaaggattctataaagccaggacaaagagtagttatagcagatgatttactagcaactggaggaactatatgctctgtaattgaaatgatagagtccttaggtggagaaatagtatctattaattttttaattgaattaacagatttaaagggtagagaaaagttaggaaaatatgatatatcttcacttgtgcaatatgatatataa

SEQ ID NO: 11397 - protein, 172 aa, Clostridium tetani
MDLKDKIRVIQGFPKEGISFKDVTTILQEKEAFKYTIDTLVEELKDKNVDVVVGPEARGFLFGAPLAYALGAGFVPVRKKGKLPSTTISSKYELEYGSDELEMHKDSIKPGQRVVIADDLLATGGTICSVIEMIESLGGEIVSINFLIELTDLKGREKLGKYDISSLVQYDI

SEQ ID NO: 11398 - DNA, 555 bp, Corynebacterium diphtheriae
  CDS (1)..(555): transl_table=11
atgactgtccccctgtatgcagatgcccgagaagcaattgcgtgtaaaactcgtttcgttcccgatttccctgtaccaggagtaattttcgaggacctcaccccagtattggctgatgccgccgctttttctctcatcgttgatgaattggcaaaaaatgcaatgcgattgggagctgatttcatcggtgggttagacgcacgtggatttcttctaggttctgcagtcgcgtacaaagccggaaccggcattcttgccattaggaaaaagggcaaattgcctccgccagtacactctgaggaatattctttagagtatggcactgcagcactcgagctacctgctgaaggtctagagttggaagacaaaaaggtcgtgctggtcgacgacgttttggctactggcggcacattggatgcggctcgcaaattgattgaagcttgtggtgccactgtaagcggatacgcagtcgtgctcgaagtcgacgggctgggtggccgtgagcgattgaatgatgcacctttggtagtaattaatgaaagcgctacggcgtaa

SEQ ID NO: 11399 - protein, 184 aa, Corynebacterium diphtheriae
MTVPLYADAREAIACKTRFVPDFPVPGVIFEDLTPVLADAAAFSLIVDELAKNAMRLGADFIGGLDARGFLLGSAVAYKAGTGILAIRKKGKLPPPVHSEEYSLEYGTAALELPAEGLELEDKKVVLVDDVLATGGTLDAARKLIEACGATVSGYAVVLEVDGLGGRERLNDAPLVVINESATA

SEQ ID NO: 11400 - DNA, 579 bp, Corynebacterium efficiens
  CDS (1)..(579): transl_table=11
atggatagcggtagggacagcggcaacgacagcggcagtgtcaacatggccagggcgcgtgtcgccctcaccgagcacacccgctatgtgcacgatttccctgcagagggtgtcctgttcgaggatctcaccccggtactggccaatgccgaggccttcgccgctgtggtggatgcacaggcggaggccgccgaggagctcggggccgagatcatcggcgggttggatgcccgtggattccttctgggttcggccgtggcctacaagctgggtctcggtgtgatcgccatccgtaagaagggcaagctgcccccgccggtggtcacccaggattatgacctggagtacggttccgcggcgttggagctgcccgcggaggggttggatcttgagggtcggagggttgtgctcatcgatgatgtgctcgccaccggcgggacactcgcggcagcacgtaaactgattgaaacatgtggtggcaatgtcaccggttatgttctcgccattgaggtcggtggcctcggtggtcgggaacgtctgggagacatcccggtccatgtgatcagggatccgcagtag

SEQ ID NO: 11401 - protein, 192 aa, Corynebacterium efficiens
MDSGRDSGNDSGSVNMARARVALTEHTRYVHDFPAEGVLFEDLTPVLANAEAFAAVVDAQAEAAEELGAEIIGGLDARGFLLGSAVAYKLGLGVIAIRKKGKLPPPVVTQDYDLEYGSAALELPAEGLDLEGRRVVLIDDVLATGGTLAAARKLIETCGGNVTGYVLAIEVGGLGGRERLGDIPVHVIRDPQ

SEQ ID NO: 11402 - DNA, 561 bp, Debaryomyces hansenii
  CDS (1)..(561)
atgtcacaagttgaaatcagcgaactcgccaaggagatcagagcttcattaaagcaatttccaaatttcccaagtgaaggaattttattcgaagactttttgccagttttcaccaaaccggacttattccaaaaattggtcagagcattccaattgcacgttggtgaacaaaaagtggattatgttgtcggtttagaaagtagagggttccttttcggacctactttggctttggctttgggtgctgggtttgttccagtcagaaaggcaggtaaattaccaggcccagtgttcacggccgaattccaaaaggaatacggtagtgacaaattccaaatccaaaaagatgtgatcgaagagggagccaaggttttgattgtcgatgatattttggctaccggtggtagtgcgtcaagtgccggtgaattggtcaagcagaccggtggtgatatcgttgaatacttatttgtcatggaattagacttcttgaacggcagagataagttggacaagcctgcattcaccttattgagtggacaggctgaaaagttgcagaattag

SEQ ID NO: 11403 - protein, 186 aa, Debaryomyces hansenii
MSQVEISELAKEIRASLKQFPNFPSEGILFEDFLPVFTKPDLFQKLVRAFQLHVGEQKVDYVVGLESRGFLFGPTLALALGAGFVPVRKAGKLPGPVFTAEFQKEYGSDKFQIQKDVIEEGAKVLIVDDILATGGSASSAGELVKQTGGDIVEYLFVMELDFLNGRDKLDKPAFTLLSGQAEKLQN

SEQ ID NO: 11404 - DNA, 552 bp, Escherichia coli O6
  CDS (1)..(552): transl_table=11
atgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgaaaccatcagtgaaacttacgacctggaatacggcaccgatcagctggagatccacgttgatgccatcaaaccgggcgacaaagttctggtggtggacgacctgctggcaaccggcggcactatcgaagcgaccgttaaactgatccgtcgtctgggtggtgaagtggctgacgctgcgttcattatcaacctgttcgatctcggcggcgaacagcgtctcgaaaaacagggcattaccagctacagccttgtcccgttcccgggccattaa

SEQ ID NO: 11405 - protein, 183 aa, Escherichia coli O6
MTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 11406 - DNA, 513 bp, Geobacillus kaustophilus
  CDS (1)..(513): transl_table=11
atggacttaaaacaatacattacgattgtgcccgatttcccgaagccgggcatcatgtttaaagatattacaacgctgatggacaacggtccggcgtacaaatatgcgaccgaccaaattgttcaatatgcgcgcgaaaaacaaatcgaaatcgtcgttggtccggaagcgcgcggctttatcatcggatgcccagtcgcctatgcgcttggcgtcggatttgcgccggtgcgcaaggaagggaagctgccgcgcgaagtcgtccgtgtggagtatggcctggaatatggaacagatgtcttgacgatgcataaagatgccattaagccagggcagcgcgtgttgatcaccgacgacttgctggcgacgggcgggacgatgcgggcgacgatcgatttggtggaacagctcggcggagtggtggccggattggcgtttttgattgagcttaccgagcttggcggccgcaaaaaattggaaggctacgatattttgacgctgatgcagttttaa

SEQ ID NO: 11407 - protein, 170 aa, Geobacillus kaustophilus
MDLKQYITIVPDFPKPGIMFKDITTLMDNGPAYKYATDQIVQYAREKQIEIVVGPEARGFIIGCPVAYALGVGFAPVRKEGKLPREVVRVEYGLEYGTDVLTMHKDAIKPGQRVLITDDLLATGGTMRATIDLVEQLGGVVAGLAFLIELTELGGRKKLEGYDILTLMQF

SEQ ID NO: 11408 - DNA, 516 bp, Geobacter sulfurreducens
  CDS (1)..(516): transl_table=11
atggatgagctgaaaaacataatccgcgacgtacccgatttccccaaaaaggggatcatcttcaaggacattaccacgctactggcggacgccccgtcgttccagcgtatggttgacctgatcgcgcatcgctatgtagggaagaagatcagcaaggttgttgtggtggaagcccgcggattcgtcatcggcgccgccctggcttacaagctgggtgccggcgtggtcctggtgcgcaagccgggcaaactcccctcagaaacctatagcaaaacctatcagctcgaatacggctccgacacgctggagatccataccgacgccattgccaagggagagcgggtgatcatcgccgacgacatcctcgccaccggcggtaccatggcggcggtggtcgacatggtcgaggcgctggggggagagattgtcgagtgctgttttatggccgagctcgaattcctcgggggcagaaagaggttgcccgaaggaaaggtttactcgcttctcaccttctag

SEQ ID NO: 11409 - protein, 171 aa, Geobacter sulfurreducens
MDELKNIIRDVPDFPKKGIIFKDITTLLADAPSFQRMVDLIAHRYVGKKISKVVVVEARGFVIGAALAYKLGAGVVLVRKPGKLPSETYSKTYQLEYGSDTLEIHTDAIAKGERVIIADDILATGGTMAAVVDMVEALGGEIVECCFMAELEFLGGRKRLPEGKVYSLLTF

SEQ ID NO: 11410 - DNA, 516 bp, Gloeobacter violaceus
  CDS (1)..(516): transl_table=11
atggacctcaaagactacatccgcaccgtccccgattttcccgaacccggcattctctttcgcgacatcaccacgctgctgcacgaacccaaggccctgcgctacaccatcgacagtctggcggaacagactggctccctcggtgccgattatgtcgtgggcatcgaatcgcgggggttcatgttcggtacgcctctggcgatcaaactggactgcggcttcgtgccggtgcgcaaacccggcaagttgccggcggcagtatttaaagaggaatacaccctcgaatacggcaagaacgccctcgaaatccaccaggacgcctttgcggcccccagccgcgtgctggtggtcgacgatttgctggccaccggcgggaccgccgtcgccgccgcccaactggtcgagcgggccgggggtacagttgtgggattcggatttatcatagagctaacctttctcaatgggcgcgcgaaactgccggagggtccttcggcagttgctttggtctcttattaa

SEQ ID NO: 11411 - protein, 171 aa, Gloeobacter violaceus
MDLKDYIRTVPDFPEPGILFRDITTLLHEPKALRYTIDSLAEQTGSLGADYVVGIESRGFMFGTPLAIKLDCGFVPVRKPGKLPAAVFKEEYTLEYGKNALEIHQDAFAAPSRVLVVDDLLATGGTAVAAAQLVERAGGTVVGFGFIIELTFLNGRAKLPEGPSAVALVSY

SEQ ID NO: 11412 - DNA, 540 bp, Gluconobacter oxydans
  CDS (1)..(540): transl_table=11
atgtcgtttcaggatccccagcctctcgatctcaagaactacattcgcgagattccggattttccgaagcggggcatcctgttctacgacatctcgaccctgatccgctcgcccgacgcctggcaggtcgccaccgcccgtctggcccgcgtgatcgccgcctggcagccggacatcctggccggaatcgaaagccgcggcttcctgacggccgcaccgctcgccctgcgtctgggctgcggcttcacgatgctccgcaagccgggcaagctgccgggcaagaccatttccctgaaatacggtctcgaatacggcgaggacgagctgcacatccaggccgacgccatcaagccgggccagcgcgtcgtggtgctggacgatctgctggcaacgggcggcacgctcgcggcctccatcgatcttctgcgcaaggtcggggccgaagtcgtgggcgcgtccgtgctcatcgaactggcggacctgaaaggccgtgagaaactggacgttccgctgaacgctctgatgacatacgacgaataa

SEQ ID NO: 11413 - protein, 179 aa, Gluconobacter oxydans
MSFQDPQPLDLKNYIREIPDFPKRGILFYDISTLIRSPDAWQVATARLARVIAAWQPDILAGIESRGFLTAAPLALRLGCGFTMLRKPGKLPGKTISLKYGLEYGEDELHIQADAIKPGQRVVVLDDLLATGGTLAASIDLLRKVGAEVVGASVLIELADLKGREKLDVPLNALMTYDE

SEQ ID NO: 11414 - DNA, 540 bp, Haemophilus ducreyi
  CDS (1)..(540): transl_table=11
atgaatcagctagatttaattaaatcatctatcaaatctattcctaattaccccaaagttggcatcattttccgtgatattacttctttactagaaaatcctaccgcatttaaagcatctatagatgcaatcgtcgcagaattcaaaaataaaggcatcactaaagtcgtcggcacagaatctcgtggttttatctttggagcgcctgtagccctagcattagggctaccctttgtattagtgcgtaaacctcataaattaccaagagccgttatttcgcaatcctatgcccttgaatatggtgaagatacacttgaaatgcacctagattctatcaatcaagatgacaacgtattagtggtagatgatctattagctactggtggcactattgatgcgaccgccaaattaattcgccaattaggcggtcaagttaaaaatgcggcttttgttattgggttacccgatttaggcggtaaagcacgacttgaacaaatcggcatcaaatcattcacactagtggaatttgacggccattaa

SEQ ID NO: 11415 - protein, 179 aa, Haemophilus ducreyi
MNQLDLIKSSIKSIPNYPKVGIIFRDITSLLENPTAFKASIDAIVAEFKNKGITKVVGTESRGFIFGAPVALALGLPFVLVRKPHKLPRAVISQSYALEYGEDTLEMHLDSINQDDNVLVVDDLLATGGTIDATAKLIRQLGGQVKNAAFVIGLPDLGGKARLEQIGIKSFTLVEFDGH

SEQ ID NO: 11416 - DNA, 537 bp, Helicobacter hepaticus
  CDS (1)..(537): transl_table=11
atggacaagcaaaaaatagcagattctatcagggcggtatataactataagcccggagttatatttagagatattactacactcataggtgatgcagaggtattcaaagaagtgataaatatcttaagaagtcgctatgagaatcaaagtattgactttatagctgctattgaagcgcgaggatttatttttggttcagctcttgcatacgcactaggcataggatttgtccctatacgcaaaaaaggcaaactgccttataatactattagtgaaaaatatacgcttgaatatggcactgatgagttgcatatacatacagatgcctttagggataagaaaaatgctaaagttgtgcttatagatgatttaatagccacaggaggcacagcagaagcaagtgtaaagcttataaaatctatcggcgcacaatgcgttgaggctgcatttgtgattaatctcaaaggtttagagggtgaaaaaaagctcgctccttatacacaagtctttagcattgtagaatatgaaggaaaataa

SEQ ID NO: 11417 - protein, 178 aa, Helicobacter hepaticus
MDKQKIADSIRAVYNYKPGVIFRDITTLIGDAEVFKEVINILRSRYENQSIDFIAAIEARGFIFGSALAYALGIGFVPIRKKGKLPYNTISEKYTLEYGTDELHIHTDAFRDKKNAKVVLIDDLIATGGTAEASVKLIKSIGAQCVEAAFVINLKGLEGEKKLAPYTQVFSIVEYEGK

SEQ ID NO: 11418 - DNA, 540 bp, Helicobacter pylori J99
  CDS (1)..(540): transl_table=11
atgaatgaaatgctcaaagaagaacttttacaaagcatcagagaagtgaaagactaccctaaaaaagggattttattcaaagacattaccacgctactcaactaccctaaactttttaacaaactcattgacgcgctcaaaaaacgctatctcgctctcaatatagactttattgtgggcattgaagcgagggggtttattttaggctctgcatttgcttatgcgcttggggtgggttttgtgcctgttaggaaaaagggcaaactccccgcgcacaccctctctcaaagctatagtttagaatacgggagcgatagcatagaaatccactctgatgcttttaggggaattaagggggtaagggtggtgttggttgatgatttattagccactggaggcacagctttagcgagccttgagcttatcaaagccctacaagctgaatgcatagaagcctgttttttgatagggttaaaagaattaccgggtatccaacttttagaagaacatgtgaaaaccttttgtttgttagagtgctag

SEQ ID NO: 11419 - protein, 179 aa, Helicobacter pylori J99
MNEMLKEELLQSIREVKDYPKKGILFKDITTLLNYPKLFNKLIDALKKRYLALNIDFIVGIEARGFILGSAFAYALGVGFVPVRKKGKLPAHTLSQSYSLEYGSDSIEIHSDAFRGIKGVRVVLVDDLLATGGTALASLELIKALQAECIEACFLIGLKELPGIQLLEEHVKTFCLLEC

SEQ ID NO: 11420 - DNA, 540 bp, Helicobacter pylori
  CDS (1)..(540): transl_table=11
atgaatgaaacgctcaaagaagaacttttacaaagcatcagagaagtgaaagactaccctaaaaaagggattttattcaaagacattaccacgctactcaactaccctaaactctttaacaaactcattgacacgctcaaaaaacgctatctcgctctcaatatagactttatcgtgggcattgaagcgagagggtttattttaggctctgctctcgcttatgcgcttggggtgggttttgtgcctgtgaggaaaaagggcaaactccccgcacacaccctatctcaaagctacagcctagaatacgggagcgacagcatagaaatccactccgacgcttttaggggaattaagggggtaagggtggtgttgattgatgatttattagccactggaggcacagctttagcgagccttgagcttatcaaagccctacaagccgaatgcatagaagcatgctttttgatagggttaaaagaattaccgggtatccaacttttagaagaacgcgtgaaaaccttttgtttgttagagtgctag

SEQ ID NO: 11421 - protein, 179 aa, Helicobacter pylori
MNETLKEELLQSIREVKDYPKKGILFKDITTLLNYPKLFNKLIDTLKKRYLALNIDFIVGIEARGFILGSALAYALGVGFVPVRKKGKLPAHTLSQSYSLEYGSDSIEIHSDAFRGIKGVRVVLIDDLLATGGTALASLELIKALQAECIEACFLIGLKELPGIQLLEERVKTFCLLEC

SEQ ID NO: 11422 - DNA, 534 bp, Idiomarina loihiensis
  CDS (1)..(534): transl_table=11
atggaatcagccacgactgatataagggactctattggttccattccggactatcctaagccaggtattattttccgggatataacgcctttactgcaaaacccggatgcgtttagattaaccattaatacgttaaagcaacgctatgcagggcagggcataacacaaattgctgctgttgaagcccgtggctttatttttggttccgcattagcctatgccatggggtgtggagttactttgttaagaaagccggggaagttacccggtaaagtgacacgtcagaattatgagttagagtacggttcagatgaattgcaaatgcatgaaaacgctttgactgaaaacgacagagtgctaattgtcgacgatttactggctaccggcggaaccgtggtagctgcaagtcagttgattaagtcttccggcgcagacgttgtagaagccgcttttgtggtctctttacctgagctcggcggtgaagataaattgcagcaggccggcgttgcgtgctataccttatgtcagttttaa

SEQ ID NO: 11423 - protein, 177 aa, Idiomarina loihiensis
MESATTDIRDSIGSIPDYPKPGIIFRDITPLLQNPDAFRLTINTLKQRYAGQGITQIAAVEARGFIFGSALAYAMGCGVTLLRKPGKLPGKVTRQNYELEYGSDELQMHENALTENDRVLIVDDLLATGGTVVAASQLIKSSGADVVEAAFVVSLPELGGEDKLQQAGVACYTLCQF

SEQ ID NO: 11424 - DNA, 564 bp, Kluyveromyces lactis
  CDS (1)..(564)
atgtctatcactgaatatgctactgagttgaaaggtgctttgcgtcagtacccaaacttcccacaagagggtatcctattcgaagatttcttaccaattttcagagaccctcaattgttcaagaaattgattgaatccttcaagcttcacctgcaagagaaattcacaggcaagaagatcgactatgtcattggcttagaagcccgggggtttctatttggcccagccctagctctggctcttgatgctggttttgtaccggtgagaaagcaaggtaagcttgctggtgaagttgtacacgcagtttatgctaaggagtacggtgaagatgttttcgaaatccaggctgattctatccctgaacattcaaacgtcgttattgtcgatgatatcattgccaccggtggctccgcaaaagcagccggtgacttggctttgcagttgaatgcaaacatcttggagttctgtttcgttatggagttggatttcttgaaaggtactcaaaaactacaggcaccatcttttactttgttaagtggtcaggaagaggctttatcaaaatga

SEQ ID NO: 11425 - protein, 187 aa, Kluyveromyces lactis
MSITEYATELKGALRQYPNFPQEGILFEDFLPIFRDPQLFKKLIESFKLHLQEKFTGKKIDYVIGLEARGFLFGPALALALDAGFVPVRKQGKLAGEVVHAVYAKEYGEDVFEIQADSIPEHSNVVIVDDIIATGGSAKAAGDLALQLNANILEFCFVMELDFLKGTQKLQAPSFTLLSGQEEALSK

SEQ ID NO: 11426 - DNA, 528 bp, Lactobacillus acidophilus
  CDS (1)..(528): transl_table=11
atggcaattgattttagtaagtatattgcaagtgttcaggactttcctaataaggggatagttttccgtgatattacacctattttgcaaaatggcgaattatatcgtgcagccacacatgaattagctgaatacgcaaagagtagaaatgcagatgtaattgtcggtcctgaagcacgtggctttattgtaggctgtccagtagcaactgaattgggtttgggctttgttccagctagaaaaccacataagttgccacgagaagttgaacgtgcttcatacgatttggaatatgggtccaacagtttggaaatgcataaagatgcaatcaagccaggacaacgagtagttctttgtgatgatttaatggctactgcgggtactttaagagcttctaaagaattaattgaaaatcttggaggcaaacttgttggtgctgcattctatattgaattgccagatttaaaaggtagagaaaaattaccagacgttgatatttactcacttgttaagtatcacggtgcttaa

SEQ ID NO: 11427 - protein, 175 aa, Lactobacillus acidophilus
MAIDFSKYIASVQDFPNKGIVFRDITPILQNGELYRAATHELAEYAKSRNADVIVGPEARGFIVGCPVATELGLGFVPARKPHKLPREVERASYDLEYGSNSLEMHKDAIKPGQRVVLCDDLMATAGTLRASKELIENLGGKLVGAAFYIELPDLKGREKLPDVDIYSLVKYHGA

SEQ ID NO: 11428 - DNA, 528 bp, Lactobacillus johnsonii
  CDS (1)..(528): transl_table=11
atggcaattgattttaaagaacacattgcaagtgtacaggattttccaaataaggggattgtctttcgcgatatcaccccaattttgcaagatgggaaattatatcgcgctgctacccatgaattagctgattatgctaaaagtcgtggagcagaagtaattgttggaccagaagcccgtggatttattgttggctgtcctgttgcaacagaattaggagttggttttgtaccagctcgtaagcctcataagttgccacgcgaagtagaaagtgcttcttatgatttagaatatggttctaatgtcttagaaatgcataaagatgcaattaagccaggtcaaaaagttgtaatctgtgatgacttgatggcaactgctggtactcttcacgcaactaaggaattaatcgaaaacttaggcggagaagtagtaggggcagcattttatattgaattaactgatcttaagggaagagaacaattcccagatttagacatatattctttagtaaagtacagtgatgcttaa

SEQ ID NO: 11429 - protein, 175 aa, Lactobacillus johnsonii
MAIDFKEHIASVQDFPNKGIVFRDITPILQDGKLYRAATHELADYAKSRGAEVIVGPEARGFIVGCPVATELGVGFVPARKPHKLPREVESASYDLEYGSNVLEMHKDAIKPGQKVVICDDLMATAGTLHATKELIENLGGEVVGAAFYIELTDLKGREQFPDLDIYSLVKYSDA

SEQ ID NO: 11430 - DNA, 519 bp, Lactobacillus plantarum
  CDS (1)..(519): transl_table=11
atggcattagatttaaaaaagtatgtggctagtattccggactatcccgaacctggaatcatttttcgcgatatttcaccactgatggctgacggggaagcttaccgtgaagcgactgatcagatcgtgcaatttgcgcgtgataaacatgttgatatgattgtcgggcctgaagcacgcggctttatcgtgggttgtccagtggcctatgaattaggcgttggttttgcacctgctcgtaagaagggtaagttaccacgcgaaacggtcaaagcgacttatgatttggaatacgggcagtctgcactttatttgcataaagatgcaattaagccgggacaaaatgtgctagttactgatgatttattagcaactggtgggaccatctcagcaacgattcaaatggttgaagaattaggcggtaacgtggttgggacggctttcttggtcgaactcaaagagttgcacggccgcgataagattaaagattatgatatgttgagcttgatgcaattttaa

SEQ ID NO: 11431 - protein, 172 aa, Lactobacillus plantarum
MALDLKKYVASIPDYPEPGIIFRDISPLMADGEAYREATDQIVQFARDKHVDMIVGPEARGFIVGCPVAYELGVGFAPARKKGKLPRETVKATYDLEYGQSALYLHKDAIKPGQNVLVTDDLLATGGTISATIQMVEELGGNVVGTAFLVELKELHGRDKIKDYDMLSLMQF

SEQ ID NO: 11432 - DNA, 522 bp, Listeria innocua
  CDS (1)..(522): transl_table=11
atggaaattaaagatttacaagattacgtagcgattgtgaacgattggccgaaaaaaggtattgtttttaaagacattacgccacttatgaatgacggcgaggcatatcgttttgctacggataaaatcgtggaatatgcaaaagaattaaaaatcgatattattgtaggaccggaagcacgtggctttattattggttgtcctgtggcttatgcgcttggaataggttttgctccagttcgtaaaccaggtaaacttccacgtgaaacgattgaaatggaatatgatttagaatatggaacaaataaattatccatgcatagtgatgccatcaaacctggtcaacgcgttttaatcacagatgatttactagcaactggtggaacgattgaagctacaatcaaactagtagaagaactaggtggtattgttgctggctgtgctttcctaatcgaactaaaagaattagaaggacataaaaaattaaatggttacgatcgtttaatcctgatgaaattataa

SEQ ID NO: 11433 - protein, 173 aa, Listeria innocua
MEIKDLQDYVAIVNDWPKKGIVFKDITPLMNDGEAYRFATDKIVEYAKELKIDIIVGPEARGFIIGCPVAYALGIGFAPVRKPGKLPRETIEMEYDLEYGTNKLSMHSDAIKPGQRVLITDDLLATGGTIEATIKLVEELGGIVAGCAFLIELKELEGHKKLNGYDRLILMKL

SEQ ID NO: 11434 - DNA, 513 bp, Mesoplasma florum
  CDS (1)..(513): transl_table=4
atggatttaaaaaaacatattttaaatgttaaggatttcccaattgatggaattgactttaaagatgtaacaccattattaaatgatgctgatgcttttgcttatgtaattgatgaaatggcaaaatttgttattgaatgtggagctaatgttgtagttgctccagaagcaagaggattcttatttgcaagtgctgtagcttataaatcacatactagatttgtattagttagaaaacctggtaaattacctcgtgaagttatcgatattgaatatactttagagtatggaacaaatcatcaacaaatgcacaaaggtgatattaaacctggtgataaagtagttattatagatgatgtactagcaactggtggaacaattgaagctattgttaaattagttgaaatgcaagaaggtaaagttgagggagtttcattcttaattgatttgccagcattacatgatgaaaatctattacaagaatacaaagttcaaaaacttgttaaatattaa

SEQ ID NO: 11435 - protein, 170 aa, Mesoplasma florum
MDLKKHILNVKDFPIDGIDFKDVTPLLNDADAFAYVIDEMAKFVIECGANVVVAPEARGFLFASAVAYKSHTRFVLVRKPGKLPREVIDIEYTLEYGTNHQQMHKGDIKPGDKVVIIDDVLATGGTIEAIVKLVEMQEGKVEGVSFLIDLPALHDENLLQEYKVQKLVKY

SEQ ID NO: 11436 - DNA, 516 bp, Methylococcus capsulatus
  CDS (1)..(516): transl_table=11
atggacaagctgcgcgcgaaaattcgggacatcccggacttccccaagcccggcatcctgttccgggacatcaccccgttggtcaaggatccggcggcgctgaggctggccatccaccagctcgtccaccccttcgtaggcgaagacatcaccgccgtcgccggcatggaagcccggggattcattttcggcgcgctggcggcctgggagctgggcgtcggcttcgtacccctgcgcaaaccgggaaaacttccctacaacgtccagtccatcgactacgatctggaatacggttcggcccgcctggaagtccatctggatgcgttgggagtgggcgaccgggtgctgatggtcgacgacctcctggcgaccggcggcaccgcccgcgccagttgttcgctggtggagagcctcggcgccgaagtggcagcctgcgccttcgtgatcgagctggacgccctcgaaggccgggaggccttgcacggccggcgcgtgcattcgctgctgcactactga

SEQ ID NO: 11437 - protein, 171 aa, Methylococcus capsulatus
MDKLRAKIRDIPDFPKPGILFRDITPLVKDPAALRLAIHQLVHPFVGEDITAVAGMEARGFIFGALAAWELGVGFVPLRKPGKLPYNVQSIDYDLEYGSARLEVHLDALGVGDRVLMVDDLLATGGTARASCSLVESLGAEVAACAFVIELDALEGREALHGRRVHSLLHY

SEQ ID NO: 11438 - DNA, 516 bp, Mycoplasma fermentans
  CDS (1)..(516): transl_table=4
atggatttaaaaaaatatattcgagatattgaaaattttcctaaaacaggcataatgtttaaagatatttcaccattattggcaaatggtaaagcattaaattatacaatcacagaaatggcaaaattagctcaagatgttgatgttattgttggaccagatgcgagaggatttttatttggcacgcctactgcagcattcttgaagaaaccatttattatggttagaaaaccaggaaaattacctggtgatgttatttcaaaaagttacgatttggaatatggaaataatgttttacaaattcaaaaagggtttattaaaaaaggtcaaacagttgcaattattgatgatgttttagcaacgggtggaacaactaaagctattataaaactattagaagaacaaggtgcaattgttaaaaaagttattttacttcttgaattagtagatcttaatggtagacaattaatcactaaagataatgatattgaaatagtttccttagttaaattttaa

SEQ ID NO: 11439 - protein, 171 aa, Mycoplasma fermentans
MDLKKYIRDIENFPKTGIMFKDISPLLANGKALNYTITEMAKLAQDVDVIVGPDARGFLFGTPTAAFLKKPFIMVRKPGKLPGDVISKSYDLEYGNNVLQIQKGFIKKGQTVAIIDDVLATGGTTKAIIKLLEEQGAIVKKVILLLELVDLNGRQLITKDNDIEIVSLVKF

SEQ ID NO: 11440 - DNA, 537 bp, Mycoplasma gallisepticum
  CDS (1)..(537): transl_table=4
atgaaaacagaacttattgcccaattaaaaaaaacaattatcaccgttaaggatttccccaaacccggaatcttgttttatgatatcaccccgatcttattagatcccaaactatttgatcaggtgattagtgtgatggctgaagtggctaagaaatcaaatgctgatatgattgcttcaccagaatcacgtggtttcttatttggtgtgccattagccaacaaacttaaattaccgtttgttttagtaagaaaacaaaacaaacttccccgagcaacttttagtgcttcttatgatcttgagtatggtaagaataacgttattgagatccaccaggatgcgattaaacctaattccaaggtgatgatcgttgatgatttattagcaactgctggaacagttgatgcaatctcaagactggtgaaacaagctaaatctgaagtggtttcatacagttttttaatccgtttaaaagatcttggtgggatcgataaattagatcaaactaaaccaattgattacatcttagaatactag

SEQ ID NO: 11441 - protein, 178 aa, Mycoplasma gallisepticum
MKTELIAQLKKTIITVKDFPKPGILFYDITPILLDPKLFDQVISVMAEVAKKSNADMIASPESRGFLFGVPLANKLKLPFVLVRKQNKLPRATFSASYDLEYGKNNVIEIHQDAIKPNSKVMIVDDLLATAGTVDAISRLVKQAKSEVVSYSFLIRLKDLGGIDKLDQTKPIDYILEY

SEQ ID NO: 11442 - DNA, 543 bp, Mycoplasma genitalium
  CDS (1)..(543): transl_table=4
atggatcaaaactttaagttgcttgatcaagcaatcaagcgctttgaaaattttcccaaccaaggtacattgttttatgacattaccccagtattttccaatccccaactatttaattttgtgctaacccaaatggcacagtttattaaagctattaatgcagaagcgatagtatgtcctgaagcgaggggttttatctttgggggagcattagcttctaaaacccaactcccgttagtattggttagaaaagccaataaactcccagggcaattaattagtgctagctatgatttggagtacagaaaacatgctgtattggagatgtcaaccacttcattaatccaagctaataatgctaaaaggtgtgttattgttgatgatgtacttgccactgctggaacagttgctgctattgaccaattacttaaacagttaaatggtgaaactgtgggatattgctttttaattgagctgaaaaaactcaatggtaaagctaagttacaaccaaatgtggttagcaagattttattacattactag

SEQ ID NO: 11443 - protein, 180 aa, Mycoplasma genitalium
MDQNFKLLDQAIKRFENFPNQGTLFYDITPVFSNPQLFNFVLTQMAQFIKAINAEAIVCPEARGFIFGGALASKTQLPLVLVRKANKLPGQLISASYDLEYRKHAVLEMSTTSLIQANNAKRCVIVDDVLATAGTVAAIDQLLKQLNGETVGYCFLIELKKLNGKAKLQPNVVSKILLHY

SEQ ID NO: 11444 - DNA, 516 bp, Mycoplasma mobile
  CDS (1)..(516): transl_table=4
atgaatgatttaaatgaattgaaaaaatatattcaagatgtaaaagattttcctattaaaggaattgtttttaaagatatttcaccacttttagcaaatggagaaatttttagaatagttgttgaaaaaatggctgaaaaagtaagagaagtggatgtcattataggaccagatgcaagagggtttatttttggtgcagccgttgcttcatatcttaaaaaaccttttgtaatgataagaaaagaaggtaaattacctcataatacaattaaaattgattataagcttgaatatggaatgggttctttggaaattcaaaaggatttaataaaaccgggccaaagtgttgctattcttgatgatgttttggctactggaggaacaacaaaagcctctgttgaacttgttaaaaaattaggagcaaaagttacaaaagctgtttttttaatggaactagaattcttaaatggtaaagaaaaaataaatgcagaagttatttctctattgaaatactaa

SEQ ID NO: 11445 - protein, 171 aa, Mycoplasma mobile
MNDLNELKKYIQDVKDFPIKGIVFKDISPLLANGEIFRIVVEKMAEKVREVDVIIGPDARGFIFGAAVASYLKKPFVMIRKEGKLPHNTIKIDYKLEYGMGSLEIQKDLIKPGQSVAILDDVLATGGTTKASVELVKKLGAKVTKAVFLMELEFLNGKEKINAEVISLLKY

SEQ ID NO: 11446 - DNA, 543 bp, Mycobacterium paratuberculosis
  CDS (1)..(543): transl_table=11
atgacggacgccggcgaagcgacgccggtcgcggagctcatcgcgtcgctgacccggcaggtgcccgatttccccaagcccggcatccagttcaaggacctcaccccgctgttcgccgaagcgacggcgatgacggccgtcaccggcgcgctggcccggcacgcgtccggtgccgacctggtggccggcatcgactcgcgcgggttcctggtcgcggcggccgtggccgaccggctgcacaccggggtgctggccatccgcaagggcggcaaactgccgccgccggtgcacgccgagcgctacgacctggaatacggcagcgccaccctggagatccccgccgacggcatcgacctgcgtgggcggcgcatcgtgatcatcgacgacgtgctggccaccggcggtaccctggccgcggcggcccgactgctgcggcgcaccggcgccaccgtgaccgcggcggcggtggtgttcgaactcggtgcgctgggcgggcgggcggcgctggcgccgttgccggtgcacagcctgacttgccagtag

SEQ ID NO: 11447 - protein, 180 aa, Mycobacterium paratuberculosis
MTDAGEATPVAELIASLTRQVPDFPKPGIQFKDLTPLFAEATAMTAVTGALARHASGADLVAGIDSRGFLVAAAVADRLHTGVLAIRKGGKLPPPVHAERYDLEYGSATLEIPADGIDLRGRRIVIIDDVLATGGTLAAAARLLRRTGATVTAAAVVFELGALGGRAALAPLPVHSLTCQ

SEQ ID NO: 11448 - DNA, 519 bp, Mycoplasma penetrans
  CDS (1)..(519): transl_table=4
atgggttatgaagaaataaaaaacacaattgcaacaatagaagactttcctaaaaaagggataagttttaaagatatcacgcctttattacttgatcataagaaaatgaattttattattgatgagttagcaaagtttgcaaaaacaattgattttgacattattgttgctcctgaatctagaggtttcttatttggcttaccattagctttaaatttaaaaaaaccttttgtcccaattagaaaaaaaggaaaattaccaagagaagtaatctctcaagaatatgaattggaatatggtaaagcaactattgaagttactaaaaatgatattcctgcaaattcaaaagtattaattattgatgatttaattgcaactggtggaactacagtagctattcaagatttagttacaaaacttggaagcactgttgttggacaagcatacttaattgaacttgttggcttatgtgattatgaaaaattacaaggtaagttcttctcaatgattaaatattaa

SEQ ID NO: 11449 - protein, 172 aa, Mycoplasma penetrans
MGYEEIKNTIATIEDFPKKGISFKDITPLLLDHKKMNFIIDELAKFAKTIDFDIIVAPESRGFLFGLPLALNLKKPFVPIRKKGKLPREVISQEYELEYGKATIEVTKNDIPANSKVLIIDDLIATGGTTVAIQDLVTKLGSTVVGQAYLIELVGLCDYEKLQGKFFSMIKY

SEQ ID NO: 11450 - DNA, 513 bp, Mycoplasma pulmonis
  CDS (1)..(513): transl_table=4
atgaacttagaaaaatttataaaagatgttaaagattttcctaaacaaggaattaattttaaagatatctcacctttgttagccaatggccaagctttaaattacacaattaaaaaaatggccgaactagcaaaggatgcagatattatagttggccccgatgcaaggggctttctttttggaacaccaactgctgcttttttgtctaagccatttattatggttagaaaaaaaggaaaacttcctggagaagtcattaaacatgaatatgatcttgaatatggaaaagatattttagaaattcaaaaaggagtgattaaaccaggggataaagccataattatcgatgatgttttagcaactggcggaacaacaaaagcaattattgatttgcttgagtctcaaggagcaaaagttataaaaataatcttgcttttggaactaactaatttaaatggaaggtccaaatttggatcattacaagtagaatctctagtaaaggtaagtgtctaa

SEQ ID NO: 11451 - protein, 170 aa, Mycoplasma pulmonis
MNLEKFIKDVKDFPKQGINFKDISPLLANGQALNYTIKKMAELAKDADIIVGPDARGFLFGTPTAAFLSKPFIMVRKKGKLPGEVIKHEYDLEYGKDILEIQKGVIKPGDKAIIIDDVLATGGTTKAIIDLLESQGAKVIKIILLLELTNLNGRSKFGSLQVESLVKVSV

SEQ ID NO: 11452 - DNA, 600 bp, Neisseria meningitidis serogroup A; identical to SEQ ID NO: 11104
  CDS (34)..(600): transl_table=11

SEQ ID NO: 11453 - protein, 188 aa, Neisseria meningitidis serogroup A
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 11454 - DNA, 567 bp, Neisseria meningitidis serogroup B
  CDS (1)..(567): transl_table=11
atgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 11455 - protein, 188 aa, Neisseria meningitidis serogroup B
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 11456 - DNA, 525 bp, Nitrosomonas europaea
  CDS (1)..(525): transl_table=11
atgtcaatcaaatcacgtatccgtaccatcccgcattacccccatgaaggcatcatgttccgggatatcaccacactcctgaaagatccggctggactgcgctcgaccatcgacggaatcgttcaacgctatcaaaccgaaaagatcgataaagtcgtcggcattgaatcacgtggattcatcattgctgcaccggttgcgtatgcactgagcgccggattcgttcctgttcgcaaacaaggtaaattaccggccgaaaccattggctgcgattatcagctggaatacggttatgacaaagtcgagattcacgtggatgcgatcgataaaggggatcgcgtattactgatcgatgatctgattgcaacaggtggaacgatggaagctgcaatcaagctggttcaggaggcaggtggagaagtgattgaatgctgtttcgtgatcgatttgcctgatatcggtggaagcaggcgactgcgtcagcaaggtcatcgactgttttcgctctgcagttttgaagattga

SEQ ID NO: 11457 - protein, 174 aa, Nitrosomonas europaea
MSIKSRIRTIPHYPHEGIMFRDITTLLKDPAGLRSTIDGIVQRYQTEKIDKVVGIESRGFIIAAPVAYALSAGFVPVRKQGKLPAETIGCDYQLEYGYDKVEIHVDAIDKGDRVLLIDDLIATGGTMEAAIKLVQEAGGEVIECCFVIDLPDIGGSRRLRQQGHRLFSLCSFED

SEQ ID NO: 11458 - DNA, 576 bp, Nocardia farcinica
  CDS (1)..(576): transl_table=11
atgagcaagcacgcggcggtggagtccgacgagcacgtggccgagcggaccgccgaggcggcgcggcaggtcgaacgcctcacccgctggcacgacgatttcccgacccccggtgtccgcttcgccgacctcacccccgtcttcgccgacgccgagggcttccgctcggtgatcgaatcgctggccgcctgcgcccccgacgccgatctggtcgccggcgtggatgcgcgggggttcctgctcggcgccggggtggcggccacgctgggcaccggtgtgctcgccgtccggaagggcggcaaactgccgccgccggtgatcagccgcgagtacagcctggagtacggctcggcggcgctggagatccccggcaacggggtggaactgcgcggacgccgagtgttgctgctcgacgacgtgctggccaccggcggcacgctggccgccgccgcgcacctgttcgtcgaggctggcgcccaggtcgtggccgccgcggtggtgctggagctggagttcctcggcggccgcgcccgccagggcgactacccgctgacctcgatcctccgcctgccctga

SEQ ID NO: 11459 - protein, 191 aa, Nocardia farcinica
MSKHAAVESDEHVAERTAEAARQVERLTRWHDDFPTPGVRFADLTPVFADAEGFRSVIESLAACAPDADLVAGVDARGFLLGAGVAATLGTGVLAVRKGGKLPPPVISREYSLEYGSAALEIPGNGVELRGRRVLLLDDVLATGGTLAAAAHLFVEAGAQVVAAAVVLELEFLGGRARQGDYPLTSILRLP

SEQ ID NO: 11460 - DNA, 513 bp, Oceanobacillus iheyensis
  CDS (1)..(513): transl_table=11
atggaatttaaaaattatattgaaatagtagaagattggcctaaggaaggcattaaatttaaagatattaccccattgatggcagatggaaaagcttttaaatctgcagtcgacgagattgtagattatgcaaataccaaagaaattgatttagtagtagggcctgaggctagaggttttattgttggttgtccggtttcttatgcattagaagtagggttcgcacctgtaagaaaagaaggcaagcttcctagagaagttattaaagtagattatggcttggagtatggagaaaacgtactaacgattcataaagatgccataaaacccgggcaacgagtacttatcacagatgatttattagcaactgggggaactatagaagctacgattaaattagtagaacaacttggcggtatcgtggttggatgtgcatttcttgttgaattaggatatctagatggaaaagataaactagaaggatacgatgtattaactttaatgaaatattag

SEQ ID NO: 11461 - protein, 170 aa, Oceanobacillus iheyensis
MEFKNYIEIVEDWPKEGIKFKDITPLMADGKAFKSAVDEIVDYANTKEIDLVVGPEARGFIVGCPVSYALEVGFAPVRKEGKLPREVIKVDYGLEYGENVLTIHKDAIKPGQRVLITDDLLATGGTIEATIKLVEQLGGIVVGCAFLVELGYLDGKDKLEGYDVLTLMKY

SEQ ID NO: 11462 - DNA, 543 bp, Pasteurella multocida
  CDS (1)..(543): transl_table=11
atgaacgataaacttgctttgattaaatcttccattaagtctattccaaatcatcccaaagaagggattatttttcgcgacattaccagtttgttagaagttcctgctgcttttcagaccgtggttgatctttttgtgacacgttataaagaaaaagggatcaccaaagtgttaggaacagaatcacgtggttttatttttggtgcacctgtggctttagcattaaatgtgccttttgtactggtgagaaaaccgggcaaattaccacgtgaaactatttcacaaacctatcagttagagtatggacaagatacgcttgaaatccatactgatgcaattcatgcacaagataaagttttgattattgatgatttgctcgccacaggtggtaccgtagaagccacggtgaaattagttcaacgtttaggcggtgatgtgcaagacgctgcttttgtgattaacttgcctgatttaggtggggaagcacgtttaaatgcattaggtattgatgcttataccttagtggactttgctgggcattaa

SEQ ID NO: 11463 - protein, 180 aa, Pasteurella multocida
MNDKLALIKSSIKSIPNHPKEGIIFRDITSLLEVPAAFQTVVDLFVTRYKEKGITKVLGTESRGFIFGAPVALALNVPFVLVRKPGKLPRETISQTYQLEYGQDTLEIHTDAIHAQDKVLIIDDLLATGGTVEATVKLVQRLGGDVQDAAFVINLPDLGGEARLNALGIDAYTLVDFAGH

SEQ ID NO: 11464 - DNA, 534 bp, Propionibacterium acnes
  CDS (1)..(534): transl_table=11
atgacctaccgtaaggacctcattgccagcctgatccgggatgtcccggactttccggagcccggggtcacttttaaggacatcactccgctactggcaaatcccaatggctatgcggctgcgatctctgaactcgtagacactgcttctcgtgacgtggacgtcgtcctcggtatggaggcacgtggattcatgttcgccgggccggtagctctctccctcggagccggatttgttcctgtccgcaaacccgggaaacttcctggtgacgtctactctcagtcattcgtgctggagtacggctctgcgaccctgacagtccatcaggatgcggtgcagcccggttccaaggtgctcatcgtcgatgacgtcctcgcgacagccggcacagttcgcgctacggcctccctcgtggagcagttgggcgcagaactggttggtgtatcggtactcatagagctgtcggctctgggcggtcgcgagaaactcgatcgcgccggaatcggtcctgtcaacgcagttctcacaatctga

SEQ ID NO: 11465 - protein, 177 aa, Propionibacterium acnes
MTYRKDLIASLIRDVPDFPEPGVTFKDITPLLANPNGYAAAISELVDTASRDVDVVLGMEARGFMFAGPVALSLGAGFVPVRKPGKLPGDVYSQSFVLEYGSATLTVHQDAVQPGSKVLIVDDVLATAGTVRATASLVEQLGAELVGVSVLIELSALGGREKLDRAGIGPVNAVLTI

SEQ ID NO: 11466 - DNA, 519 bp, Prochlorococcus marinus
  CDS (1)..(519): transl_table=11
atgatcggatcaaagctgaaagaagctattcgaagttattcagacttccctaaaaagggaatacttttccatgacatctcccctatattttgtaagcctgatctatatcaagagttaatagaagaaatggcaaaatctgaaatattaaactcctcagatgcaattatatcaatagatgctagaggatttttatttgggtcttgtatatcacttaaactttcgaaacccctaatactagcaagaaaggctgggaaactacctggtccaatcttatcaagtacttacaacttagagtatggagaaaatagtttatcgattcaaaaagaatcgttaaatgaattcaagaattttgccattatagacgacgtactagcaactggtggaaccataaactgtgttaaaagtctattaacttctcacaataaaaatatttccggagcttgtgtagtaattgagctacttgctttaaaagctagagaaaaattagatttccctatatattcaacattaacactttag

SEQ ID NO: 11467 - protein, 172 aa, Prochlorococcus marinus
MIGSKLKEAIRSYSDFPKKGILFHDISPIFCKPDLYQELIEEMAKSEILNSSDAIISIDARGFLFGSCISLKLSKPLILARKAGKLPGPILSSTYNLEYGENSLSIQKESLNEFKNFAIIDDVLATGGTINCVKSLLTSHNKNISGACVVIELLALKAREKLDFPIYSTLTL

SEQ ID NO: 11468 - DNA, 549 bp, Pseudomonas aeruginosa
  CDS (1)..(549): transl_table=11
atgattttcgacgagttcaccctcaagtcgcagatccgcgccgtgccggactttcccaagcccggcgtggtgttccgcgacatcaccccgctgttccagtcgccacgcgcgctgcgcatgaccgtggacagcttcgtccagcgctacatcgaggccgatttcagccacatcggcgccatggatgcccgcggcttcctcatcggctcggcggtggcctatgcgctgaacaagccgctggtcctgttccgcaagcagggcaagctacccgccgacgtactcgccgagggctaccagaccgaatacggcgaggccttcctcgaagtacatgccgacagcctctgcgaaggcgacagcgtactgatcttcgacgacctcatcgccaccggcgggaccctgctggcggccgcgagcctggtacgacgcctcggggccagggtcttcgaggccgcggcgatcatcgacctgccggaactcggcggctccactcgcctgcaggacgccggcatctccaccttcagtctcaccgcgttcgctctcgacgagcgttga

SEQ ID NO: 11469 - protein, 182 aa, Pseudomonas aeruginosa
MIFDEFTLKSQIRAVPDFPKPGVVFRDITPLFQSPRALRMTVDSFVQRYIEADFSHIGAMDARGFLIGSAVAYALNKPLVLFRKQGKLPADVLAEGYQTEYGEAFLEVHADSLCEGDSVLIFDDLIATGGTLLAAASLVRRLGARVFEAAAIIDLPELGGSTRLQDAGISTFSLTAFALDER

SEQ ID NO: 11470 - DNA, 549 bp, Pseudomonas putida
  CDS (1)..(549): transl_table=11
atgcacagcgacgccttcgacctcaaagccctgatccgcccggtagtggacttccccaaaccgggtgtgatcttccgcgacatcaccccgctgttccaatcgccacgcgggcttcgctatgtggccgaccagttcatcgagcgctatgtcgaggctgagttcagccacattggtgccatggacgcgcgtggtttcctgatcggttcgatcatcgcccaccagttgaacaagcccctgatcctgttccgcaagcagggcaagctgccggctgacgtgctgagcgagggttaccagaccgaatatggcgaagccttcctggaagtgcatgccgacagcctgtgcgaaggcgattcggtgctgatcttcgatgacctgattgcgactggcggcacactgctggcagcagccaacctggtgcgccgtactggggcgcaggtgttcgaggcggcggcgatcattgacttgccggagctggacgggtcgcgtcggctgcaggcggcgggtgtgccgaccttctgcctgaccgagttttcgctcagcgagtattaa

SEQ ID NO: 11471 - protein, 182 aa, Pseudomonas putida
MHSDAFDLKALIRPVVDFPKPGVIFRDITPLFQSPRGLRYVADQFIERYVEAEFSHIGAMDARGFLIGSIIAHQLNKPLILFRKQGKLPADVLSEGYQTEYGEAFLEVHADSLCEGDSVLIFDDLIATGGTLLAAANLVRRTGAQVFEAAAIIDLPELDGSRRLQAAGVPTFCLTEFSLSEY

SEQ ID NO: 11472 - DNA, 549 bp, Pseudomonas stutzeri
  CDS (1)..(549): transl_table=11
atgatctttgacgagttcagcatcaaaaccctgatccgaccggtgcaggatttcccccgtccgggagtggtgtttcgcgacatcaccccgctgtttcagtcgcccaaggcgctgcgcatggtcgccgacagcctcatccaacgctatgtagaggccgatttcacccacatcggagcgctcgatgcgcgtggctttctagttggctccatcctcgcctacgagttgaacaagccgctggtgctcttccgcaagcagggcaagctgcccgcagatgtgttgtcgcaggcctatagcaccgagtacggcgaagcccatctggagatccatgccgacagcctctgcgaaggtgattcggtgctgctgttcgatgaccttatagccaccggcggcaccctgctcgccgctgcgcaactggtgcgacgcatgcgtgcgaacatccatgaggccgcagcaatcatcgacttgcccgagctcggtgggtcgcagaagttgcaagacatcggcattcccaccttcacactcaccgcctttgccttgagcgaccgctga

SEQ ID NO: 11473 - protein, 182 aa, Pseudomonas stutzeri
MIFDEFSIKTLIRPVQDFPRPGVVFRDITPLFQSPKALRMVADSLIQRYVEADFTHIGALDARGFLVGSILAYELNKPLVLFRKQGKLPADVLSQAYSTEYGEAHLEIHADSLCEGDSVLLFDDLIATGGTLLAAAQLVRRMRANIHEAAAIIDLPELGGSQKLQDIGIPTFTLTAFALSDR

SEQ ID NO: 11474 - DNA, 594 bp, Ralstonia solanacearum
  CDS (1)..(594): transl_table=11
atgaccgacgccagcatctctccgtcctcgcccgttcctgcctcgaccgaactgggcgatgtgacgcgctacctgcgcgagcgcatccgcaccgtgcccgactggccgcagctgggggtgatgttccgcgacatcacgccgctgctgcaggacccgaagagcctgcgcgtgctggtggacgtgttcgtccatcgctatatgggacaggggctgaacctggtggcgggcatcgatgcgcgcggcttcatcctcggctccatcgtcgcgtacgagctgaacctgggcttcgtgccgatccgcaagaagggcaagctgccgttcaccaccgtggccgaggagtacatgctggagtacggcagcgccacggtggagatccacgccgacgcctgcaagcccggcgaccgcgtgctgctgatcgacgacctgatcgccaccggcggcaccatgatggccggcaagcgcctgctggagcggctgggcgcgacggtggtggagggcgcggccatcgtcgacctgcccgaactgggtggctcgcgcctgctgatggacggcggcctgccgctctttaccgtgtgccgcttcgacgggcattga

SEQ ID NO: 11475 - protein, 197 aa, Ralstonia solanacearum
MTDASISPSSPVPASTELGDVTRYLRERIRTVPDWPQLGVMFRDITPLLQDPKSLRVLVDVFVHRYMGQGLNLVAGIDARGFILGSIVAYELNLGFVPIRKKGKLPFTTVAEEYMLEYGSATVEIHADACKPGDRVLLIDDLIATGGTMMAGKRLLERLGATVVEGAAIVDLPELGGSRLLMDGGLPLFTVCRFDGH

SEQ ID NO: 11476 - DNA, 546 bp, Rhizobium galegae
  CDS (1)..(546): transl_table=11
atgactgcctcaaccaaagacatcctcgccacagcgatccgctccattccggattatcccaagcccggcatcatctttcgcgatatcaccacgttgctgggtgatgcagcggccttccgcctcgcggtggacgaactggtgaagccctatgagggactgggtgtcgacaagattgccggcatggaagcgcgtggcttcattctgggcggcgcgatggcgcatcagctgtctgccggcttcgttccgatccgcaagaagggcaagctgccttaccgcaccgtgagcatggcctatgcgctggaatacggcaccgacgagatggaaattcatgtcgatgcggtgaagccgggtgaaaaggtcatcctctgcgacgacctgatcgcgaccggcggaaccgctgtgggcgcggtcaagctgttgcgccagatcggtgcagaagtcgtatccgcctgcttcgtcatcgatctgccggatctcggtggccgcaaggcgctcgaagcgcttggcgtcgaagtccgcacactggcggaattttccggccactga

SEQ ID NO: 11477 - protein, 181 aa, Rhizobium galegae
MTASTKDILATAIRSIPDYPKPGIIFRDITTLLGDAAAFRLAVDELVKPYEGLGVDKIAGMEARGFILGGAMAHQLSAGFVPIRKKGKLPYRTVSMAYALEYGTDEMEIHVDAVKPGEKVILCDDLIATGGTAVGAVKLLRQIGAEVVSACFVIDLPDLGGRKALEALGVEVRTLAEFSGH

SEQ ID NO: 11478 - DNA, 546 bp, Rhizobium loti
  CDS (1)..(546): transl_table=11
atgaaaccttcgctcgaagacacgctgctggcttcgatccgcaccattccggattacccgaagcccggcatcctgtttcgcgacatcaccacgctgcttggcaatgcgcgcgctttccgccgcgccatcgacgaactggtgcatccctatgccggccagaaggtcgacaagatcgccggcatcgaggcgcgcggctttatcctgggcggcgccgtcgcccaccagctttcggccggtttcgtgccgatccgcaagaagggcaagttgccgttcgacacggtgcgcgtcgcctacagtctggaatacgggctggacgagatggagatgcacaaggatggcgttgccccgggcgaaaaggtgatcctggtcgacgacctgatcgccaccggcggcaccgcggaagcggcggtcaagctgctgcgccagatcggcgccgatattcttgccgcttgcttcgtcatcgacctgccggatcttggcggccgcgccaagctcgaggcgcttggcgtgccggtaaggacgctgatcgggttcgagggacactaa

SEQ ID NO: 11479 - protein, 181 aa, Rhizobium loti
MKPSLEDTLLASIRTIPDYPKPGILFRDITTLLGNARAFRRAIDELVHPYAGQKVDKIAGIEARGFILGGAVAHQLSAGFVPIRKKGKLPFDTVRVAYSLEYGLDEMEMHKDGVAPGEKVILVDDLIATGGTAEAAVKLLRQIGADILAACFVIDLPDLGGRAKLEALGVPVRTLIGFEGH

SEQ ID NO: 11480 - DNA, 543 bp, Rhizobium meliloti
  CDS (1)..(543): transl_table=11
atgaccgctgttcaatcggaactgatttccgctatcagaagcattccggactatccgaagcccggcgtcatgttccgtgacatcacgaccctgctcggcaacccgcgggcattccgccgggcgatagacgagctcgtccatccctatgccggtaccaaggtcgacaaggtcgccggcatcgaggcgcgcggctttatcctgggcggcgcgattgcgcaccagctttcggccggcttcatacccattcgcaagaagggaaagttgccgcacgacacggtgcggatcgcctacagtctggaatacggcgtggacgagatggaaatgcacagggacgcggtcgctcccggcgacaaggtgatcctcgtcgacgacctgatcgccaccggcggcaccgccgaaggcgccgccaagctcctgaagcagatgggtgcggacatcgtcgcagcctgcttcatcatcgatctgcctgagctcggcggacgcaagaagctcgaagcgctcggcgtcaatgtgcgcacgctcatcgaattcgaggggcattga

SEQ ID NO: 11481 - protein, 180 aa, Rhizobium meliloti
MTAVQSELISAIRSIPDYPKPGVMFRDITTLLGNPRAFRRAIDELVHPYAGTKVDKVAGIEARGFILGGAIAHQLSAGFIPIRKKGKLPHDTVRIAYSLEYGVDEMEMHRDAVAPGDKVILVDDLIATGGTAEGAAKLLKQMGADIVAACFIIDLPELGGRKKLEALGVNVRTLIEFEGH

SEQ ID NO: 11482 - DNA, 546 bp, Rhodopseudomonas palustris
  CDS (1)..(546): transl_table=11
atgacccccgagtttgcaaacgatttgaaagccagcgtccgggcgattccggactatcccaagcccggcatcatcttccgcgacatcaccacgctgctcggcgaaccgcgcgcgttccgccgcgccatcgacgagctggtgcagccctgggcgggttcgaagatcgacaaggtggcgggcatcgaggcgcgcggcttcatcatcggcggcgcgatcgcccatcaggtgtcgagcggcttcgtgccgatccgcaagaagggcaagctgccgcatacctgcgtgtcgatggaatacgcgctggaatacggcaccgacaagatcgaggtccacgtcgacgccatcacccccggcgagcgggtaatcctggtcgacgacctgatcgccaccggcggcaccgccgagggcgcgatcaagctgctgcgccagatcggcgccgaagtcgtcgccgcctgcttcgtgatcgacctgccggagctcggcggcgccgccaagatccgcgccatgggcgtcccggtgcgcacgctggtcgcgttcgaagggcattga

SEQ ID NO: 11483 - protein, 181 aa, Rhodopseudomonas palustris
MTPEFANDLKASVRAIPDYPKPGIIFRDITTLLGEPRAFRRAIDELVQPWAGSKIDKVAGIEARGFIIGGAIAHQVSSGFVPIRKKGKLPHTCVSMEYALEYGTDKIEVHVDAITPGERVILVDDLIATGGTAEGAIKLLRQIGAEVVAACFVIDLPELGGAAKIRAMGVPVRTLVAFEGH

SEQ ID NO: 11484 - DNA, 552 bp, Salmonella paratyphi
  CDS (1)..(552): transl_table=11
atgaccgcgactgcacagcagcttgagtttctcaaaaacagcatcaaaagcattcaggattacccgaaaccgggcattcttttccgtgatgtcaccagcttactggaagacccgaaagcctacgcgctcagtattgaactgttggttgagcgttataaaaatgcgggtatcaccaaagtggtcggcaccgaagcgcgtggcttcctgtttggcgcgccggttgcgcttgggctgggcgttggttttgttccggtacgtaaaccgcgcaaattaccgcgtgaaactattgccgagacctatgaattagagtacggcaccgatcagctggaaatccatgtcgacgcgattaaacctggcgacaacgtgctggtcgtggacgatctgctggcgactggcggcaccattgaggcgaccgtgaagctgatccgtcgtctgggcgggaaagtcaccgatgcggcgttcatcatcaatttgttcgatctgggcggcgagcagcgtctggaaaagcaggggattacctgttatagcctggtgccgtttccagggcattga

SEQ ID NO: 11485 - protein, 183 aa, Salmonella paratyphi
MTATAQQLEFLKNSIKSIQDYPKPGILFRDVTSLLEDPKAYALSIELLVERYKNAGITKVVGTEARGFLFGAPVALGLGVGFVPVRKPRKLPRETIAETYELEYGTDQLEIHVDAIKPGDNVLVVDDLLATGGTIEATVKLIRRLGGKVTDAAFIINLFDLGGEQRLEKQGITCYSLVPFPGH

SEQ ID NO: 11486 - DNA, 567 bp, Schizosaccharomyces pombe
  CDS (1)..(567)
atgtccgacgatagaatcaattaccttaagaataaacttgttcaatatccagattttcccaaaaagggaatcttgtttgaagatataatgcccatttttcaagatcccagagcctttggcatccttatcgatcttttgcttgaagccgttgaaactgaattcaataacattgatgtgattgttggtttggaggcgcgtggatttctttttggacctacgttggctttacgtgcaaattgtgcatttgtccctgtccgtaagcccaacaagcttcccggtgatttggtcgtcgtaagctacaataaggaatattctactgattcttttgcaatccaaaagggtactattaaacccggtcaaagagtcttaatagttgacgacattcttgctactggtggcaccgccttggctgctgatgaactcgttactcgtttgggtggtgaattagttggacatctcttccttttagaacttacatttcttcaaggacgtaagcgtcttatggctcctacttatacacttcttactggacaggatgaagcacctgatggtagtgaatttgcttaa

SEQ ID NO: 11487 - protein, 188 aa, Schizosaccharomyces pombe
MSDDRINYLKNKLVQYPDFPKKGILFEDIMPIFQDPRAFGILIDLLLEAVETEFNNIDVIVGLEARGFLFGPTLALRANCAFVPVRKPNKLPGDLVVVSYNKEYSTDSFAIQKGTIKPGQRVLIVDDILATGGTALAADELVTRLGGELVGHLFLLELTFLQGRKRLMAPTYTLLTGQDEAPDGSEFA

SEQ ID NO: 11488 - DNA, 546 bp, Shewanella oneidensis
  CDS (1)..(546): transl_table=11
atgaatacagaaaccttatccttgataaagcaaagcattaaaacaattcctaattatcctaaggaagggattctatttcgcgatgtgactagcttgctggaaaacgctaccgcttacaaagcgactatcgatttattggttgagcattatcgtagtaaaggctttaccaaaattgtgggcaccgaagcccgtggttttctgtttggtgcgcctttagcgctggggttaggcattggttttgtgcctgtacgtaagccgggtaaattgccgcgtgctactatcagccaaagctatgagctggagtatggtcacgatagccttgaaatccatactgatgcgattaccgcgaacgataaagtattagtggttgatgatttactggcgactggtggtactatcgaagcgacggttaaacttatccgccaattgggtggtgaagtgcaagatgccgcttttgtgatttcgttacctgatttaggcggcgaggcgcgtttaaccgccttaggtcttgagttggttaaactttgtgagtttgaaggcgaataa

SEQ ID NO: 11489 - protein, 181 aa, Shewanella oneidensis
MNTETLSLIKQSIKTIPNYPKEGILFRDVTSLLENATAYKATIDLLVEHYRSKGFTKIVGTEARGFLFGAPLALGLGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 11490 - DNA, 552 bp, Shigella flexneri
  CDS (1)..(552): transl_table=11
atgaccgcgactgcacagcagcttgagtatctcaaaaatagcatcaaaagcattcaggactacccaaaacccggcattcttttccgcgatgtcaccagcttactggaagacccgaaagcttacgctctcagcatcgacttgctggttgagcgttacaaaaatgcgggcattaccaaagttgtcggcaccgaagcgcgtggcttcttgtttggcgctccggtagctctgggtctgggcgttggctttgtaccggtccgtaaaccgggcaaactgccgcgtgaaaccatcagtgaaaattacgacctggaatacggcaccgatcagctggaaatccacgttgatgccatcaaaccgggcgacaaagttctggtggtggacgatctgctggcaaccggcggcactatcgaagcgaccgttaaactgatccgtcgtctgggtggtgaagtggctgacgctgcgttcattatcaacctgtttgatctcggcggcgaacagcgtctcgaaaaacagggcattaccagctacagccttgtcccgttcccgggccattaa

SEQ ID NO: 11491 - protein, 183 aa, Shigella flexneri
MTATAQQLEYLKNSIKSIQDYPKPGILFRDVTSLLEDPKAYALSIDLLVERYKNAGITKVVGTEARGFLFGAPVALGLGVGFVPVRKPGKLPRETISENYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 11492 - DNA, 540 bp, Silicibacter pomeroyi
  CDS (1)..(540): transl_table=11
atgtccagaacgaaatcggttcaggattacatccgcaccatcgtcgatttcccgcatgagggaatcctgtttcgggacgtcaccacgctgtttgccgatccacgcggctttcgcatcgcgatcgaccagatgctgcacccctatgccggagagcgcatcgacaaggtggtggggctcgaggcgcgcggtttcattctgggcggcgccatcgcccatcagctgagcgttggtttcgtgccgatccgcaagaagggcaagctgcccggcaccacgatcagccaggattacaagctggaatatggcgaggcgattgtcgaaatccatgatgacgcaattcagcctggagagaagatcctgctggtcgacgacctattggcgaccggcggaactgcggcggccggtatcaagctggtcgaacggctgggcggcgagatcgtctcttgtgccttcatcatcgacctgcccgaccttggcggccgcaaggtgctggaatccatgggcatggatgtgcacgcgctttgtgcctttgacggtctctga

SEQ ID NO: 11493 - protein, 179 aa, Silicibacter pomeroyi
MSRTKSVQDYIRTIVDFPHEGILFRDVTTLFADPRGFRIAIDQMLHPYAGERIDKVVGLEARGFILGGAIAHQLSVGFVPIRKKGKLPGTTISQDYKLEYGEAIVEIHDDAIQPGEKILLVDDLLATGGTAAAGIKLVERLGGEIVSCAFIIDLPDLGGRKVLESMGMDVHALCAFDGL

SEQ ID NO: 11494 - DNA, 519 bp, Staphylococcus epidermidis
  CDS (1)..(519): transl_table=11
atggatttaaaacaatatgtttcagaagtaaaagattggccttcagcaggtgtaagctttaaggatataacaactataatggataatggtgaagcttatggatatgctacggatcaaattgttgaatacgcaaaggaaaaaaatatagatatagtagttggtcctgaagccagaggattcataatagggtgtccagttgcttactcaatgggtattggatttgctccagtacgtaaagaaggaaaactacctcgagaagttattcgttatgaatataatttagaatatggaactaacgtattaactatgcataaagacgcgattaaaccaggacaacgagttttaatcactgatgatttactagctacaggtggaactattgaagctgcaataaagcttgttgaacaattaggtggtatagttgtaggtattgcttttattattgaacttaaatatttgaatggaattgataaaataaaagattatgatgtgatgagtttgatttcatatgatgaataa

SEQ ID NO: 11495 - protein, 172 aa, Staphylococcus epidermidis
MDLKQYVSEVKDWPSAGVSFKDITTIMDNGEAYGYATDQIVEYAKEKNIDIVVGPEARGFIIGCPVAYSMGIGFAPVRKEGKLPREVIRYEYNLEYGTNVLTMHKDAIKPGQRVLITDDLLATGGTIEAAIKLVEQLGGIVVGIAFIIELKYLNGIDKIKDYDVMSLISYDE

SEQ ID NO: 11496 - DNA, 549 bp, Streptomyces avermitilis
  CDS (1)..(549): transl_table=11
atgaccgagctcgtcaacatcacggagctgctgctcagccgtatccgtgacgttcgtgactacccggagccgggcgtggtgttcaaggacatcacgccgctgctggccgacccggcggcgttcaccgcgctgaccggtgcgctggccgagctcaccgtgcggcacggcgccacgaagatcgtcggcctggaggcccgcggcttcattctgggcgccccggccgccgttcaggcgggtgtcggcttcatccccgtacgcaaggcgggcaagctccccggagcgaccctcagccagtcgtacgacctggagtacggctccgccgagatcgaggtgcacgccgaggacctggtcgcgggcgaccgcgtcatggtcgtcgacgacgtcctcgccaccggcggcaccgccgaggcctcgctccagctcatccgccgggcgggcgccgaggtcgcgggcgtctccgtgctcatggagctgggcttcctgggcggccgggcacggctggagccggccctggccggcgccccgctggaagcactgctccagatctga

SEQ ID NO: 11497 - protein, 182 aa, Streptomyces avermitilis
MTELVNITELLLSRIRDVRDYPEPGVVFKDITPLLADPAAFTALTGALAELTVRHGATKIVGLEARGFILGAPAAVQAGVGFIPVRKAGKLPGATLSQSYDLEYGSAEIEVHAEDLVAGDRVMVVDDVLATGGTAEASLQLIRRAGAEVAGVSVLMELGFLGGRARLEPALAGAPLEALLQI

SEQ ID NO: 11498 - DNA, 537 bp, Streptomyces clavuligerus
  CDS (1)..(537): transl_table=11
atgaccgggggagcacaggagctgctgctcagccgcatccgggacgttccggactatccgcagccgggtgtggtgttcaaggacatcaccccgctgctcgcggaccccgaggcgttctcggtgctgaccgaggcgctcgccgaggtgtgtgtgcgccacggcgccaccaaggtcgtcggtctggaggcccggggcttcatcctgggcgccccggtcgccgtccgcgcgggcctcggcttcatcccgatccgcaaggcgggcaagctccccggggcgaccctctcccaggcgtacgcgctggagtacggcaccgccgagatcgaggtgcacgccgaggacctgaccccggacgaccgggtcatggtcatcgacgacgtcctggccaccggtggcaccgccgccgcggcgatggagctgatccgccggggcggcgccgatgtcgccggactcgcggtcctgatggagctgggcttcctcggcgggcgggcccggctggagcccactctcgcggcgctggaggccctgctcgcgctctaa

SEQ ID NO: 11499 - protein, 178 aa, Streptomyces clavuligerus
MTGGAQELLLSRIRDVPDYPQPGVVFKDITPLLADPEAFSVLTEALAEVCVRHGATKVVGLEARGFILGAPVAVRAGLGFIPIRKAGKLPGATLSQAYALEYGTAEIEVHAEDLTPDDRVMVIDDVLATGGTAAAAMELIRRGGADVAGLAVLMELGFLGGRARLEPTLAALEALLAL

SEQ ID NO: 11500 - DNA, 549 bp, Streptomyces coelicolor
  CDS (1)..(549): transl_table=11
atgaccgagccgaccggcatcacggagctgctgctcagccgcatccgtgacgtggccgactacccggagccgggcgtggtgttcaaggacatcaccccgctcctggcggacccgggggcgttcgccgccctgaccgacgcgctcgccgaggccgccgggcgcaccggcgccaccaaggtcgtcggcctggaggcccgcggcttcatcctcggcgccccggtggccctgagggcgggtctcggcttcatccccgtgcgcaaggcgggcaagctccccggagccacgctcagccaggcgtacgacctggagtacggctccgccgagatcgaggtgcacgccgaggacctcaccgcgggcgaccgcgtgctggtcgtcgacgacgtcctcgccaccggcggcaccgccgaggcctcgctggagctgatccgccgggccggtgccgaggtcgcgggcctcgccgtgctgatggagctgggcttcctcggcgggcgggcccggctggagccggcgctggccggggcaccgctggaggcactgctcacggtctga

SEQ ID NO: 11501 - protein, 182 aa, Streptomyces coelicolor
MTEPTGITELLLSRIRDVADYPEPGVVFKDITPLLADPGAFAALTDALAEAAGRTGATKVVGLEARGFILGAPVALRAGLGFIPVRKAGKLPGATLSQAYDLEYGSAEIEVHAEDLTAGDRVLVVDDVLATGGTAEASLELIRRAGAEVAGLAVLMELGFLGGRARLEPALAGAPLEALLTV

SEQ ID NO: 11502 - DNA, 549 bp, Streptomyces galbus
  CDS (1)..(549): transl_table=11
atgaccgagctcgccaacatccctgagctgctggccagccgtatccgcgacgtggccgactacccggagccgggcgtgatgttcaaggacatcaccccgctcctggccgacccggtggccttcaccgcgctcaccgacacgctcgccgcaggccgccgccggcacccgcgcaccaaggtcgtcggactggaggcccggggcttcatcctcggcgccccggtcgccgtccgcgccgggctgggcttcatcccggtccgcaaggcgggcaagctgcccggagccaccctgagccaggcgtacgacctggagtacggctcggcggagatcgaggtgcacgccgaggacctggccgcgggcgaccgtgtcctgatcgtggacgacgtcctggccaccggcgggaccgccgaggccgcgatccagctcatccggcgcgcgggcgccgaggtctgcggcctcgcggtcctgatggagctgggcttcctgggcggccgggcccgcctggagccgatcctggacggggctccgctggaggccctcctccaggtctga

SEQ ID NO: 11503 - protein, 182 aa, Streptomyces galbus
MTELANIPELLASRIRDVADYPEPGVMFKDITPLLADPVAFTALTDTLAAGRRRHPRTKVVGLEARGFILGAPVAVRAGLGFIPVRKAGKLPGATLSQAYDLEYGSAEIEVHAEDLAAGDRVLIVDDVLATGGTAEAAIQLIRRAGAEVCGLAVLMELGFLGGRARLEPILDGAPLEALLQV

SEQ ID NO: 11504 - DNA, 519 bp, Streptococcus mutans
  CDS (1)..(519): transl_table=11
atggatttaaaaaattacattgcaacaattgaggattatccacaagaaggcgtcacttttcgtgatatcagtcctttgatggctaacggcaatgcttatagctatgctattcgtgagattgtccaatatgcgacagataaaaaaattgacatgattgttggacctgaagcgcgtggttttattgttggctgtccggtcgcctatgaattgggtgttggctttgctcctgtccgcaaaccggggaaactgccgcgtgaagttattgaagctcattatgaaaaagaatatggtattgataccttaaccatgcatgcagatgccattaagcccggtcaaagggttcttattgttgacgatcttttagcaactggtggcacagttaaggcaaccattgaaatgattgaaaggttaggcggtattgttgcaggctgtgctttcttaatcgagttagatgggctcgatggacgtcaggctattgaaggttatgatactaaagttttgatgaatttccctggctaa

SEQ ID NO: 11505 - protein, 172 aa, Streptococcus mutans
MDLKNYIATIEDYPQEGVTFRDISPLMANGNAYSYAIREIVQYATDKKIDMIVGPEARGFIVGCPVAYELGVGFAPVRKPGKLPREVIEAHYEKEYGIDTLTMHADAIKPGQRVLIVDDLLATGGTVKATIEMIERLGGIVAGCAFLIELDGLDGRQAIEGYDTKVLMNFPG

SEQ ID NO: 11506 - DNA, 513 bp, Symbiobacterium thermophilum
  CDS (1)..(513): transl_table=11
atggatttcaagtcgaagatccgcaccgtagacgatttccccaagcccgggatctcgttcaaggatatcacgaccctgctgaaggacggcgaggcgttccacgccgcgatcgagaccatggccgcgcacttcgagccgctgggcatcaacatggtgacgggcccagaggctcgtggctatatctttgcgtccgccctggctttccggctgcgggccggcttcgtgcccatccgcaagccgggcaagctgccgtggaagacccgcagcatctcgtatcaactggagtacggcgaggataggctggaggtacacgaggacgccttccaacccggacagaaggtgctcgtggtcgacgacctgctcgctacgggcggcacgattcgggccaccattgacctggtggagtcgctgggcgccaaggtggtcggtgtcgccgtgctgatcgagctctcggacctcggcggcaggaagcggttggaaggccacgatgtgatttcgctggtccagttctga

SEQ ID NO: 11507 - protein, 170 aa, Symbiobacterium thermophilum
MDFKSKIRTVDDFPKPGISFKDITTLLKDGEAFHAAIETMAAHFEPLGINMVTGPEARGYIFASALAFRLRAGFVPIRKPGKLPWKTRSISYQLEYGEDRLEVHEDAFQPGQKVLVVDDLLATGGTIRATIDLVESLGAKVVGVAVLIELSDLGGRKRLEGHDVISLVQF

SEQ ID NO: 11508 - DNA, 522 bp, Thermoanaerobacter tengcongensis
  CDS (1)..(522): transl_table=11
atgacgcttgacgacataaaggaaatgattagagagataccagattttcctaaaaaaggaataagatttaaagatataactcctgttttaaaagacgccaaagcttttaactattctatagagatgcttgctaaagcgttagaggggaggaaatttgaccttatcgcagctccagaggcgagaggattcttgtttggagcacctcttgcttttcgcttaggagtgggatttgttccggtgagaaaacccgggaagttacctgctgaaaccttaagctacgaatatgaactagagtacggcctggattctcttgagatacacaaagatgcggtagttaaggggcagagagttgtgatagtggatgaccttctggctacagggggaactgtttacgcttcagccaagcttgtagaaagcttgggaggagtagtggattctattttgtttttgacggaactgacatttctagatggtagaaaaaagcttgacggatatgatataatttcattaataaagttctaa

SEQ ID NO: 11509 - protein, 173 aa, Thermoanaerobacter tengcongensis
MTLDDIKEMIREIPDFPKKGIRFKDITPVLKDAKAFNYSIEMLAKALEGRKFDLIAAPEARGFLFGAPLAFRLGVGFVPVRKPGKLPAETLSYEYELEYGLDSLEIHKDAVVKGQRVVIVDDLLATGGTVYASAKLVESLGGVVDSILFLTELTFLDGRKKLDGYDIISLIKF

SEQ ID NO: 11510 - DNA, 522 bp, Ureaplasma parvum
  CDS (1)..(522): transl_table=4
atgatcaatattgattacattaaatcaaaaatcagggatgtaccagacttccctaaaaaaggaatcgtttttaaggatattactcctttatttttagaaccaaaaattattgaaaagattgttgatgattttgctgactttgctaaatcattaaatatagatgctataataggtgcggagtcgcgtggttttttgtttgcagcaccattatcaatcaaattaaataagccatttattttggtacgtaaaccaaataagttaccaaatgatgtttatagtgctgagtacacattagaatatggtagttctcgtgtggagatgcacaaagatgcactaaaaccaaaccaacgcgttttaattgttgatgatttattagcaacaggagggactgttgctgcgattgaaaatcttgttcgtcaagctaaaggaattgtagcagggagtgtttatttaattcgtttaggatttctaaaaggtgaagaaaaactaagtggaaaagttcatgctttaattaattattaa

SEQ ID NO: 11511 - protein, 173 aa, Ureaplasma parvum
MINIDYIKSKIRDVPDFPKKGIVFKDITPLFLEPKIIEKIVDDFADFAKSLNIDAIIGAESRGFLFAAPLSIKLNKPFILVRKPNKLPNDVYSAEYTLEYGSSRVEMHKDALKPNQRVLIVDDLLATGGTVAAIENLVRQAKGIVAGSVYLIRLGFLKGEEKLSGKVHALINY

SEQ ID NO: 11512 - DNA, 546 bp, Vibrio cholerae
  CDS (1)..(546): transl_table=11
atgacaactgaaactctttcactgatcaaatccagcatcaaaagtattcctgactacccgaaaaaaggcattctgtttcgtgatgtgaccagcttgctggaagatgcccaagcctaccaagcgaccattcaacttctggttgaaaagtacaaagacatgggttttaccaaggttgtgggcacagaagcgcgtggtttcttatttggtgctcctctagcactagaactgggtgtcggctttgtgcctgtgcgtaagccgggtaaattgccgcgtcaaaccgtcgctcaatcttatgagctggaatacggtactgatacgctggaaattcatgtggatgcgatcaaaccgggtgacaaagtactggtggtggatgacctgctggcgaccggtggtacgattgaagcgaccactaagcttatccgtcaattgggtggagaagtcgagcacgctgccttcgtgattaacttgccagaaattggtggtgataagcgccttgaagggttaggcttgcaggtttacagcatctgtgaatttgaaggtcactaa

SEQ ID NO: 11513 - protein, 181 aa, Vibrio cholerae
MTTETLSLIKSSIKSIPDYPKKGILFRDVTSLLEDAQAYQATIQLLVEKYKDMGFTKVVGTEARGFLFGAPLALELGVGFVPVRKPGKLPRQTVAQSYELEYGTDTLEIHVDAIKPGDKVLVVDDLLATGGTIEATTKLIRQLGGEVEHAAFVINLPEIGGDKRLEGLGLQVYSICEFEGH

SEQ ID NO: 11514 - DNA, 546 bp, Vibrio parahaemolyticus
  CDS (1)..(546): transl_table=11
atgactacagaaacaatttcgctgatcaaatctagcatcaaaagcatccaagattacccaaaaccaggcattcttttccgcgacgtaacaagcctattagaagacgcaaaagcgtatcaagcaaccatcggtctgctggttgaacgctacaaagacatgggctttacaaaggttgtgggtacagaagcacgtggtttcctatttggtgcgccactagcgcttgagctaggtgttggttttgttccagtgcgtaagccaggcaaactacctcgcccgaccattgctcaatcttatgaactagaatacggcattgatacgctagaaattcacacagacgctatcgtagaaggcgataaagtattggttgtggatgacttgctggcgacaggtggcacgattgaggcaacgacaaagttaattcgccaacttggtggtgaagttgaacacgcagcgttcgttatcaacctaccagaaatcggtggtgataagcgtttagaagcattaggcctaaacgtattcagcatttgcgattttgaaggacattaa

SEQ ID NO: 11515 - protein, 181 aa, Vibrio parahaemolyticus
MTTETISLIKSSIKSIQDYPKPGILFRDVTSLLEDAKAYQATIGLLVERYKDMGFTKVVGTEARGFLFGAPLALELGVGFVPVRKPGKLPRPTIAQSYELEYGIDTLEIHTDAIVEGDKVLVVDDLLATGGTIEATTKLIRQLGGEVEHAAFVINLPEIGGDKRLEALGLNVFSICDFEGH

SEQ ID NO: 11516 - DNA, 546 bp, Vibrio vulnificus
  CDS (1)..(546): transl_table=11
atgactacaaacaccattgcacagatccaagccagtattaaaagcatcccagattacccgaaaccaggtatcctgtttcgcgatgtgaccagccttctagaagacgctcaggcgtaccaggcaaccatccaattgttggttgataagtacaaagacatggggttcaccaaagtggtgggtactgaagcgcgtggtttcctatttggtgcaccgcttgcgttgcaattaggtgtgggctttgtacctgtacgtaagccgggtaaactgcctcgcaacaccatcgcacaatcatacgaacttgagtacggtgttgatacactggaaatccatacggatgcgattgttgaaggtgacaaagttttagtggttgatgacttgcttgcgacaggcggcaccattgaagcgacaaccaaactgattcgtcagcttggcggtgtggttgagcatgcagcgtttgttatcaatctacctgaaattggtggcgacaagcgtttggaaggtcttggccttaacgtttacagcatctgtgaattcgaaggacactaa

SEQ ID NO: 11517 - protein, 181 aa, Vibrio vulnificus
MTTNTIAQIQASIKSIPDYPKPGILFRDVTSLLEDAQAYQATIQLLVDKYKDMGFTKVVGTEARGFLFGAPLALQLGVGFVPVRKPGKLPRNTIAQSYELEYGVDTLEIHTDAIVEGDKVLVVDDLLATGGTIEATTKLIRQLGGVVEHAAFVINLPEIGGDKRLEGLGLNVYSICEFEGH

SEQ ID NO: 11518 - DNA, 549 bp, Wolinella succinogenes
  CDS (1)..(549): transl_table=11
atgtccgtcctcgatgagaatcaaaagcagtttttgcttgactctatccgtaacattcctgactttcccaagcccggaatccaattcaaagatatcaccaccctcctcaatgatcccaaggcgtttggctttttgatcgattttttaaccgatcgttacgcccgttttgagcttgattacgtcgcgggtatcgaatcgcgcgggttcatctttggcgccgctcttgccgccaagctcgaagtcggcttcgtccctattcggaaaaaagggaagctcccctccaccactatcgccgagaaatactcgctggagtacggctttgatgaggtggagattcatatcgatgcttttagagaaaaagagggaagccgagtcctcctcatcgatgatctcatcgctacaggcgggacggctgaggcggcagtgaagctgatccaatccgccaaaggtcactgtgtggaggcttgcttcctcctgaatttagaagagctgggaggggccaaaaaggtctccaatctcgctccactctacactctattggatatttga

SEQ ID NO: 11519 - protein, 182 aa, Wolinella succinogenes
MSVLDENQKQFLLDSIRNIPDFPKPGIQFKDITTLLNDPKAFGFLIDFLTDRYARFELDYVAGIESRGFIFGAALAAKLEVGFVPIRKKGKLPSTTIAEKYSLEYGFDEVEIHIDAFREKEGSRVLLIDDLIATGGTAEAAVKLIQSAKGHCVEACFLLNLEELGGAKKVSNLAPLYTLLDI

SEQ ID NO: 11520 - DNA, 549 bp, Yarrowia lipolytica
  CDS (1)..(549)
atgtctctccagaccctccagaccgagctcaaggccaagctgcgccagtaccaggatttcccctccaagggcattgtgttcgaggacatcctgcctatttttcaggaccccaagtctttccagcagttgatcgacgccttcaagctgcacatcaaggacacgtttggcgacaagaaaatcgacgtcattgtgggcttggacgcccgaggctttctgtttggccccaccttggccctggccattggcgctgcgtttgtgccggttcgaaagcagggaaagctgcccggcaagaccgtccatgccgagttccagaaggagtacggcaaggacgtgtttgagatccaggaggatgccatcaagcccggccagaccgttattgtcgtcgacgatatcattgccactggaggctctgctgcctgcgctggagatctggtaaccaagctcaagggcgaggtactggagttcatctttattctcgagctgctcttcctcaagggcagagataagctgtgtgctcctgcctacactcttcttagtggtcaggagtag

SEQ ID NO: 11521 - protein, 182 aa, Yarrowia lipolytica
MSLQTLQTELKAKLRQYQDFPSKGIVFEDILPIFQDPKSFQQLIDAFKLHIKDTFGDKKIDVIVGLDARGFLFGPTLALAIGAAFVPVRKQGKLPGKTVHAEFQKEYGKDVFEIQEDAIKPGQTVIVVDDIIATGGSAACAGDLVTKLKGEVLEFIFILELLFLKGRDKLCAPAYTLLSGQE

SEQ ID NO: 11522 - DNA, 564 bp, Yersinia pestis
  CDS (1)..(564): transl_table=11
atgaccgtttctgcatctaagacagcacaacagcttaaatatataaaagacagtatcaaaactattcccgattatccaaaagcgggaatattgttccgtgatgtgaccagcttgctggagaatccaaaggcctattccgccagcatcaaactgctgtctgaacactatagtgagtccggtgtgacaaaagtcgtgggtactgaagctcgcggttttttgtttggtgccccggtggcactggcgctgggggtaggttttgttccggtgcgtaaaccgggaaaattgccacgtgaaacgatcagtgaaagctatgaattagaatacggcactgacacattagagatccatacggatagcatccaaccgggtgataaagtcttggttgttgatgatctattggcgactggcggcaccattgaagccacggttaagcttattcgccgcttggggggggaagtggttcacgcggcatttattattaatttacctgaactggggggcgaggctcgcctgactcagcaagggattcattgctacagcctcgtttctttcgacggtcattga

SEQ ID NO: 11523 - protein, 187 aa, Yersinia pestis
MTVSASKTAQQLKYIKDSIKTIPDYPKAGILFRDVTSLLENPKAYSASIKLLSEHYSESGVTKVVGTEARGFLFGAPVALALGVGFVPVRKPGKLPRETISESYELEYGTDTLEIHTDSIQPGDKVLVVDDLLATGGTIEATVKLIRRLGGEVVHAAFIINLPELGGEARLTQQGIHCYSLVSFDGH

SEQ ID NO: 11524 - DNA, 564 bp, Yersinia pseudotuberculosis
  CDS (1)..(564): transl_table=11
atgaccgtttctgcatctaagacagcacaacagcttaaatatataaaagacagtatcaaaactatccccgattatccaaaagcgggaatattgttccgtgatgtgaccagcttgctggagaatccaaaggcctattccgccagcatcgaactgctgtctgaacactatagtgagtccggtgtgacaaaagtcgtgggtactgaagctcgcggttttttgtttggtgccccggtggcactggcgctgggggtaggttttgttccggtgcgtaaaccgggaaaattgccacgtgaaacgatcagtgaaagctatgaattagaatacggcactgacactttagagatccatacggatagcatccaaccgggtgataaagtcttggttgttgatgatctattggcgactggcggcaccattgaagccacggttaagcttattcgccgcttggggggggaagtggttcacgcggcatttattattaatttacctgaactggggggcgaggctcgcctgactcagcaagggattcattgctacagcctcgtttctttcgacggtcattga

SEQ ID NO: 11525 - protein, 187 aa, Yersinia pseudotuberculosis
MTVSASKTAQQLKYIKDSIKTIPDYPKAGILFRDVTSLLENPKAYSASIELLSEHYSESGVTKVVGTEARGFLFGAPVALALGVGFVPVRKPGKLPRETISESYELEYGTDTLEIHTDSIQPGDKVLVVDDLLATGGTIEATVKLIRRLGGEVVHAAFIINLPELGGEARLTQQGIHCYSLVSFDGH

SEQ ID NO: 11526 - DNA, 552 bp, Brassica napus
  CDS (1)..(552)
atgtcgggaaacaagcaagaagaggatcctcgtatcaacggaatcaaaactaagatccgtgtcgttccagattttcccaagaaaggaataatgtttcaagacataacaacagtgttgttggatccgaaagccttcaaagatacaattgatctgtttgttgagagatacagagacaagaacatctcagtggttgcaggaatagaggctcgtgggttcctgttcggtccaccaatagcgttagccatcggagcaaagttcgttcctctccgtaaacccaagaaattgccaggtgaaacgatatttgaagaatacgagttggagtacgggaatgaccggctagagatgcacgtaggagccgttgaggctggagaccgagctttggtagttgatgatctaattgcgaccggtggtactctctgtgctgccattaacttgctcgagagggttggggcagaagttgtggaatgtgcatgcgtgatcgagttacccgaattaaagggaaggcagagactcaaggggaagccactatgcatgcttgtggagtacagatga

SEQ ID NO: 11527 - protein, 183 aa, Brassica napus
MSGNKQEEDPRINGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHVGAVEAGDRALVVDDLIATGGTLCAAINLLERVGAEVVECACVIELPELKGRQRLKGKPLCMLVEYR

SEQ ID NO: 11528 - DNA, 585 bp, Glycine max
  CDS (1)..(585)
atgtttgtcctagaaaatggtgcgaagaagaagggggaagacccaaggcttcaagcaatctcccaagccatcagagtggtgcctcacttccccaaacaaggaataatgtttcaagacataacaacattgctgttggatcacagcgcgtttaaagacgtggttgacatttttgttgatcgttacagagacatggatatttctgttgttgccggagttgaagccaggggattcatttttggttcctcaattgcgttaggcattggtgccaagtttgttcctttatgcaaacctggaaagctaccaggtgaagtaatttcagaaaaatatgttctagaatatggaactgattgcttggagatgcatgttggcgctgtccaacacaatgaacgggtcataattatcgatgatttggtggctacaggtggaactctgtcagcagcaattatacttctagaacgtgctgatgctgaagtagtggagtgtgcttgtgtgattggtctctctgatctcaaggtacgcagcaaacttaatggaaagccactttatatccttgtggagccacgtcaagtagaaaatggtttttga

SEQ ID NO: 11529 - protein, 194 aa, Glycine max
MFVLENGAKKKGEDPRLQAISQAIRVVPHFPKQGIMFQDITTLLLDHSAFKDVVDIFVDRYRDMDISVVAGVEARGFIFGSSIALGIGAKFVPLCKPGKLPGEVISEKYVLEYGTDCLEMHVGAVQHNERVIIIDDLVATGGTLSAAIILLERADAEVVECACVIGLSDLKVRSKLNGKPLYILVEPRQVENGF

SEQ ID NO: 11530 - DNA, 528 bp, Glycine max
  CDS (1)..(528)
atgtcggcttacaaagaccaggatccccgtcttcatggcatcaaaactaagattcgtgtcgtccccaatttccccaaatccggtcttatgttcctagacattactactctattgcttgatcccaaagcatttaaggactcaatagatttgttcgtggagcggtacaagggcaaaaacatttctgttgttgcaggaattgaagctcgaggttttatttttggtccccccattgcgctggctataggagcaaagtttgtaccattgaggaaaccaaagaagttgcctggaaaagttatttctcaagaatatattctggaatatggaagggactgtcttgagatgcatgttggagctgttgatgatttgattgcaactggcggaacactctgtgccgctatggacttgttagaacgtgtgggagcagaagtagtggagtgtgcatgtgtaattgaattaccagaattgaagggtcgtgaacgtttgaacgggaagcccttgtgcgtgttggtggaatatgtggatatatga

SEQ ID NO: 11531 - protein, 175 aa, Glycine max
MSAYKDQDPRLHGIKTKIRVVPNFPKSGLMFLDITTLLLDPKAFKDSIDLFVERYKGKNISVVAGIEARGFIFGPPIALAIGAKFVPLRKPKKLPGKVISQEYILEYGRDCLEMHVGAVDDLIATGGTLCAAMDLLERVGAEVVECACVIELPELKGRERLNGKPLCVLVEYVDI

SEQ ID NO: 11532 - DNA, 561 bp, Glycine max
  CDS (1)..(561)
atgtcgacttacagagacgaggatccccgtcttcatgacatcaaaactaagattcgtgttgtccctaatttccccaaacctggtattatgttccaagacattactactctgttgcttgatcccagggtctttaaggacacgatagatttgttcgttgagcgatacaaaggcaaaaacatttctgttgttgcaggaattgaagctcggggtttcatttttggttctcccattgcactggcaataggagcaaagtttgtaccattgaggaaaccgaaaaaattgcctggcaaagttatttctcaagagtatattctggaatatggaagagactgtcttgagatgcatgttggagccgttgaacctggtgagcgtgctttagttgttgatgatttgattgcaactggaggaacactctgtgcagctatggacttactagagcgagtgggagcagaggtagtggagtgcggatgtgtaattgaattgccagaattaaagggccgtgaacggttgaacgggaagcccttgcatgtgttagtggaatgttttgagtgctgtgaatag

SEQ ID NO: 11533 - protein, 186 aa, Glycine max
MSTYRDEDPRLHDIKTKIRVVPNFPKPGIMFQDITTLLLDPRVFKDTIDLFVERYKGKNISVVAGIEARGFIFGSPIALAIGAKFVPLRKPKKLPGKVISQEYILEYGRDCLEMHVGAVEPGERALVVDDLIATGGTLCAAMDLLERVGAEVVECGCVIELPELKGRERLNGKPLHVLVECFECCE

SEQ ID NO: 11534 - DNA, 711 bp, Glycine max
  CDS (1)..(711)
atgcgggttgtttgttgttccaattcaggcgtgagtgctttccctagttgtcttagattccctccactgatcgcaatttcaacaacaccctcttcgatccgctttctaaattctccacccctccgttccactgcttcgtcgcaacacgttacaataatggcttcgaagaattctcaacaagacacgcgcttagcgagaatcgcctctgcaatccgagtcatccccgactttcctaagccaggaattttgtttcaggacataaccacgctgcttcttgatacaaaggctttcaaagacaccattgacttgtttgttgagaggtacagagatcaaaacatcaatgttgtcgcaggagttgaagctagaggctttatatttggtccacccattgcattagctattggagcaaaatttgtccccatgaggaaacccaataaattgcctggggaggttatctcagaagagtattctttggagtatggaacagacaaaatggagatgcatgtaggggctgtacaacctggagaacgagccctaatcatagatgatcttattgccactgggggaacgttaggtgctgcaattaagcttctagaacgtgttggggtgcatgttgtggagtgtgcttgtgtgattgaattgccagagttaaaggggcgggaaaggttgggagacaagtcgctatttgtcttgattaatgggggagcctga

SEQ ID NO: 11535 - protein, 236 aa, Glycine max
MRVVCCSNSGVSAFPSCLRFPPLIAISTTPSSIRFLNSPPLRSTASSQHVTIMASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRERLGDKSLFVLINGGA

SEQ ID NO: 11536 - DNA, 555 bp, Glycine max
  CDS (1)..(555)
atggcttcgaagaattctcaacaagacacgcgcttagcgagaatcgcctctgcaatccgagtcatccccgactttcctaagccaggaattttgtttcaggacataaccacgctgcttcttgatacaaaggctttcaaagacaccattgacttgtttgttgagaggtacagagatcaaaacatcaatgttgtcgcaggagttgaagctagaggctttatatttggtccacccattgcattagctattggagcaaaatttgtccccatgaggaaacccaataaattgcctggggaggttatctcagaagagtattctttggagtatggaacagacaaaatggagatgcatgtaggggctgtacaacctggagaacgagccttaatcatagatgatcttattgccactgggggaacgttaggtgctgcaattaagcttctagaacgtgttggggtgcatgttgtggagtgtgcttgtgtgattgaattgccagagttaaaggggcgggaaaggttgggagacaagtcgctatttgtcttgattaatgggggagcctga

SEQ ID NO: 11537 - protein, 184 aa, Glycine max
MASKNSQQDTRLARIASAIRVIPDFPKPGILFQDITTLLLDTKAFKDTIDLFVERYRDQNINVVAGVEARGFIFGPPIALAIGAKFVPMRKPNKLPGEVISEEYSLEYGTDKMEMHVGAVQPGERALIIDDLIATGGTLGAAIKLLERVGVHVVECACVIELPELKGRERLGDKSLFVLINGGA

SEQ ID NO: 11538 - DNA, 582 bp, Glycine max
  CDS (1)..(582)
atgttcgccgaagagaatggactcaagggagaccctagactccaagccatttcccaagccatcagagtcgtccctcacttccccatacatggaataatgtttcaagacataacgacattgttgttggatcacaaggcgtttaaagacactgtcgacatttttgtcgatcgttacagagacacgcacatttccgttgttgccggaattgaggctagggggttcatgtttggtccctcaattgcgttgggcattggtgcaaagtttgttcctttacgcaaaccacggaagctgccaggtgaagtaatttcagaaaaatatgctctagaatatggaactgattgcttggagttgcatgttggtgctgtccagcccggtgaacgggccataatcattgatgacttggtggccacaggtggaacaatgtcagcaggagtaaaacttctagaacgtgttggtgctgaagtggtggaatgtgcctgtgtcattggtgtgcctgatgtcaaggggcagtgcaggcgtattggaaagccactttatgttcttgttgagccgcgtaaagcagataaatgttacccagattga

SEQ ID NO: 11539 - protein, 193 aa, Glycine max
MFAEENGLKGDPRLQAISQAIRVVPHFPIHGIMFQDITTLLLDHKAFKDTVDIFVDRYRDTHISVVAGIEARGFMFGPSIALGIGAKFVPLRKPRKLPGEVISEKYALEYGTDCLELHVGAVQPGERAIIIDDLVATGGTMSAGVKLLERVGAEVVECACVIGVPDVKGQCRRIGKPLYVLVEPRKADKCYPD

SEQ ID NO: 11540 - DNA, 555 bp, Glycine max
  CDS (1)..(555)
atgtcggcttacaaagaccaggatacccgtcttcatggcatcaaaactaagattcgtgtcgtccccaatttccccaaatccggtattatgttccaagacattactactctattgcttgatcccaaagcatttaaggacacaatagatttgttcgttgagcggtacaagggcaaaaacatttctgttgttgcaggaattgaagctcgaggttttatttttggtcctcccattgcgctggctataggagcaaagtttgtaccattgaggaaaccaaagaagttgcctggaaaagttatttctcaagaatatattctggaatatggaagggactgtcttgagatgcatgttggagctgttgaacctggtgagcgtgctttagtggttgatgatttgattgcaacaggtggaacactctgtgcagctatggacttgttagaacgtgtgggagcagaagtggtggagtgtgcatgtgtaattgaattaccagaattgaagggtcgtgaacgtttgaacgggaagcccttgtacgtgttggttgaatatgtggagatatga

SEQ ID NO: 11541 - protein, 184 aa, Glycine max
MSAYKDQDTRLHGIKTKIRVVPNFPKSGIMFQDITTLLLDPKAFKDTIDLFVERYKGKNISVVAGIEARGFIFGPPIALAIGAKFVPLRKPKKLPGKVISQEYILEYGRDCLEMHVGAVEPGERALVVDDLIATGGTLCAAMDLLERVGAEVVECACVIELPELKGRERLNGKPLYVLVEYVEI

SEQ ID NO: 11542 - DNA, 582 bp, Glycine max
  CDS (1)..(582)
atgttcgccgaagagaatggactcaagggagaccctagactccaagccatttcccaagccatcagagtcgtccctcacttccccaaacatggaataatgtttcaagacataacgacattgttgttggatcacaaggcgtttaaagacactgtcgacatttttgtcgatcgttacagagacacgcacatttccgttgttgccggaattgaggctagggggttcatgtttggtccctcaattgcgttgggcattggtgcaaagtttgttcctttacgcaaaccacggaagctgccaggtgaagtaatttcagaaaaatatgctctagaatatggaactgattgcttggagttgcatgttggtgctgtccagcccggtgaacgggccataatcattgatgacttggtggccacaggtggaacaatgtcagcaggagtaaaacttctagaacgtgttggtgctgaagtggtggaatgtgcctgtgtcattggtgtgcctgatgtcaaggggcagtgcaggcgtattggaaagccactttatgttcttgttgagccgcgtaaagcagataaatgttacccagattga

SEQ ID NO: 11543 - protein, 193 aa, Glycine max
MFAEENGLKGDPRLQAISQAIRVVPHFPKHGIMFQDITTLLLDHKAFKDTVDIFVDRYRDTHISVVAGIEARGFMFGPSIALGIGAKFVPLRKPRKLPGEVISEKYALEYGTDCLELHVGAVQPGERAIIIDDLVATGGTMSAGVKLLERVGAEVVECACVIGVPDVKGQCRRIGKPLYVLVEPRKADKCYPD

SEQ ID NO: 11544 - DNA, 645 bp, Zea mays
  CDS (1)..(645)
atgggggagcaggagaacaacaagatcggcggcagcggcaacgacaacgccatggcggtggacgaagcgggcgcgggcgcggccgcgaacaaggggaagagcctcggcgccgcggacccgcgcctgcaggccatttccgacgccatccgcgtcgtcccccacttccccaagccagggatcatgttcaacgacatcacggagctgctgctgcggccgggcgtgttcagggacgccgtggacatgttcgtcgagcgctaccgcggcatgggcatcgcggccgccgcaggcattgaagctagaggattcatctttgggccagccattgcgctagccataggagcaaagttcataccactacgtaaacctaagaagcttccaggtgaggtattttctgaaagttatgtacttgagtatgggatggattgtttggagatgcatgttggagctattgaacccggggagcgcgtagtggttgtcgatgatttggttgcaactggtggaactctttctgctgcaataagacttctcgagcgcgcaggagctaacgtggttgagtgtgcatgcctcattgggcttcccaagtttaaggatttctataagctcaacgggaaaccggtttacatcctggtggagtcccgcaaatag

SEQ ID NO: 11545 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMGIAAAAGIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 11546 - DNA, 666 bp, Zea mays
  CDS (1)..(666)
atgggtgaagaggccagctgcaacgctgccagcgcgatggaggccgccaccaacgccaggccggccaaggagaacggacgcgcgccggctgtggcggaggtagtggcccaggaggcggccgctgacccccggctgcagggcatctccgacgccatccgcgtcgtgccgcacttccccaagcacggcatcatgttcaacgacatcaccacgctgctgctgcgccccagggtgttcaaggacgccgtcgacctgttcgtcgagcgctaccgcgggatgcgcatcgacgccgtcgccgggattgaggccaggggcttcatatttggcccggcagtcgcattggctattggcgccaagttcatacctttgcgcaagcctaggaagctccccggcgaggtgatctccgagaaatacgttctcgagtacgggaccgattgcttagagatgcatgtcggagccatcgaacggcctggtgagcgcgtgctgatcaccgacgacttggtcgcgaccggagggacgctctgtgctgcaatcaggcttcttgaacgtgctgaagctgatgtggtcgagtgcgcatgcctcattggcctcccaaaattcaaggatttctacaagttgaatggaaagcccgtctacgtgctggttgagtcccgtgaatcagataaataa

SEQ ID NO: 11547 - protein, 221 aa, Zea mays
MGEEASCNAASAMEAATNARPAKENGRAPAVAEVVAQEAAADPRLQGISDAIRVVPHFPKHGIMFNDITTLLLRPRVFKDAVDLFVERYRGMRIDAVAGIEARGFIFGPAVALAIGAKFIPLRKPRKLPGEVISEKYVLEYGTDCLEMHVGAIERPGERVLITDDLVATGGTLCAAIRLLERAEADVVECACLIGLPKFKDFYKLNGKPVYVLVESRESDK

SEQ ID NO: 11548 - DNA, 25 bp, Artificial sequence
  primer
atgtctatagcaagttatgcccaag

SEQ ID NO: 11549 - DNA, 26 bp, Artificial sequence
  primer
tcattttttcaacgcttccttttgag

SEQ ID NO: 11550 - protein, 174 aa, Artificial sequence
  consensus sequence
  Variant (2)..(3): Xaa in position 2 to 3 is any amino acid
  Variant (5)..(6): Xaa in position 5 to 6 is any amino acid
  Variant (8)..(8): Xaa in position 8 is any amino acid
  Variant (10)..(38): Xaa in position 10 to 38 is any amino acid
  Variant (39)..(68): Xaa in position 39 to 68 is any or no amino acid
  Variant (70)..(72): Xaa in position 70 to 72 is any amino acid
  Variant (76)..(77): Xaa in position 76 to 77 is any amino acid
  Variant (79)..(81): Xaa in position 79 to 81 is any amino acid
  Variant (83)..(88): Xaa in position 83 to 88 is any amino acid
  Variant (90)..(92): Xaa in position 90 to 92 is any amino acid
  Variant (95)..(95): Xaa in position 95 is any amino acid
  Variant (100)..(106): Xaa in position 100 to 106 is any amino acid
  Variant (108)..(108): Xaa in position 108 is any amino acid
  Variant (113)..(116): Xaa in position 113 to 116 is any amino acid
  Variant (117)..(117): Xaa in position 117 is any or no amino acid
  Variant (119)..(124): Xaa in position 119 to 124 is any amino acid
  Variant (125)..(132): Xaa in position 125 to 132 is any or no amino acid
  Variant (134)..(136): Xaa in position 134 to 136 is any amino acid
  Variant (139)..(140): Xaa in position 139 to 140 is any amino acid
  Variant (146)..(147): Xaa in position 146 to 147 is any amino acid
  Variant (149)..(151): Xaa in position 149 to 151 is any amino acid
  Variant (153)..(156): Xaa in position 153 to 156 is any amino acid
  Variant (158)..(168): Xaa in position 158 to 168 is any amino acid
  Variant (170)..(171): Xaa in position 170 to 171 is any amino acid
  Variant (173)..(173): Xaa in position 173 is any amino acid
PXXGXXFXDXXXXXXXXXXXXXXXXXXXXXXXXXXXXXXXXXXXXXXXXXXXXXXXXXXXXXXXXXXXGXXXRGFXXGXXXAXXXXXXFXXXRKXGKLPXXXXXXXYXLEYGXXXXXEXXXXXXXXXXXXXXVXXXDDXXATGGTXXAXXXLXXXXGXXXXXXXXXXXLXXLXG

SEQ ID NO: 11551 - protein, 41 aa, Artificial sequence
  protein pattern
  Variant (2)..(2): Xaa in position 2 is any amino acid
  Variant (3)..(3): Xaa in position 3 is Asp or Glu
  Variant (4)..(4): Xaa in position 4 is Ala or Ser
  Variant (8)..(13): Xaa in position 8 to 13 is any amino acid
  Variant (14)..(15): Xaa in position 14 to 15 is any or no amino acid
  Variant (17)..(24): Xaa in position 17 to 24 is any amino acid
  Variant (25)..(26): Xaa in position 25 to 26 is any or no amino acid
  Variant (29)..(30): Xaa in position 29 to 30 is any amino acid
  Variant (34)..(40): Xaa in position 34 to 40 is any amino acid
  Variant (41)..(41): Xaa in position 41 is Phe or Tyr
GXXXRGFXXXXXXXXAXXXXXXXXXXRKXXKLPXXXXXXXX

SEQ ID NO: 11552 - DNA, 1158 bp, Saccharomyces cerevisiae
  CDS (1)..(1158)
atgtcacaagaaacaaaaatgctaccttctctatctagtcttctatcgggaaccgaaatctcgtccagccccgtatcaccaagcttcactaatccaagaacgagttttcacctcgatgatcgcggaaccataaaattaccaccgctaaacaccagtatcaatcgtccaagatctgtggaaagcgccttgagacacactgttacatccttgcatgaaaatagcagcgcttatggtgatgacatgctcaagcacacgcaatcagactcagccctctcatctcagttgaatagttctcaagaaacagttgatgaatcacacgaaaaccttctactgactcccctaaatagcaaaaagagagattattcggtttcttcaaagaaaaacgacatattaacaccactctctgcagcgaagtcgattattatcccctctgcctctaaggaaaaaagacgtgcatttgctttcatcacacactcgcaggagaccttccctaagaaggagcctaagatcgacaacgctccactagcacgccgaaagagaagaagaacctcgtcccaggaactatctattcttcaggctgaatttgaaaaatgtcctgctccatcgaaggagaaacgaattgagttagctgaatcttgccatatgactgaaaaagccgttcaaatatggttccagaataaaagacaagcggttaaaaggcagagaatcgccacttcgaagtcaaccactataatacaaacggtatctccaccatctccgcctctggacgttcatgctacgccactagcatccagagtcaaggcggacatacttcgtgatggaagctcatgttctcgttcttcctcttcttcaccgctggaaaatacgccgccaaggcctcatcattccctaaataggcgctcatccacaccaagcataaagagaagccaggctttaacattccatctaaacccacaaaagaagacgttgactcccgtgaaaacgtctcccaacagcagagtaaataaattgatcaatagcatagatcattctccatccaaagccaagcgtccggtaagcaatccctccggctcccctaaaaggaagagaaaattcggattcaagatcgtcgatcaacaaccgttgaaggatcttgatccgaacgctttccgtggttga

SEQ ID NO: 11553 - protein, 385 aa, Saccharomyces cerevisiae
MSQETKMLPSLSSLLSGTEISSSPVSPSFTNPRTSFHLDDRGTIKLPPLNTSINRPRSVESALRHTVTSLHENSSAYGDDMLKHTQSDSALSSQLNSSQETVDESHENLLLTPLNSKKRDYSVSSKKNDILTPLSAAKSIIIPSASKEKRRAFAFITHSQETFPKKEPKIDNAPLARRKRRRTSSQELSILQAEFEKCPAPSKEKRIELAESCHMTEKAVQIWFQNKRQAVKRQRIATSKSTTIIQTVSPPSPPLDVHATPLASRVKADILRDGSSCSRSSSSSPLENTPPRPHHSLNRRSSTPSIKRSQALTFHLNPQKKTLTPVKTSPNSRVNKLINSIDHSPSKAKRPVSNPSGSPKRKRKFGFKIVDQQPLKDLDPNAFRG

SEQ ID NO: 11554 - DNA, 1038 bp, Candida glabrata CBS 138
  CDS (1)..(1038)
atgctgcccgccctcaacacagttatacacgaggagaagtccccattcttgacttctaacttccaatgcgacaaccagggagtcattaggctgcctccgatcctgtcgcagcacgtcgccaggccgaagtcggtggagagctgcgtgcgctacaccgccatcgcctccgctatgcacacaccacacgccaactaccttgccactcctgcgcctaagcccagactggtcactgtgcagcacaccgtacccagcacaccagcagctacgcctgtctccgctacgccgctcgctaccaagccaaagtccaagaagctggataacatactcacgcccatctcggcagtgaaggccgctatcagcaccccgtccagtgacgataagaagcgcgcatttgcgttcatcacacactcccaggagaccttccctacaaaggagcccaagattgacaacgcacagctggcccgcagaaagagaaggcgtacttcatcccaggagctcaatatcctgcaggcggagttccaaagatgcagcaccccggacaagcagaccaggatcaaccttgctcagcgttgtaacatgactgagaaagccgtccaggtgtggttccagaacaagagacaagccatgaagagacacaaggtcatcgctgacaacagatcaaggtccaacggctccacaacatcaactacgcccttggcatccagaacaccttccgaggatttcaacatctctacagacacttcctcttgcgatgactccgaaagcgtcccacaacttgcattgcctctctccacttcgtcgccaaagaaggcaccactgtcgccaagaccaaaatcccctacaaaaaagagaagccaggcacttactttccacctggatgcttctaacaagactttgactccagtgaagacctccccaaatagaagagtcaacagactgatcaataacgagaacttgacatctccttcaaagagcaagaaagttacaaaagtaaagaaagaacctttaaagtcactagacgttaacgtcaagcactaa

SEQ ID NO: 11555 - protein, 345 aa, Candida glabrata CBS 138
MLPALNTVIHEEKSPFLTSNFQCDNQGVIRLPPILSQHVARPKSVESCVRYTAIASAMHTPHANYLATPAPKPRLVTVQHTVPSTPAATPVSATPLATKPKSKKLDNILTPISAVKAAISTPSSDDKKRAFAFITHSQETFPTKEPKIDNAQLARRKRRRTSSQELNILQAEFQRCSTPDKQTRINLAQRCNMTEKAVQVWFQNKRQAMKRHKVIADNRSRSNGSTTSTTPLASRTPSEDFNISTDTSSCDDSESVPQLALPLSTSSPKKAPLSPRPKSPTKKRSQALTFHLDASNKTLTPVKTSPNRRVNRLINNENLTSPSKSKKVTKVKKEPLKSLDVNVKH

SEQ ID NO: 11556 - DNA, 1395 bp, Kluyveromyces lactis NRRL Y-1140
  CDS (1)..(1395)
atgtcaaaacctgtattgccatcattctctgccattatcgatgcaacttctaccacttcttctccattaccaagatcagcaagcatgggtttcagaatggacattcagggtaatattagattacctccactaagtggaaatgaccctcaaacaccaatagtcaagaataacttgctatctatcacacctacgacaagtatgcttagaattggtaccgcatcaacctcaagtgttgatgtagatcacgtgactacatcatcatcgacactagtaccaacgccggggatgagctccaaatctttacttggagtaaacgcaagagcatcaaggtcatctcctactgctagcgggtctaatagtacgggaagaagtcttagcgttaatctcagtatacccgacaatggcacgctacaacacacgccgtcaaagagaccaaaggtaactaaaagaagcaacagcgctggtaacaaccttgttctgacggatccagaatcgctagatgattctgattcgaaaaacagtagtgctaagaaaagaaccaacaaagctaaatcgtttgcattcatcacacactctcaggaaacgtttccctctaatgagccttcaatcgataacgcacaactggctagaagaaagagaagaagaacttcgaaaaatgaatcagacatcttaaaaaaggaattcgaagtgaaccctgctccctcaaaggagagaagatcggaactatcaataatatgtaacatgagcgaaaaggcagtccaagtttggttccaaaatagaagacaaaacttcagaaagaagttcaaggtggattcaaaacaaataaactcaccattagatgattcaaacgacattggattaaatgacacggctaaaataccagatttgagagatcaaattagtagccccactgagtctatatctaacgcagatggtatgcagacagacgattctcttcaacaaaaccatcccctcattgaaatcacaacctcgaatattgctaccgtatccactaccaaacgcaacagttccaatgataacggttcattagtcataatgaatgatgaattgaagttccaaaagaaattgaagctcgatatcccaagatacactatatccagtccacctgaaaaaattacttccccctcagaaaagggtaaagtactcacttttaggttgaagcaagacaatgaactctcaagggtctataccagcccgaataacagagtgaacaagctgataaatggtacaaatatcaaagattttgttactacacccgtcaaggaagtaacagacgagaatgtcaaaatgagtgaaaatatgaatacggctggaaagctcaatttcagttccaacagaggcatattaaaagaattgaacatcaatacgacataa

SEQ ID NO: 11557 - protein, 464 aa, Kluyveromyces lactis NRRL Y-1140
MSKPVLPSFSAIIDATSTTSSPLPRSASMGFRMDIQGNIRLPPLSGNDPQTPIVKNNLLSITPTTSMLRIGTASTSSVDVDHVTTSSSTLVPTPGMSSKSLLGVNARASRSSPTASGSNSTGRSLSVNLSIPDNGTLQHTPSKRPKVTKRSNSAGNNLVLTDPESLDDSDSKNSSAKKRTNKAKSFAFITHSQETFPSNEPSIDNAQLARRKRRRTSKNESDILKKEFEVNPAPSKERRSELSIICNMSEKAVQVWFQNRRQNFRKKFKVDSKQINSPLDDSNDIGLNDTAKIPDLRDQISSPTESISNADGMQTDDSLQQNHPLIEITTSNIATVSTTKRNSSNDNGSLVIMNDELKFQKKLKLDIPRYTISSPPEKITSPSEKGKVLTFRLKQDNELSRVYTSPNNRVNKLINGTNIKDFVTTPVKEVTDENVKMSENMNTAGKLNFSSNRGILKELNINTT

SEQ ID NO: 11558 - DNA, 1464 bp, Yarrowia lipolytica CLIB122
  CDS (1)..(1464)
atggatctggcgaaaatcaccgacggcttcgtcaagcacgagacctcgtcgtcgtcctcttcttgctccaccaccaacacagggcccaccccagacttgtctccagtgacgccctccaaggaatgtgagaagcggccacgagaggacgaccctgaagagtcgcacgacacgagcgccggcgccaacagcaacaacaacgctagcgtgtctctcatgtccaccccagagcccaagtcgtcgtctccccccggactgtcgcatttcgcacacctgatgcaaaagtcggacaccatgtaccgacagaacctcaactcggaccagtacatctactcggacgaggagaaggagaaccacaagacttcgggcaagccccacaccccccaggtgcctcatacgccctccagtgtgccgacacaacaaccccaatatgcatttatttcacattccatcacctcgtacccgtcgaacgagcctcagattgacaacgcacggctggcgcgccgaaaacgacgccgaacgtctcccacggaactcgcgctgctggagcaggagtttgcccgcaaccagaagcctcccaagcacattcgcgtcgacattgcccgccgagtcgacatgactgaaaaggctgtgcaggtgtggttccagaacaagcggcagagcgtgcgaaagagcatgaacaagagcatgaccgatgacacctctttcgccgactcttcgttcgctgaaactacctttgacgagacagacggtaactccacattcctgtccaattccaacgtcagcaccagcgtaagcaacaagtcaatcacttcttccatcacagacaacaagtcgcccctggcacagtcaaccaccgccgactctgttgccaacgccaacgccaacgccaacgccaacgccaacaacaacaccgcatccacttcctccacaaacgactccgaaattgcatccgtcgcccccaaaacaaacggcagctcattctctgttttcgaagatacccccgagactcccgcgaaaaagaaacccagtgctccgcgactgtccatgcgtggtgggaaggctactgttatctacgccggcaagcccaagggtgtcacgctgtcctcgggaagacgtcttggggtccctgccacaccctcctctcccgccaacaacaatcttggcctgggaggctcgcctctggccacatcgtctcctatgacccagcggaccgcgtcgcaactgaaccaggcatctgcatcttctcccctatcggctgttaagtccaagtcttttggaactgccgaggaaagcctggctgcgacgctcaagaagcggcttccgtccatgcactacgacctgcccgtgaccaacaagacgtcgtctgtgcgccatggcgtgagctctcccgtggtcgacgccggcagccgtgaggccgagtgtatttccaatctcctctctcttcgaaacggaggacgatggtaa

SEQ ID NO: 11559 - protein, 487 aa, Yarrowia lipolytica CLIB122
MDLAKITDGFVKHETSSSSSSCSTTNTGPTPDLSPVTPSKECEKRPREDDPEESHDTSAGANSNNNASVSLMSTPEPKSSSPPGLSHFAHLMQKSDTMYRQNLNSDQYIYSDEEKENHKTSGKPHTPQVPHTPSSVPTQQPQYAFISHSITSYPSNEPQIDNARLARRKRRRTSPTELALLEQEFARNQKPPKHIRVDIARRVDMTEKAVQVWFQNKRQSVRKSMNKSMTDDTSFADSSFAETTFDETDGNSTFLSNSNVSTSVSNKSITSSITDNKSPLAQSTTADSVANANANANANANNNTASTSSTNDSEIASVAPKTNGSSFSVFEDTPETPAKKKPSAPRLSMRGGKATVIYAGKPKGVTLSSGRRLGVPATPSSPANNNLGLGGSPLATSSPMTQRTASQLNQASASSPLSAVKSKSFGTAEESLAATLKKRLPSMHYDLPVTNKTSSVRHGVSSPVVDAGSREAECISNLLSLRNGGRW

SEQ ID NO: 11560 - DNA, 1008 bp, Candida albicans SC5314
  CDS (1)..(1008): transl_table=12
atgatgatgcacttacaacaaacaccaactaaaagatcaatcttaccaccaatcactccattaactaattccaacaatggttcaaaactaagtttaccacctttatcttctattttaccaactgctccaagtagtcattatagagatcatccattgactactagtaccccatacaaggcaccattgccatcaataaatacttcagctgcttatcaaagtccatcaatgacttatggtagttatattccaactccagaatcagccacttcactggtaactagttccaataagagaagcttttctgtgctcgatgattcatcaataatggatactagtatactagaagaaagaaaattaaaggcatccaccagttcatcagttgcttccacatcttcttcatctccaacactttcttcacctgcctctactcctactgacaacaaggcttatgcatttatttcacattcactagctactttcccactgcaagaaccatcaattgataatgctccattagcaagacgtaaaagaagaagaacttcacctcatgaattaaatatattgaatcaagaatttgctttaggaacaacccctaataaatcaagaagaattcaaattgctaaaaaagtttccatgacggaaaaggctgtacaaatatggtttcaaaataaaagacaatcaataagaaaacaactgaatctggaaaaagaaatcactgtattaccaccaacttcaaattatcccccatttcaacaacaccaaccagaacaaatatcaactttacctccacctccaccagcacaagtgcaacctgtacaacctgtacaatctgtgcaactaccaattcaagctcaatcaacaccattaccaaaacctgctagcatttccccactcccgattacaaattcctatacttctatgaaattcaaatttatgccaagtaagagtaaagtcactcgtaaactacaagaatgtaaagctttaggtgatatcaccaatttacaataa

SEQ ID NO: 11561 - protein, 335 aa, Candida albicans SC5314
MMMHLQQTPTKRSILPPITPLTNSNNGSKLSLPPLSSILPTAPSSHYRDHPLTTSTPYKAPLPSINTSAAYQSPSMTYGSYIPTPESATSSVTSSNKRSFSVLDDSSIMDTSILEERKLKASTSSSVASTSSSSPTLSSPASTPTDNKAYAFISHSLATFPSQEPSIDNAPLARRKRRRTSPHELNILNQEFALGTTPNKSRRIQIAKKVSMTEKAVQIWFQNKRQSIRKQSNSEKEITVLPPTSNYPPFQQHQPEQISTLPPPPPAQVQPVQPVQSVQLPIQAQSTPLPKPASISPLPITNSYTSMKFKFMPSKSKVTRKLQECKALGDITNLQ

SEQ ID NO: 11562 - DNA, 1062 bp, Saccharomyces cerevisiae
  CDS (1)..(1062)
atggaaagcagaaataccgtgcttccttctttaccaaacattattacaggtacttctaattcgcctttccaactgcatactttgccaaatacaaacttccctagtgatgaccaaggtgacatcaggttgccaccattagctgcatctgcgcacattgtgagaccagtggtaaatatttataaaagtccttgcgatgaggaaaggccaaaaaggaaaagtccacaggctgtggatttcttatcacaacgtgtaaccacttccatgacgcctttatccaagcccaagaagctgagctctcattcaccattcacgccaacggtcagagtctgttctaaagagcagccacctcagagtatgcactcttataaaaaagttaatattcttactcctctatctgctgcaaaggctgttctcacaccaaccacaagaaaagaaaagaaaaggtcatttgcctttattacacactcacaggaaacttttccaaagaaggagcctaagatagacaatgctcggttagctcgtcggaaaagaagaagaacttcatcatatgagcttgggatattgcaaacagcatttgacgaatgtcccacgcccaataaggctaaaaggatagagttatccgagcaatgtaatatgtccgaaaaatcggttcaaatatggtttcagaacaaaaggcaggctgctaaaaagcacaagaacagtggcaacaccagccattgcaaagttcactctaatgattcgatgtctatgatatcttactcagacgctgcgttggaaattacctctacgccaacgagtacgaaggaggctattactgcagagttgctgaaaacttcacctgccaatacgtcctcgatcttcgaagaccaccacataacgccttgcaagcccggcggacagctcaagttccacaggaaatctgtgcttgttaagagaacattatcaaataccggtcatagcgagattatcaaaagtcctaaaggcaaggaaaaccgcctaaagttcaatgcatacgaaagaaaaccccttggggaggtcgatctcaattctttcaaaaactaa

SEQ ID NO: 11563 - protein, 353 aa, Saccharomyces cerevisiae
MESRNTVLPSLPNIITGTSNSPFQLHTLPNTNFPSDDQGDIRLPPLAASAHIVRPVVNIYKSPCDEERPKRKSPQAVDFLSQRVTTSMTPLSKPKKLSSHSPFTPTVRVCSKEQPPQSMHSYKKVNILTPLSAAKAVLTPTTRKEKKRSFAFITHSQETFPKKEPKIDNARLARRKRRRTSSYELGILQTAFDECPTPNKAKRIELSEQCNMSEKSVQIWFQNKRQAAKKHKNSGNTSHCKVHSNDSMSMISYSDAALEITSTPTSTKEAITAELLKTSPANTSSIFEDHHITPCKPGGQLKFHRKSVLVKRTLSNTGHSEIIKSPKGKENRLKFNAYERKPLGEVDLNSFKN

SEQ ID NO: 11564 - DNA, 26 bp, Artificial sequence
  primer
atgtcacaagaaacaaaaatgctacc

SEQ ID NO: 11565 - DNA, 23 bp, Artificial sequence
  primer
tcaaccacggaaagcgttcggat

SEQ ID NO: 11566 - protein, 457 aa, Artificial sequence
  consensus sequence
  Variant (2)..(26): Xaa in position 2 to 26 is any amino acid
  Variant (27)..(35): Xaa in position 27 to 35 is any or no amino acid
  Variant (37)..(38): Xaa in position 37 to 38 is any amino acid
  Variant (40)..(138): Xaa in position 40 to 138 is any amino acid
  Variant (139)..(183): Xaa in position 139 to 183 is any or no amino acid
  Variant (187)..(187): Xaa in position 187 is any amino acid
  Variant (190)..(191): Xaa in position 190 to 191 is any amino acid
  Variant (195)..(196): Xaa in position 195 to 196 is any amino acid
  Variant (199)..(199): Xaa in position 199 is any amino acid
  Variant (204)..(204): Xaa in position 204 is any amino acid
  Variant (215)..(216): Xaa in position 215 to 216 is any amino acid
  Variant (219)..(219): Xaa in position 219 is any amino acid
  Variant (222)..(223): Xaa in position 222 to 223 is any amino acid
  Variant (226)..(230): Xaa in position 226 to 230 is any amino acid
  Variant (232)..(232): Xaa in position 232 is any amino acid
  Variant (234)..(235): Xaa in position 234 to 235 is any amino acid
  Variant (237)..(244): Xaa in position 237 to 244 is any amino acid
  Variant (246)..(246): Xaa in position 246 is any amino acid
  Variant (252)..(252): Xaa in position 252 is any amino acid
  Variant (260)..(360): Xaa in position 260 to 360 is any amino acid
  Variant (361)..(456): Xaa in position 361 to 456 is any or no amino acid
PXXXXXXXXXXXXXXXXXXXXXXXXXXXXXXXXXXIXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAFIXHSXXTFPXXEPXIDNAXLARRKRRRTSXXELXILXXEFXXXXXPXKXXRXXXXXXXXMXEKAVQXWFQNKRQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXL

SEQ ID NO: 11567 - protein, 61 aa, Artificial sequence
  protein pattern
  Variant (5)..(5): Xaa in position 5 is any amino acid
  Variant (16)..(16): Xaa in position 16 is Pro or Ser
  Variant (17)..(17): Xaa in position 17 is any amino acid
  Variant (20)..(20): Xaa in position 20 is Ala, Gly, Asn or Ser
  Variant (21)..(21): Xaa in position 21 is Ile or Leu
  Variant (23)..(23): Xaa in position 23 is any or no amino acid
  Variant (25)..(25): Xaa in position 25 is any amino acid
  Variant (26)..(26): Xaa in position 26 is any or no amino acid
  Variant (28)..(28): Xaa in position 28 is Ala, Asp, Glu or Gln
  Variant (29)..(29): Xaa in position 29 is any amino acid
  Variant (30)..(30): Xaa in position 30 is Cys, Gly or Asn
  Variant (31)..(31): Xaa in position 31 is Pro, Gln, Ser or Thr
  Variant (32)..(32): Xaa in position 32 is any amino acid
  Variant (34)..(34): Xaa in position 34 is Asp, Asn, Pro or Ser
  Variant (36)..(37): Xaa in position 36 to 37 is any amino acid
  Variant (39)..(39): Xaa in position 39 is Ile or Val
  Variant (40)..(40): Xaa in position 40 is Asp, Glu, Asn or Gln
  Variant (41)..(41): Xaa in position 41 is Ile or Leu
  Variant (42)..(42): Xaa in position 42 is Ala or Ser
  Variant (43)..(44): Xaa in position 43 to 44 is any amino acid
  Variant (45)..(45): Xaa in position 45 is Cys or Val
  Variant (46)..(46): Xaa in position 46 is any amino acid
  Variant (48)..(48): Xaa in position 48 is Ser or Thr
  Variant (51)..(51): Xaa in position 51 is Ala or Ser
  Variant (54)..(54): Xaa in position 54 is Ile or Val
IDNAXLARRKRRRTSXXELXXLXQXXFXXXXXPXKXXRXXXXXXXXMXEKXVQXWFQNKRQ

SEQ ID NO: 11568 - protein, 14 aa, Artificial sequence
  protein pattern
  Variant (4)..(4): Xaa in position 4 is Ser or Thr
  Variant (7)..(7): Xaa in position 7 is any amino acid
  Variant (8)..(8): Xaa in position 8 is Ala or Glu
  Variant (12)..(13): Xaa in position 12 to 13 is any amino acid
AFIXHSXXTFPXXE

SEQ ID NO: 11569 - DNA, 2745 bp, Saccharomyces cerevisiae
  CDS (1)..(2745)
atggcaaaaacgttgaaggatttacagggttgggagataataacaactgatgagcagggaaatataatcgatggaggtcagaagagattacgccgaagaggtgcaaaaactgaacattacttaaagagaagttctgatggaattaaactaggtcgtggtgatagtgtagtcatgcacaacgaagccgctgggacttactccgtttatatgatccaggagttgagacttaatacattaaataatgttgtcgaactctgggctctcacctatttacgatggtttgaagtcaatcctttagctcattataggcagtttaatcctgacgctaacattttgaatcgtcctttaaattattacaataaactgttttctgaaactgcaaataaaaatgaactgtatctcactgcagaattagccgaattgcagctatttaactttatcagggttgccaacgtaatggatggaagcaaatgggaagtattgaaaggaaatgtcgatccagaaagagactttacagttcgttatatttgtgagccgactggggagaaatttgtggacattaatattgaggatgtcaaagcttacataaagaaagtggagccaagggaagcccaggaatatttgaaagatttaacacttccatcaaagaagaaagagatcaaaagaggtcctcaaaagaaagataaggctactcaaacggcacaaatttcagacgcagaaacaagagctacagatataacggataatgaggacggtaatgaagatgaatcatctgattatgaaagtccgtcagatatcgacgttagcgaggatatggacagcggtgaaatatccgcagatgagcttgaggaagaagaagacgaagaagaagacgaagacgaagaagagaaagaagctaggcatacaaattcaccaaggaaaagaggccgtaagataaaactaggtaaagatgatattgacgcttctgtacaacctccccccaaaaaaagaggtcgtaaacctaaagatcctagtaaaccgcgtcagatgctattgatatcttcatgccgtgcaaataatactcctgtgattaggaaatttacaaaaaagaatgttgctagggcgaaaaagaaatataccccgttttcgaaaagatttaaatctatagctgcaataccagatttaacttcattacctgaattttacggaaattcttcggaattgatggcatcaaggtttgaaaacaaattaaaaacaacccaaaagcatcagattgtagaaacaattttttctaaagtcaaaaaacagttgaactcttcgtatgtcaaagaagaaatattgaagtctgcaaatttccaagattatttaccggctagggagaatgaattcgcctcaatttatttaagtgcatatagtgccattgagtccgactccgctactactatatacgtggctggtacgcctggtgtagggaaaactttaaccgtaagggaagtcgtaaaggaactactatcgtcttctgcacaacgagaaataccagactttctttatgtggaaataaatggattgaaaatggtaaaacccacagactgttacgaaactttatggaacaaagtgtcaggagaaaggttaacatgggcagcttcaatggagtcactagagttttactttaaaagagttccaaaaaataagaagaaaaccattgtagtcttgttggacgaactcgatgccatggtaacgaaatctcaagatattatgtacaattttttcaattggactacttacgaaaatgccaaacttattgtcattgcagtagccaatacaatggacttaccagaacgtcagctaggcaataagattacttcaagaattgggtttaccagaattatgttcactgggtatacgcacgaagagctaaaaaatatcattgatttaagactgaaggggttgaacgactcatttttctatgttgatacaaaaactggcaatgctattttgattgatgcggctggaaacgacactacagttaagcaaacgttgcctgaagacgtgaggaaagttcgcttaagaatgagtgctgatgccattgaaatagcttcgagaaaagtagcaagtgttagtggtgatgcaagaagagcattgaaggtttgtaaaagagcagctgaaattgctgaaaaacactatatggctaagcatggttatggatatgatggaaagacggttattgaagatgaaaatgaggagcaaatatacgatgatgaagacaaggatcttattgaaagtaacaaagccaaagacgataatgatgacgatgatgacaatgatggggtacaaacagttcacatcacgcacgttatgaaagccttaaacgaaactttaaattctcatgtaattacgtttatgacgcgactttcatttacagcaaaactgtttatttatgcattattaaacttgatgaaaaagaacggatctcaagagcaagaactgggcgatattgtcgatgaaatcaagttacttattgaagtaaatggcagtaataagtttgtcatggagatagccaaaacattgttccaacagggaagtgataatatttctgaacaattgagaattatatcatgggatttcgttctcaatcagttacttgacgcgggaatattgtttaaacaaactatgaagaacgatagaatatgttgtgtcaagctaaatatatcagtagaagaagccaaaagagccatgaatgaggatgagacattgagaaatttatag

SEQ ID NO: 11570 - protein, 914 aa, Saccharomyces cerevisiae
MAKTLKDLQGWEIITTDEQGNIIDGGQKRLRRRGAKTEHYLKRSSDGIKLGRGDSVVMHNEAAGTYSVYMIQELRLNTLNNVVELWALTYLRWFEVNPLAHYRQFNPDANILNRPLNYYNKLFSETANKNELYLTAELAELQLFNFIRVANVMDGSKWEVLKGNVDPERDFTVRYICEPTGEKFVDINIEDVKAYIKKVEPREAQEYLKDLTLPSKKKEIKRGPQKKDKATQTAQISDAETRATDITDNEDGNEDESSDYESPSDIDVSEDMDSGEISADELEEEEDEEEDEDEEEKEARHTNSPRKRGRKIKLGKDDIDASVQPPPKKRGRKPKDPSKPRQMLLISSCRANNTPVIRKFTKKNVARAKKKYTPFSKRFKSIAAIPDLTSLPEFYGNSSELMASRFENKLKTTQKHQIVETIFSKVKKQLNSSYVKEEILKSANFQDYLPARENEFASIYLSAYSAIESDSATTIYVAGTPGVGKTLTVREVVKELLSSSAQREIPDFLYVEINGLKMVKPTDCYETLWNKVSGERLTWAASMESLEFYFKRVPKNKKKTIVVLLDELDAMVTKSQDIMYNFFNWTTYENAKLIVIAVANTMDLPERQLGNKITSRIGFTRIMFTGYTHEELKNIIDLRLKGLNDSFFYVDTKTGNAILIDAAGNDTTVKQTLPEDVRKVRLRMSADAIEIASRKVASVSGDARRALKVCKRAAEIAEKHYMAKHGYGYDGKTVIEDENEEQIYDDEDKDLIESNKAKDDNDDDDDNDGVQTVHITHVMKALNETLNSHVITFMTRLSFTAKLFIYALLNLMKKNGSQEQELGDIVDEIKLLIEVNGSNKFVMEIAKTLFQQGSDNISEQLRIISWDFVLNQLLDAGILFKQTMKNDRICCVKLNISVEEAKRAMNEDETLRNL

SEQ ID NO: 11571 - DNA, 3278 bp, Kluyveromyces lactis
  CDS (395)..(3052)
  misc_feature (309)..(309): m is a or c
  misc_feature (311)..(311): n is a, g, c or t
  misc_feature (327)..(327): n is a, g, c or t
  misc_feature (328)..(328): n is a, g, c or t
  misc_feature (3143)..(3143): n is a, g, c or t
caaggaatggtgcatgcaaggagatggcgcccaacagtccccgccacgggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcttaattcagtaaacagaggaaccgtgtaacaaccaatatgctatgagataaaagaatgctacggaaacaggtagctgtcatttcaacatacttggccagcaagtaactmcnactagtttaggaaggnnttactgcattttaacggttatctgattatttttcctttttattccgtggtagcgagtttattaggcatggcgtcaacgttagctgagtttgaagttcaatgggaaatacagaagacagacttgaaggggaatctcattgctgaaactcctaggcgaagaagaagaggagatgctacagaacatgaagtgattaatttggtacgatacgatggagtcagactttatcctggtgttacgattgtgtgcaaggtagagggtgcagacgagttatcagcgtatatgatccatgaggtgcgattgaatacaagcaattacgtagaactctggtgtttgaactatttgagttggtacgagatcaatgctgcggaaagatataaacagcttgatggagagttttatgagactaataaggaaaaaggtgacaaattttttgaggaaaccttcgcgtcacaatcgataaagaacgaattgtatttgacagctgagctttcagagatttatctacgggacttgcaatttgtagctaatattaaaaatgaaaaggagtatttagactctgtcaatgaagggaaaatggattctaatatgtttttatgtcgatctgcatgcttgccttcaggaactaatctggcggatttagatatacatttctttgaagaaaaaatacgttcctcgaatcctaaggtgtctctggagtatttgcgtgatattactttacccaagcttccaaaacctttaaataaatccaaggtccacgcacgagagaaggtagtggcgacgaaattgcagtccgacaacacaccaagcaaaaaaagctttcaacaaacagtgagcaaaaccaacgctgaagtccaacgcattgcatctactattgttaacgaaaaggaagctatatcagataatgaatcggatttatctgaatatcacgaaagtaaagaagagtttgcaaacgcatcctcttcggacagtgatgaagagtttgaagattaccagtctgcagaagagcttgcaattgtagaacctgccaagaaaaaggtgagatctattaaaccagatatacccatttcaccagtaaaatcacagactccattgcagccatcagcagttcattcatctcctagaaagttctttaagaataatatagtgcgcgctaaaaaggcatatactccattttccaaacggtataagaatccgaagattcctgacttgaacgatattttccaaaggcataataatgatttggatatagctgcattagaggagagattcagaacagtttctgctaaaggcaaaatggagactattttttctaaggtgaagaagcaattgaactcaaggaatagcaaagaagaaattgtcaaagctgctgatttcgacaattatcttccggcaagagaaaatgaatttgcaagtatatacctctcactttacagtgcaattgaagcaggcactagcaccagtatttacattgccgggacgccaggcgttggtaaaactttgacggttcgagaggtagttaaggatttaatgacatctgcagaccaaaaagaacttccaagattccaatacattgaaatcaatggtttaaagattgtcaaagcaagtgatagttatgaagtcttttggcaaaaaatatctggagaaaagcttacatctggagctgccatggaatctctggagttttattttaacaaagttccagctacgaaaaaacgtcctatcgttgtgttattggatgagcttgatgcattagttagcaagagccaagatgtaatgtacaacttctttaactgggctacctattcaaatgcgaaacttattgttgtagctgtcgcaaacaccttagatctccccgaacgccatcttggtaacaagatttcgtccagaattggttttactagaattatgttcactggttacacgcatgaagagcttagaacaatcatcaatttgagacttaaatatttgaacgaatctagtttctatgtcgacccggagacagggagttcgtacatgatctctccggatagtagtactatagaaactgatgaagaagaaaagcgaaaagacttctctaactataaacgactaaaacttaggattaatcctgatgccattgagattgcatcaagaaaaattgctagtgtcagtggtgatgtgcggagagctttaaaggtggtcaaaagagcggtagaatatgcggaaaatgattacttaaagaggcttagatatgagcgactagtcaattccaaaaaagatactagtggcaatggtacaggaaatgaagaattacagagtgtagaaattaagcatattaccaaggcattaaacgaaagttcgacctctccggaacaacaattcatatctggtctgtcatttagcggaaaacttttcctatacgcattaatcaatttaattaagaagaagcaaactgacgtacaacttggtgatatcgtagaagaaatgaggctcctcattgatgtcaatgggaataacaaatacattttagagttgaaacggattttattccaaaatgattctgttgatacaaaggaacagttaagggccgtgtcttgggactatattttattgcaattattggatgcaggtgttgtagtaaggcaatatttcaagaatgagaggctctcgacgatcaaattaaatatttccatggaagatgcggacgaatgcttgcatgaagatgaaatgttgaagacattttagtatatgccttcaagacgcctttgctgctattataattgctacttaggttgtcatgtagcgtacgttaagtagaatatgaaactgctttttncaactatttaattataagatagaaagatataataaaggatgcattttttttaactactattttaccgtgtttattcattctttaccctccgcttcggcaagatgaacgtgatcacgtaataggaggtaggtgatt

SEQ ID NO: 11572 - protein, 885 aa, Kluyveromyces lactis
MASTLAEFEVQWEIQKTDLKGNLIAETPRRRRRGDATEHEVINLVRYDGVRLYPGVTIVCKVEGADELSAYMIHEVRLNTSNYVELWCLNYLSWYEINAAERYKQLDGEFYETNKEKGDKFFEETFASQSIKNELYLTAELSEIYLRDLQFVANIKNEKEYLDSVNEGKMDSNMFLCRSACLPSGTNLADLDIHFFEEKIRSSNPKVSLEYLRDITLPKLPKPLNKSKVHAREKVVATKLQSDNTPSKKSFQQTVSKTNAEVQRIASTIVNEKEAISDNESDLSEYHESKEEFANASSSDSDEEFEDYQSAEELAIVEPAKKKVRSIKPDIPISPVKSQTPLQPSAVHSSPRKFFKNNIVRAKKAYTPFSKRYKNPKIPDLNDIFQRHNNDLDIAALEERFRTVSAKGKMETIFSKVKKQLNSRNSKEEIVKAADFDNYLPARENEFASIYLSLYSAIEAGTSTSIYIAGTPGVGKTLTVREVVKDLMTSADQKELPRFQYIEINGLKIVKASDSYEVFWQKISGEKLTSGAAMESLEFYFNKVPATKKRPIVVLLDELDALVSKSQDVMYNFFNWATYSNAKLIVVAVANTLDLPERHLGNKISSRIGFTRIMFTGYTHEELRTIINLRLKYLNESSFYVDPETGSSYMISPDSSTIETDEEEKRKDFSNYKRLKLRINPDAIEIASRKIASVSGDVRRALKVVKRAVEYAENDYLKRLRYERLVNSKKDTSGNGTGNEELQSVEIKHITKALNESSTSPEQQFISGLSFSGKLFLYALINLIKKKQTDVQLGDIVEEMRLLIDVNGNNKYILELKRILFQNDSVDTKEQLRAVSWDYILLQLLDAGVVVRQYFKNERLSTIKLNISMEDADECLHEDEMLKTF

SEQ ID NO: 11573 - DNA, 3054 bp, Candida glabrata CBS 138
  CDS (1)..(3054)
atggctaggaaccagaaagagctgaacgggtggcagatactagttctggatgaaaaagatgagttgattgactattttgagcagaagagaccgagacgtcgcagaggcgctgttgagagacttggaaaagaccagatatttctgaagcaaggcgacgaaggtatgcttctatctgttggtgatacgattgtggttaaggaagacatcaagagcaatggtatttatcttatacaagatcttcgattgaatacgccaggaaaccttatagagatatgggcatttgtgctgcttggccgtgatgagatagacgctaggtcttatttacaagagatactcccagaatttgtcaaggataatggtgacgaagatagtataacagaaaaatataagaacttagttcatgacaaggagttattcttcactgcgacacttattgaaatcaaattagagcagatcatcgataaagcgaaagtattaaatcagacggaatggaatttattgtctacaacagacaagggttacgagactacttatttcttgcgctatgcatgcgaaccttcgtcttccaattttgtagctatagatattgacaaagagtctaagaatattcacgagtggatgccaaagaaaagcttagaatactacaagcggcttaccgaaccattagaagtaagaaacaaaaagagccctcaaaagagagaagtagttaatctatcggaaagtaatggtattgacaccgttgaagaaaaatcgataaaaatgtctggtaatgttgttgataactctgacaataagccacagagtcccataaaaagaaggcccggaagacccaggaaaaatgaggtcaatcagaaacaaccagaaaaaattgtagagacgtctactgccaatgtgcaaaatcatgacaccaaggtggacaatattgatatagtgtcatctaccatacctcagaagaggaaaagagggaggccgaagaaatcgacaactttgattattaattcaaatgtggtagaaagtacagctccaaccaagaggtcaacgagaacaaaaaaagcgcgcaaaatatacacggaggatagttttgatgaagatccattggacagcgacgataactcagggactgattattttacagatgcagatgatggcgagtataaagaagaagagaagatatctgaaaaaatagagcaagatgaagaggagttggaagttgaagaagacgaagctcaaatctctgatgaagccgagcttttggaagatgactatctttctgataatgacacagctaagatagctcttaataaattaaaaaagaccgaaaatagaccatctaagatggtgcaaaagtcataccagcttgaagattcttccagaagaaaggctcagagcaaaggctattcaagtcaaccatataccactggctcaattaggaaatttacaaaaaaaaatgttgtcagagccaagaaagggtatactcctttttccaaacgttataagtctattgatgatattccagatttaatgaaaatggctgactttaaccaagaatcaacattgaactactttgctaaacttggaaatcgcctaagtacaggaaacgatagtcttgaggtagaaaccatattttcaaaaatcaaaaagcaattaacatcgtcacaaaataaggacgcaattgtgaaatctggtaatatatcagatcatcttccagccagagaaaatgagtttgcttcaatatatttgagtgtttacagtgccatagagtcagggtcagctacaactgtgtatattgctggtacaccaggtgtcggtaaaacactgacagtaagagaagtcattagcgacctacaagctgcctcattacagggtgaactgccgaaatttcaatacgttgaaattaacgggttaaagatggtgaaaccgactgatagttacgaatttttttggaataaaatatcgggagaggaattgacctgggctgctgcgatggagtcattagaattttatttcaacaaagtcccaaaaaacaagaaaaggccaatcgtagtcttattagatgagcttgatgcattggtgactaaatcacaggacgttatgtacaacttttttaattggtccacttacgaaaatgcaaaattagttgtcatcagtgttgcgaacactatggatctacctgaaaagcaacttggtaacaaagtttcatccagaataggttttacaagaatcatgttcactggttactctcatgaggaacttaagacgatcataaaattccgtcttcgcggtttgaacaactcgtccttttatgtggatcccaaaactggtaatgctaaactggccgaggctacaagtaacgaaaatgttccggagggtatgttgaaggtcagactaaagatgacagacgatgctatcgaaattgcctccaggaaagttgcaagtgtcagtggtgatgcaagaagagcactaaaagtttgtaaaagggccgccgaaattgctgaaaaacattatatggctaagcatggctataattacgatggtaaagcaattattgaagacgaagaggtcagagaagaactcgaagctgggaatattcctcaaatcgaggaagataatgatggtgaagttcaaatagttaatattaatcacattatgaaagctttgaatgagactattaattcccatgccatcacttacgtaagtcggcttgcttttgcagcgaagcttttcatttatgcaatattaaatttgatgaagaaaactaatacactggaccaaactctgggcaatgtcattgatgaggtaaaattattaatggataaaaatagcggtaacaagaacttgcatgacattcaaaaagctctatattctagtgatcatgatggtaacatggaactgagaatccgtgcatgggacttcaacataaaccagctcattgaagcaggtatcttatcaagacaatcaatgagaaatgagagaactacaactgtaagagtaaatttagcggtggaagagcttcgtgaagcaatcgaaaaggacgatgtgatcaaagcgttgtaa

SEQ ID NO: 11574 - protein, 1017 aa, Candida glabrata CBS 138
MARNQKELNGWQILVLDEKDELIDYFEQKRPRRRRGAVERLGKDQIFLKQGDEGMLLSVGDTIVVKEDIKSNGIYLIQDLRLNTPGNLIEIWAFVLLGRDEIDARSYLQEILPEFVKDNGDEDSITEKYKNLVHDKELFFTATLIEIKLEQIIDKAKVLNQTEWNLLSTTDKGYETTYFLRYACEPSSSNFVAIDIDKESKNIHEWMPKKSLEYYKRLTEPLEVRNKKSPQKREVVNLSESNGIDTVEEKSIKMSGNVVDNSDNKPQSPIKRRPGRPRKNEVNQKQPEKIVETSTANVQNHDTKVDNIDIVSSTIPQKRKRGRPKKSTTLIINSNVVESTAPTKRSTRTKKARKIYTEDSFDEDPLDSDDNSGTDYFTDADDGEYKEEEKISEKIEQDEEELEVEEDEAQISDEAELLEDDYLSDNDTAKIALNKLKKTENRPSKMVQKSYQLEDSSRRKAQSKGYSSQPYTTGSIRKFTKKNVVRAKKGYTPFSKRYKSIDDIPDLMKMADFNQESTLNYFAKLGNRLSTGNDSLEVETIFSKIKKQLTSSQNKDAIVKSGNISDHLPARENEFASIYLSVYSAIESGSATTVYIAGTPGVGKTLTVREVISDLQAASLQGELPKFQYVEINGLKMVKPTDSYEFFWNKISGEELTWAAAMESLEFYFNKVPKNKKRPIVVLLDELDALVTKSQDVMYNFFNWSTYENAKLVVISVANTMDLPEKQLGNKVSSRIGFTRIMFTGYSHEELKTIIKFRLRGLNNSSFYVDPKTGNAKLAEATSNENVPEGMLKVRLKMTDDAIEIASRKVASVSGDARRALKVCKRAAEIAEKHYMAKHGYNYDGKAIIEDEEVREELEAGNIPQIEEDNDGEVQIVNINHIMKALNETINSHAITYVSRLAFAAKLFIYAILNLMKKTNTLDQTLGNVIDEVKLLMDKNSGNKNLHDIQKALYSSDHDGNMELRIRAWDFNINQLIEAGILSRQSMRNERTTTVRVNLAVEELREAIEKDDVIKAL

SEQ ID NO: 11575 - DNA, 2418 bp, Candida albicans SC5314
  CDS (1)..(2418): transl_table=12
atgaataaacttcccaaaggatggaattttaccatagtggacgacaatgccgatctgaccaactcagaaaacatacaaggaaaaagaccaagaaggtcaagaactagtgtacaaaggagtgacggggcttctccaattatccgagacaatatagtcttaataagaactgacgataatgaggaattcaaagtgggcgatactatagagataactcaaggaaaagggccggaggatccaaccactgaatacggccttataacagaaataaagtttggaaatagtgagtttattgaagtcatcgttgattggtttatacggtcatccgaaatagttggtatgcccaatgatttttttgcagacaatgaattgttgttaactccgtttagaagtgaggtgaaatttattgattttattagacccatcaatgttctatctgaaagccaatttgcggatgtggtaatagacgagtctaattcccattccacgtttttagtgaaacgtgctacagataacgaaggaaactttagcgacatttttgattataaggattttagtggtaaagtacttgagaacccaaagaaatgtgcgatacaggttaaagaattgatatctactactgtgcaaaaagaacttttaaaggaatttagcaaggagcaacgtaaaaaaaaagcaaacaaggtttcgacaacgggtcgcgtaactagattcaataaacgcaaggaaagtgtatcaacaaaagctattaaaccggaaaataagcaggttagaattgagattgataacgacgttttatctgaccaatctgaagaaaaacaggaagagagtgattataatgaggcggaagatgcaaattctgcgttggagtctgacgaagaaaacatttcacaagaactggaggacctggaagtggaatattcaacaaaaaagaagttgaaaaataagaagttgctgcgtagatcgaaggcagcagccaccccttcacccaaacgaaagctacaaaaaaaggatattgaagacatttactccgttgtcacacccactaaaagaatgaaattgggtaaagatgaccgagactcgttaccagtatttttatcaccgaccaaaagcgttcctagtgaattcaccgaccccaaatcggttgctttcaaagaagtgaaacaaagattgcacacatcacagaagttaaatgctctacctggtagagaagatgaatttgccatgatatatatgaatctagagtcagcagtaaacgaaaaaacaggttgttgtgtgtatgtatgtggagtaccaggtatgggaaagacggcaacaatcaaggacgttgttgaacaaatgacatattcgagtgaaagaggtgaaatggaacagtttagttatttagagttgaatggattgaagttattaagccccactgttgcgtacgaagctctttggcatcatataagcggggacaaagtcagtgcttcaaatgcagcattattgttagaggaatatttcaaacgagaagatcacaagagaaaacctttagtgatacttatggatgaattcgaccagattgctaccaaaaagcaaaatgttatgtataacttcttcaattggccgacatattcaacatccaaattaattgtcatagctgttgccaacactatggatttaccagaacgaatgttaacaaacaaaatagcatcaagattgggattaagaagaattcaatttagagggtacacctttcaacaattgggagatatcataacacatagattagaaatgatcactaagaataacagaagaaaagttgtgattacatctgacgcaattgggtttgcctctagaaaagttgctagtgtgagtggtgatgctcgtagagcattgacaatatgtcgacgggcagttgagatagctgagaaggaatacttggagaataaaaagggtgaggacgatagtgagccttaccaggtattgatttctcacatatccactgcgataaatgaaacggtgaactcgccattaagtaaatatattgcatcacttccatttgcatccaagttggtattggcatcactattaagaagatcgagaagaactggccttgctgaaaacagcctaggcgatataattgatgaaatgagaaactcatttgccatggccacacattcagaagaacaaggaagtgacgagttgaatatgcaagatgtcttgtacagtgataaaacatttactgccactaatgaaactgcacctattttgaatttgagaatccattttttcaaacaaatagtgacgtctttggtagaagcaggaattataatacagcagaattcaccaggtgaaagatcaagacttgttaaacttgacgtgcctgaggaagaagtcgtatcggtcttcaagaaagataatgctatatcacagtttttatag

SEQ ID NO: 11576 - protein, 805 aa, Candida albicans SC5314
MNKLPKGWNFTIVDDNADSTNSENIQGKRPRRSRTSVQRSDGASPIIRDNIVLIRTDDNEEFKVGDTIEITQGKGPEDPTTEYGLITEIKFGNSEFIEVIVDWFIRSSEIVGMPNDFFADNELLLTPFRSEVKFIDFIRPINVLSESQFADVVIDESNSHSTFLVKRATDNEGNFSDIFDYKDFSGKVLENPKKCAIQVKELISTTVQKELLKEFSKEQRKKKANKVSTTGRVTRFNKRKESVSTKAIKPENKQVRIEIDNDVLSDQSEEKQEESDYNEAEDANSALESDEENISQESEDSEVEYSTKKKLKNKKLSRRSKAAATPSPKRKLQKKDIEDIYSVVTPTKRMKLGKDDRDSLPVFLSPTKSVPSEFTDPKSVAFKEVKQRLHTSQKLNALPGREDEFAMIYMNLESAVNEKTGCCVYVCGVPGMGKTATIKDVVEQMTYSSERGEMEQFSYLELNGLKLLSPTVAYEALWHHISGDKVSASNAALLLEEYFKREDHKRKPLVILMDEFDQIATKKQNVMYNFFNWPTYSTSKLIVIAVANTMDLPERMLTNKIASRLGLRRIQFRGYTFQQLGDIITHRLEMITKNNRRKVVITSDAIGFASRKVASVSGDARRALTICRRAVEIAEKEYLENKKGEDDSEPYQVLISHISTAINETVNSPLSKYIASLPFASKLVLASLLRRSRRTGLAENSLGDIIDEMRNSFAMATHSEEQGSDELNMQDVLYSDKTFTATNETAPILNLRIHFFKQIVTSLVEAGIIIQQNSPGERSRLVKLDVPEEEVVSVFKKDNAISQFL

SEQ ID NO: 11577 - DNA, 2418 bp, Candida albicans SC5314
  CDS (1)..(2418): transl_table=12
atgaataaacttcccaaaggatggaattttaccatagtggacgacaatgccgatctgagcaactcagaaaacatacaaggaaaaagaccaagaaggtcaagaactagtgtacaaaggagtgacggggcttctccaattatccgagacaatatagtcttaataagaactgacgataatgaggaattcaaagtgggcgatactatagagataactcaaggaaaagggccggaggatccaaccactgaatacggccttataacagaaataaagtttggaaatagtgagtttattgaagtcatcgttgattggtttatacggtcatccgaaatagttggtatgcccaatgatttttttgcagacaatgaattgttgttaactccgtttagaagtgaggtaaaatttattgattttattagacccatcaatgttctatctgaaagccaatttgcggatgtggtaatagacgagtctaattcccattccacgtttttagtgaaacgtgctacagataacgaaggaaactttagcgacacttttgattataaggattttagtggtaaagtacttgagaacccaaagaaatgtgcgatacaggttaaagaattgatatctactactgtgcaaaaagaacttttaaaggaatttagcaaggagcaacgtaaaaaaaaagcaaacaaggtttcgacaacgggtcgcgtaactagattcaataaacgcaaggaaagtgtatcaacaaaagctattaaaccggaaaataagcaggttaaaattgagattgataacgacgttttatctgaccaatctgaagaaaaacaggaagagagtgattataatgaggcggaagatgcaaattctgcgttggagtctgacgaagaaaacatttcacaagaactggaggacctggaagtggaatattcaacaaaaaagaagttgaaaaataagaagttgctgcgtagatcgaaggcagcagccaccccttcacccaaacgaaagctacaaaaaaaggatattgaagacatttactccgttgtcacacccactaaaagaatgaaattgggtaaagatgaccgagactcgttaccagtatttttatcaccgaccaaaagcgttcctagtgaattcaccgaccccaaatcggttgctttcaaagaagtgaaacaaagattgcacacatcacagaagttaaatgctctacctggtagagaagatgaatttgccatgatatatatgaatctagagtcagcagtaaacgaaaaaacaggttgttgtgtgtatgtatgtggagtaccaggtatgggaaagacggcaacaatcaaggacgttgttgaacaaatgacatattcgagtgaaagaggtgaaatggaacagtttagttatttagagttgaatggattgaagttattaagccccactgttgcgtacgaagctctttggcatcatataagcggggacaaagtcagtgcttcaaatgcagcattattgttagaggaatatttcaaacgagaagatcacaagagaaaacctttagtgatacttatggatgaattcgaccagattgctaccaaaaagcaaaatgttatgtataacttcttcaattggccgacatattcaacatccaaattaattgtcatagctgttgccaacactatggatttaccagaacgaatgttaacaaacaaaatagcatcaagattgggattaagaagaattcaatttagagggtacacctttcaacaattgggagatatcataacacatagattagaaatgatcactaagaataacagaagaaaagttgtgattacatctgacgcaattgggtttgcctctagaaaagttgctagtgtgagtggtgatgctcgtagagcattgacaatatgtcgacgggcagttgagatagctgagaaggaatacttggagaataaaaagggtgaggacgatagtgagccttaccaggtattgatttctcacatatccactgcgataaatgaaacggtgaactcgccattaagtaaatatattgcatcacttccatttgcatccaagttggtattggcatcactattaagaagatcgagaagaactggccttgctgaaaacagcctaggcgatataattgatgaaatgagaaactcatttgccatggccacacattcagaagaacaaggaagtgacgagttgaatatgcaagatgtcttgtacagtgataaaacatttactgccactaatgaaactgcacctattttgaatttgagaatccattttttcaaacaaatagtgacgtctttggtagaagcaggaattataatacagcagaattcaccaggtgaaagatcaagacttgttaaacttgacgtgcctgaggaagaagtcgtatcggtcttcaagaaagataatgctatatcacagtttttatag

SEQ ID NO: 11578 - protein, 805 aa, Candida albicans SC5314
MNKLPKGWNFTIVDDNADSSNSENIQGKRPRRSRTSVQRSDGASPIIRDNIVLIRTDDNEEFKVGDTIEITQGKGPEDPTTEYGLITEIKFGNSEFIEVIVDWFIRSSEIVGMPNDFFADNELLLTPFRSEVKFIDFIRPINVLSESQFADVVIDESNSHSTFLVKRATDNEGNFSDTFDYKDFSGKVLENPKKCAIQVKELISTTVQKELLKEFSKEQRKKKANKVSTTGRVTRFNKRKESVSTKAIKPENKQVKIEIDNDVLSDQSEEKQEESDYNEAEDANSALESDEENISQESEDSEVEYSTKKKLKNKKLSRRSKAAATPSPKRKLQKKDIEDIYSVVTPTKRMKLGKDDRDSLPVFLSPTKSVPSEFTDPKSVAFKEVKQRLHTSQKLNALPGREDEFAMIYMNLESAVNEKTGCCVYVCGVPGMGKTATIKDVVEQMTYSSERGEMEQFSYLELNGLKLLSPTVAYEALWHHISGDKVSASNAALLLEEYFKREDHKRKPLVILMDEFDQIATKKQNVMYNFFNWPTYSTSKLIVIAVANTMDLPERMLTNKIASRLGLRRIQFRGYTFQQLGDIITHRLEMITKNNRRKVVITSDAIGFASRKVASVSGDARRALTICRRAVEIAEKEYLENKKGEDDSEPYQVLISHISTAINETVNSPLSKYIASLPFASKLVLASLLRRSRRTGLAENSLGDIIDEMRNSFAMATHSEEQGSDELNMQDVLYSDKTFTATNETAPILNLRIHFFKQIVTSLVEAGIIIQQNSPGERSRLVKLDVPEEEVVSVFKKDNAISQFL

SEQ ID NO: 11579 - DNA, 2937 bp, Saccharomyces cerevisiae
  CDS (1)..(2937)
atggctaaaacattgaaagatttggacggttggcaagttatcattacagatgatcaggggagggttattgacgacaacaatagaagaagatcaagaaaaagaggaggagaaaacgtatttctgaaaagaatttctgatggattgagttttgggaagggtgagagcgtgatatttaatgataatgtgacggaaacatattctgtctacttgatccatgagaccagactcaatacacttaataatgttgtggagatttgggttttttcttacttgagatggtttgaactcaaaccaaaactgtactacgaacaattcaggccagatctaataaaggaagatcatcctttagaattttacaaagataaatttttcaacgaagtaaataagagcgagttatatttaactgctgagctatcagagatttggcttaaggatttcattgcagttggacagatactgccagagtcacaatggaatgatagtagtatcgataaaatagaggatagagattttctagtacgttatgcatgcgaacctactgcggaaaagtttgtaccaattgatatttttcaaatcataagaagagtaaaggaaatggaacccaaacaatctgatgaatacttgaaaagagtatctgtaccagtgagtgggcagaagacaaatagacaggtgatgcataagatgggagttgaaagatcttcaaaaagactagcaaagaaaccttcaatgaaaaaaattaaaatcgagccctctgcagatgatgacgtaaataatggaaatataccgtctcagcgaggaacgtcaacaactcatggttcaatttctccccaagaagagtctgtttcccctaacatctcatcggcgtccccttctgcgctcacatcacctacagattcttcgaaaattttacaaaaaagatctatatcaaaggaactaattgtttcagaggaaataccaataaactcttcagaacaggaatccgattatgagccaaacaatgaaacatctgtgctttcaagtaaacctgggtcaaagccagagaagacatctacagaactcgttgacggccgagagaattttgtatatgcaaataatccagaagtgagtgatgatggtgggcttgaagaggaaacagatgaagttagttcagaaagttctgatgaagcaataataccagtaaataaaagacgtggcgctcacggaagcgaattgagcagtaaaattagaaaaatccacattcaagaaacacaagaattttctaaaaattacactacagaaacagataacgaaatgaacggaaatggaaaacctggaattcccaggggcaacaccaaaattcatagtatgaacgaaaatcctacaccagaaaaaggtaatgcaaagatgattgatttcgctactttgtcaaagttgaaaaaaaaatatcagataattttagaccggtttgcaccagataatcaagtaacagattcctcccaattgaacaaattaacagacgaacagtcaagcttggacgttgcaggccttgaggataagtttagaaaagcatgctcttcatctggaagagaaaccattctgtcaaattttaacgctgatataaatttagaggaatcaattagagaatctttacaaaagagagaactactaaaatcacaagtggaggattttacaagaatattccttccgatttacgacagtttgatgtcttcccaaaataaactattttatattaccaatgcagatgattctactaaattccagcttgtgaatgatgtaatggatgagttgatcacctcttcggcccgaaaggaactacctattttcgattacattcatattgatgccttggaactggcaggaatggatgcattatatgagaaaatatggttcgccatttctaaagaaaatctatgcggtgatatatcactagaggccttaaacttctatattacaaatgtcccgaaagcaaaaaagagaaagacactaatattaatacaaaatccggaaaatctattgagtgagaagattttacaatatttcgagaaatggatttcttcgaaaaattcaaaattgtctatcatttgcgttggcggacataatgtgacgattagagagcaaataaatataatgccctccctcaaagcacactttaccgaaatcaaacttaataaggtggacaagaatgaattgcaacaaatgatcatcacgcgactcaaatctttattgaaaccttttcatgtcaaagtaaatgataagaaggaaatgactatttacaataatattcgcgaaggacagaaccagaaaataccagataatgtgatagtaatcaatcataagatcaacaacaaaatcactcaacttattgcaaagaacgtagccaacgtaagtggtagtactgaaaaagcattcaaaatatgtgaagctgccgtagaaatttctaaaaaagacttcgtacggaaaggtggtctacaaaagggtaaattggtagtgtcacaggagatggtaccacgctatttctcagaagctattaacggattcaaggatgaaactatttcaaagaagattataggaatgtctctgttgatgagaacatttttatataccctggcgcaagaaaccgaaggcacgaatcgtcatacgcttgctctggagaccgtcctgattaagatggtgaagatgttgcgggacaacccagggtacaaggcgtcaaaagaaattaagaaggtcatatgcggtgcctgggagcccgcaataactatagagaaactaaagcaattttcttggataagtgtagtgaatgatttagtgggagaaaaattagttgttgtggtgctcgaggagcccagtgcaagcattatggtagaactaaaacttcctttagaaataaattacgccttttcgatggatgaagaattcaaaaatatggactgcatttga

SEQ ID NO: 11580 - protein, 978 aa, Saccharomyces cerevisiae
MAKTLKDLDGWQVIITDDQGRVIDDNNRRRSRKRGGENVFLKRISDGLSFGKGESVIFNDNVTETYSVYLIHETRLNTLNNVVEIWVFSYLRWFELKPKLYYEQFRPDLIKEDHPLEFYKDKFFNEVNKSELYLTAELSEIWLKDFIAVGQILPESQWNDSSIDKIEDRDFLVRYACEPTAEKFVPIDIFQIIRRVKEMEPKQSDEYLKRVSVPVSGQKTNRQVMHKMGVERSSKRLAKKPSMKKIKIEPSADDDVNNGNIPSQRGTSTTHGSISPQEESVSPNISSASPSALTSPTDSSKILQKRSISKELIVSEEIPINSSEQESDYEPNNETSVLSSKPGSKPEKTSTELVDGRENFVYANNPEVSDDGGLEEETDEVSSESSDEAIIPVNKRRGAHGSELSSKIRKIHIQETQEFSKNYTTETDNEMNGNGKPGIPRGNTKIHSMNENPTPEKGNAKMIDFATLSKLKKKYQIILDRFAPDNQVTDSSQLNKLTDEQSSLDVAGLEDKFRKACSSSGRETILSNFNADINLEESIRESLQKRELLKSQVEDFTRIFLPIYDSLMSSQNKLFYITNADDSTKFQLVNDVMDELITSSARKELPIFDYIHIDALELAGMDALYEKIWFAISKENLCGDISLEALNFYITNVPKAKKRKTLILIQNPENLLSEKILQYFEKWISSKNSKLSIICVGGHNVTIREQINIMPSLKAHFTEIKLNKVDKNELQQMIITRLKSLLKPFHVKVNDKKEMTIYNNIREGQNQKIPDNVIVINHKINNKITQLIAKNVANVSGSTEKAFKICEAAVEISKKDFVRKGGLQKGKLVVSQEMVPRYFSEAINGFKDETISKKIIGMSLLMRTFLYTLAQETEGTNRHTLALETVLIKMVKMLRDNPGYKASKEIKKVICGAWEPAITIEKLKQFSWISVVNDLVGEKLVVVVLEEPSASIMVELKLPLEINYAFSMDEEFKNMDCI

SEQ ID NO: 11581 - DNA, 2433 bp, Debaryomyces hansenii
  CDS (1)..(2433)
atggcaaagagtcaaagagatctaaagggatggcaatatttcttggatgatgcagagttaaataacaccgatagtgttaatggggagcccacaacaccgtctcgtagaagtcgaagaggtaaatctactagtagtcaaaagatatcgttgaaaagagaagaagacgaattggaaattaaggagggcgatttcttgcttgttcaacaagataataattcccctgaggttgcaattgttaaagagattaaatttggtaatgataattttcttgacattattgtttcgtggttcatacgaatgagagatattgaggaggccgatttacctaaagttgaagaatacaaagaaaggtctcaacttaacgagaatgagctttttataacttcctacttggacgaggttaagttaggtgaaataatagacaaagttaatatactatcagaggaagaattcaacaatgatattgtaattgacgattccaataaagcaagtacttttatatgtcgaagaggatgcgattcggctggcgagttattcactgatgtatttgacttcagggatctatgtgtgttgttcgaaaagaaccaccatgaatttattgaatttatcagacgtaaaacagtaccagtcgcctataacgcaaataagacccatgacaagtcaaagtcaataaaggacaagctagatgaagttgaaacgaagaaacctaaacaaaaaactgtatctaagcaaatacttgatgaagaagaagaaaataatgatagctctgatgaatttgaatcggccatagatttgcaggatgaaccttcaagcgatgagctcgaatcagacgaagacgctagtgagtccaagaataaaagtccgaggaaaaggaaagcaagtctgaagccaaaggcggtaaaggagaaacaaaaacgtgtaaagataccgaataatcattctaaatttgatgacgagtcgagacaattcatcacctctgtcgtgagtcccttaaataagagaatgaaaatcaaagattcgtccaaaccatccatattagcgttatctccaagaaagccgaaaaagggtgtatctaaaggtgagaatggcaaaaatggaagtttaggagtagatgcatcgtcagaagcattcaaagagttgaaagaaaaattgcacacatctaccagattatcctcattaccgtgtcgtgaagatgaatttacatctatttatctaaacctagaaactgctatacaggaacaaactggttgttgtttatatgtaagtggtactccaggagtaggcaagacggcgacagtacgagaagtcattgcacaattaagagaattaaccgagatgggtgagttgaatgattttgattaccttgaaataaatgggttaaaattgctttcgccaaatgtagcttatgaaaaattatgggaaaagatcagtggtttaaaggttacggcatcgaatgctgccttgctcttagagagctattttagtcaagatacaccccgtaaacctttgattgtacttatggatgaattggatcaaattgtaactaaaaagcaaaacgtcatgtataattttttcaattggcccacgtattctaattcgaaattgattgttatcgcagttgcaaacaccatggatttacctgaacgagtgctatctaataaaatctcttcaaggttggggttgagaagaattcagtttattggttatacttttgagcagttagggtcaattataaagcatagattagatatgctcacgaagcagaataagagaaaggttattatcaacagcgatgctattggttttgcgtccagaaaggtggctagtgtgagtggagatgccagaagggctttaactatttgccgcagagctgttgagattgctgagaaggattttttatccagtaaggaagatcctggaaatgaacaggaaatcgaaaatgaatcatatcatgtacaaatatcgcatatttctaaagccatcaatgaaacggtcaacagtccgatctctcaattcttaatgagtttaccatttgcgtccaaactagttcttgctggtgtattacttagaatgaaacgttctggtttagcagagaattcgttgggtgatataatagacgagatgaaaaattcgttaacaatgcttacttccagagacggtgataaggtattagaggcaattgattctaaaatgactcttatagacttactatatgggaatggtcttctccaaaaccttgattcaacctttaatctgaaagatactaacattagaatacttaggttcaaatacattgttaacgagttagttgagaatggtattttacaacaaaatgtcagaggcgaaagacatagtctcattaatttgaatatttctgaagaagaaattgtttctgtattgaagcgggacaaggaaataagtagtatactttga

SEQ ID NO: 11582 - protein, 810 aa, Debaryomyces hansenii
MAKSQRDLKGWQYFLDDAELNNTDSVNGEPTTPSRRSRRGKSTSSQKISLKREEDELEIKEGDFLLVQQDNNSPEVAIVKEIKFGNDNFLDIIVSWFIRMRDIEEADLPKVEEYKERSQLNENELFITSYLDEVKLGEIIDKVNILSEEEFNNDIVIDDSNKASTFICRRGCDSAGELFTDVFDFRDLCVLFEKNHHEFIEFIRRKTVPVAYNANKTHDKSKSIKDKLDEVETKKPKQKTVSKQILDEEEENNDSSDEFESAIDLQDEPSSDELESDEDASESKNKSPRKRKASLKPKAVKEKQKRVKIPNNHSKFDDESRQFITSVVSPLNKRMKIKDSSKPSILALSPRKPKKGVSKGENGKNGSLGVDASSEAFKELKEKLHTSTRLSSLPCREDEFTSIYLNLETAIQEQTGCCLYVSGTPGVGKTATVREVIAQLRELTEMGELNDFDYLEINGLKLLSPNVAYEKLWEKISGLKVTASNAALLLESYFSQDTPRKPLIVLMDELDQIVTKKQNVMYNFFNWPTYSNSKLIVIAVANTMDLPERVLSNKISSRLGLRRIQFIGYTFEQLGSIIKHRLDMLTKQNKRKVIINSDAIGFASRKVASVSGDARRALTICRRAVEIAEKDFLSSKEDPGNEQEIENESYHVQISHISKAINETVNSPISQFLMSLPFASKLVLAGVLLRMKRSGLAENSLGDIIDEMKNSLTMLTSRDGDKVLEAIDSKMTLIDLLYGNGLLQNLDSTFNLKDTNIRILRFKYIVNELVENGILQQNVRGERHSLINLNISEEEIVSVLKRDKEISSIL

SEQ ID NO: 11583 - DNA, 2661 bp, Kluyveromyces lactis
  CDS (1)..(2661)
atggcgtcaacgttagctgagtttgaagttcaatgggaaatacagaagacagacttgaaggggaatctcattgctgaaactcctaggcgaagaagaagaggagatgctacagaacatgaagtgattaatttggtacgatacgatggagtcagactttatcctggtgttacgattgtgtgcaaggtagagggtgcagacgagttatcagcgtatatgatccatgaggtgcgattgaatacaagcaattacgtagaactctggtgtttgaactatttgagttggtacgagatcaatgctgcggaaagatataaacagcttgatggagagttttatgagactaataaggaaaaaggtgacaaattttttgaggaaaccttcgcgtcacaatcgataaagaacgaattgtatttgacagctgagctttcagagatttatctacgggacttgcaatttgtagctaatattaaaaatgaaaaggagtatttagactctgtcaatgaagggaaaatggattctaatatgtttttatgtcgatctgcatgcttgccttcaggaactaatctggcggatttagatatacatttctttgaagaaaaaatacgttcctcgaatcctaaggtgtctctggagtatttgcgtgatattactttacccaagcttccaaaacctttaaataaatccaaggtccacgcacgagagaaggtagtggcgacgaaattgcagtccgacaacacaccaagcaaaaaaagctttcaacaaacagtgagcaaaaccaacgctgaagtccaacgcattgcatctactattgttaacgaaaaggaagctatatcagataatgaatcggatttatctgaatatcacgaaagtaaagaagagtttgcaaacgcatcctcttcggacagtgatgaagagtttgaagattaccagtctgcagaagagcttgcaattgtagaacctgccaagaaaaaggtgagatctattaaaccagatatacccatttcaccagtaaaatcacagactccattgcagccatcagcagttcattcatctcctagaaagttctttaagaataatatagtgcgcgctaaaaaggcatatactccattttccaaacggtataagaatccgaaggatattcctgacttgaacgatattttccaaaggcataataatgatttggatatagctgcattagaggagagattcagaacagtttctgctaaaggcaaaatggagactattttttctaaggtgaagaagcaattgaactcaaggaatagcaaagaagaaattgtcaaagctgctgatttcgacaattatcttccggcaagagaaaatgaatttgcaagtatatacctctcactttacagtgcaattgaagcaggcactagcaccagtatttacattgccgggacgccaggcgttggtaaaactttgacggttcgagaggtagttaaggatttaatgacatctgcagaccaaaaagaacttccaagattccaatacattgaaatcaatggtttaaagattgtcaaagcaagtgatagttatgaagtcttttggcaaaaaatatctggagaaaagcttacatctggagctgccatggaatctctggagttttattttaacaaagttccagctacgaaaaaacgtcctatcgttgtgttattggatgagcttgatgcattagttagcaagagccaagatgtaatgtacaacttctttaactgggctacctattcaaatgcgaaacttattgttgtagctgtcgcaaacaccttagatctccccgaacgccatcttggtaacaagatttcgtccagaattggttttactagaattatgttcactggttacacgcatgaagagcttagaacaatcatcaatttgagacttaaatatttgaacgaatctagtttctatgtcgacccggagacagggagttcgtacatgatctctccggatagtagtactatagaaactgatgaagaagaaaagcgaaaagacttctctaactataaacgactaaaacttaggattaatcctgatgccattgagattgcatcaagaaaaattgctagtgtcagtggtgatgtgcggagagctttaaaggtggtcaaaagagcggtagaatatgcggaaaatgattacttaaagaggcttagatatgagcgactagtcaattccaaaaaagatactagtggcaatggtacaggaaatgaagaattacagagtgtagaaattaagcatattaccaaggcattaaacgaaagttcgacctctccggaacaacaattcatatctggtctgtcatttagcggaaaacttttcctatacgcattaatcaatttaattaagaagaagcaaactgacgtacaacttggtgatatcgtagaagaaatgaggctcctcattgatgtcaatgggaataacaaatacattttagagttgaaacggattttattccaaaatgattctgttgatacaaaggaacagttaagggccgtgtcttgggactatattttattgcaattattggatgcaggtgttgtagtaaggcaatatttgaagaatgagaggctctcgacgatcaaattaaatatttccatggaagatgcggagcaatgcttgcatgaagatgaaatgttgaagacattttag

SEQ ID NO: 11584 - protein, 886 aa, Kluyveromyces lactis
MASTLAEFEVQWEIQKTDLKGNLIAETPRRRRRGDATEHEVINLVRYDGVRLYPGVTIVCKVEGADELSAYMIHEVRLNTSNYVELWCLNYLSWYEINAAERYKQLDGEFYETNKEKGDKFFEETFASQSIKNELYLTAELSEIYLRDLQFVANIKNEKEYLDSVNEGKMDSNMFLCRSACLPSGTNLADLDIHFFEEKIRSSNPKVSLEYLRDITLPKLPKPLNKSKVHAREKVVATKLQSDNTPSKKSFQQTVSKTNAEVQRIASTIVNEKEAISDNESDLSEYHESKEEFANASSSDSDEEFEDYQSAEELAIVEPAKKKVRSIKPDIPISPVKSQTPLQPSAVHSSPRKFFKNNIVRAKKAYTPFSKRYKNPKDIPDLNDIFQRHNNDLDIAALEERFRTVSAKGKMETIFSKVKKQLNSRNSKEEIVKAADFDNYLPARENEFASIYLSLYSAIEAGTSTSIYIAGTPGVGKTLTVREVVKDLMTSADQKELPRFQYIEINGLKIVKASDSYEVFWQKISGEKLTSGAAMESLEFYFNKVPATKKRPIVVLLDELDALVSKSQDVMYNFFNWATYSNAKLIVVAVANTLDLPERHLGNKISSRIGFTRIMFTGYTHEELRTIINLRLKYLNESSFYVDPETGSSYMISPDSSTIETDEEEKRKDFSNYKRLKLRINPDAIEIASRKIASVSGDVRRALKVVKRAVEYAENDYLKRLRYERLVNSKKDTSGNGTGNEELQSVEIKHITKALNESSTSPEQQFISGLSFSGKLFLYALINLIKKKQTDVQLGDIVEEMRLLIDVNGNNKYILELKRILFQNDSVDTKEQLRAVSWDYILLQLLDAGVVVRQYLKNERLSTIKLNISMEDAEQCLHEDEMLKTF

SEQ ID NO: 11585 - DNA, 2937 bp, Saccharomyces cerevisiae
  CDS (1)..(2937)
atggctaaaacattgaaagatttggacggttggcaagttatcattacagatgatcaggggagggttattgacgacaacaatagaagaagatcaagaaaaagaggaggagaaaacgtatttctgaaaagaatttctgatggattgagttttgggaagggtgagagcgtgatatttaatgataatgtgacggaaacatattctgtctacttgatccatgagatcagactcaatacacttaataatgttgtggagatttgggttttttcttacttgagatggtttgaactcaaaccaaaactgtactacgaacaattcaggccagatctaataaaggaagatcatcctttagaattttacaaagataaatttttcaacgaagtaaataagagcgagttatatttaactgctgagctatcagagatttggcttaaggatttcattgcagttggacagatactgccagagtcacaatggaatgatagtagtatcgataaaatagaggatagagattttctagtacgttatgcatgcgaacctactgcggaaaagtttgtaccaattgatatttttcaaatcataagaagagtaaaggaaatggaacccaaacaatctgatgaatacttgaaaagagtatctgtaccagtgagtgggcagaagacaaatagacaggtgatgcataagatgggagttgaaagatcttcaaaaagactagcaaagaaaccttcaatgaaaaaaattaaaatcgagccctctgcagatgatgacgtaaataatggaaatataccgtctcagcgaggaacgtcaacaactcatggttcaatttctccccaagaagagtctgtttcccctaacatctcatcggcgtccccttctgcgctcacatcacctacagattcttcgaaaattttacaaaaaagatctatatcaaaggaactaattgtttcagaggaaataccaataaactcttcagaacaggaatccgattatgagccaaacaatgaaacatctgtgctttcaagtaaacctgggtcaaagccagagaagacatctacagaactcgttgacggccgagagaattttgtatatgcaaataatccagaagtgagtgatgatggtgggcttgaagaggaaacagatgaagttagttcagaaagttctgatgaagcaataataccagtaaataaaagacgtggcgctcacggaagcgaattgagcagtaaaattagaaaaatccacattcaagaaacacaagaattttctaaaaattacactacagaaacagataacgaaatgaacggaaatggaaaacctggaattcccaggggcaacaccaaaattcatagtatgaacgaaaatcctacaccagaaaaaggtaatgcaaagatgattgatttcgctactttgtcaaagttgaaaaaaaaatatcagataattttagaccggtttgcaccagataatcaagtaacagattcctcccaattgaacaaattaacagacgaacagtcaagcttggacgttgcaggccttgaggataagtttagaaaagcatgctcttcatctggaagagaaaccattctgtcaaattttaacgctgatataaatttagaggaatcaattagagaatctttacaaaagagagaactactaaaatcacaagtggaggattttacaagaatattccttccgatttacgacagtttgatgtcttcccaaaataaactattttatattaccaatgcagatgattctactaaattccagcttgtgaatgatgtaatggatgagttgatcacctcttcggcccgaaaggaactacctattttcgattacattcatattgatgccttggaactggcaggaatggatgcattatatgagaaaatatggttcgccatttctaaagaaaatctatgcggtgatatatcactagaggccttaaacttctatattacaaatgtcccgaaagcaaaaaagagaaagacactaatattaatacaaaatccggaaaatctattgagtgagaagattttacaatatttcgagaaatggatttcttcgaaaaattcaaaattgtctatcatttgcgttggcggacataatgtgacgattagagagcaaataaatataatgccctccctcaaagcacactttaccgaaatcaaacttaataaggtggacaagaatgaattgcaacaaatgatcatcacgcgactcaaatctttattgaaaccttttcatgtcaaagtaaatgataagaaggaaatgactatttacaataatattcgcgaaggacagaaccagaaaataccagataatgtgatagtaatcaatcataagatcaacaacaaaatcactcaacttattgcaaagaacgtagccaacgtaagtggtagtactgaaaaagcattcaaaatatgtgaagctgccgtagaaatttctaaaaaagacttcgtacggaaaggtggtctacaaaagggtaaattggtagtgtcacaggagatggtaccacgctatttctcagaagctattaacggattcaaggatgaaactatttcaaagaagattataggaatgtctctgttgatgagaacatttttatataccctggcgcaagaaaccgaaggcacgaatcgtcatacgcttgctctggagaccgtcctgattaagatggtgaagatgttgcgggacaacccagggtacaaggcgtcaaaagaaattaagaaggtcatatgcggtgcctgggagcccgcaataactatagagaaactaaagcaattttcttggataagtgtagtgaatgatttagtgggagaaaaattagttgttgtggtgctcgaggagcccagtgcaagcattatggtagaactaaaacttcctttagaaataaattacgccttttcgatggatgaagaattcaaaaatatggactgcatttga

SEQ ID NO: 11586 - protein, 978 aa, Saccharomyces cerevisiae
MAKTLKDLDGWQVIITDDQGRVIDDNNRRRSRKRGGENVFLKRISDGLSFGKGESVIFNDNVTETYSVYLIHEIRLNTLNNVVEIWVFSYLRWFELKPKLYYEQFRPDLIKEDHPLEFYKDKFFNEVNKSELYLTAELSEIWLKDFIAVGQILPESQWNDSSIDKIEDRDFLVRYACEPTAEKFVPIDIFQIIRRVKEMEPKQSDEYLKRVSVPVSGQKTNRQVMHKMGVERSSKRLAKKPSMKKIKIEPSADDDVNNGNIPSQRGTSTTHGSISPQEESVSPNISSASPSALTSPTDSSKILQKRSISKELIVSEEIPINSSEQESDYEPNNETSVLSSKPGSKPEKTSTELVDGRENFVYANNPEVSDDGGLEEETDEVSSESSDEAIIPVNKRRGAHGSELSSKIRKIHIQETQEFSKNYTTETDNEMNGNGKPGIPRGNTKIHSMNENPTPEKGNAKMIDFATLSKLKKKYQIILDRFAPDNQVTDSSQLNKLTDEQSSLDVAGLEDKFRKACSSSGRETILSNFNADINLEESIRESLQKRELLKSQVEDFTRIFLPIYDSLMSSQNKLFYITNADDSTKFQLVNDVMDELITSSARKELPIFDYIHIDALELAGMDALYEKIWFAISKENLCGDISLEALNFYITNVPKAKKRKTLILIQNPENLLSEKILQYFEKWISSKNSKLSIICVGGHNVTIREQINIMPSLKAHFTEIKLNKVDKNELQQMIITRLKSLLKPFHVKVNDKKEMTIYNNIREGQNQKIPDNVIVINHKINNKITQLIAKNVANVSGSTEKAFKICEAAVEISKKDFVRKGGLQKGKLVVSQEMVPRYFSEAINGFKDETISKKIIGMSLLMRTFLYTLAQETEGTNRHTLALETVLIKMVKMLRDNPGYKASKEIKKVICGAWEPAITIEKLKQFSWISVVNDLVGEKLVVVVLEEPSASIMVELKLPLEINYAFSMDEEFKNMDCI

SEQ ID NO: 11587 - DNA, 25 bp, Artificial sequence
  primer
atggcaaaaacgttgaaggatttac

SEQ ID NO: 11588 - DNA, 26 bp, Artificial sequence
  primer
ctataaatttctcaatgtctcatcct

SEQ ID NO: 11589 - protein, 1083 aa, Artificial sequence
  consensus sequence
  Variant (2)..(28): Xaa in position 2 to 28 is any amino acid
  Variant (29)..(29): Xaa in position 29 is any or no amino acid
  Variant (31)..(31): Xaa in position 31 is any amino acid
  Variant (33)..(74): Xaa in position 33 to 74 is any amino acid
  Variant (75)..(89): Xaa in position 75 to 89 is any or no amino acid
  Variant (91)..(129): Xaa in position 91 to 129 is any amino acid
  Variant (130)..(138): Xaa in position 130 to 138 is any or no amino acid
  Variant (141)..(142): Xaa in position 141 to 142 is any amino acid
  Variant (144)..(147): Xaa in position 144 to 147 is any amino acid
  Variant (149)..(178): Xaa in position 149 to 178 is any amino acid
  Variant (179)..(180): Xaa in position 179 to 180 is any or no amino acid
  Variant (182)..(209): Xaa in position 182 to 209 is any amino acid
  Variant (210)..(210): Xaa in position 210 is any or no amino acid
  Variant (212)..(275): Xaa in position 212 to 275 is any amino acid
  Variant (276)..(408): Xaa in position 276 to 408 is any or no amino acid
  Variant (410)..(482): Xaa in position 410 to 482 is any amino acid
  Variant (483)..(531): Xaa in position 483 to 531 is any or no amino acid
  Variant (533)..(538): Xaa in position 533 to 538 is any amino acid
  Variant (539)..(540): Xaa in position 539 to 540 is any or no amino acid
  Variant (542)..(582): Xaa in position 542 to 582 is any amino acid
  Variant (583)..(602): Xaa in position 583 to 602 is any or no amino acid
  Variant (604)..(609): Xaa in position 604 to 609 is any amino acid
  Variant (611)..(612): Xaa in position 611 to 612 is any amino acid
  Variant (614)..(629): Xaa in position 614 to 629 is any amino acid
  Variant (631)..(638): Xaa in position 631 to 638 is any amino acid
  Variant (640)..(645): Xaa in position 640 to 645 is any amino acid
  Variant (647)..(657): Xaa in position 647 to 657 is any amino acid
  Variant (659)..(661): Xaa in position 659 to 661 is any amino acid
  Variant (663)..(663): Xaa in position 663 is any amino acid
  Variant (665)..(669): Xaa in position 665 to 669 is any amino acid
  Variant (671)..(678): Xaa in position 671 to 678 is any amino acid
  Variant (681)..(682): Xaa in position 681 to 682 is any amino acid
  Variant (684)..(685): Xaa in position 684 to 685 is any amino acid
  Variant (688)..(699): Xaa in position 688 to 699 is any amino acid
  Variant (701)..(702): Xaa in position 701 to 702 is any amino acid
  Variant (704)..(710): Xaa in position 704 to 710 is any amino acid
  Variant (711)..(711): Xaa in position 711 is any or no amino acid
  Variant (713)..(716): Xaa in position 713 to 716 is any amino acid
  Variant (717)..(717): Xaa in position 717 is any or no amino acid
  Variant (719)..(733): Xaa in position 719 to 733 is any amino acid
  Variant (734)..(735): Xaa in position 734 to 735 is any or no amino acid
  Variant (737)..(738): Xaa in position 737 to 738 is any amino acid
  Variant (740)..(745): Xaa in position 740 to 745 is any amino acid
  Variant (748)..(751): Xaa in position 748 to 751 is any amino acid
  Variant (753)..(775): Xaa in position 753 to 775 is any amino acid
  Variant (777)..(785): Xaa in position 777 to 785 is any amino acid
  Variant (787)..(789): Xaa in position 787 to 789 is any amino acid
  Variant (791)..(792): Xaa in position 791 to 792 is any amino acid
  Variant (795)..(819): Xaa in position 795 to 819 is any amino acid
  Variant (820)..(854): Xaa in position 820 to 854 is any or no amino acid
  Variant (856)..(856): Xaa in position 856 is any amino acid
  Variant (860)..(863): Xaa in position 860 to 863 is any amino acid
  Variant (865)..(870): Xaa in position 865 to 870 is any amino acid
  Variant (872)..(872): Xaa in position 872 is any amino acid
  Variant (874)..(901): Xaa in position 874 to 901 is any amino acid
  Variant (902)..(938): Xaa in position 902 to 938 is any or no amino acid
  Variant (940)..(940): Xaa in position 940 is any amino acid
  Variant (942)..(978): Xaa in position 942 to 978 is any amino acid
  Variant (979)..(979): Xaa in position 979 is any or no amino acid
  Variant (981)..(1017): Xaa in position 981 to 1017 is any amino acid
  Variant (1018)..(1035): Xaa in position 1018 to 1035 is any or no amino acid
  Variant (1037)..(1047): Xaa in position 1037 to 1047 is any amino acid
  Variant (1049)..(1067): Xaa in position 1049 to 1067 is any amino acid
  Variant (1068)..(1068): Xaa in position 1068 is any or no amino acid
  Variant (1070)..(1081): Xaa in position 1070 to 1081 is any amino acid
  Variant (1082)..(1082): Xaa in position 1082 is any or no amino acid
MXXXXXXXXXXXXXXXXXXXXXXXXXXXXRXRXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXELXXTXXXXEXXXXXXXXXXXXXXXXXXXXXXXXXXXXXXXXFXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXDXXXXXXXXXXXXXXXXXXXXXXXXXXXXXXXXXXXXXXXXXXXXXXXXXXXXXXXXXXXXXLXXXXXXFXXIXXXXXXXXXXXXXXXXYXXXXXXXXKXXXXXXVXXXXXXXXXXXEXXXFXYXXXXXLXXXXXXXXYEXXWXXISXXXXXXXXXXXXLXXYXXXXXXXXKXXXXXLXXXXXXXXXXXXXXXXXFXXWXXXXXXKLXXXXVXXXXXXXXXXXXXXXXXXXXXXXIXXXXXXXXXLXXXIXXRLXXXXXXXXXXXXXXXXXXXXXXXXXXXXXXXXXXXXXXXXXXXXXXXXXXXXXXXXXXXXAXVSGXXXXAXXXXXXAXEXXXXXXXXXXXXXXXXXXXXXXXXXXXXXXXXXXXXXXXXXXXXXXXXXXXXXXXXXXXXXXXXXAXNXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXLXXXXXXXXXXXLXXXXXXXXXXXXXXXXXXXXLXXXXXXXXXXXXXD

SEQ ID NO: 11590 - protein, 28 aa, Artificial sequence
  protein pattern
  Variant (2)..(3): Xaa in position 2 to 3 is any or no amino acid
  Variant (5)..(5): Xaa in position 5 is any amino acid
  Variant (6)..(6): Xaa in position 6 is any or no amino acid
  Variant (8)..(8): Xaa in position 8 is any amino acid
  Variant (9)..(9): Xaa in position 9 is Ser or Thr
  Variant (10)..(11): Xaa in position 10 to 11 is any amino acid
  Variant (12)..(12): Xaa in position 12 is Asn or Thr
  Variant (13)..(13): Xaa in position 13 is Ala or Ser
  Variant (16)..(16): Xaa in position 16 is any amino acid
  Variant (17)..(18): Xaa in position 17 to 18 is Ile or Val
  Variant (19)..(19): Xaa in position 19 is Ala or Cys
  Variant (21)..(21): Xaa in position 21 is Ala or Gly
  Variant (22)..(22): Xaa in position 22 is Gly or Asn
  Variant (23)..(24): Xaa in position 23 to 24 is any amino acid
  Variant (25)..(25): Xaa in position 25 is Asp or Val
  Variant (26)..(26): Xaa in position 26 is any amino acid
  Variant (27)..(27): Xaa in position 27 is Ile or Pro
  Variant (28)..(28): Xaa in position 28 is Glu or Arg
YXXFXXWXXXXXXKLXXXXVXXXXXXXX

SEQ ID NO: 11591 - protein, 61 aa, Artificial sequence
  protein pattern
  Variant (2)..(2): Xaa in position 2 is Ile or Val
  Variant (3)..(3): Xaa in position 3 is Ala, Cys or Thr
  Variant (4)..(4): Xaa in position 4 is Gly or Asn
  Variant (5)..(5): Xaa in position 5 is Ala, Thr or Val
  Variant (6)..(6): Xaa in position 6 is Asp or Pro
  Variant (7)..(7): Xaa in position 7 is Asp or Gly
  Variant (8)..(8): Xaa in position 8 is any amino acid
  Variant (9)..(9): Xaa in position 9 is Gly or Thr
  Variant (11)..(13): Xaa in position 11 to 13 is any amino acid
  Variant (14)..(14): Xaa in position 14 is Ile or Val
  Variant (15)..(15): Xaa in position 15 is any amino acid
  Variant (16)..(16): Xaa in position 16 is Asp or Glu
  Variant (18)..(23): Xaa in position 18 to 23 is any amino acid
  Variant (24)..(24): Xaa in position 24 is any or no amino acid
  Variant (26)..(28): Xaa in position 26 to 28 is any amino acid
  Variant (29)..(29): Xaa in position 29 is any or no amino acid
  Variant (31)..(31): Xaa in position 31 is Ile, Leu or Met
  Variant (32)..(32): Xaa in position 32 is Glu or Pro
  Variant (33)..(33): Xaa in position 33 is any amino acid
  Variant (35)..(35): Xaa in position 35 is any amino acid
  Variant (37)..(37): Xaa in position 37 is Ile, Leu or Val
  Variant (38)..(38): Xaa in position 38 is Glu or His
  Variant (39)..(39): Xaa in position 39 is Ile or Leu
  Variant (40)..(40): Xaa in position 40 is Asp or Asn
  Variant (41)..(41): Xaa in position 41 is Ala or Gly
  Variant (43)..(43): Xaa in position 43 is Glu or Lys
  Variant (44)..(44): Xaa in position 44 is Ile, Leu or Met
  Variant (45)..(45): Xaa in position 45 is Ala, Leu or Val
  Variant (46)..(47): Xaa in position 46 to 47 is any amino acid
  Variant (48)..(48): Xaa in position 48 is Asp, Ser or Thr
  Variant (49)..(49): Xaa in position 49 is Ala, Asp or Val
  Variant (50)..(50): Xaa in position 50 is any amino acid
  Variant (53)..(53): Xaa in position 53 is any amino acid
  Variant (54)..(54): Xaa in position 54 is Phe, Ile or Leu
  Variant (56)..(57): Xaa in position 56 to 57 is any amino acid
  Variant (58)..(58): Xaa in position 58 is Ile or Val
  Variant (60)..(60): Xaa in position 60 is any amino acid
  Variant (61)..(61): Xaa in position 61 is Asp or Glu
YXXXXXXXXKXXXXXXVXXXXXXXSXXXXEXXXFXYXXXXXLXXXXXXXXYEXXWXXXSXX

SEQ ID NO: 11592 - protein, 35 aa, Artificial sequence
  protein pattern
  Variant (2)..(6): Xaa in position 2 to 6 is any amino acid
  Variant (8)..(8): Xaa in position 8 is any amino acid
  Variant (9)..(9): Xaa in position 9 is any or no amino acid
  Variant (11)..(11): Xaa in position 11 is Asn or Ser
  Variant (15)..(15): Xaa in position 15 is Asp or Ser
  Variant (16)..(16): Xaa in position 16 is Ala, Thr or Val
  Variant (17)..(17): Xaa in position 17 is Glu or Arg
  Variant (18)..(18): Xaa in position 18 is Lys or Arg
  Variant (20)..(20): Xaa in position 20 is Phe or Leu
  Variant (21)..(21): Xaa in position 21 is any amino acid
  Variant (22)..(22): Xaa in position 22 is Ile or Val
  Variant (23)..(23): Xaa in position 23 is Cys or Val
  Variant (24)..(24): Xaa in position 24 is Glu, Lys or Arg
  Variant (25)..(25): Xaa in position 25 is any amino acid
  Variant (27)..(27): Xaa in position 27 is Ala or Val
  Variant (29)..(29): Xaa in position 29 is any amino acid
  Variant (30)..(30): Xaa in position 30 is Ala or Ser
  Variant (31)..(31): Xaa in position 31 is Glu or Lys
  Variant (32)..(32): Xaa in position 32 is any amino acid
  Variant (33)..(33): Xaa in position 33 is Asp, Glu or His
  Variant (34)..(34): Xaa in position 34 is Phe or Tyr
  Variant (35)..(35): Xaa in position 35 is Leu, Met or Val
IXXXXXKXXAXVSGXXXXAXXXXXXAXEXXXXXXX

SEQ ID NO: 11593 - protein, 36 aa, Artificial sequence
  protein pattern
  Variant (2)..(2): Xaa in position 2 is any amino acid
  Variant (3)..(3): Xaa in position 3 is any or no amino acid
  Variant (5)..(10): Xaa in position 5 to 10 is any amino acid
  Variant (11)..(11): Xaa in position 11 is any or no amino acid
  Variant (13)..(13): Xaa in position 13 is any amino acid
  Variant (14)..(14): Xaa in position 14 is Phe or Leu
  Variant (15)..(17): Xaa in position 15 to 17 is any amino acid
  Variant (18)..(18): Xaa in position 18 is Asp or Thr
  Variant (19)..(19): Xaa in position 19 is any amino acid
  Variant (20)..(20): Xaa in position 20 is Glu, Asn or Gln
  Variant (21)..(21): Xaa in position 21 is Glu or Gln
  Variant (23)..(23): Xaa in position 23 is any amino acid
  Variant (24)..(24): Xaa in position 24 is Asp, Asn, Gln, Ser or Thr
  Variant (25)..(25): Xaa in position 25 is Ile or Met
  Variant (27)..(28): Xaa in position 27 to 28 is any amino acid
  Variant (31)..(31): Xaa in position 31 is Asp, Glu or Lys
  Variant (32)..(32): Xaa in position 32 is any amino acid
  Variant (33)..(33): Xaa in position 33 is Ile or Leu
  Variant (34)..(34): Xaa in position 34 is any amino acid
  Variant (35)..(35): Xaa in position 35 is Asp, Glu or Lys
  Variant (36)..(36): Xaa in position 36 is Asn, Pro, Gln or Ser
IXXSXXXXXXXIXXXXXXXXXLXXXIXXRLXXXXXX

SEQ ID NO: 11594 - protein, 25 aa, Artificial sequence
  protein pattern
  Variant (2)..(2): Xaa in position 2 is Leu or Pro
  Variant (3)..(3): Xaa in position 3 is any amino acid
  Variant (4)..(4): Xaa in position 4 is Arg or Ser
  Variant (5)..(5): Xaa in position 5 is Glu or Gln
  Variant (6)..(6): Xaa in position 6 is Asp, Asn or Val
  Variant (8)..(8): Xaa in position 8 is any or no amino acid
  Variant (10)..(10): Xaa in position 10 is Ala or Thr
  Variant (11)..(11): Xaa in position 11 is any amino acid
  Variant (13)..(16): Xaa in position 13 to 16 is any or no amino acid
  Variant (18)..(18): Xaa in position 18 is any amino acid
  Variant (19)..(19): Xaa in position 19 is Ala, Asn or Ser
  Variant (20)..(20): Xaa in position 20 is Ile or Leu
  Variant (21)..(21): Xaa in position 21 is any amino acid
  Variant (23)..(23): Xaa in position 23 is Ala, Asp, Gly or Ser
  Variant (24)..(24): Xaa in position 24 is any amino acid
  Variant (25)..(25): Xaa in position 25 is Ala, Glu or Asn
LXXXXXEXFXXIXXXXYXXXXSXXX

SEQ ID NO: 11595 - protein, 31 aa, Artificial sequence
  protein pattern
  Variant (2)..(2): Xaa in position 2 is Glu or Lys
  Variant (3)..(4): Xaa in position 3 to 4 is any amino acid
  Variant (6)..(7): Xaa in position 6 to 7 is any or no amino acid
  Variant (9)..(9): Xaa in position 9 is Ala, Pro or Ser
  Variant (10)..(11): Xaa in position 10 to 11 is any amino acid
  Variant (12)..(12): Xaa in position 12 is Ala, Asp or Ser
  Variant (14)..(14): Xaa in position 14 is Ile, Leu or Val
  Variant (15)..(15): Xaa in position 15 is any amino acid
  Variant (16)..(16): Xaa in position 16 is Phe or Leu
  Variant (17)..(17): Xaa in position 17 is any amino acid
  Variant (18)..(18): Xaa in position 18 is Asp, Glu or Asn
  Variant (19)..(19): Xaa in position 19 is Phe, Ile or Leu
  Variant (20)..(22): Xaa in position 20 to 22 is any amino acid
  Variant (23)..(23): Xaa in position 23 is Ala, Gly, Ile or Val
  Variant (24)..(24): Xaa in position 24 is Asn or Gln
  Variant (25)..(25): Xaa in position 25 is Ile or Val
  Variant (26)..(26): Xaa in position 26 is any amino acid
  Variant (27)..(27): Xaa in position 27 is Asp, Asn, Pro or Ser
  Variant (28)..(28): Xaa in position 28 is Glu or Gly
  Variant (29)..(30): Xaa in position 29 to 30 is any amino acid
  Variant (31)..(31): Xaa in position 31 is Phe, Trp or Tyr
NXXXLXXTXXXXEXXXXXXXXXXXXXXXXXX

SEQ ID NO: 11596 - DNA, 369 bp, Saccharomyces cerevisiae
  CDS (1)..(369)
atgccgcacgcttggcaaagctgtatatttgactcttttagtagatttgtagagcttttcctggcatacaataagcaaagactttatttccgctcgagtccgcttttaaccgccgaattcctccggctaaccaatgaaatgcaagagcgcacaaaaagtggggcagctccgaatgcgcgcgttctcattggccaggcactcggggccgagactcggtgtgccttacaattcccccatgacaaagcaaaaactgtcagtttccctcgaatcatacacacgtcaattacaaatccatggattaagttgtctctcgttcgtccatattacacttttctctttagttgtatgctttataaaattgatccgtga

SEQ ID NO: 11597 - protein, 122 aa, Saccharomyces cerevisiae
MPHAWQSCIFDSFSRFVELFLAYNKQRLYFRSSPLLTAEFLRLTNEMQERTKSGAAPNARVLIGQALGAETRCALQFPHDKAKTVSFPRIIHTSITNPWIKLSLVRPYYTFLFSCMLYKIDP

SEQ ID NO: 11598 - DNA, 22 bp, Artificial sequence
  primer
atgccgcacgcttggcaaagct

SEQ ID NO: 11599 - DNA, 26 bp, Artificial sequence
  primer
tcacggatcaattttataaagcatac

SEQ ID NO: 11600 - DNA, 1542 bp, Saccharomyces cerevisiae
  CDS (1)..(1542)
atgaagcaattcaagttggttaatgcggtttccgcatcatttgtgcttattggcttagtgttggccaattcagattcagtgttcgacaagtggacgcaggaagacctggccgattatttacgtgataataagaagagcttggaaaagtacgctacagactccattgaggacttgaaaacggaggcatcgcaggtatgggacaaacacgcgcagcccaaaccatggtggcaggtgtggtctagtgacagcagtagcgtgagcaacagtaaccccggatggtttggttatactggttcttcggatcacccagtttctgactggctctttgacacctggtccacagacagtctacgtaacttcttgaagaaaaacggcgtggatgttgacgacgctaaggcttccaaggactcgctggtgaagactgctaaggagaacttcaacaagatttccaaatctttgaagtcgtcgggatactatccttctagctcttactttgatagctggtcaaccaaagatttgcaaaactggttgaatgacaatggtatcgactacgacaaggcagttcaaagcaaggacgagctagttcagaaagtcaaggaaaacatctaccgaacttcagaaaaggcagaacagcagcgtctgggtttgctagaaagcttggatttggctcaccaacaaatattagacacatcgggacaaataaaagacactgtatttgacaagtggtctagtgatcagttaaccaattggttggagagccacaaggtcaatattgacaagaacatggccaagaaacacgactatttggttagaatggccaaagaaaattctgccaatttgaaagatgatatctactggtacctggactatatgaaaagagagtcttctccatttttgaccaagaccccagaatacgttggttccgtttgggactcttctaaaaatttcctcacaaatttgtactccaagttcagaggtaagactgacaatgtgatcaatgatacttttttggttggcctagactcttggccaaaggacaaattgaaaatgtttttagatgctcgtggtattaagtactcaatgctgtctactgaacatcaattgagagaattagtcaaaaaatccagaaacgaaaaactcaagatcctgccaaaagactaccaaaaatactttgacaacagtaactggtctttggatgacataaagggttggtttgctgacaaaaaggacgacttccaagattctcagacttactccacaattatgcaggattttgacaaggtttccaaaaacacaaatgatgctaaggaccaaatcgctaagacctggtcaaatacctttcagagctggtctcaagaagacctattgcagtacctaaaatcattcggtgttccggttaaacagacttctacgaaggacgacttaatcaacttggccaagcagaatacgcaatggttgttcggcactgttaaggagcctgcttacaagaggtacctacataacgttaaaaactggtcgaaaagcatattagggttcaactaa

SEQ ID NO: 11601 - protein, 513 aa, Saccharomyces cerevisiae
MKQFKLVNAVSASFVLIGLVLANSDSVFDKWTQEDLADYLRDNKKSLEKYATDSIEDLKTEASQVWDKHAQPKPWWQVWSSDSSSVSNSNPGWFGYTGSSDHPVSDWLFDTWSTDSLRNFLKKNGVDVDDAKASKDSLVKTAKENFNKISKSLKSSGYYPSSSYFDSWSTKDLQNWLNDNGIDYDKAVQSKDELVQKVKENIYRTSEKAEQQRLGLLESLDLAHQQILDTSGQIKDTVFDKWSSDQLTNWLESHKVNIDKNMAKKHDYLVRMAKENSANLKDDIYWYLDYMKRESSPFLTKTPEYVGSVWDSSKNFLTNLYSKFRGKTDNVINDTFLVGLDSWPKDKLKMFLDARGIKYSMLSTEHQLRELVKKSRNEKLKILPKDYQKYFDNSNWSLDDIKGWFADKKDDFQDSQTYSTIMQDFDKVSKNTNDAKDQIAKTWSNTFQSWSQEDLLQYLKSFGVPVKQTSTKDDLINLAKQNTQWLFGTVKEPAYKRYLHNVKNWSKSILGFN

SEQ ID NO: 11602 - DNA, 1548 bp, Candida glabrata CBS 138
  CDS (1)..(1548)
atgaaactagttggagtttatgctacaacgttagcagtgctggtctctgttgatgctttgggcagctcagatggagccatcgccaatattagaaacaagttcaccaagcgtgacttgtcagagtatgtcaacgattactctgatgacctagctcgcagtttctccaagagcaaagatgagttgatcaaggaacttgaagagaagtgggagtctgccaaggatgccactggctacaacaaccaagggtggtggaacacctggggcagtgaccagtaccaattcccatggctaggcggtgtcgattccgctaaatctaaggccaagaagaagtcttccgaattgaagaactggttctttgactcctggtctcaggactcgctaatgaagttcttggccaagtacgacttgccccacgaggccaaccaatctaaggaccaattgatcaagactatcaaggacaactttgacaccatctcaaagaaattggaagtctctggttactatccatcctcctcatacttcgatgactggtctaacaaggatctacaggactggctagaccactacaagatcaagtatgatcagaccacggacaaaagggaccaattgatgagcctagttaagaagaatatctacaaagtctctgaggatgtggacaacaagcgccttgaccttttgaaccaactcgaccttgctaagctggacttatttgacaaggcaggtgagatcaagggcactgtgttcgacacctggaactccgaccaaattgagaactggctgaagagccacggtgtctcagtcaaggagaacgccaaggatcaagccgactacttgaagaacttggcctcaacgcatgccaacttgttgaaggatgatgtcgagtggtacacccaggagatgcaggacactgctacaccatacttgaagaagtctgctgacactgcattgcaatactccaagagtagtttctggaatttgttctcattcttcaagaggaagactggcgagaccgttgatgctgtgagccaatatggtatggacacttgggacagtgccaaattgaaggcgtacctggacagctacagagtgaagtatgccaaggatgccactgagcaacaactgcgtgacttggctgtatccaccaagaacaagtggttcaagagcctaccaaaggaatacactgacgactttgttagctggttaaagaccaagaagaacaacatcgccggccaaggctccgacacatacgactacattgtcaacgagttgaccaacgtgcagaagggtgctgccaacatgaaggacgacgtcgccaacaagttcatggactccttccaaggctggtccacggacgacttgactcagtacttgaagaaagttggtgtgaacgtcaagcaaggcatgtacagccaggacgagctcgttgccatggcccgcgagaacacccagtggctgttcggcaagatccaacctgaaccatggtacaagagagccgcacgcagagtctccgacacggcctccatggtatacaatggtgtgctacattaa

SEQ ID NO: 11603 - protein, 515 aa, Candida glabrata CBS 138
MKLVGVYATTLAVLVSVDALGSSDGAIANIRNKFTKRDLSEYVNDYSDDLARSFSKSKDELIKELEEKWESAKDATGYNNQGWWNTWGSDQYQFPWLGGVDSAKSKAKKKSSELKNWFFDSWSQDSLMKFLAKYDLPHEANQSKDQLIKTIKDNFDTISKKLEVSGYYPSSSYFDDWSNKDLQDWLDHYKIKYDQTTDKRDQLMSLVKKNIYKVSEDVDNKRLDLLNQLDLAKLDLFDKAGEIKGTVFDTWNSDQIENWLKSHGVSVKENAKDQADYLKNLASTHANLLKDDVEWYTQEMQDTATPYLKKSADTALQYSKSSFWNLFSFFKRKTGETVDAVSQYGMDTWDSAKLKAYLDSYRVKYAKDATEQQLRDLAVSTKNKWFKSLPKEYTDDFVSWLKTKKNNIAGQGSDTYDYIVNELTNVQKGAANMKDDVANKFMDSFQGWSTDDLTQYLKKVGVNVKQGMYSQDELVAMARENTQWLFGKIQPEPWYKRAARRVSDTASMVYNGVLH

SEQ ID NO: 11604 - DNA, 1458 bp, Kluyveromyces lactis NRRL Y-1140
  CDS (1)..(1458)
atgaagcttagtagtgctttgatattttgtgcagctgcttgccaagtagttatttgcaacaatctatttgaaaattggtctagtcaagacattattcaatatttgaaggacactggtgactctgctaaaaaggatgcagacacttcacttgaagaattgaaggcttacgctagtcagaaatggtctgagcatgcgcaaccaaaaccgtggtggaaagtctggccggatgaaagggatcaagataactggtggaacttccaatcagaaccaagcacaactgagtctatttccaattggttatttgacacttggtctgcgaaggatttgaggaaaaccttgaggaacgctggtgtcaagttcgacaccgatacttcttatgacaatttgaagtcattggccaaggagaatttcgataaaatcaataaaaagctgggtagttccggttactattcgactgaatcctacttcaatcaatgggatgattatgacttgaaagcctggttagataagcacggtgtcacttatgacaaggctaaggctaacaaggaagaattgttgtcccttgttagaaaaaacatttacaaggcctctcaagtttactctgaggagagattgagtgcattggaatcgttagatttggccaagaaacaactatatgataagtccaacaaattaaagagcgacctatttgattcttggtcttcggatgacatttacgactggttgcaatctcatagcatccaagtgaaagaaaatgctaaagaaaatcgtgatcaactactagacgttgccaacaagaacataaatttgttagaagatgatatcaaatggtacaccgaagcttctaaatcaaaggcttctgctctattgacaaaaagcaccgactcagtgaattcggtttgggaagctttcaagggtaagttatctggtgcttaccacgacgacaacgtcatcaatgacacatttttgctaggtgttcaatcatggccaaagaagagactccagaacttccttgacgctcgtggtgtaaaataccatttattgtctactaaagctgaactcttgaaactagtatatgagaaccgcaacaagccattgaagtcatgggaaaacgcttacgatgaagccaagcactggtggaacaagcaaaacatcgttggtaaggccaagagtactggttcagacattctgaataaagtttctgactacgaaagcaccgctgttgacagtttccaacgctcctttgactcgatgtctaacagcgacctaatcgaatatttgaagagttactctgttaaaccatccgatttgaattcattgagtaaagaacaattagttgaaagggcaaaggaaaatacccaatggttcttcggtgttccacagaagccttggtattcaagagctgctgacaacacgttaaactttgccaaacgtgcttatgcagttattagaccatag

SEQ ID NO: 11605 - protein, 485 aa, Kluyveromyces lactis NRRL Y-1140
MKLSSALIFCAAACQVVICNNLFENWSSQDIIQYLKDTGDSAKKDADTSLEELKAYASQKWSEHAQPKPWWKVWPDERDQDNWWNFQSEPSTTESISNWLFDTWSAKDLRKTLRNAGVKFDTDTSYDNLKSLAKENFDKINKKLGSSGYYSTESYFNQWDDYDLKAWLDKHGVTYDKAKANKEELLSLVRKNIYKASQVYSEERLSALESLDLAKKQLYDKSNKLKSDLFDSWSSDDIYDWLQSHSIQVKENAKENRDQLLDVANKNINLLEDDIKWYTEASKSKASALLTKSTDSVNSVWEAFKGKLSGAYHDDNVINDTFLLGVQSWPKKRLQNFLDARGVKYHLLSTKAELLKLVYENRNKPLKSWENAYDEAKHWWNKQNIVGKAKSTGSDILNKVSDYESTAVDSFQRSFDSMSNSDLIEYLKSYSVKPSDLNSLSKEQLVERAKENTQWFFGVPQKPWYSRAADNTLNFAKRAYAVIRP

SEQ ID NO: 11606 - DNA, 2559 bp, Debaryomyces hansenii CBS767
  CDS (1)..(2559)
atgaaggtatttaatttcgcattgataggtctattagcaggcaatttagtggctgcaactgatggattatcgacatggaaagagaaagacgtgaaacactttttaaaggatcgtcaaatagattttagcgagaaagaatcgttccaagagctaagcaggaaggcagaagaggagtttgaaaagttgaaaaacatccaccgggatactgttagggacgattcgcagcaacatatattagcaactaatccgaaggatgaattgaccaatattttcccagcacatatcaattggaattacttgttcgagtccaatgctgaacatgccagactggtaaagaattggattttcgaatcgtggtcgaccgaaggcctcaaggactttttgaccaataataagattaagtttgacaagaattatagcaagcaagatttaattgatttggcgcagaaggaatacgacaatattgcagagggacatgatgtttcaggatactatcctggtgactggatttatcaaggttggagcgttgatcgcttaaagcaatggttgcgagaccatgaattagaatttgactccaaagacaacagagagagcttattgagcaaggttaagcacaataattatattgcatcgttatcgaatatcgacaacaagaattccttgttggattcgcttgatttggcgcaagcaaatatttttgataaggctggtgaaattaaagacgatttttttgacacatggtcatacggccaattgagggaatggttatactaccatggcttcattagcaccagacctgatgtttatgttgaagagttggatgcagataaattgaagaagattgccaagtctcaacaaaattatttagtctctgacattaagaaatggagcgagaaggcgaagaagacagctgacccctatctttcgaaaggagctgataaaaagaagacccttgataatgttatcaatgacacatttttaattggggtcgaaaaatggtccaaggatcgcttgaaggagttcttaagatccagaaatgttaaattttcacaatttgcatctaaacatcaattagtcgatttagtgaaaaaaagtaaggatgttaagttggcccttaaacaaaatgccaacccagcatcatggttagttgagaactggtccaccgatagaattagggagtggttagaaaacaagggcgagaatgttaaaggcactagagaagatttgattaatggcatcagtaactatgtcctgcaacattcattagctcctagtgatacttttgatttcctggcgaatttgtataagccagatttagatgattataagaaatcatttaaggaatctttaaataagttcaatgaggacgttaaagacagcgggggaaaagctaaggaagctcttgattcagctgttgattcatcggttgctgatagaactatgttaactgcctattctattggtgccgaatactataagcaggctgcaaagaccctccgcgagaagtactccgaatccaagttttcgatagatgatgccttatctcaggctaaggatgcatcatacgaatatgccaatcggttcgttgatgatgcttctagtaagtacgctgataataaaccggttgtagaagaacaggtgaaaagcgcaggaatcgctgcttccgaatttgcaaattctttaagtaattctttaactgaacaactcaaatctggcaaagctaaattaaacgatgttaccaatgatcctcaagaacatttgaagagcgttaatgaaattgtcgagaaaagcatcagggacaagaagccaatagctgaacaggctgccaaagacgcctatagagttgcgcaagactaccttgcgtctgcaaatgatgccatagtaaagaactacggtgagtacaagcctgcggctgaggatgctatgaataccatttacgggtcagccaaggattacgccaattcggctaatgaagccctcgaaaagggttacggccagtatagaccaaaggctgtcgaggctgcggagaaagcaaaggaatacgctgacgccataaatgaggcagtgggtaagaacttccaggaatacgaaggaaagcttcaagacgcatataaagctgcctctgatgccgctactgccgcctatgccgaatacaagcctatagtcgacagcaccgctaagaatgcttacgacaccgcaaagcaatatgccggcagtgcaaacgaagcaatccagagtacctacgccgagactataccaaaggttgaaaatgcggccaaaagtggctgggaataccttttagtctcctactccaacgccgacttgagatcttacttacaatcctttggctacaatttcaatcttttatctaccttaactcgtcaacagcttgtcaatctagctaatgaacaatctgacatcttttttggctccgatacaaagtgggataaatccatagtagatgtgttgaaagacacttctgacggtttccaagaaatgataggcataaagccaaaggaagagtctatatggtcaaaagtaaagaactcccttttctag

SEQ ID NO: 11607 - protein, 852 aa, Debaryomyces hansenii CBS767
MKVFNFALIGLLAGNLVAATDGLSTWKEKDVKHFLKDRQIDFSEKESFQELSRKAEEEFEKLKNIHRDTVRDDSQQHILATNPKDELTNIFPAHINWNYLFESNAEHARLVKNWIFESWSTEGLKDFLTNNKIKFDKNYSKQDLIDLAQKEYDNIAEGHDVSGYYPGDWIYQGWSVDRLKQWLRDHELEFDSKDNRESLLSKVKHNNYIASLSNIDNKNSLLDSLDLAQANIFDKAGEIKDDFFDTWSYGQLREWLYYHGFISTRPDVYVEELDADKLKKIAKSQQNYLVSDIKKWSEKAKKTADPYLSKGADKKKTLDNVINDTFLIGVEKWSKDRLKEFLRSRNVKFSQFASKHQLVDLVKKSKDVKLALKQNANPASWLVENWSTDRIREWLENKGENVKGTREDLINGISNYVLQHSLAPSDTFDFLANLYKPDLDDYKKSFKESLNKFNEDVKDSGGKAKEALDSAVDSSVADRTMLTAYSIGAEYYKQAAKTLREKYSESKFSIDDALSQAKDASYEYANRFVDDASSKYADNKPVVEEQVKSAGIAASEFANSLSNSLTEQLKSGKAKLNDVTNDPQEHLKSVNEIVEKSIRDKKPIAEQAAKDAYRVAQDYLASANDAIVKNYGEYKPAAEDAMNTIYGSAKDYANSANEALEKGYGQYRPKAVEAAEKAKEYADAINEAVGKNFQEYEGKLQDAYKAASDAATAAYAEYKPIVDSTAKNAYDTAKQYAGSANEAIQSTYAETIPKVENAAKSGWEYLLVSYSNADLRSYLQSFGYNFNLLSTLTRQQLVNLANEQSDIFFGSDTKWDKSIVDVLKDTSDGFQEMIGIKPKEESIWSKVKNSLF

SEQ ID NO: 11608 - DNA, 2367 bp, Candida albicans SC5314
  CDS (1)..(2367): transl_table=12
atgtatttcccaatcattgtatggttatatgtatctatcacttttgtggttgccaattatggttttgatcaatggacaaatgatgatttaaaacaatttttaaaagaacgtaaagttgcattcaatgatgccttggagaatccaaaattaattagtttggctaatgaagaagctaagaaattagaaaaaggttacaagaaagttactgaagaattaaataacaatttgaatcctccagatgattcattaaatgattatttgaattttgattacttatttgggaaaagaaaagaaaattattcaattaaagaatggatttttgaaagttggccagtaaccagtttgcaaacttttttaactcaaaataatatccaatatagtgcaaaggataccaaagatgatttaatcaataaggttaaagatcaatttgattctatttctaagaaaaatcatgggtctagtttttatcctggcaattggttatatgaatcttggtcagaaaatgatttgaaagattggttgaaatcttatggcattgaatttaatcctagttcaacaaaggatcaattggttgaaaaattaaaagaatttagttatcaagccactcattcaattagagattccaaagaatctttatttgattcattggatttatttgataaaaccatttttgataaaaaaggtcaaattgaagatgaatttttccaaacttggtcatattctcaattacgtgaatggctttatttacatggatttattgacactaaaccaggaatttacgttgaagatttggataaggaaaaattagtcaagattgcccaaagttataagaaatgtttgttgagtgacattcatacttggttggcaaacactgaaaagaagtctcaaccttggatcacaaagggagaacaaaagtctcagaaaaagaagggtagtaatttgattaatgatacattctttgttggtattaataattggtccaaggataaattgcgtgaattcttggatgtcagaaaagttccttactcaatatttaccaccaaacatcaattaatcaagttggtgcaaaagcacaagtttgatccagttcacgttgaaacatatgcttggattgttgatgatgtctctactgattctatcaagcaatggttaattgaacaaggtgaaaatgtagaaggtacaagaaaagatattgtgtctgccttccaaaaacaatttgagtctttgaaaaaaggatttaaggatgctttcaacaatgttgatctgcaaattcgtttatttgcaccagatattaatggctataaaaggtacttgcagaagaaattgagtgaagctgaatataaaaagttgactgaagaccaaatttcacaaggttttaaagttgttcaagaatattataatctggctggtgatgctgcgaaggaagaatttacaaagacaacttattcagctgaggaagcattggatcaaattgaagaagcatcatacgaatactcacttgaattcttacgtaagcttgaaaagggagaacatgatgttactagttttatcaaagatgcccgagttgcaagtaaaagttttgctttgtctttaattaccaaattgagagaaaatgcacaaaaattacaaactgacgcgttgaataaagttggaagctggtggtatggtgccaagagtggattcagcaacaaggttgacgaggcccatcaggttgtattggatgttcatgaccaagccgtgaattaccaagaacaagttggcagtcaatacctgtctattaaggctgaagccgatgaaaagtatgattctattgcaaaggaggctactcagcaatacgatacagctgtgcaaaatgctcaagaacaatacaagcaggcacaagaacatgtatctaaatttgccgatgacgttgggtctcaggctactcaaactcataaaaaacttgaaaaggattatgtgacttataaatccaagatcttttctttccttactaacgtctaccgtggtataatgtatcgtctttcgatattcaatagcaatgcctatgatgctgcaaaatcgacaggagacgtaataaataatcagtggaatagcgttgttcgtacttactccaacgccgatttgaaagcctatctcagatcatttggttatagctacgattggttgtcagctttaaacagacgtgaattgttgagtttggcaactttccaaaacaaattattcagtggatatgacaacttgcaaaactgggaaaaatctgttggtgaagttttaaatgatgctagtgatgaattgaaaattaaattgggattgaaaaaagaacccaaaagcttgattgcaaaattgaagtctgtagttggtttttag

SEQ ID NO: 11609 - protein, 788 aa, Candida albicans SC5314
MYFPIIVWLYVSITFVVANYGFDQWTNDDLKQFLKERKVAFNDALENPKLISLANEEAKKLEKGYKKVTEELNNNLNPPDDSLNDYLNFDYLFGKRKENYSIKEWIFESWPVTSLQTFLTQNNIQYSAKDTKDDLINKVKDQFDSISKKNHGSSFYPGNWLYESWSENDLKDWLKSYGIEFNPSSTKDQLVEKLKEFSYQATHSIRDSKESLFDSLDLFDKTIFDKKGQIEDEFFQTWSYSQLREWLYLHGFIDTKPGIYVEDLDKEKLVKIAQSYKKCLLSDIHTWLANTEKKSQPWITKGEQKSQKKKGSNLINDTFFVGINNWSKDKLREFLDVRKVPYSIFTTKHQLIKLVQKHKFDPVHVETYAWIVDDVSTDSIKQWLIEQGENVEGTRKDIVSAFQKQFESLKKGFKDAFNNVDSQIRLFAPDINGYKRYLQKKLSEAEYKKLTEDQISQGFKVVQEYYNSAGDAAKEEFTKTTYSAEEALDQIEEASYEYSLEFLRKLEKGEHDVTSFIKDARVASKSFALSLITKLRENAQKLQTDALNKVGSWWYGAKSGFSNKVDEAHQVVLDVHDQAVNYQEQVGSQYSSIKAEADEKYDSIAKEATQQYDTAVQNAQEQYKQAQEHVSKFADDVGSQATQTHKKLEKDYVTYKSKIFSFLTNVYRGIMYRLSIFNSNAYDAAKSTGDVINNQWNSVVRTYSNADLKAYLRSFGYSYDWLSALNRRELLSLATFQNKLFSGYDNLQNWEKSVGEVLNDASDELKIKLGLKKEPKSLIAKLKSVVGF

SEQ ID NO: 11610 - DNA, 26 bp, Artificial sequence
  primer
atgaagcaattcaagttggttaatgc

SEQ ID NO: 11611 - DNA, 26 bp, Artificial sequence
  primer
ttagttgaaccctaatatgcttttcg

SEQ ID NO: 11612 - DNA, 1626 bp, Saccharomyces cerevisiae
  CDS (1)..(1626)
atgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataa

SEQ ID NO: 11613 - protein, 541 aa, Saccharomyces cerevisiae; identical to SEQ ID NO: 4563

SEQ ID NO: 11614 - DNA, 1509 bp, Oryza sativa (japonica cultivar-group)
  CDS (1)..(1509)
atggcggacgatcctctctccaactccaccaccaacaacaagagggcagaggggatccagctccagcacggcgactgcgagagcgagagcactgcgcccttgctgctcgcgccacacgagtcctaccgcctctccgccgcaatcctccccttcctatttccagctttgggcggccttctctatggctacgacatcggagcaacgtctggtgctaccatatcgctcaagtcatccaccttcagtggcaccacatggtacaacttgtcatcgctgcaaaccggccttgtcgtcagtggctcactctatggtgctctcatcggttccatcttggcattcaacattgccgattttctaggacggcgcagagagcttattctttcttctgtctcatatttgattggagctcttctcacagcagcagcacctaacttccctatcatggtggttggccgctttttctatggcataggaataggattggctatgcatgctgctccaatgtacattgcagagactgctccaagtcagataagaggcatgctcatttctctcaaggaattctttattgttcttgggatgcttcttggctacattgcaggcagtctctttgtcgaagtggtttctggttggcgctacatgtatgccaccagtacaccattatgtctcatcatgggaattgggatgtgctggttacctgcttcacctaggtggcttctgttatgtgccatacaagggaagaggaatattatggagtcaaaagaaaatgctacccgttgcttatgtcgattgaggggtcaagcttctcctgatttggtttcggaacaagttgatttgattctggatgaactgtcatacgttgatcaagagaggcaagcaggcttcagtgagatctttcagggaaaatgcctcaaagcaatgataatcggatgtggcttggtgttctttcagcaggttactggtcaaccaagtgtgctatattatgctgcgacaatccttcagagtgctggattctctggtgcatctgatgctactcgtgtatcagttcttcttggcttactgaagttgattatgactggtgtggcagttcttgtggttgacagacttgggagaagaccattactgattggaggtgttagtgggattgctgtttccttgtttttgttatcttcgtactacaccttattgaaggatgctccttatgtggctgtaatagcacttctactctatgttggctgctaccagctgtcattcggtccaattggctggcttatgatttcggaagttttcccattaaggctgcgagggcgtgggttgagtattgctgttcttgtgaattttgcctccaatgcactagtcacttttgctttctccccattggaggatttgattggaactgggatcctcttctctgcgtttggggtgattgcagtggcgtctcttgttttcatattcttcatcgtgcccgagacgaaagggctcaccttggaagaaattgaagccagcctgtag

SEQ ID NO: 11615 - protein, 502 aa, Oryza sativa (japonica cultivar-group)
MADDPLSNSTTNNKRAEGIQLQHGDCESESTAPLLLAPHESYRLSAAILPFLFPALGGLLYGYDIGATSGATISLKSSTFSGTTWYNLSSLQTGLVVSGSLYGALIGSILAFNIADFLGRRRELILSSVSYLIGALLTAAAPNFPIMVVGRFFYGIGIGLAMHAAPMYIAETAPSQIRGMLISLKEFFIVLGMLLGYIAGSLFVEVVSGWRYMYATSTPLCLIMGIGMCWLPASPRWLLLCAIQGKRNIMESKENATRCLCRLRGQASPDLVSEQVDLILDELSYVDQERQAGFSEIFQGKCLKAMIIGCGLVFFQQVTGQPSVLYYAATILQSAGFSGASDATRVSVLLGLLKLIMTGVAVLVVDRLGRRPLLIGGVSGIAVSLFLLSSYYTLLKDAPYVAVIALLLYVGCYQLSFGPIGWLMISEVFPLRLRGRGLSIAVLVNFASNALVTFAFSPLEDLIGTGILFSAFGVIAVASLVFIFFIVPETKGLTLEEIEASL

SEQ ID NO: 11616 - DNA, 1683 bp, Saccharomyces cerevisiae
  CDS (1)..(1683)
atgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttggttccaccaaacaagagaggtactgactacaacgctgatgatctaa

SEQ ID NO: 11617 - protein, 560 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWFHQTREVLTTTLMI

SEQ ID NO: 11618 - DNA, 1410 bp, Clostridium acetobutylicum ATCC 824
  CDS (1)..(1410): transl_table=11
atgggggaaaacaattcacataagcattctttattattcatagttctaatttcttgtgctgctggacttggtggcttattatatggatacgacactgcagtaatctctggtgctataggctttttaaagaagctttataatctttcacctgctatgcagggctttgttatttcaagtatcatggtcggtggtgtactaggcgttggtttttctggtttcttgggcgatgctattggtaggagaaaagttttaatgcttgctgctgcactatttgctatttccgctgtaatatcttctatatccacttctgcatttatgctcatttttgctcgtatagtaggaggtcttggtataggaatggcttctgccctatctgtaacatatataactgaatgtgcgccgccatctattcgcggtaggctgtcctcactttaccaactatttaccatacttggtatttcaattaccttctttgtaaacttgggaattgtaaatatgggcagcgaaacctggagagtttcaacaggttggagatatatgttagcttgtggaactgttccagccatagtattcttaattacattattctttgttccagaaagtcctcgttttcttgttaaatcaggaaatataaaaaaggctgctgctgttttaaccaaaatcaacggtgctgaaattgcaaagcaggaactagattccatttctaagtctcttgctaccgaaaacgattcttcattaggtcaacttcttcaacctggtcttagaagagctttattaattggtattttcttagctatatttaatcaagctattggaatgaattcaattacttattatggtcctgaaatatttcaaatgataggtttcaaaaataattctagctttcttgcaaccagtgttattggtgttgttgaagttttctcaacaattttagcaatgtttttaatagataaacttggacgtaaaaaattaatggaaataggatctgctgctatggcagtattcatgctattaatcggaacttctttctatataaaattatcaaatggttttgtaatattaatcttcataatatgttttgttgtttccttctgtatttcaatgggacctataccttggattatgattcctgaaatattccctaaccatttgagagctcgtgcaacaggcatagcaactatcttcctttggggtgctaactgggcaattggacaatttactccaatgcttttaaacggcattggtggagcatatactttttggatattctgtggaattaacgtaatatgcttcttagtagttacaactaaggttcctgagacaaaaaacaaaagtctggaagaaatagaaaagttttggattccaaaatcaaaacaaaatgccaaaggaagttcagtaggagcaaaataa

SEQ ID NO: 11619 - protein, 469 aa, Clostridium acetobutylicum ATCC 824
MGENNSHKHSLLFIVLISCAAGLGGLLYGYDTAVISGAIGFLKKLYNLSPAMQGFVISSIMVGGVLGVGFSGFLGDAIGRRKVLMLAAALFAISAVISSISTSAFMLIFARIVGGLGIGMASALSVTYITECAPPSIRGRLSSLYQLFTILGISITFFVNLGIVNMGSETWRVSTGWRYMLACGTVPAIVFLITLFFVPESPRFLVKSGNIKKAAAVLTKINGAEIAKQELDSISKSLATENDSSLGQLLQPGLRRALLIGIFLAIFNQAIGMNSITYYGPEIFQMIGFKNNSSFLATSVIGVVEVFSTILAMFLIDKLGRKKLMEIGSAAMAVFMLLIGTSFYIKLSNGFVILIFIICFVVSFCISMGPIPWIMIPEIFPNHLRARATGIATIFLWGANWAIGQFTPMLLNGIGGAYTFWIFCGINVICFLVVTTKVPETKNKSLEEIEKFWIPKSKQNAKGSSVGAK

SEQ ID NO: 11620 - DNA, 1368 bp, Clostridium acetobutylicum ATCC 824
  CDS (1)..(1368): transl_table=11
atgaataaaaaaatatctccagcactaatttatttctttggagccttcggtggatttatgtttggatatgatattggaataattaatggtgctttacctggaattaatgcaacttggcacgtaagttcttggttagaaggatttatcacttctggattgtttgttggagctatgataggagcctcattaatggcttcactagcagataggtttggtcgtcgtagaatgattatgtggagtgcaattgtgtttgcacttggtgcattaggttctgccgtttctactagtactaatcttttaatcggtgctcgtgttattttaggagtagctgtaggtggagcttctgctttagttccaatgtatatgggagaaattagccctgctgaaacacgtggaaaactatctggtttaaatcaattaatgataactgttggaatgcttttctcatatggtgtaaattttgcgtttgctggtgcatttgaaggatggcgttggatgcttggaggagctatggtacctgcaatggtactattaattggaacatttatacttccagagtcaccaagatttttagctagaataggaaagacagaattagcaaaacaagtacttcagactttacgttcaaaggaagaggcagaaactgaatatcaagagattattaattcaaaacatactgaaacaggttcttttggagatttatttgcaaaacaggctttgccagctgtaattgcaggctgtgggttaacacttcttcaacaaattcaaggtgcaaacactattttctactattcatcacaaattttatccaatgtttttggatcagcaaatggtggaactattagtactgttggaattggtgtggttctagtattagcaactattgtaactttattggttgtagacaaattcaaacgtcgtacattatttatgactggttctattggaatgggcgcatctctattattagttggattaatttatccatactctgaagctaaacatgcgtgggcaacttggttagtattcttcttcatatgtttatacgttgttttctatgcatactcttgggcagctactacatggattgttgttggagaattattcccaagtaatgttagaggacttgcaacaggtattgcatcagcagtaaactggtttggtaacattttagttgctttattcttcccagtattacttgaaactgtaggtttatctgtaatcttcttcggttttgctgcaatttgtatcataggatttttatttgcaaaatatgttctttatgaaacaaaaggaaaatctttagaagaaattgagacatatttgtacaatcgttctattggaaaagttagaggattaaatgagtag

SEQ ID NO: 11621 - protein, 455 aa, Clostridium acetobutylicum ATCC 824
MNKKISPALIYFFGAFGGFMFGYDIGIINGALPGINATWHVSSWLEGFITSGLFVGAMIGASLMASLADRFGRRRMIMWSAIVFALGALGSAVSTSTNLLIGARVILGVAVGGASALVPMYMGEISPAETRGKLSGLNQLMITVGMLFSYGVNFAFAGAFEGWRWMLGGAMVPAMVLLIGTFILPESPRFLARIGKTELAKQVLQTLRSKEEAETEYQEIINSKHTETGSFGDLFAKQALPAVIAGCGLTLLQQIQGANTIFYYSSQILSNVFGSANGGTISTVGIGVVLVLATIVTLLVVDKFKRRTLFMTGSIGMGASLLLVGLIYPYSEAKHAWATWLVFFFICLYVVFYAYSWAATTWIVVGELFPSNVRGLATGIASAVNWFGNILVALFFPVLLETVGLSVIFFGFAAICIIGFLFAKYVLYETKGKSLEEIETYLYNRSIGKVRGLNE

SEQ ID NO: 11622 - DNA, 1374 bp, Bacillus subtilis subsp. subtilis str. 168
  CDS (1)..(1374): transl_table=11
atgaaaaagcagtcaaatatatggctttattttttcggagctcttggaggcgcgttatatggctatgataccggagtgatttccggagctattttatttatgaaaaaggagttaggcttaaacgcgtttacagaaggtcttgttgtcagctccttgctggttggggcgatattgggctcaggagcggccggcaagctgactgaccgtttcggaagaaaaaaagcaattatggcagccgcgctgctgttttgtataggcggtcttggtgtggcactggccccaaatacaggagtcatggtgctgtttcgcatcattttgggacttgcagtcggaacatcgacgacaatcgtacccctttatttatctgaactggcgccaaaacataaacgcggggcgctgtcatcactgaatcagctgatgatcacggtcggcatccttctttcttacattgtcaattacatatttgccgatgccgaagcgtggcgctggatgcttggattggctgctgtgccgtcattgctcttgcttattggcattttgtttatgccggagagcccgcgctggctgttcacgaatggcgaagaaagcaaagcgaagaaaattcttgaaaaattgcgtggcacaaaagatattgatcaggaaatacatgatataaaagaagcggaaaagcaggatgaaggcggtctgaaggagctgttcgatccatgggtgcgcccagcgcttattgcaggtttgggactcgcttttttgcagcaatttatcggaacgaatacgatcatctactatgcgccaaagacctttacaaacgtcggattcggaaactccgcttcgattttaggcacggtcggaatcggcacagtcaatgttctcatgacattagtagcgattaaaatcatcgacaagattggaagaaagccgttactgctattcgggaatgcgggcatggtgatcagcttgatcgttctcgctttagtaaatctctttttcaataacactccggctgcctcatggacgaccgtcatttgtttaggcgtgtttatcgttgtctttgcggtcagctggggaccggttgtgtgggtgatgcttcctgaattgttcccgcttcacgtcagaggaatcgggaccggtgtttcgaccttaatgttgcacgttgggacactgattgtttcattaacctatccaatattaatggaagcgatcggaatcagttatttattcctgatttatgccgcgatcggtatcatggcgttcttatttgtccgatttaaagtgacagagacaaagggaagaagccttgaagaaattgagcaggatttacgggacaaaaacggacagggaggagcggccggaaaacagcagactgtcggaacataa

SEQ ID NO: 11623 - protein, 457 aa, Bacillus subtilis subsp. subtilis str. 168; identical to SEQ ID NO: 4555

SEQ ID NO: 11624 - DNA, 1458 bp, Thermoplasma acidophilum DSM 1728; identical to SEQ ID NO: 4720
  CDS (1)..(1458): transl_table=11

SEQ ID NO: 11625 - protein, 485 aa, Thermoplasma acidophilum DSM 1728; identical to SEQ ID NO: 4721

SEQ ID NO: 11626 - DNA, 1560 bp, Caulobacter crescentus CB15
  CDS (1)..(1560): transl_table=11
gtggtcgtcagaaccaccgcttgcgcgctgataccggtaacactaatgtcgccggcaaccaaaggtccgacaaggaccagtagggcatcaacgggccggtacggccccatggggaggacacctgtggcttcagtatccaacgccggtcccagcgccggcatgagcgcggacggcgggaaggtcaacatgaccttcgtcgccgcgatcgtcgccgtcgccacgatcggcggcttcatgttcggctacgacagcggcgtcatcaacggcacgcaagagggcctggaaagcgccttcaatctcagcaagctgggcaccggcctgaatgtcggcgccatcctgatcggctgcgccatcggcgccttcgccgccggccgcctggccgacgtgtggggccgccgcacggtgatgatcatctcggccctgctgttcgtgatcagcgccatcggcaccggcgcggccgagagctcgatcgtgttcatcatcttccgcctgatcggcggtctgggcgtcggcgccgccagcgtgctgtgcccggtctacatctcggaagtcacgcccgcgaacatccgcggccgcctgtcgtccgtgcagcagatcatgatcatcaccggcctgaccggcgccttcgtggccaactacgccctggcccacaccgccggcagctcgacggccgagttctggctgggcctgcccgcctggcgctggatgttctggatgcagatcattcccgccggcgtgttcttcctctgcctgctgggcattcccgaaagcccccgctacctcgtggccaagggcaaggacgcccaggccgaagcgatcctctcgcgcctgttcggcgcgggccagggcgccaagaaggtcgaggaaatccgcgcctcgctgtcggccgatcacaagcccacgttctcggaccttctggatccgacgaccaagaagctgcgcgtcatcctgtgggcgggcctcgtcttggccgtgttccagcagctggtgggcatcaacatcgtcttctactacggctcggtgctgtggcagtcggtgggcttcaccgaggacgacagcctgaagatcaacatcctgtcgggcacgctgtcgatcctggcctgtctgctggccatcggcctgatcgacaagatcggccgcaagccgctgctgctgatcggttcggccggcatggccgtgacgcttggcgtgctgacctggtgcttctcgaccgccaccacggtcaacggcgccctgaccctgggcgaccagatcggcctgaccgcccttatcgccgccaacctctacgtgatcttcttcaacctctcgtggggtccggtcatgtgggtgatgctgggcgagatgttccccaaccagatgcgcggctcggccctggccgtctgcggcttcgcccagtggatcgccaacttcgccatctcggtcagcttcccggccctggccgcggccagcctgccgatgacctacggcttctatgcgctgagcgctgtcgtctcgttcttcctggtccagaagctggtccacgaaacgcgcggcaaggaactggaagcgatgcaggggtga

SEQ ID NO: 11627 - protein, 519 aa, Caulobacter crescentus CB15; identical to SEQ ID NO: 4547

SEQ ID NO: 11628 - DNA, 1434 bp, Salmonella typhimurium LT2
  CDS (1)..(1434): transl_table=11
atgtccacatcagatagttgttataatacgggttacatattacgcatctgcgcgattgccgcactgggcggaatattatttggctacgatactgctgttatttcaggtgcgattggttcactgaccagctactttcatctatctcctgctgagaccggctgggcggtttcctgcgttgtggtggggtgcgttattggttcgtttagcgccggatatttatccaaacgttttggacgcaagaaatcattgatggtttcagcgctgttattcactatttccgcagtgggcacctccctctcctacacgttcacccattttgtgatttatcgcattatcggtggactggcagtcggcctggcggcaacagtatcaccgatgtatatgtctgaagtctcaccgaaaaacatgcgcggcagagcattaagtatgcagcagttcgctatcgttttcggtcagattctgatcttctacgttaactacaaaatagcatcgattgcagcggatacctggctcattgaacttggctggcgctatatgtttgctgcgggtattattccctgcattttgttctgtattttagtctttttaatcccggaatctccccgctggatgatgatgattggtcgcgaggaggagacgctaaaaatactgaccaaaatatccaacgaagaacatgccagacatcttcttgccgatataaaaacctcactgcaaaatgaccaactaaacgcccatcaaaaactcaattaccgcgacgggaacgtgcgtttcatcctgatcctgggctgcatgatcgctatgctgcaacaggtaacaggggttaacgtcatgatgtattacgcgccaatcgtccttaaggatgtgaccggtagcgcccaggaggccctgttccagacaatctggatcggcgtgattcagcttatcggttccattattggcgcaatgattatggataagatggggcgtttgtcgctgatgcgtaaaggcactatcggcagcatcatcggcttgttgctcacctcatgggcgctgtacagccaggcaaccggttatttcgcgctattcggtatgctgttctttatgattttctacgcgctttcctggggcgtgggcgcatgggtgcttatttctgaaatattccctaaccggatgaggtcgcagggaatgagtatttcggtcggatttatgtggatggcaaactttttagtttcgcaattcttcccgatgattaatgaaaacccgtatttactttcgcatttccacggcgcatttccaatgtggatatttgccatctgctgcatcttcagttacttctttatctgccgttacctgccggaaacaaaaggcatttcgctggagaaaatggagagcgtagtgttagcaaaacgcagaaaaaaactgcagccaattcaaaccgaacgttattctgattaa

SEQ ID NO: 11629 - protein, 477 aa, Salmonella typhimurium LT2
MSTSDSCYNTGYILRICAIAALGGILFGYDTAVISGAIGSLTSYFHLSPAETGWAVSCVVVGCVIGSFSAGYLSKRFGRKKSLMVSALLFTISAVGTSLSYTFTHFVIYRIIGGLAVGLAATVSPMYMSEVSPKNMRGRALSMQQFAIVFGQILIFYVNYKIASIAADTWLIELGWRYMFAAGIIPCILFCILVFLIPESPRWMMMIGREEETLKILTKISNEEHARHLLADIKTSLQNDQLNAHQKLNYRDGNVRFILILGCMIAMLQQVTGVNVMMYYAPIVLKDVTGSAQEALFQTIWIGVIQLIGSIIGAMIMDKMGRLSLMRKGTIGSIIGLLLTSWALYSQATGYFALFGMLFFMIFYALSWGVGAWVLISEIFPNRMRSQGMSISVGFMWMANFLVSQFFPMINENPYLLSHFHGAFPMWIFAICCIFSYFFICRYLPETKGISLEKMESVVLAKRRKKLQPIQTERYSD

SEQ ID NO: 11630 - DNA, 1644 bp, Schizosaccharomyces pombe 972h-
  CDS (1)..(1644)
atgggtaagacattgaccattgtcatgttggtcttcgtgtccatggccggatggatgtttggcgccgataccggttccattggtggtatcaccaacatgagagatttccaatctcgtttcgcagatcggtataatccggtgactgacacgtattcgtattcttcagcgcgacaaggtttaattactggtatggttaacgttggttctatgactggttgtattttgtcttctcctcttatggatcgcattggcaagcgtgtttccattatgttttggactattgtttatttgattggtattattcttcaagttaccgctgtcccatcttgggtccaaatcatggttgctaagatttggactggtcttgccattggtgccttgtctgtgcttgcccccggtttccaatctgaggttgctcccgctacccttcgtggtaccattgtcaccacctatcaattggctgtcactggtggtattttcattgccgcttgtatcaacatgggtactcacaagttgcacaagactgctcaatggcgtgtatccatgggtattaacttgctttggggtattatcatgttcatcggtatttctttccttcctgaatcccctcgttatttgattgctattggtaaagatgaagaggctcttgacattatgtgcaaaaacaacgttcttcctcgtgaacacgaaattattcaaacggaataccatgtcattaaaactgactgtgaagctgaaatggccggtggtcccgctacttggggtgacattctaggtgcggatattcgttatcgtaccttccttggtcttggtgtcatgtctcttcaacaacttaccggtgataactactacttctactatggtttcgaggtgtttgagggtactggtatgaactctccttatctttctgctttgattcttgatgccgttaactttggatgtacgtttggtggtcttttcgtcctagagttctttggtcgtcgtatgccattgattattggtggtgtttggcaatccattactttcttcatttacgcagctgttggtaatcgtgctcttactcgtaagaatggtacctcaaaccatcgtgccggtgccgttatgattgtgttctcatgtcttttcattttcagttttgctcaaacttggggtcctgccgcatacgttatcgttggtgaatcgtatcccattcgttatcgttccaagtgtgctgccgtcgctaccactggtaactggttgtggggtttccttattactttctttactcccttcattagtgactccattggattcaagtatggttatattttcgctgcctgtaatttgtgtgctgcttgtattattttcttgtttgcccatgaaaccaaaggtcttaccttggaagagattaacgaactgtatctctccggcgctaagccctggatgcctaggcccgagaatctcggacaagctgcaaagcaacaacaagaggttcttgaaaaatctcgtggtgttcaaggtgaaagtgccgctcatcttgaaaacgttgacaatgagggtatggaggatacttcgagtaacgacattacatcttctacctcttcttctgaaggccgtgctaagcctgagtctaactatgttgatgaacaagatcgctacgcataa

SEQ ID NO: 11631 - protein, 547 aa, Schizosaccharomyces pombe 972h-
MGKTLTIVMLVFVSMAGWMFGADTGSIGGITNMRDFQSRFADRYNPVTDTYSYSSARQGLITGMVNVGSMTGCILSSPLMDRIGKRVSIMFWTIVYLIGIILQVTAVPSWVQIMVAKIWTGLAIGALSVLAPGFQSEVAPATLRGTIVTTYQLAVTGGIFIAACINMGTHKLHKTAQWRVSMGINLLWGIIMFIGISFLPESPRYLIAIGKDEEALDIMCKNNVLPREHEIIQTEYHVIKTDCEAEMAGGPATWGDILGADIRYRTFLGLGVMSLQQLTGDNYYFYYGFEVFEGTGMNSPYLSALILDAVNFGCTFGGLFVLEFFGRRMPLIIGGVWQSITFFIYAAVGNRALTRKNGTSNHRAGAVMIVFSCLFIFSFAQTWGPAAYVIVGESYPIRYRSKCAAVATTGNWLWGFLITFFTPFISDSIGFKYGYIFAACNLCAACIIFLFAHETKGLTLEEINELYLSGAKPWMPRPENLGQAAKQQQEVLEKSRGVQGESAAHLENVDNEGMEDTSSNDITSSTSSSEGRAKPESNYVDEQDRYA

SEQ ID NO: 11632 - DNA, 1476 bp, Corynebacterium glutamicum ATCC 13032
  CDS (1)..(1476): transl_table=11
atggctagtaccttcattcaggccgacagccctgaaaaaagtaagaagctgcccccactcacagaaggtccgtatagaaagcggctattctacgttgcactagttgcgacgtttggtgggctgctcttcggatatgacaccggagtaatcaacggtgcactcaacccaatgacacgtgagctcggactaaccgcgttcaccgagggtgttgtaacttcttccctgctgtttggtgcagcagctggtgcgatgtttttcggtcgcatttccgacaactggggtcgccggaaaacaatcatctcacttgcagtagctttctttgtcggcaccatgatctgcgtgtttgctccatcttttgcagtaatggttgtcggacgtgtgcttcttggactcgcagttggtggcgcttccactgttgtccctgtctacctggctgaacttgctccttttgaaatccgtggctcactggctggccgtaatgagttgatgattgttgttggtcagctcgcagcttttgtcatcaatgcgattattggaaatgtttttggacaccacgatggtgtgtggcgctacatgctggcaattgccgcaatcccagcaattgccctcttctttggaatgctccgagttccagaatccccacgctggcttgttgagcgaggacgcattgatgaggctcgcgcagttcttgaaaccattcgccctctagaacgtgcccatgcagaagttgctgatgttgaacacctagcaagagaagagcacgccgtttccgagaagtccatgggcttaagggaaattttgtccagcaagtggcttgtgcgcatcctcctggtaggtatcggattgggtgtcgcacagcagctgaccggcatcaactccatcatgtactacggccaggttgttctcattgaggctggtttctccgagaatgcagctctgatcgccaacgtggcgccaggagtgatcgcagttgtcggtgcattcatcgcactgtggatgatggatcgtatcaaccgccgtaccaccctcattaccggttattctctcaccaccattagccacgtattgatcggtatcgcatccgtagcattcccagtcggcgatcctcttcgcccctacgttatcttgactctggttgtggtcttcgtgggatccatgcagaccttcctcaacgtagctacctgggttatgctctctgagctcttcccgctggcaatgcgcggtttcgcaatcggtatctcagtgttcttcctctggatcgcaaacgcgttcctcggattgttcttcccaaccatcatggaagcagtaggactaaccggaaccttcttcatgttcgccggaatcggtgtggttgccttgatcttcatctacacccaggttcctgaaactcgtggacgtaccttggaggagattgatgaggatgttacttccggtgtcattttcaacaaggacatccgaaaaggaaaggtgcactaa

SEQ ID NO: 11633 - protein, 491 aa, Corynebacterium glutamicum ATCC 13032
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 11634 - DNA, 1527 bp, Corynebacterium glutamicum ATCC 13032
  CDS (1)..(1527): transl_table=11
atgacggacatcaaggccacatcaagtacatcggccactacagcaccaacagcaggccgaccagcgcgtcgacttggacaaatttccctcgtcgcctgtctcggcggacttctcttcggctatgacaccggtgtcgccaacggcgccgaaggccacatggcacaagaactcggactcaacgtgctgcagctcggcgttgtcatcagttcactggttttcgctgcagcctttggcgcgctgttcgctgggcgtatctcggacgaaatcgggcgtcgaaaagcaattatcactttgtccgtgctgttcttcctcggatcaatcctcgtcgtattctcccccgccggtgagctggggcagttctacggaccaggatttgccaccttggtcaccgggcgcatcatgttgggtctcgcggttggcggcgcctccacagtagttccggtgtacctcgctgaactcgcaccactagaaatccgcggctccctgaccggccgaaacgagcttgctatcgtcaccggccagctgcttgccttcgtgatcaacgcgcttatcgccgtcaccctacacggagttattgatggaatctggcgcatcatgttcgccgtctgtgccctccctgccgtcgccctcttcctcggcatgctgcggatgccggaatcaccacgctggctggtcaaccaggggcgttacgacgacgcccgccgcgtcatggagaccgtccgtacccctgagcgtgcgaaagccgaaatggatgaaatcatcgcggtgcactctgaaaacaatgcggcacttcctggtgttaagcagtcttcgggccaggcttcaggccaggtttctagcaagcacacccacatgtccatcggcgaagtcctcagcaacaaatggctggttcgtctgctcatcgccggcatcggtgttgcagttgcccagcagctcaccggcatcaacgccatcatgtactacggaacccgcgtcctcgaggaatccggcatgagcgcagaaatggctgtggttgccaacattgctttcggtgccgttgccgtcatcggtggactgatcgcactgcgcaacatggaccgcctggatcgccgcaccaccttcatcatcggcctgtcactgaccaccaccttccaccttttgatcgcagctgccggcactctccttccagaaggtaactccattcgaccattcgccatcatgatccttgttgttgggttcgtgctctccatgcagactttcctcaacgttgcagtgtgggtgtggctggcggaaatcttcccagtccgaatgaagggtatcggcaccggtatttcggtattctgcggttggggcatcaatggcgtcctagcgttgttcttcccagcactggtctccggcgtgggtatcaccttctccttccttatcttcgcagtcgtcggagtcattgccctggcgttcgtcaccaagtttgttcctgaaacccgtggccgctcacttgaagaactcgatcacgcagcattcaccggccagatcttcaagaaggcttaa

SEQ ID NO: 11635 - protein, 508 aa, Corynebacterium glutamicum ATCC 13032
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 11636 - DNA, 1419 bp, Streptomyces coelicolor A3(2)
  CDS (1)..(1419): transl_table=11
gtggccagcacatcgcaggcgcccagtccaggagccgggacggctcatcccgatcatctcgggcacgtcatcttcatcgcggcggcggccgcgatgggcggtttcctgttcggttacgacagttccgtgatcaacggtgcggtcgaggcgatccgggaccgctacgacgtcggttccgcggtgctggcgcaggtcatcgccgtggctctgatcggctgtgccatcggtgccgcgaccgcgggccgtatcgcggaccgtatcggccgtatccgctgcatgcagatcgccgcggtcctgttcacggtgagcgccgtcggctccgcgctgcccttcgcgctgtgggacctggccatgtggcggatcatcggcggcttcgcgatcggcatggcctcggtgatcggccccgcctacatcgccgaggtgtccccgcccgcctaccgcggccggctcggttccttccagcaggccgcgatcgtcatcggcatcgccgtctcccagctggtcaactggggtctgctgaacgccgccggcggtgaccagcgcggcgagctgatgggcctggaggcctggcaggtcatgctcggcgtcatggtgatcccggccgtcctgtacggcctgctgtccttcgccatccccgagtccccccgcttcctgatctcggtgggcaagcgcgagcgcgccaagaagatcctcgaggaggtcgagggcaaggacgtggacttcgacgcccgcgtcaccgagatcgagcacgccatgcaccgcgaggagaagtcctccttcaaggacctcctcggcggcagcttcttcttcaagccgatcgtgtggatcggtatcggcctgtcggtcttccagcagttcgtcggcatcaacgtcgcgttctactactcctcgacgctgtggcagtcggtcggcgtcgaccccgccgactcgttcttctactcgttcacgacgtcgatcatcaacatcgtcggcaccgtgatcgcgatgatcttcgtggaccgcgtcggccgcaagccgctcgccctgatcggctccgtcggcatggtgatcgggctggcgctggaggcctgggccttctccttcgacctggtcgacgggaaactcccggccacccagggctgggtcgccctgatcgccgcccacgtcttcgtcctcttcttcgccctgtcgtggggtgtggtcgtgtgggtcttcctcggcgagatgttccccaaccggatccgcgccgccgcgctgggcgtggccgcctccgcgcagtggatcgccaactgggccatcaccgcgagcttcccgtcactggccgactggaacctctccggcacctacgtgatctacacgatcttcgccgccctctccatccccttcgtcctgaagttcgtgaaggagaccaagggcaaggccctggaggaaatgggctga

SEQ ID NO: 11637 - protein, 472 aa, Streptomyces coelicolor A3(2)
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 11638 - DNA, 1446 bp, Xanthomonas campestris pv. campestris str. ATCC 33913
  CDS (1)..(1446): transl_table=11
atgtttccaggtgaacccatgtccagtgtctccattgacggcgcccccgatgccggcgagaacacccgtttcatcatcctgatcagctgcgtggccacgatcggcggctttctgttcggcttcgacagtggcgtgatcaatggcaccgtcgacgggctcaagcagaccttccagtccagcgccgccgagaccggcttcgaagttgcctcgatgctgctggggtgcgccatcggcgccttctttgccggccgcctggccgaccgctggggccgccgtgctgtcctgatcatttctgcggcgctgttcctgctctcggctatcggtgccggtgcctcgcacagctccggcttcttcatctttgcccgcgtgatgggcggctttgcggtaggcgcagccagcgtcatttcgccggcctacatcgccgaggttgcctccgcgcgctatcgcggccggctcgccaccatgcagcagatcgccatcatcagcgggctgttctgcgcgttcttgagcaactacctgctggccaatgccgccggtgcgtccaccgagccgttatggggcgggcaggcggcctggcgctggatgttctggatgcaggccatcccgtcgctgctgttcctgctgctgttgctggtcatccccgaaagcccgcgctacctggtggtcaagggccgtcgcgagcaggcgctggtggtgctcaagcggctgtacggtaacgcggccgcgcagaccaagctgggcgaaatctccgcctcgatgtcggccgaccagcacaagcccaagttctccgacctgatcagcaagaccaccggcaagatccgcccgatcgtatggattggcgtcggcctggcggtgttccagcaactggtcggcatcaacgtggtgttctattacggcgcggtgctgtggcaggcagtgggcttctccgaacaggacgccttgctgatcaacgtgctctccggcggcctcagcattggtgcctgcctggtcacggtgatgctggtcgacaagatcggccgcaagccgttgctgtggatcggctcggccggtatggcggtatcgctggcactggtgacctacgccttcgccaccgcctcgctggatcccaacggcaagctcgcgatgtccgatgccatgggcatgctcgcgctggttgccgccaacgtctacgtggtgttcttcaatgcctcgtggggcccggtgatgtgggtgatgctgggcgagatgtttcccaaccagatccgcggttcgggcctggccattgccggcgctgcacagtggacttccaacttcgccatcaccgtcagcttcccgatcctgctcggcagcatcggtcttgccggcgcctacggcatctacaccgttgccgccttcatctcggtgttcttcgtgctcaagtacgtctacgagacgaagggcaaggagctggagcagatggagggctga

SEQ ID NO: 11639 - protein, 481 aa, Xanthomonas campestris pv. campestris str. ATCC 33913
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 11640 - DNA, 1446 bp, Xanthomonas axonopodis pv. citri str. 306
  CDS (1)..(1446): transl_table=11
atgttcccaggtgaacccatgtccagtgtttccattgacggcgcccccgatgccggcgagaacacccgtttcatcatcctgattagttgcgtggccacgatcggtggcttcctgttcggcttcgacagcggcgtgatcaatggcaccgtcgacggcctgaaacagaccttccagtccactgccgcagagacgggcttcgaggtcgcctcgatgctgctgggctgcgccatcggcgccttctttgccggccgcctggccgaccgctggggccgccgcgcggtcctgatcatttccgcggcgctgttcctgctctcggccatcggggccggcgcctcgcacagctctgcctttttcatctttgcgcgcgtgatgggcggctttgcggtgggcgcggccagcgtcatttcgccggcctacatcgccgaggtcgcctccgcgcgctaccgcggccggctcgccacgatgcagcagatcgccatcatcagcgggctgttctgcgcattcctgagcaactacctgctggccaacgccgccggtgcctccaccgagccgctctgggccgggcaggccgcctggcgctggatgttctggatgcaggcggttccctccatcctgttcctgttgctgctgctggtcatcccggaaagcccgcgctatctggtggtcaagggtcgccgcgagcaggcgctggtggtgctcaagcgcctgtacggcaacgccgccgcgcagaccaagctgggcgagatttccgcctcgatggcggccgaccagcacaagcccaagttctccgacctgatcaacaaggccaccggcaagatccgccccatcgtctggatcggcattggcctggcggtgttccagcaactggtcggcatcaacgtggtgttctactacggcgcggtgttgtggcaggcagtgggcttctccgagcaggatgcgctgttgatcaacgtgctttccggcggcctcagcatcggtgcctgcctggtcacggtgatgctggtggacaagatcggccgcaagccgctgctgtggatcggctcggccggcatggccgtctcgctggccttggtgacctacgcgtttgccactgcctcgctggatcccaacggcaagcttgcgatgtccgatgccatgggcatgctcgccctggtggccgccaacgtctatgtggtgttcttcaacgcctcgtggggcccggtgatgtgggtgatgctgggcgaaatgttccccaaccagatccgcggctcgggcctggccattgccggtgccgcgcagtggacgtccaacttcgccatcaccgtcagcttcccgatcctgctcggcagtatcggtctggccggtgcctacggcatctacaccgtcgccgccttcatctcggtgttcttcgtactcaagtacgtctacgagaccaagggcaaggagctggagcagatggagggctga

SEQ ID NO: 11641 - protein, 481 aa, Xanthomonas axonopodis pv. citri str. 306
MFPGEPMSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 11642 - DNA, 1392 bp, Oceanobacillus iheyensis HTE831
  CDS (1)..(1392): transl_table=11
atgattcaagataagaaaatatcaagtaagttcatttatttttttggagcttttggaggtattctctttggttatgatattggtgttatgacaggagctttaccttttctgcaaagtgattggaatcttcaaaacgatcctactgcaataggatggattacttcatcgttaatgctaggtgcaatctttggaggggcgctatcaggtcaattatcagatcgtataggaagacgtaagatgattttaatcgcttctattatttttgcactaggttctattatggctgggatttctcctcataatggcattctatttatgattgtatctcgcattattttaggacttgctgtaggagcagcttcagctctagtaccagcatatatgtctgaaatggcccctgcacgtttacgtggacgtttatcaggaattaatcaaacgatgatagtttcagggatgttactctcgtatatcgttgcatttgtattaaaagatttaccggaaacaatggcttggcgcttaatgcttagtttggcagcggtaccagcgttaattttattcttcggagtattaagattaccagaatcacctcgttttctaatcaaaaataataaaataaacgaagctcgtaaagtattgagttatattcgtccaaaagaaaaaattgaaagcgaaatctctcaaattcaagcatcaacaaaatatgaagaaaaagcaagccaaaaaacatcttggggaacactgttaagcggtaaatatcgttatttagtaattgctggtttaggtgtagctgctttccaacaattccagggtgcaaatgctattttttattacatcccgttaattgtagagaatgcgacagggaatgcagcaagttcagctcttatgtggccgataattcaagggataatattagtactaggttcgctcctattcctactaattgctgacaagttcaatcgacgtacattattaacacttggtggaactgttatgggattatcgtttatattaccggcgattttaaatatcgttatcccgaatgcaagtccaatgatgatcgttgtattcttaagtatctacgttgctttttattcgttcacatgggctcctttaacttgggttatagttggagaaatcttcccgctagtcattagaggacgttcttcgggattagcgtcatcgtttaattggatcggatctttcttagttggattattattcccagttatggttgcttcgatggcacaagaagcagttttcgcaatttttggtgcgatttgtctgctaggtgtactatttgttcgattatgtgtacctgaaacgcgtggtcgttctcttgaggaaattgagaaaataggagaaagtaaacagcttcataagaaaacagtttaa

SEQ ID NO: 11643 - protein, 463 aa, Oceanobacillus iheyensis HTE831
MIQDKKISSKFIYFFGAFGGILFGYDIGVMTGALPFLQSDWNLQNDPTAIGWITSSLMLGAIFGGALSGQLSDRIGRRKMILIASIIFALGSIMAGISPHNGILFMIVSRIILGLAVGAASALVPAYMSEMAPARLRGRLSGINQTMIVSGMLLSYIVAFVLKDLPETMAWRLMLSLAAVPALILFFGVLRLPESPRFLIKNNKINEARKVLSYIRPKEKIESEISQIQASTKYEEKASQKTSWGTLLSGKYRYLVIAGLGVAAFQQFQGANAIFYYIPLIVENATGNAASSALMWPIIQGIILVLGSLLFLLIADKFNRRTLLTLGGTVMGLSFILPAILNIVIPNASPMMIVVFLSIYVAFYSFTWAPLTWVIVGEIFPLVIRGRSSGLASSFNWIGSFLVGLLFPVMVASMAQEAVFAIFGAICLLGVLFVRLCVPETRGRSLEEIEKIGESKQLHKKTV

SEQ ID NO: 11644 - DNA, 1554 bp, Bifidobacterium longum NCC2705; identical to SEQ ID NO: 4696
  CDS (1)..(1554): transl_table=11

SEQ ID NO: 11645 - protein, 517 aa, Bifidobacterium longum NCC2705; identical to SEQ ID NO: 4697

SEQ ID NO: 11646 - DNA, 1476 bp, Shigella flexneri 2a str. 301
  CDS (1)..(1476): transl_table=11
atgaatacccagtataattccagttatatattttcgattaccttagtcgctacattaggtggtttattatttggctacgacaccgccgttatttccggtactgttgagtcactcaataccgtctttgttgctccacaaaacttaagtgaatccgctgccaactccctgttaggattttgcgtagccagcgctctgattggttgcatcatcggcggtgccctcggtggttattgcagtaaccgcttcggccgtcgtgattcacttaagatttctgctgtcctgttttttatttctggtgtaggttctgcctggccagaacttggttttacctctataaacccggacaacacagtacctatttatctggcaggttatgtcccggaatttgttatttatcgtattattggcggtattggcgttggtttagcctcaatgctttcaccaatgtatattgcggaactggctccagctcatattcgcggaaaactggtttcatttaaccagtttgcgattattttcgggcaacttttagtttactgcgtaaactattttattgcccgttccggtgatgccagctggctgaatactgacggcaggcgttatatgtttgcctcggaatgtatccctgcactgctgttcttaatgctgctgtataccgtgccagaaagtcctcgctggctgatgtcacgcggcaagcaagaacagacggaaagtatcctgcgcaaaattatgggcaacacgcttgcaactcaggcagtacaggaaattaaacactccctggatcatggccgcaaaaccggtggtcgtctgctgatgtttggcgtgggcgtgattgtaatcggcgttatgctctccatcttccagcaatttgtcggcatcaatgtggtgctgtactacgcgccggaagtgttcaaaacgctgggggccagcacggatatcgcgctgttgcagaccattattgtcggagttatcaacctcacctttaccgtactggcaattatgactgtggataaatttggtcgtaagccactgcaaattatcggcgcactcggaatggcaatcggtatgtttagcctcggtaccgcgttttacactcaggcatcgggtattgtggcgctactgtcgatgctgttctatgttgccgcctttgccatgtcctggggtccggtatgctgggtactgctgtcggaaatcttcccgaatgctattcgtggtaaagcgctggcaatcgcggtggcggcccagtggctggcgaactacttcgtctcctggaccttcccgatgatggacaaaaactcctggctggtggcccatttccacaacggtttctcctactggatttacggttgtatgggcgttctggcagcactgtttatgtggaaatttgtcccggaaaccaaaggtaaaacccttgaggagctggaagcgctctgggaaccggaaacgaagaaaacacaacaaactgctacgctgtaa

SEQ ID NO: 11647 - protein, 491 aa, Shigella flexneri 2a str. 301
MNTQYNSSYIFSITLVATLGGLLFGYDTAVISGTVESLNTVFVAPQNLSESAANSLLGFCVASALIGCIIGGALGGYCSNRFGRRDSLKISAVLFFISGVGSAWPELGFTSINPDNTVPIYLAGYVPEFVIYRIIGGIGVGLASMLSPMYIAELAPAHIRGKLVSFNQFAIIFGQLLVYCVNYFIARSGDASWLNTDGRRYMFASECIPALLFLMLLYTVPESPRWLMSRGKQEQTESILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQASGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 11648 - DNA, 1404 bp, Staphylococcus epidermidis ATCC 12228
  CDS (1)..(1404): transl_table=11
atgttgaaacgctttcataaaggcattataattagtctagctatagaaaaaggaatgatacgaatgaaagcaaataagtatttaatctttattttgggagcacttggtggcttattatatggttatgataatggtgtgatttccggtgctttattatttatacataaagacatacctctcaatagtacaactgagggtatcgttgtgtcttcaatgttaattggcgcaatagtcggtgcgggaagcagtgggccacttgctgataaattaggtcgtcgacgtctagtaatgctcatcgctattgtatttattattggggcactgattcttgctgcatcaaccaatttagcattattaattattggacgtttaattattggtttagcagtgggtggttcgatgtctacggtacctgtttatttaagtgaaatggcaccgacagaatatcgtggctcactaggttcacttaatcaactaatgattacaattggtattttagcagcatatttagtcaactatgcatttgcggatattgagggttggcgttggatgctaggattagcagttgttccatcggttattttacttgtgggtatttattttatgcctgagagtccaagatggttacttgaaaatagaaacgaagaagccgctcgtcaagtgatgaagattacttatgacgatagcgaaattgataaagaacttaaagagatgaaagaaattaacgctatctctgaatctacatggacagtcattaaatcaccatggttaggtagaatattaattgtaggttgtatatttgctattttccagcaatttattggtatcaatgcagtcattttctattcatcttcaatctttgctaaggctggactgggtgaagcggcgtctatattaggttcagttggtataggaactattaatgttcttgtaacaatagttgccatttttgtagtagataagattgatcgtaaaaaactacttgttggtggtaatattggtatgattgcctcattattaattatggcaatcttaatttggacaattggaattgcttcatcagcgtggattattattgtttgtttatcattatttattgtattctttgggatttcttggggacctgttctatgggttatgctacctgaattattcccgatgcgcgcacgtggcgctgctacgggcatttcagcgcttgtgctaaatatcggaacgcttatcgtgtcattgttcttcccaatattaagtgatgcattaagtacagaatgggtatttttaatctttgcattcataggtgttttagcgatgattttcgtaattaaattcttaccagaaacacgcggacgtagtttagaagaaatagaatatgaattacgtgaacgtacaggagcaagaactgaataa

SEQ ID NO: 11649 - protein, 467 aa, Staphylococcus epidermidis ATCC 12228
MLKRFHKGIIISLAIEKGMIRMKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 11650 - DNA, 1401 bp, Lactobacillus plantarum WCFS1
  CDS (1)..(1401): transl_table=11
ttgaataagcagaaaaaggtttccagtaaatttattttcttctttggttcgtttggtggcattctctttgggtatgacattggggtaatgacaggcgcattaccgtttctgaagaccgattgggcattgactaatgcaacattggttgggtgggtgacatcagcagtaatgtttggcgcaatttttggtgctgcaattgccggtcagttggcggatcgactaggtcgtcggcggatgatcttgatgtcatcattgatttttgcaattggctcgattctgtgtggcttttcacctaacaacggaacttactatttgattggcatgcggatcttcttggggttagccgtgggtgctgcttctgcactagtacctgcatatatgtctgaaatggcaccagcacgattgcgcggtagtttatctggaattaatcagaccatgattgtgtcggggatgttaatttcttacattgttgattatattctgaaggatctacccgagaatatgtcatggcggctaatgttaggattggcagcggttccagcgattattctctttctgggagtcttgaagttgccggaatccccacggttcttaattaaagccaatcggttagacgaagcccgtcaagttttatcttttgttcgtaaaccagatgaagttgacagtgaagttaaagcgattcaatcaacagcccaaacggaggctaacaatttagaaaagacctcctgggcaaccttgttcaatgggaaatatcggtacttagtcatggcaggtgttggggttgcagcttttcaacaatttcaaggtgctaatgcaatcttttactacattccgttaatcgttgaaaaggcaaccggtagtgctgcaagttcagcactaatgtggccaattgttcaaggcatcttattagttttaggatcattactttacatttggattgctgaaaaattcaatcggcggactttattgatgttgggtggttccgtcatggcattatcattcctgctaccagctgttattaatagtttggtgccaaatgcaagtccaatgatgattgttgtcttcttatcgatttacgtggctttctactcattcacttgggcaccattgacttgggtgctcgtgggtgaagtctttccgcttgcagttcgcggtcgggcatcaggcttagcttcttcattcaattggattgggtcatgggctgtggggttattattcccaattatgacggcttcaatgtcacaagaagcagtttttgcggtgttcggtgtgatctgtgtattaggagtgctattcgttcgattctgtgttccagaaactcgtggtcactcacttgaagagattgaagcagcaggaacgaatcatcacaaacaagtacccgtacaacaagcgagtcattaa

SEQ ID NO: 11651 - protein, 466 aa, Lactobacillus plantarum WCFS1
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 11652 - DNA, 1407 bp, Bacteroides thetaiotaomicron VPI-5482
  CDS (1)..(1407): transl_table=11
atgaagtctacaattaactttggctatcttattttcctttctgttgtagcagctttgggaggatttttgttcggatatgatactgctgttatatccggaacaatcgctcaggttactcaactttttcaactggatacgttgcaacaggggtggtatgtgggatgtgctttaataggttctatcgtcggtgttctttttgccggtatcctgagtgataagctgggacgaaaaatgacgatgattatttcagcgactctgttttctacatcggctttaggttgtgcgatctccgcagacttcacccaattggtagtctatcgtattattggtggagttggtattggtgttgtgtcgattgtttctcctttgtatatatctgaagtggctgtggcacaatatagagggcgtttggtatctttatatcaattggctgtgacagttggatttttaggagcttatttgattaactatcaattgctggcttatgctgaaagtggtaatcagttaagtatggactggttgaataagatatttgttactgaagtctggcgaggaatgttgggaatggaaacattgccggctgtgttattcttcatcattatcttctttattccggagagtcctcgttggctgatcgtaagaggtaaagaagaaaaagctgtcaatatattagaaaggatatataattcagtttcagaggctgcaagtcaattaaaagaaacgaaatctgtattgacgtctgaaacaaaatctgaatgggctatgttaatgaaacccggaatttttaaagcggtcatcattggtgtatgcattgctattttgggacagttcatgggtgtaaatgctgtactttattatggcccttccattttcgaaaacgcaggactttcaggaggagattctttgttttaccaagttctcgtaggactagtcaacactctgaccaccgttcttgctcttgtgatcattgacagggtcggccgcaagcaactggtctattacggagtttcgggtatggttgtctccctcctgctgatcggcgtttacttcctcttcggtgattcctggggagtatccagcctcttcctgcttgttttcttcctgttctatgtattctgctgtgccgtctccatctgtgccgtggtgttcgtgctcctttcggagatgtaccccaccaaggtacgcgggctggcgatgtccattgcaggattcgccctgtggataggaacgtacctgatcggacagttaaccccctggatgctccagaatctcacccccgccggaacattcttcctgttcgcagtcatgtgcgtgccgtatatgctcatcgtatggaaactcgtgccggagaccacaggaaagtcactggaagagattgaaagatactggacccggtcggaacagtag

SEQ ID NO: 11653 - protein, 468 aa, Bacteroides thetaiotaomicron VPI-5482
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 11654 - DNA, 1407 bp, Bacteroides thetaiotaomicron VPI-5482
  CDS (1)..(1407): transl_table=11
atgaaaacaacaattaatctgggttatatcatattcctttcagtcgttgctgctttaggaggctttctgttcggttatgacacagctgtcatatccggcacaatagctcaggtgacacatctgtttcagttggacaccttgcaacaaggatggtatgtaggatgcgcattgatcggatcgattgtcggtgttctcttttccggaatattgagcgacagcatcggacgtaaaagaacaatgatactttctgccattctgttttctacatcagcaatcggctgtgctttttgcattgactttaaccagttagttgtttatagaatcataggtggcatcggaattggtgttgtttctattgtatctcctctttacatttccgaagtttccgtcgcacaattcagaggcaggatggtctccctgtatcaactggccgtaactgtcggttttctaggagcttatcttgtcaactaccagttattggcatattcagagagtggaaaccacttacctatcgcctggttagaaaaaatagtagttacagaagtgtggagaggtatgttaggcatggagacattaccagccataatattctttattattatctttttcatacccgaaagccccagatggctgatagtaaaaggacaagaaaggaaagccacttatattctggaaaagatctacaattcatttaaagaggctgatttccagctaaacgagacaaaatccgtccttgtttccgagacccgttcagaatggtctatccttctgaaaccaggtattctgaaagcagtcattatcggtgtatgtattgctattctgggacagttcatgggggttaatgcagttctttactacgggccttccatttttgagaatgccggtctttcaggaggggattctctgttctatcaggttcttgtaggacttgtgaatacactgaccactatcctggcacttctcatcattgacaaagtaggacgcaagaaactgatatattatggggtatccggaatggtcgtttcattgatactcattggcagttatttcctcttcggaaatgcctggaatatttccagcctgtttctgttagccttctttctgtgttatgttttttgttgcgccatttccatttgcgctgtgatattcgtacttctctctgagatgtaccctaccaaaatacgcggattagcaatgtccattgccggattcgctctttggatcggtacctatctgatcggacagctaaccccctggatgctccagaatcttactccagccggaacattcttcctgttcgccatcatgtgtgtaccgtatatgctcattgtctggaaactcgtaccggaaactaccggaaagtctctggaggagattgaaagatactggacccgttcggaacggtaa

SEQ ID NO: 11655 - protein, 468 aa, Bacteroides thetaiotaomicron VPI-5482
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 11656 - DNA, 1383 bp, Bacteroides thetaiotaomicron VPI-5482
  CDS (1)..(1383): transl_table=11
atgaaaagttataataaaaagtttgtctattccatttgtttggtttctgcgatgggcggtctgctctttgggtatgactgggtggtaatcggaggagcgaaacctttctatgaactctatttcggtattgccgattcgccgacgatgcagggactggctatgagtgtagccttgcttggctgtctgatcggtgctatggtagccggtatgatggctgaccgctatggcaggaaacctctcttgctgatttccgcatttatctttttatcttccgcatacgctaccggtgcattttccgtattcagctggtttttggcagcacgctttttgggaggtatcggcatcggtatcgcttcggggctgtctccgatgtacattgccgaagtagctcctacttccatccgggggaaactggtatccctcaatcaactgactattgtattaggaatccttggcgcacaaatagccaactggctgatagccgagcctatacctgccgactttacgcctgccgatatctgtgcttcatggaacgggcagatgggatggcgctggatgttttggggagcagcatttccggcagcggtattcttgctgctagcctgttttattcccgaaagtccccgttggctggcaatgaaaggcaagagagagaaagcatggagtgtacttagccggataggaggaaaccgctatgcggagcaggaacttcagatggtggaacaaacttctgcttccaagtcggaaggaggattgaaattattgttcagtcgcccgttccgtaaggtactcgtactgggtgttatcgtggctgtgttccagcaatggtgcggtacgaatgtgattttcaattatgcacaggaaatattccagtcggcgggttattcgctgggtgatgtactctttaatattgtggtgaccggtgtagcgaatgtgatctttacgtttgtggctatctatacggtcgaacgtttggggcgccgtgctttgatgcttttgggggctggaggactggcaggtatttatctggttctcggcacgtgttacttttttcaggtcagcggtttctttatggtagtgctggtagtgttggcgatagcttgttatgccatgtctctggggcctatcacgtgggtactgcttgctgagatattccccaaccgcgtgcgtggtgtggctatggcaacctgtactttcgctttgtgggtcggtagtttcacgcttacctacacatttccgttgctgaatactgcattgggcagttacggcacattctggatttattcggctatctgcgtcttcggcttccttttcttcctgcgtgcattgcctgagacaaaagggaaatcgctggagacattggagaaagatctgataaaataa

SEQ ID NO: 11657 - protein, 460 aa, Bacteroides thetaiotaomicron VPI-5482
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 11658 - DNA, 1413 bp, Streptomyces avermitilis MA-4680
  CDS (1)..(1413): transl_table=11
gtgaccagcacagcgcaggcgcccggagcccgggaagctcatcccgagcatctcggccatgtcatcttcatcgcggcggcggccgcgatgggcggcttcctcttcggttacgacagtgccgtgatcaacggcgccgtcgaggccatccggagcaagtacgacatcggttccgcgaccctggcccaggtcatcgccatcgcgctgatcggctgcgccgtcggcgccgcgaccgcgggccgcatagccgaccgcatcggccgcatccggtgcatgcagatcgccgccgtgctgttcaccgccagcgccatcggctcggcgctgcccttcgcgctgtgggacctcgcgttctggcgcgtcatcggcggcttcgccatcggtatggcctccgtgatcggccccgcctacatcgccgaggtcgccccggccgcgtaccgcggccgtctcggctccttccagcaggccgcgatcgtcatcggcatcgccatctcgcagctggtcaactgggccatcctgaacgccgccggcggcgaccagcgcggcaagctgctgggcctcgaagcctggcaggtcatgctcggcgtcatggtcgtcccggccgtcctctacggtctgctctccttcgcgatccccgagtcgccgcgctatctgatcgaagcgggcaaggacgcgcgcgcccgtgaggtgctcgaagaggtcgagggcaaggagatcgacctcgacgcccgcgtggaggagatcaggctcgccatgtaccgcgaggagaagccgagcttcaaggacctgctcggcggcaccttcttcttcaagccgatcgtctgggtcggtatcggactctcggtcttccagcagttcgtcggcatcaacgtggcgttctactactcggcgacgctgtggcagtcggtcggcgtcgacccgacggactcgttcctctactcgttcaccacgtcgatcatcaacatcatcggcaccgtgatcgccatgatcttcgtcgacagggtcggccgcaagccgctcgcgatcatcggctccgtgggtatggtcatcggtctcgcgctggaggcctgggccttctcgtacgacctcgtcgacggcaagctgccggccacccagggctgggtggccctgatcgccgcccacgtgttcgtcctcttcttcgccctctcctggggcgtcgtggtctgggtcttcctcggcgagatgttcccgaacaggatccgtgccgccgcgctcggtgtggccgcgtcggcccagtggatcgccaactgggcgatcaccgcgagcttcccgtccctggccgactggagcctctccggcacgtacatcatctacacggtgttcgccgcgctctccatccccttcgtgctcaagttcgtgaaggagaccaagggcaaggcgctggaggagatgggctga

SEQ ID NO: 11659 - protein, 470 aa, Streptomyces avermitilis MA-4680
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 11660 - DNA, 1407 bp, Bacillus cereus ATCC 10987; identical to SEQ ID NO: 4668
  CDS (1)..(1407): transl_table=11

SEQ ID NO: 11661 - protein, 468 aa, Bacillus cereus ATCC 10987; identical to SEQ ID NO: 4669

SEQ ID NO: 11662 - DNA, 1605 bp, Magnaporthe grisea 70-15
  CDS (1)..(1605)
atgtatgttgtgggaaatgtctacctcatcgccgccatatcggtgatcggcggtgctctcttcggcttcgacatttcgtccatgagcgccgtcatatcgactcaaccatatctgtgtcgcttcaatgagcttgggttcaacgaaaatggttcctgcaggggtctgcatgaggacgtccagggcggtgtagtggctgccatgcctggaggatctctcattggtgccatggtctccggtttcctttccgaccgttttggacgcaaaccaactatccagattggtgctgccatctggtgtgttggttccatcatcacggcagctgcagtcaacgtgcccatgttggctattggccgtgtcatcaacggcttcgccgtcggcatctgctctgcccaggtccccgtctacatatctgagatcgccaagccaactgttcgcggccgtctcatcggactacagcagtgggcgatcacatggggtatcgccattatgttttttatctgctatggctgctcttttatcaagtccgaggctgctttccgtgtgccatggggcgtccaagctgtccccgccgttctcctgggcctgggcctcattatcctccccgaatctccccgatggctggccaagcatgaccgatgggaagagacccttgctgtattggcccgcacacacggcaaaggcgacagcaacgctccctttgtcgtcaaggaaatggctgaaatccgggcagtggtggaattcgagcgcgccaacgccgatgtctcctaccttgagcttttccgtcccaacatgattgtccggaccagcattggagtggccacccaaatttggagccaattgacgggaatgaatgtcatgatgtactacatcacctacgtcttcaccatggccggtctcggaagcgacgttctcctgcccagcgggattcagttcatcatcaacgtggtcatgaccgtgcctgctctcatctggatggacagctggggtcgtcgccctacgttgctgatcggcgctgctctcatgtgtctctggctatgcatcaacgccggcttgttcgccacctacagtcgcccgccacgaccagaagacaactttacctcggcttccatgtcgatgaagatcgagggcgcccctgccaaggctgtcattgcctcgacatatttgttcgtcgcttcgttcgcctgcacctggggcccgacctcttgggcctacccgcctgaactctaccctctgagacttagaggcaaggctgtctcccttgctaccgcaggcaactggactttcaactttgccttggcatactttgtacctcccgcgttcgcaaacatcacatggcgcacctatgtcatttttgccgtcttctgcgccgccatgttcattcatgtgtttttcttgtttcccgagacggccaacaaaccgctggaggaggtctcggatatgtttgacgacaccaaaccgggcgcgatccggctcatcggtaccccggcctggaaaacgcacaacgtacgcaactctgcacgccgcgttgagcgcagcgagttcgacatcgaggacaagagggtgggcacgccgccggcgactgaacagaaggagacggttgcatag

SEQ ID NO: 11663 - protein, 534 aa, Magnaporthe grisea 70-15
MYVVGNVYLIAAISVIGGALFGFDISSMSAVISTQPYLCRFNELGFNENGSCRGLHEDVQGGVVAAMPGGSLIGAMVSGFLSDRFGRKPTIQIGAAIWCVGSIITAAAVNVPMLAIGRVINGFAVGICSAQVPVYISEIAKPTVRGRLIGLQQWAITWGIAIMFFICYGCSFIKSEAAFRVPWGVQAVPAVLLGLGLIILPESPRWLAKHDRWEETLAVLARTHGKGDSNAPFVVKEMAEIRAVVEFERANADVSYLELFRPNMIVRTSIGVATQIWSQLTGMNVMMYYITYVFTMAGLGSDVLLPSGIQFIINVVMTVPALIWMDSWGRRPTLLIGAALMCLWLCINAGLFATYSRPPRPEDNFTSASMSMKIEGAPAKAVIASTYLFVASFACTWGPTSWAYPPELYPLRLRGKAVSLATAGNWTFNFALAYFVPPAFANITWRTYVIFAVFCAAMFIHVFFLFPETANKPLEEVSDMFDDTKPGAIRLIGTPAWKTHNVRNSARRVERSEFDIEDKRVGTPPATEQKETVA

SEQ ID NO: 11664 - DNA, 1731 bp, Magnaporthe grisea 70-15
  CDS (1)..(1731)
atggataaccacgcagactcgacggccaagaccgccacggcgggtgaagccgaaacggaacgtattgaagttcacgatgcaacccagcgtgtccaagagcaggcccagacagacagatggcgctcgatcaaggcgaaccccaagcttgtcctgcttgcccttttcgcatcttttggcggtttcgaatatggctaccagcagggcatcctctcccagtcgctggccatgtaccgcttcaaggagaacttccccagcgtcgtctcctcacccaccgcgaccggctggctcacttccatcctgcagctcggcggtatcctgggctccctgaccgccggcatcctcagtgaggtcatctcgagaaaatacaccatgttcaccgcctgctgctgggtcatcctgggcagctacctgtacattggcgccaccgcgggcaagcccgacctcttgtacgccggccgcttctttaccggtctcggcgttggtctgttcagtggtgtcggtccgctgtacaatgctgagatctcggcgcccgagacgcgtggttttactgtctcgttttaccagtttgccaccatctttggcatcttcctctccttctgggtcggctacggcagcaactacatcggcggacacgacgcaacccagtccgacatggcatggcgcctcccgtccatcatccagggcatccccgcgatcctgctggccggcggtatctggttcatgcccttctcgccgcgctggctagtcaagaagggccgctacgaagaagcgcgcaagaccctggcctggattcgcaagaaggagctcgacgatccgctcgtcgaggttgagctgctcgagatcagggcccagcagctgtttgaggagagggcctttgcgcgcgccctgccccagtacgccaacaaggagaaccgcaacccttgggtccacgagatcgtcgcctacgtgcagtgcttcaagacctgggataacgtcaagcgcgtcgccacggcttggcttgtcatgttcttccagcagtggtctggcatcgacgccatcatctactatgccaccaacgtctttatgagctttggctttaccgagggcaccatcgctctgctggcgacgggcgtcacgggtgttgtgtttttggtgtcgaccattcccgccatgttgctcatcgacaagctcggccgcaagcccatgctctacactggctccatcatcatgttcctgaccatggtcaccgtcggcatcgtggtagccaagttccaacacgactggcccaacaaccccgccgcgggctgggcgtccgtgatcctgatctggatctacattggtgcctttggcttcggctggggcccggcctcgtgggttgtcatctcggagatcttccctctcagcatccgcgcccgcggtgcctcgatcggcgcctcgtccaactggctcaacaactttgccatcgccttcttcgtgccgcccatgttccagaccctggcctggggcacctacatcttcttcgccggcttcctcgccgccggcatcgcctggatctacttttacctgcccgagaccaaggacgtcagcctcgaggagatggaccgcgtctttggcagccacacgggtgccgaggacgcgaggctgctggctgaggcgcaacgcgacgtcggcttgattgactttctcaggagggccgagggcaagtcggttgatgtcgaggcggaggagaagaggcaggagcctgtagtttag

SEQ ID NO: 11665 - protein, 576 aa, Magnaporthe grisea 70-15
MDNHADSTAKTATAGEAETERIEVHDATQRVQEQAQTDRWRSIKANPKLVLLALFASFGGFEYGYQQGILSQSLAMYRFKENFPSVVSSPTATGWLTSILQLGGILGSLTAGILSEVISRKYTMFTACCWVILGSYLYIGATAGKPDLLYAGRFFTGLGVGLFSGVGPLYNAEISAPETRGFTVSFYQFATIFGIFLSFWVGYGSNYIGGHDATQSDMAWRLPSIIQGIPAILLAGGIWFMPFSPRWLVKKGRYEEARKTLAWIRKKELDDPLVEVELLEIRAQQLFEERAFARALPQYANKENRNPWVHEIVAYVQCFKTWDNVKRVATAWLVMFFQQWSGIDAIIYYATNVFMSFGFTEGTIALLATGVTGVVFLVSTIPAMLLIDKLGRKPMLYTGSIIMFLTMVTVGIVVAKFQHDWPNNPAAGWASVILIWIYIGAFGFGWGPASWVVISEIFPLSIRARGASIGASSNWLNNFAIAFFVPPMFQTLAWGTYIFFAGFLAAGIAWIYFYLPETKDVSLEEMDRVFGSHTGAEDARLLAEAQRDVGLIDFLRRAEGKSVDVEAEEKRQEPVV

SEQ ID NO: 11666 - DNA, 1713 bp, Magnaporthe grisea 70-15
  CDS (1)..(1713)
atgcttggcggcaagtccatcagggtcaatggcgccgagtgcggcgtcgagtctctcttcctcggcgctgtcaccagcctgggtggctttcttttcggttacgacacgggtcagatctcgggcatgctcatcttcgaggactttcagcgccgcttcgccacgggccccgttggggagaatggcatccgggaatgggttcccatcattcagtccaccatggtgtccctgatgagcatcggaacgctcatcggtgctctttctggtgcctacactgccgactggtggggacgtcggaggagtttggcgttcggtgtcatcttgttcatcatcggcaacatcatccagattactgccatggagtcttggattcacatgatgatgggtcgcctgattgctggttttggtattggtaacctgtctgtcggtgtgcccatgttccagtcggagtgtgctccccgtgagattaggggtgccgttgtggccagctaccaactgctcatcactttcggaatcctcatctcaaacatcatcaactacggtgtcaggaacatccagggctccgacgcctcgtggagaatcgtgattggcctgggcatcttcttcagcgtgcctctcggtatcggcatcctgctcgtccccgagtctccccgttggctcgccggacgtcaggactgggatggtgctcgcatgtccatcgctcgtctccgcggcatgaagcacgaccccaacaacgtcctcgtcgagaccgacatcagcgagatgtacaagatcatcaaggaggagtccagcgtcggagtcggcagctgggccgaatgcttcaccggcaagggcggttccgaaggcattcccaaggttgtgtaccgcaccatcttgggcatgttcatgcactttacgcagcagtggaccggtgtaaactacttcttctactacggtgccacgattttccagtctgctggtgtcgacgaccctatcgtcacgcaattgatcctgggcgccgtcaacgtcgccatgaccttcttgggtctgtacattgtcgagaagtttggacgtcgtggtcccctctttattggtggcgcgtggcaggcggtctggctggctgtttttgctgccattggaaccgctctgccgcccacagagaaccgcgtctctggcatcgtcatgattgtgtccgcctgcatgtttattgcttcgttcgccagcacctggggtcccatctgctgggtcgtcatcggcgagaccttcccgctccgcacgcgtgccaagcaggcctcgctgtccacagccggcaactggctgggcaactttatgatttcgttcctcacgcccatcgccaccgacggcatctcgttctcctacggcttcgtgtttgccgccgtcaacttgtgcggtgccctgggcgtgtacttcttcctctacgagtcccgcatgctgtcgctcgagaacgtcgaccgcatgtacggcgacccgtccatcaagccctggaactcgcgcaagtggactccccccggatacatcaaccgccgcaccaaggacgagaagtacgtgcccgagggcgagcacgtccagggcggagtcaggggctcggtcggcagcgacaacaccgccgtccccggcgaggccgacgtcaaccacgaccacgccaagcaaaggcctggtagcgacggcgttcccacgacggagcagcacgagcaggctgtgctccggaacgcgtaa

SEQ ID NO: 11667 - protein, 570 aa, Magnaporthe grisea 70-15
MLGGKSIRVNGAECGVESLFLGAVTSLGGFLFGYDTGQISGMLIFEDFQRRFATGPVGENGIREWVPIIQSTMVSLMSIGTLIGALSGAYTADWWGRRRSLAFGVILFIIGNIIQITAMESWIHMMMGRLIAGFGIGNLSVGVPMFQSECAPREIRGAVVASYQLLITFGILISNIINYGVRNIQGSDASWRIVIGLGIFFSVPLGIGILLVPESPRWLAGRQDWDGARMSIARLRGMKHDPNNVLVETDISEMYKIIKEESSVGVGSWAECFTGKGGSEGIPKVVYRTILGMFMHFTQQWTGVNYFFYYGATIFQSAGVDDPIVTQLILGAVNVAMTFLGLYIVEKFGRRGPLFIGGAWQAVWLAVFAAIGTALPPTENRVSGIVMIVSACMFIASFASTWGPICWVVIGETFPLRTRAKQASLSTAGNWLGNFMISFLTPIATDGISFSYGFVFAAVNLCGALGVYFFLYESRMLSLENVDRMYGDPSIKPWNSRKWTPPGYINRRTKDEKYVPEGEHVQGGVRGSVGSDNTAVPGEADVNHDHAKQRPGSDGVPTTEQHEQAVLRNA

SEQ ID NO: 11668 - DNA, 1539 bp, Magnaporthe grisea 70-15
  CDS (1)..(1539)
atggctccctcaactctcgtcggccgtcccctgaactgggccatcacggccgcagctggtgcaggcttcctgcttttcggatatgaccaaggcgtcatgagcggtctccttaccggagcagcttttaccaagacattcccagagatggacaccctcaatggcgggagtgcttctcttcaaggcacagtagtcgccatatacgaaataggttgtttctttggagcgattgcagctctgttcatcggagagccccttggaagacgcaagatgatcatgttagggtgcatcattcttgccatcggtggtgcgcttcaggcgtcggcgagcacgattccccacctgatcgttggtcgaatagtggctggattggggaacggtctgaataccagcacaatccccgtctggcactcggagctgatgaaagccaccaagcgcggaaagggactgtgcgtcgaattggccatcaacatctttggagtaatgttatcctactgggtcgactacggcatgtcctttgagaagagcgacgcccaattccggttcccgctggccctacagtgcgcatttgccatcgtcaccttcttgggcgtgctcttcctccccgagtcgccccgctggctcgtcgccaacgaccgccacgaagaggcccaggacgttctgtggtccgtcgaagagaatgccagaagcatttcacgcgacgatgagcgtgtgactaagcatttggtcgagatccagacggcgatccgcgaggagcgcgaggccgcgggcaacaacggctacagcgccctattccacaacggcgagcaaaagttcctctacagaactttgctggggataggtgggcagttttgccagcaactatctggtatcaatttaattacatactatgctcccgtcatctttcaacagagcgttgggttgagccgggacctttcgctgcttctcgcgggcttcaacggcgtagcctacttcttttcctcgctggtaccgatctggctcatcgaccgcctgggccgccgcaagctcatgctctttgctgcagccggccagggctgctgtatggcaatccttgccgggacggttgccaacgggagcaagagcgcgggcattgtcgccattgtcatgctcttcctcttcaacttcttcttctccgtcggtctgctggccatcccatggctactccccgccgagtacgcacccctggctattcggtctcgggccgcagcactggcaactgcttccaactggatctttaccttcctcgtcgtcgaaatcacccccgtcagcatcaccaacatccagtggcgcacctacatttactttggcgtcttcaacttttgcttcctaccactcatctacttcttctaccccgagacccgcaacctgaccctggagcagatcgacaagctctttacgggcgatcgcgtaaagatgcactgggatcccagcatgggctccgtcgagggcctgaccaccggaagccccgagggcgagaaggaggctgctgtccagaccgagattgccgagaggcgggattaa

SEQ ID NO: 11669 - protein, 512 aa, Magnaporthe grisea 70-15
MAPSTLVGRPLNWAITAAAGAGFLLFGYDQGVMSGLLTGAAFTKTFPEMDTLNGGSASLQGTVVAIYEIGCFFGAIAALFIGEPLGRRKMIMLGCIILAIGGALQASASTIPHLIVGRIVAGLGNGLNTSTIPVWHSELMKATKRGKGLCVELAINIFGVMLSYWVDYGMSFEKSDAQFRFPLALQCAFAIVTFLGVLFLPESPRWLVANDRHEEAQDVLWSVEENARSISRDDERVTKHLVEIQTAIREEREAAGNNGYSALFHNGEQKFLYRTLLGIGGQFCQQLSGINLITYYAPVIFQQSVGLSRDLSLLLAGFNGVAYFFSSLVPIWLIDRLGRRKLMLFAAAGQGCCMAILAGTVANGSKSAGIVAIVMLFLFNFFFSVGLLAIPWLLPAEYAPLAIRSRAAALATASNWIFTFLVVEITPVSITNIQWRTYIYFGVFNFCFLPLIYFFYPETRNLTLEQIDKLFTGDRVKMHWDPSMGSVEGLTTGSPEGEKEAAVQTEIAERRD

SEQ ID NO: 11670 - DNA, 1623 bp, Gibberella zeae PH-1
  CDS (1)..(1623)
atgaacactcttcgaagggcatcgctcagcaagcccgaggaggctggcaagacatggcctgctatcgccatcggtgccttcgtcgcctttggtggtgttctctacggttatgataccggtaccatctctggtattctggccatgccatactggcagagcctcttcagcaccggctacagagacgccaagggccacctgaacattacaacagctcaggaatcgggaattgtctcgattctttccgccggtacctttttcggtgctctgtcgtcaccctttatgactgactacatcggtcgtcgccctggtcttatgattgctacatgggttttcaacctcggtgtctgtcttcaagttgctgctacatctattcccctgttcttggctggccgattctttgctggtttcggtgttggtcagatctctgctattattcctctataccagtccgaaacagctcctaaatggattcgaggtgccattgtcggatcatatcaatgggccatcacaatcggtcttttactagcagctatcgtcaacaacgcaacaggtggccgcaacgacacaggctcttaccgtatccccgtcgccgttcagttcgcatactctctcatccttttcggtggaatgattatcctccccgagactcctcgattcctcatcaagaaggatcgtcatgaagccgcagccaaggccctctccagaatccgtcgtctcactcccgatcatcccgctatccaggctgagctcgccgaggtcagggccaaccacgagtacgagacgagcattggaaagtcctcttacctcgactgcttcaagcctcctattctgaagcgtcagttcactggttgtgctctccaggctctgcagcagcttactggtatcaacttcattttctactatggtaccaagtacttccagaattctggtatctcaagcggttttgttatttccatgatcacttcagccatcaacgtcgcttccacaatccctggaatgtacgccatcgacaaatggggtcgacgacctcttctcctctggggtgctgtcggcatgtgtgtctcgcagttcatcgtggccatggctggtacattttccactggtcagaatgctgatggaaccatctttgtcaagagtctggctggccaaaaggctgctgtctctttcgtctgtatctacatcttcttcttcgcctctacctggggtcctctggcttgggtcgttactggcgagatcttccctctcaagacccgtgccaagtctctcagtatgaccactgccactaactggcttttcaactgggctatcgcttattctactccctacctcgtcgattacggctctggaaaggccaacctccagtccaaaatcttcttcatctggttcggctgctgtttcctgtgtattgctttcgtttacttcttcatctacgagaccaagggtctgtcccttgaggaggttgatcagctgtacgatgaagtcagtgttgctagcaagtccaagcagtggaagcctagcgagtcctgggagcaccgccagagtgtttcgggggcggatggtaagatgtttggtggaaacgatcaccagggagaagttactcacaacgagaagaacgaggcttaa

SEQ ID NO: 11671 - protein, 540 aa, Gibberella zeae PH-1
MNTLRRASLSKPEEAGKTWPAIAIGAFVAFGGVLYGYDTGTISGILAMPYWQSLFSTGYRDAKGHLNITTAQESGIVSILSAGTFFGALSSPFMTDYIGRRPGLMIATWVFNLGVCLQVAATSIPLFLAGRFFAGFGVGQISAIIPLYQSETAPKWIRGAIVGSYQWAITIGLLLAAIVNNATGGRNDTGSYRIPVAVQFAYSLILFGGMIILPETPRFLIKKDRHEAAAKALSRIRRLTPDHPAIQAELAEVRANHEYETSIGKSSYLDCFKPPILKRQFTGCALQALQQLTGINFIFYYGTKYFQNSGISSGFVISMITSAINVASTIPGMYAIDKWGRRPLLLWGAVGMCVSQFIVAMAGTFSTGQNADGTIFVKSLAGQKAAVSFVCIYIFFFASTWGPLAWVVTGEIFPLKTRAKSLSMTTATNWLFNWAIAYSTPYLVDYGSGKANLQSKIFFIWFGCCFLCIAFVYFFIYETKGLSLEEVDQLYDEVSVASKSKQWKPSESWEHRQSVSGADGKMFGGNDHQGEVTHNEKNEA

SEQ ID NO: 11672 - DNA, 1584 bp, Gibberella zeae PH-1
  CDS (1)..(1584)
atgaagttttttagtagcaaacgccaagagcatgctgctgagggcgagcatctcgagcggagaaagactcccgacaccgatggtcgcatcaccttcctggcctgcttcatgggccttgtcgcctccatggggggcatgatatttggatacagttctgggcagatttccggttatttcatgatgaaagattatggcgaacgattcggagtacccaacggcgatggtacatacgagttcagcgcggcgcgacaaggaacaatcaccggtcttctctctgttggatgcctgttcggttctctcattgccggtaacctttgcgacaccatcggccgtcgaactaccatctctatctctgctctctggacctgtgtcggtaccgtcattgaggtcgcttcccagcacgcctggtaccaacacgctattggtcgtctcgtcactggtcttggtgtcggtgccctctctgtcgctgtccccatgtaccagtccgagagtgctcctgccatcatccgaggtatcattgtctcctgctaccagctcttcgtcaccctcggtatctggtgtgccgagatggtcaactggggcaccaaccactacgacggcagcgcttcttggaggatccccaacggtctcaacttcctctgggctcttcttctcggagttggcatcctcttcctccccgagtccccccgattcgcctaccgcaagggtaaggaggaggaagctcgcaagaccatcgccaaccttgctggtctcgacatcaactcccccagtgtcaaccgccagattgatgagatccgtgagaagcttgaagaggagcgatctctccctgagacccgctgggttgagatcttcactggtccccgtatgatgtaccgtaccctcctcggcatcactctccaggctggtcagcagctcactggtatcaacttcttcttctacttcggtaccactgtctttgcttccaccggtctcaaggactcctacgtcacccagctcattctcggctcagtcaactgcgcttgcacctttggcggtctctacgtcgtccagaagtgtggtcgccgtatctctctgatgattggtgccgcctggatgatgatgtgcttctttatctacgcctttgttggtcacttcgctcttgaccgcgccgaccctctcaacactcccgccgctggtacagtccttgttaccttctcctgcttggccattgtcgctttcgctaccacctggggtcctcttgtctgggctgtcgtcgccgagatgtacccttcccagtaccgatctcgctgcatggccattgctactgctaccaactggctcttcaacttcctcatcggtttcttcacccgattcatcactgatgccattgactactactacggtctcgtctacgccggatgctgtgccgccctggtcgccattgtcttcttcttcgtcatcgagtccaaggaccgtactctcgaggagattgacaccatgtacgtccagaaggtcaaccccattacctcctccaagtgggttggccacaaccacgcctccaaggccgcccgtgagggtgtcaccgacgaggaagtttcttcctaa

SEQ ID NO: 11673 - protein, 527 aa, Gibberella zeae PH-1
MKFFSSKRQEHAAEGEHLERRKTPDTDGRITFLACFMGLVASMGGMIFGYSSGQISGYFMMKDYGERFGVPNGDGTYEFSAARQGTITGLLSVGCLFGSLIAGNLCDTIGRRTTISISALWTCVGTVIEVASQHAWYQHAIGRLVTGLGVGALSVAVPMYQSESAPAIIRGIIVSCYQLFVTLGIWCAEMVNWGTNHYDGSASWRIPNGLNFLWALLLGVGILFLPESPRFAYRKGKEEEARKTIANLAGLDINSPSVNRQIDEIREKLEEERSLPETRWVEIFTGPRMMYRTLLGITLQAGQQLTGINFFFYFGTTVFASTGLKDSYVTQLILGSVNCACTFGGLYVVQKCGRRISLMIGAAWMMMCFFIYAFVGHFALDRADPLNTPAAGTVLVTFSCLAIVAFATTWGPLVWAVVAEMYPSQYRSRCMAIATATNWLFNFLIGFFTRFITDAIDYYYGLVYAGCCAALVAIVFFFVIESKDRTLEEIDTMYVQKVNPITSSKWVGHNHASKAAREGVTDEEVSS

SEQ ID NO: 11674 - DNA, 1698 bp, Gibberella zeae PH-1
  CDS (1)..(1698)
atggcacgcgccatgggctggcataagcccgaaaactttgctggctcgtcgatacgcgccattcttgtcggtttgtttgtgtcctcagggggtttgctttttggctacgatgtgggagtcatcaatggcatccttgccatggacgtcttccagaacgactttgccaccgatcaaacctgcagagacgaaaatgaccacattgatctatgtcccatagactcatctcttatcgtcgctattcttagtggcggagctgttgtaggctcaatacttgctgccccagctggcgatagtatcggccgacgcaaaacgttgtttcttgccgtggtaacattctgtatcggggctatttttcaggtgtgtgctcaagcaactcccatgttactggttggcagggctttagcaggtgttgctgtaggagccacatcagttctcgtgcctctttatcaatctgagacggcaccaaaatggatcagaggaagcatcatctgcgcttatcaactctctatcacggttggaattctcggtgcaaccattatcaacgtgattacatcaggaatgaacagcgcagccgcctaccgtatccctctaggattgcaacttgtgcccggtgtcatcctcgcattcggcatcatgttactcccagagacgcctcgcttcttggtcaagaaaggacgaaacgacgacgctggcatttccctcagtcggttccgtaggctcgacattactcaccctgctctcgtgaacgaactacaggagatcattgccaaccatcagtatgagatgacacttggtcaagatacataccgagctctcttcacgagtaactcctcccttgggcatcggaccctgacaggatgtgtattgcaaatgttgcagcaactcaccggcatcaacttcgtcatgtactacggtacaacctttttcagtagatccggtgttagcaatccgttcatcatcaacctcgtcatgatcatcgttaattgtgtctgcacaatacctggtctcatcgttatcgaatcgtggggaagacgaaaacttctcatggctggtgcattgggcatggcagtatgtcagtttataatcggcgccgtatccacagcaaacgagaaatcatcgcaagacctcggaaacgcgtccaacatggcactcatcgtctgctgtgcgataaatgtcttcttttatgcttcatcgtgggggcctgtcacttgggttgtcacttcagagatcttccctctcaagttacgcgcaaaggcaatgtcggtgtcaaccacagcgaactggctcttgaactttgccgtagcatacgcgcctccgtttatattgggaagaagggccgacgcgtttgggttgaagatcttcttcatttggggtaccttttgtatacttgctatcgtcttcgtctggttcatggtttatgagactagtaggatgacactggaacagattgacgagatgtacgagcgcgtgagtcacgcgtgggaaagcccaggcttcaatccaagctggagcttccaagagatgcacaatactgggtgggcagccaatgggcaagcagagctacagagtgctacttcgacgtctaacaatatcagctcctcaaatacagaagatgggggcaatgatcggcactcgatacactcaaacgctcccccgaattctgcgactcccatagccaatgtcgattttagttattag

SEQ ID NO: 11675 - protein, 565 aa, Gibberella zeae PH-1
MARAMGWHKPENFAGSSIRAILVGLFVSSGGLLFGYDVGVINGILAMDVFQNDFATDQTCRDENDHIDLCPIDSSLIVAILSGGAVVGSILAAPAGDSIGRRKTLFLAVVTFCIGAIFQVCAQATPMLLVGRALAGVAVGATSVLVPLYQSETAPKWIRGSIICAYQLSITVGILGATIINVITSGMNSAAAYRIPLGLQLVPGVILAFGIMLLPETPRFLVKKGRNDDAGISLSRFRRLDITHPALVNELQEIIANHQYEMTLGQDTYRALFTSNSSLGHRTLTGCVLQMLQQLTGINFVMYYGTTFFSRSGVSNPFIINLVMIIVNCVCTIPGLIVIESWGRRKLLMAGALGMAVCQFIIGAVSTANEKSSQDLGNASNMALIVCCAINVFFYASSWGPVTWVVTSEIFPLKLRAKAMSVSTTANWLLNFAVAYAPPFILGRRADAFGLKIFFIWGTFCILAIVFVWFMVYETSRMTLEQIDEMYERVSHAWESPGFNPSWSFQEMHNTGWAANGQAELQSATSTSNNISSSNTEDGGNDRHSIHSNAPPNSATPIANVDFSY

SEQ ID NO: 11676 - DNA, 2448 bp, Gibberella zeae PH-1
  CDS (1)..(2448)
atggacgaaagtcaacttcagcagcctcgccgtacctacctatttggctacccattacaacactcattggcacctcttcttcactcaaccatcttcgagagtctcaatgtgccatggacctacgatctgatcgaatctatcgacaagaatgacttcatacccaaactaaaggccagcgactgtgtcggagctgctgtcactatgccgcacaaggttgcctggatcaacgagtgtgatgaagtaacagacgaaggacgggccataggcgctatcaacactgtcttcattcgcaaagacgaagttacgggtgaaagaaagtacatcggtacaaacacagactgtgttggagttcgcgagtccttcctgcagaactctcccggaatcacggagaagagcaagggaaagccggcgctggttattggcggtggaggtgcctgtaggagcgctgtctacgctctttacaagtggttgggcgccagtgagatttatctggtgaaccgtctaaaggaagaggcggacgcagtgattgagtcattttcagggctggaggatggcccaaagatgacctatatctcctccctcgagcaggcaaaacaactcgagacaccagtccttattgttggcacgatcccagactttgaacctagcacggagggcgagattctggcacgggatatcgttactgagctcgttcagaaagaggaaaagggcgttttgcttgagatgtgctatcatcccaggatagtcacgagattgtatagtcttgctgaagataacagatggaaggtaattcctggaacggaggccatgatctaccaagatatagccaatatggtcaagaatatatttgccaggccaaaagatgactcggccaatccagcgcctccagaggtgtacaactggaggatctacgctctcgccgcttctgcagctctgggatcctccatgtttggatatgattcagctttcatcggaggtactctgtcactgccctctttccaagaacgattcaatctggcttctgagaccggtaccgccttggcatcactgaaagcaaacatcgtcagcacgttccagggtggttgcttctttggtgtattactttgttattacatgactgaaaaactcggtcgtcgctgggttctcatcttgtgtggtatcattttcaacctcggtgctattatccaactagttgctgatggcaagctgtcatttatctatgctggtcgtgtccttactggccttgctgttggtgcatcttccatgatcattcctgtctatatctccgaatccggcccacctgctattcgaggacgtctcattggcatattcgaaatcttcctgcagttctcgcagatcataggcttctgggtcaactacggagtgaacatccatatttctccaacatccgacgtacaatggcacattccctttggcctacagcttgctcctggcactttgcttgtcatctgcatgctcttccagcccgagtctcctcgttggttgcttaatgctggacgaactgaccaggctcgcaaggtcctgcagcgtcttcgacaactacccgctgatcacgcttacctaaactgggagatcgacactgttttgaaacagatagaagaggagaagtctatgggggccgataggagctttttcgcgaaattgcgcgaggtggtagggcctaccaacagacctcgtctccttttgggtatcgccctcatgttcatccagaacatgtcaggtatcaatgcgctcaactattattccccatctatcttcaagtctattggcttcactggaacaagcgttggactcctcgcaactggtatctttggcattgtcaaggcgagcgctacaggactttacatgatctggggcgtcgacgctcttggtcgtcgccagtcattgatgattggatcaaccggtgcagccattgcactattttatctcggtatatactccaagctttcgggttcctttgatgtaggaatggtccctgcagaaaagacccctggtgcatatgtggctattgttatggtttacatctttgctgttttttatgcaatctcatggaacggtattccctggatcttttgtgctgaaattttccccatggctattcgctctatctgcctggtcttcacaacctgcgcccagtggcttggtcaattcattatcgtgtactcgactccttatatgatgactgacatcacttacgggacatttcttctattcgcatgttcagtcgtatttggactcttctttgctttcttcctcgttccagagaccaagggtatttctctggaggacatggatgtactgttcagccgcaagggcatgccccgtacatggcgtcgtcaaacaaatgatgtaatcgcccaacgacgggctggggaagaagtttacagtaagcaaggtgagagtgttgtgcacgaggaaaaggtttga

SEQ ID NO: 11677 - protein, 815 aa, Gibberella zeae PH-1
MDESQLQQPRRTYLFGYPLQHSLAPLLHSTIFESLNVPWTYDLIESIDKNDFIPKLKASDCVGAAVTMPHKVAWINECDEVTDEGRAIGAINTVFIRKDEVTGERKYIGTNTDCVGVRESFLQNSPGITEKSKGKPALVIGGGGACRSAVYALYKWLGASEIYLVNRLKEEADAVIESFSGLEDGPKMTYISSLEQAKQLETPVLIVGTIPDFEPSTEGEILARDIVTELVQKEEKGVLLEMCYHPRIVTRLYSLAEDNRWKVIPGTEAMIYQDIANMVKNIFARPKDDSANPAPPEVYNWRIYALAASAALGSSMFGYDSAFIGGTLSLPSFQERFNLASETGTALASLKANIVSTFQGGCFFGVLLCYYMTEKLGRRWVLILCGIIFNLGAIIQLVADGKLSFIYAGRVLTGLAVGASSMIIPVYISESGPPAIRGRLIGIFEIFLQFSQIIGFWVNYGVNIHISPTSDVQWHIPFGLQLAPGTLLVICMLFQPESPRWLLNAGRTDQARKVLQRLRQLPADHAYLNWEIDTVLKQIEEEKSMGADRSFFAKLREVVGPTNRPRLLLGIALMFIQNMSGINALNYYSPSIFKSIGFTGTSVGLLATGIFGIVKASATGLYMIWGVDALGRRQSLMIGSTGAAIALFYLGIYSKLSGSFDVGMVPAEKTPGAYVAIVMVYIFAVFYAISWNGIPWIFCAEIFPMAIRSICLVFTTCAQWLGQFIIVYSTPYMMTDITYGTFLLFACSVVFGLFFAFFLVPETKGISLEDMDVLFSRKGMPRTWRRQTNDVIAQRRAGEEVYSKQGESVVHEEKV

SEQ ID NO: 11678 - DNA, 1608 bp, Gibberella zeae PH-1
  CDS (1)..(1608)
atgggctggaatactcatgcgtcgggcaccaatgatccgcctgaggtgcggaactggcgaatccacctgattgccacggtggcttccatgtccgccctcgccattggatatgacacttctgttattggaggtaccatggcattgacctctttcatgagggactttggccttgacctcgtcgaaaagacacagcgcgacaccatccagggaaacattgtatccacctttcaggctggctgtttcttcggtgccctgtgcacattccccattgctgagaaatggggccgtaggaagaccatcatggcagcagcctgtatcttcctcctcggcggcgctctcatgaccgccgccaacggtaatctcaacatgatctacgccggccgtgccgtagcaggcctcggcctcggcgcttcctccctcactgtccctgtctacatcagcgaaactgcccctccgtccatccgtggtcgtctgattggtattttcgaaatcgcctcccagggcggtggtatgctgggcttttggatcaactacgcaaccgaccgcaccatcgatgtcaataccaagacgcagtggattgtcccgctgggtcttcagctattgcccggtgctggtcttgcgttgggtatgctgtggtgtcccgaatcgccgcgttggttggcgagaggtgaccgctttgaggaagctgagaagatcctctcgcagatccgtgggatgacgcctgatcatgagtacatccgtcgagagatgggtgatattcgcgcgcaggtcgaagagcgcagtaccaacaagatgagcaagaagcagatgtttatgaagcttttccagaagggcgtgcgcaaccgtatgggaattggcatggcactcatgttcttgcagagtttcactggtgtcaacatcatcacttactacgctcctcgcatttttgagagtcttggtattcctggtacctcgctgaagctcttctctactggattctacggtatttccaagacacttggtatggtcctgtttactttttgggttgtcgaaaaggtcggtcgtcgcaagggtctcatctggggtgctgcccttggatgtattcccatgttgtatattggtggttatgtcatgaaggccgaccctgctgctgctgccgcagctggtgttgtcaaccgtgatggttggggatacttggcgattgtttgtgtgtacatcaacgctattatcatctgcgcgacatggcagggtatcacctggacgtatgcatccgagatctttcctctcgacatccgtatgctgtgtgtggccattacgactgccgatacatggttgggttcgttcatcattgcgcgatcgacgccttatatgatttccgatcttggttatggagcttacttcttctttggctcgattcttgtcttgatgggtatttggtcactctttttcgtccccgagacaaagggtattactctcgaagacatggacgcgctattcgccaagcccgtgtacaagacagtctgggcccaaatgcgaggcaaaccagtcctggaaggaaacgcggccaatcgatccgactcgccgtttgacgaggacgacgaaaaggctcgcgagctgaggataccttag

SEQ ID NO: 11679 - protein, 535 aa, Gibberella zeae PH-1
MGWNTHASGTNDPPEVRNWRIHLIATVASMSALAIGYDTSVIGGTMALTSFMRDFGLDLVEKTQRDTIQGNIVSTFQAGCFFGALCTFPIAEKWGRRKTIMAAACIFLLGGALMTAANGNLNMIYAGRAVAGLGLGASSLTVPVYISETAPPSIRGRLIGIFEIASQGGGMLGFWINYATDRTIDVNTKTQWIVPLGLQLLPGAGLALGMLWCPESPRWLARGDRFEEAEKILSQIRGMTPDHEYIRREMGDIRAQVEERSTNKMSKKQMFMKLFQKGVRNRMGIGMALMFLQSFTGVNIITYYAPRIFESLGIPGTSLKLFSTGFYGISKTLGMVLFTFWVVEKVGRRKGLIWGAALGCIPMLYIGGYVMKADPAAAAAAGVVNRDGWGYLAIVCVYINAIIICATWQGITWTYASEIFPLDIRMLCVAITTADTWLGSFIIARSTPYMISDLGYGAYFFFGSILVLMGIWSLFFVPETKGITLEDMDALFAKPVYKTVWAQMRGKPVLEGNAANRSDSPFDEDDEKARELRIP

SEQ ID NO: 11680 - DNA, 1620 bp, Gibberella zeae PH-1
  CDS (1)..(1620)
atggacaaacaaatcgaatccatcaaggataaacttgacgagtgcggtgccgtcacagaggagcatgctggcatgagcatggccctggagccatacggtccctctggtttccgcggtctcttctcttctccctacgtcgcagcatgcgccgccttctcagccattggcggcctgttgttcggctatgaccaaggcgtgatttccgtgacgcttgtcatggaccatttcctcgaacggtttccagaagtttcggacgatgccccaggcgcaggcttcaaaaagggcctcatgactgccatgattacgcttggggcattcattggtgctatcaaccagggatggattgctgactggatatcgagaaagcgttcgctcatggttgctgttgtaatctttacagttgggtcgacgcttcagactgcggctatcaactatgccatgcttgtggtaggtcgctttatcggtggtattggcattggacagttgtccatggtggttcccctgtacatttctgagatttcacctcccgaaatccgcggctctcttcttgttttcgaacaactctccattgtcattggtatcgtggtcgcgttttggatcacttacggcacaaagctaccctttcttcttcaaattctccccggtctactgttaggtttcggtgctatttttctaccatattctcctcgttggctagcttccaaagatcgcgaagaagaagccttgctcaacctcgccaaattacgtgctctgcccgagtcggacccccgagttcagcgagaaattctcgacattattgccgaggctcgattccaagcaagtgctctccgagagcgtcacccaaatctcacccaaagaacagatttaggcggaaagattcgacttgcgttgtttagccgggctgattgtttcaagcctggttgctggcgtcgaacacttgtcggtgcaggtctcatgttctttcagcaattcactggcatcaacgcactgatctattactctccaactctgtttggaactatgggtcttggctttgagatgcaactaataatgtcaggcgttctcaatgtcacccagttggtcggcgtgttgacaagcttgtggactatggatcgtttcggccgtcgaagtattcttcttgtgggaagcctcctcatgtttgtcccacacctgatcatcgctatcttggttggtgtcttttccaaagactggccgagtcacactgccgaaggctggactagcgtcgcctttctactgtgctacatgttcacttttggagcttcctgggggcctgttccttgggccatgcccgctgaagttttcccttcgtctctcagagcgaagggcgtggcaatttccacttgttcaaactggataaacaacttcatcataggcctcatcacgccgcctcttgttcgttcaacaggtttcggtgcttacgtgttctttgcggttttctgtctcttatctttcgtctgggtttggttcagcgtcccagagacgaacggaaaatctttggaggaaatggatgaagtgtttaatgaccggactggtactgcggatattgccaagaaagatcgcatcatggccgatctatatactgaaagacagaaccgttga

SEQ ID NO: 11681 - protein, 539 aa, Gibberella zeae PH-1
MDKQIESIKDKLDECGAVTEEHAGMSMALEPYGPSGFRGLFSSPYVAACAAFSAIGGLLFGYDQGVISVTLVMDHFLERFPEVSDDAPGAGFKKGLMTAMITLGAFIGAINQGWIADWISRKRSLMVAVVIFTVGSTLQTAAINYAMLVVGRFIGGIGIGQLSMVVPLYISEISPPEIRGSLLVFEQLSIVIGIVVAFWITYGTKLPFLLQILPGLLLGFGAIFLPYSPRWLASKDREEEALLNLAKLRALPESDPRVQREILDIIAEARFQASALRERHPNLTQRTDLGGKIRLALFSRADCFKPGCWRRTLVGAGLMFFQQFTGINALIYYSPTLFGTMGLGFEMQLIMSGVLNVTQLVGVLTSLWTMDRFGRRSILLVGSLLMFVPHLIIAILVGVFSKDWPSHTAEGWTSVAFLLCYMFTFGASWGPVPWAMPAEVFPSSLRAKGVAISTCSNWINNFIIGLITPPLVRSTGFGAYVFFAVFCLLSFVWVWFSVPETNGKSLEEMDEVFNDRTGTADIAKKDRIMADLYTERQNR

SEQ ID NO: 11682 - DNA, 1605 bp, Gibberella zeae PH-1
  CDS (1)..(1605)
atgttgggtcaaaagtccatcaaggtcaatggcgccgactgcggtgtcgaagccatcctcctgggtgtgattacgtccattggaggctttctctttggctacgatacaggtcaaattagttctatgctcctgttctcagacttcaaggagcgatttgcccaaggccctgcgggtgataaagaatggaacccttacatccagtctattcttgttagtctcatgagtattggaagtttgattggtgctctctctggtgcttataccgctgattggtggggtcgacgaaagagtatgacattcggagtcgccgttttcattatcggtaatatcattcagatttcggcgatggagtcgtgggttcatatgatgatgggtcgattcatcgctggtctcggtgtcggtaacctttccgtcggtgttcccatgttccagtccgaatgcgcccctcgagagatccgtggtgccgttgtcgcctcgtaccagctcatgatcaccatcggtatccttatttccaacatcgcatgttttggtttcaagaagatggataccagcagcgcctcgtggagaatcgtcatcggcctcggtatccttttctctcttcctcttggcatcggtatcctcatcgtccccgagtctcctagatggcttgcttctcgaggcgactgggagggcgcccaaatagcactgggtcgactccgtggcatgaagcacaacctcgaccaccccctcgtccaggacgacctgaaggaaatgaaggacattcttgagaaggagcgacaagttggccagggtagctgggccgagtgcttcaaccccaagagcggaattcccaagctcgtctggcgaacattcctcggcttcttcatccacttcctccagcagtggaccggtgtcaactacttcttctactatggtgcctccatcttcgagtccgccggtatcgaggaccctatccagacccagcttatcctgggtgctgtcaacgtcgccactacctttatgggtctctggttcgttgagcgattcggtcgtcgctggcctctattcatcggtgctctctggcaagctggttggctcgctgtctttgccgctattggtaccgctatgaacccctcagagagcaaggccgtcggtatcgtcctcattgtctgcgcctgcatgttcatcgcttctttcgccagtacttggggtcccatggcttgggtcgttatcggcgaaagtttccctctccgtactcgtgcgaagcaagcttctattgctacagccggcaactggcttggaaacttcatgattgctttccttactcctattgccaccgctggtatcagttacggttatggtttcgtctttgtcggaaccaacttggctgccgctgcccttgtttggttcttccttttcgaatctcgcgccctcagtctggagaacgtcgacctcatgtacggccaggagggtctcaagccttggaacagtcacaagtgggttcctcctggatacatcacccgcgagcagcgagacgaagtccacttccaacgtggcaacgagaagcccaggaacagcgagtctcactctggagaagactcgagagtcgagtcggttatggcttaa

SEQ ID NO: 11683 - protein, 534 aa, Gibberella zeae PH-1
MLGQKSIKVNGADCGVEAILLGVITSIGGFLFGYDTGQISSMLLFSDFKERFAQGPAGDKEWNPYIQSILVSLMSIGSLIGALSGAYTADWWGRRKSMTFGVAVFIIGNIIQISAMESWVHMMMGRFIAGLGVGNLSVGVPMFQSECAPREIRGAVVASYQLMITIGILISNIACFGFKKMDTSSASWRIVIGLGILFSLPLGIGILIVPESPRWLASRGDWEGAQIALGRLRGMKHNLDHPLVQDDLKEMKDILEKERQVGQGSWAECFNPKSGIPKLVWRTFLGFFIHFLQQWTGVNYFFYYGASIFESAGIEDPIQTQLILGAVNVATTFMGLWFVERFGRRWPLFIGALWQAGWLAVFAAIGTAMNPSESKAVGIVLIVCACMFIASFASTWGPMAWVVIGESFPLRTRAKQASIATAGNWLGNFMIAFLTPIATAGISYGYGFVFVGTNLAAAALVWFFLFESRALSLENVDLMYGQEGLKPWNSHKWVPPGYITREQRDEVHFQRGNEKPRNSESHSGEDSRVESVMA

SEQ ID NO: 11684 - DNA, 1596 bp, Gibberella zeae PH-1
  CDS (1)..(1596)
atgggtatcgcaggtgtcctcaagaaggtcgttcgcaatgacgcgatgaagactgaccccgaagagatttacaattggcgcgtctttgccgtcgttgcaggttcatgcttcggaggtatgctgtttggctgggacactggagctattggtggtgttcttgccatgaaggctacccaggagcgcttcaactacactcctgaggccaaggtcacactcgatcaaaacattgtctcaactctccaggccggttgttttgctgcttgtttcttcacctcgtatttcactgagagatatggccgacgctggtgtctcattggaaccggtgctgtcacaactatcggtgttattcttcaggccgcctctactgctcaaggatctctccccgtcatgtatatcggacgctttgttgccggtctgggcgttggagctgcttcgtctctggttcccttgtatgtgtctgagtgtgcgcctcgagccattcgtggcggtttgacttccttttaccagctgtttattgttaccggtgtcatgctttctttctggatcaactatggcgctcttctccacctcagtgctcctaccgtctacgctctgcctcttgctctccaggctctccccgctgtgcttttgattgcctgcatgttggctgcacctgaaagtcctcgatggtgtgctcgcaaggatgactgggaacgtgccaagtctattttgatcggacttcgacagctccccgaaacccacccatatgtccagaccgaactacaggagatgtccgcgcagctcgaggccgagaagcgactcacaggcaacgcttctgccagcactctttggaaggagcttgtaacaatccctggcaaccgaaagcgagctattatctctgttttgctcatggtgtgtcagcaaatgacaggtgtcaacgctgttaactactatgctcctcaaatcttccagtctctcggtatgaccggcacaaccgtctcgctcttcgctactggtgtctacggtatcatcaaggtattaggatgtgctaccttcctcatcttctttgccgactctcttggtcgacgccgcagtcttctgtggacaagtgctgctcagttcctcgccatgtacatcatcggtatctacggtcgcgttgagccccctgttgctggcgcaggtatctctgctttcggttatgttgctattgtctgcatttacctctgggctgctttcttccaattcggttggggaccttgctgctggattctcgtttctgagattcctactgcccgtctccgagccctcaacgttgccatcgctgctgctacccagtggctctttaactttatcgtcgcccgaactgtgcttaccatgcagaagacaatgggacctgccggttacggtatgtttttcatgtttggtacctttgatcttctcatgggtatctttgtgtggctcttcgttcctgagaccaagggtcttagcttggagcagatggatgagctctttggcgtagctgacgtccagggcaagcttgacgccgagggccctgagggagcccgcactcctagcatccgcgaggaggtggcccatatcaagagcaacaagagctaa

SEQ ID NO: 11685 - protein, 531 aa, Gibberella zeae PH-1
MGIAGVLKKVVRNDAMKTDPEEIYNWRVFAVVAGSCFGGMLFGWDTGAIGGVLAMKATQERFNYTPEAKVTLDQNIVSTLQAGCFAACFFTSYFTERYGRRWCLIGTGAVTTIGVILQAASTAQGSLPVMYIGRFVAGLGVGAASSLVPLYVSECAPRAIRGGLTSFYQLFIVTGVMLSFWINYGALLHLSAPTVYALPLALQALPAVLLIACMLAAPESPRWCARKDDWERAKSILIGLRQLPETHPYVQTELQEMSAQLEAEKRLTGNASASTLWKELVTIPGNRKRAIISVLLMVCQQMTGVNAVNYYAPQIFQSLGMTGTTVSLFATGVYGIIKVLGCATFLIFFADSLGRRRSLLWTSAAQFLAMYIIGIYGRVEPPVAGAGISAFGYVAIVCIYLWAAFFQFGWGPCCWILVSEIPTARLRALNVAIAAATQWLFNFIVARTVLTMQKTMGPAGYGMFFMFGTFDLLMGIFVWLFVPETKGLSLEQMDELFGVADVQGKLDAEGPEGARTPSIREEVAHIKSNKS

SEQ ID NO: 11686 - DNA, 1743 bp, Gibberella zeae PH-1
  CDS (1)..(1743)
atggcgccaccttccatgactgtttatttcgatgaccagaacccaaactcagaaaagggcaaagaagctggtgctcgtcggtccctcgccggacttgactactcacctctgcctcgcatcaccggaaggtcttttcttctagccacctttgtctctatgggtggtcttctcttcggatatgacaccggccaaatctctggcttcctcgagatgcccgactttctcgaccgctttgcccaaaccaacagcaatggcgaaaaagaattcagcactgtgcgctcaggtctaatcgtcgctcttctttccattggtaccctcatcggcgctctcgtcgctgcgcccatctccgatcgcattggtcgtaaatacagtatttctggctggacctgggtcatcgctatcggttttatcattcagatctcgtcaaaccgagattgggtgcagatcatgatgggacgatgggtcgctggtttgggtgttggtgcgctgtcgcttttggtgcccatgttccaggccgagactgctcctccatggattcgaggtgccatggtttgttgttaccagctcttcatcacaatgggtatcttcttggccgcctgcttcaactacggcacagtcacccaccagcgcaacaactcagcaagctggcgcatcgtcatcggcatcggctgggtcttcaccctcattctcggcattggaattctcttccttcccgacacacctcgattcgactaccgcaagggcaagattgaccgcgcacgcgacaccctctgcaaagtctacggcgcgacacccaaccactgggccatccacacccagatggaagaaatcgaatccaagcttcgcgcagaaagccagatcaagggcaaccctgcaaaggagtttgttcaaatgttcaaagctccgcgcatgacgtaccgcatcttactcggcatgggcctgcagatgtttcagcagcttacgggtgccaactacttcttctactacggtaccaccatctttgcatctgtctcgattgacagctacaagacgcagattatcctcaacaccatcaacttcttggtcacgtttatcggtctatacatcgttgaacactatggtcgtcgcaagtctcttattgcgggaagtacttggatgtttatctgtttcctcattttcgcctcggttggtcacttctcactcgatcgcgcaaatccttctagtacccaaggcgctggtgttgccatgattgtctttgcctgtctcttcattctcggtttcgcgaccacctggggacctatgatttggaccatcatggctgagatcttcccttcgcgttaccgagccaagggtatggctttggccaccgccagtaactggctctggaatttcctgctcgccttcttcacacccttcatcaccaaagacattgacttccgctacggatacgtctttgctggatgcaatgtcctcggtggactcatcgtctacttcttcgtcattgaaggccagggtcgcacacttgaggagattgacaccatgtatcttgaaagagtaagccctatgaagagttcaaagtggatccctcctcctccagaggaaatgtcgaggatccgaaaggaggctggtacggatatcgagactgctgctgcagctcatcatggctcgagtgatgatgagactctggctcgacgttcgggtgtgactgatggtggccacgggcagaggaaggaggagaatgctggagctactcaccgcgaatag

SEQ ID NO: 11687 - protein, 580 aa, Gibberella zeae PH-1
MAPPSMTVYFDDQNPNSEKGKEAGARRSLAGLDYSPLPRITGRSFLLATFVSMGGLLFGYDTGQISGFLEMPDFLDRFAQTNSNGEKEFSTVRSGLIVALLSIGTLIGALVAAPISDRIGRKYSISGWTWVIAIGFIIQISSNRDWVQIMMGRWVAGLGVGALSLLVPMFQAETAPPWIRGAMVCCYQLFITMGIFLAACFNYGTVTHQRNNSASWRIVIGIGWVFTLILGIGILFLPDTPRFDYRKGKIDRARDTLCKVYGATPNHWAIHTQMEEIESKLRAESQIKGNPAKEFVQMFKAPRMTYRILLGMGLQMFQQLTGANYFFYYGTTIFASVSIDSYKTQIILNTINFLVTFIGLYIVEHYGRRKSLIAGSTWMFICFLIFASVGHFSLDRANPSSTQGAGVAMIVFACLFILGFATTWGPMIWTIMAEIFPSRYRAKGMALATASNWLWNFLLAFFTPFITKDIDFRYGYVFAGCNVLGGLIVYFFVIEGQGRTLEEIDTMYLERVSPMKSSKWIPPPPEEMSRIRKEAGTDIETAAAAHHGSSDDETLARRSGVTDGGHGQRKEENAGATHRE

SEQ ID NO: 11688 - DNA, 1686 bp, Gibberella zeae PH-1
  CDS (1)..(1686)
atggcagatgaaacagttatcagtgagccgcaaccaagcccagcgcctcgcaaaggcgtttggcacctcctcctcgaaaacccatacatctttggattatcgctttttgccagtttgggtggctttctttttggctatgatcaaggcgttttgaccatggagtcattcgccactaaattccccagaatctatcttgatagcagtttcaagggttggttcgtgtcgacacttctactctgtgcatggtttggctctctggtcaacggacccatcgccgacttcctgggccgcaagggctctatgctagtggcggttgtcatctttacaattggttctgcattccaggcaggcgccagtgatattccgatgctctttgctggtcgtgctgtggccggttttgctgtaggaatgttgactatgattgtgcccatgtacgtgtccgaagtatctacagctggtattcgtggcaccctagttgtgctacagcaattaagtattaccttgggtattttgtatatcggcggtcatcgatgtgcgcctgacattccctattctggtggcactaaagacaagcctacattcgatcccaggcatgatgttggctcgggagggtgcactggtcaatctgatgctgcatggagagtcccctttgccattcaaatctttcctgcgattgtgcttggcctcggtatgctgttgtttcccgagtcccctcgcttctacctgatgcgccgcaaagaagacaaggccttgaacgccctggctcaacttcgccgagtccatcctgacacaaattcacttcgacatgaatacctggccatcaaggccgaggtcctcttcgacgaggctgtcaacagagataagttctcgggcaagaagggcgtctctctattcatcgcccagcatggtgctcttgtatccaattgggcctccttcagacgactggccatcggttgctgcatcatgttcttccagcaatttatgggatgcaacgccatcatctactatgcgccgactatgtttgcccaactgggtttgtctgggggtacttcaggcctcttggcaactggtgtgtatggaatcgtcaacacgctttctacgctacctgcccttttcctgattgacaagattgggcgtcgacctcttctcatgtgtggtgccgctggtactttcatctcactcgttatcgtgggtggtatcatcggaggatatggcgcatctcttgcgtcgaacaaatccgctggttgggcaggtattgcttttatctacatctacgacatcaacttctctttctccttcgcgcccattgggtgggtgttgcccgccgagatctttaacctcggtattcgctccaaggccatggcgatcactaccagcacaacgtggatgtgcaatttcatcattggcttggtgacacccgacatgctgagtacaattggatggggcacgtacatcttctttgcggctttttgtctcctcgcattcttctttacatacttcttcgtcccggagactcgcggtaagagtctagaggagatggatgctttgtttggtgatacagccgcttacgaagagaaggcgcggttgatggagattgcatctgagattggccttaccgaggcatttcctgacagtacgattgaccttgccagaaagaaacctgccacagcagagcacttagcttga

SEQ ID NO: 11689 - protein, 561 aa, Gibberella zeae PH-1
MADETVISEPQPSPAPRKGVWHLLLENPYIFGLSLFASLGGFLFGYDQGVLTMESFATKFPRIYLDSSFKGWFVSTLLLCAWFGSLVNGPIADFLGRKGSMLVAVVIFTIGSAFQAGASDIPMLFAGRAVAGFAVGMLTMIVPMYVSEVSTAGIRGTLVVLQQLSITLGILYIGGHRCAPDIPYSGGTKDKPTFDPRHDVGSGGCTGQSDAAWRVPFAIQIFPAIVLGLGMLLFPESPRFYLMRRKEDKALNALAQLRRVHPDTNSLRHEYLAIKAEVLFDEAVNRDKFSGKKGVSLFIAQHGALVSNWASFRRLAIGCCIMFFQQFMGCNAIIYYAPTMFAQLGLSGGTSGLLATGVYGIVNTLSTLPALFLIDKIGRRPLLMCGAAGTFISLVIVGGIIGGYGASLASNKSAGWAGIAFIYIYDINFSFSFAPIGWVLPAEIFNLGIRSKAMAITTSTTWMCNFIIGLVTPDMLSTIGWGTYIFFAAFCLLAFFFTYFFVPETRGKSLEEMDALFGDTAAYEEKARLMEIASEIGLTEAFPDSTIDLARKKPATAEHLA

SEQ ID NO: 11690 - DNA, 1674 bp, Gibberella zeae PH-1
  CDS (1)..(1674)
atgggtggagctccgactacagttggcacttatgatgctgcccttcaacgacgacaggcccttatgggtgccagtggtgccagagccctggtaaagaactggaaggttttccgaattgctgcgttcgcctgtattggaggtattctttatggttacaaccagggaatgttttcgggaattctcgtcatgaaatcttttgagagacatatgggcgattatgtccaaaacaagacgaaaaagggctggcttacatcgattcttgagcttggtgcttggctcggtactctgatgtctggtgctattgccgagctgtgttctcgaaaatacggtattcttatcgctacgagtgttttcatcatcggtgttgtcatccaatgtactgctatgcaagctggacataacgctattctggctggccgatttatcacgggtatgggagttggtagtttgtcaaccattgtgcctctgtacaactctgaatgtgctcctcctgaggtccgtggtgctcttgtagctcttcaacaacttgccatcaccttcggtatcatggtcagtttctggatcgactacggaactcacttcatcggtggtactggtgaaggtcaatccgacgcagcctggttgatccctgtctgccttcaactcggccccgccattattctcttcatcggaattatgtggatgccattttctccccgatggctcacacaccacaacagagaagaagaagctcgtcaagtcctggccaacctacgtgaccttcctaccgaccacgaacttatcgaacttgaattcctcgaaatcaaggctcagtccctgtttgagaagaggagtttggcagagaagttccctcatcttcaggaacaaactgctggcaacactattaagcttcaatttgttgctattgctgcgctgttcaagacaaaggccatgtttaagcgtgttattgtagcaacagttactatgttctttcagcaatggactggtatcaatgccatctttgagcagcttggtctgagcagcaacaccaccagtctcttggccactggagtcgtcggtatcgtcatgtttatcgctactattccagctgttttgtggattgatcgtctcggtcgtaaacctgttttggctgtcggtgctattggtatgggtctttgccatctcatcattgctgtcattctagccagaaacattgaccaattcgacacgcaccctgctgctggttgggccgctatctgcatggtgtggctattcgtggttcactttggatactcctggggtccttgtgcctggatcattatcgctgagatttggcctctcagcactcgaccttatggtgtggcgcttggtgcttccagtaactggatgaacaactttatcgtcggtcaagtcacgcccgaaatgttggacggtatcacatacggaacctacattttgtttggactcttgactatgatcggtgctgcatttatttggttctttgttccagagaccaagcgtctctcactcgaggagatggatatcatctttggatccgagggcgctgctcaagccgataacgagagaatggccgagatcaacagggagattggcctcgatgatcttatctaccgctcaggagcagttcattctaacgaagatatccaccaagatgtcaaggatgtgaaggagtaa

SEQ ID NO: 11691 - protein, 557 aa, Gibberella zeae PH-1
MGGAPTTVGTYDAALQRRQALMGASGARALVKNWKVFRIAAFACIGGILYGYNQGMFSGILVMKSFERHMGDYVQNKTKKGWLTSILELGAWLGTLMSGAIAELCSRKYGILIATSVFIIGVVIQCTAMQAGHNAILAGRFITGMGVGSLSTIVPLYNSECAPPEVRGALVALQQLAITFGIMVSFWIDYGTHFIGGTGEGQSDAAWLIPVCLQLGPAIILFIGIMWMPFSPRWLTHHNREEEARQVLANLRDLPTDHELIELEFLEIKAQSLFEKRSLAEKFPHLQEQTAGNTIKLQFVAIAALFKTKAMFKRVIVATVTMFFQQWTGINAIFEQLGLSSNTTSLLATGVVGIVMFIATIPAVLWIDRLGRKPVLAVGAIGMGLCHLIIAVILARNIDQFDTHPAAGWAAICMVWLFVVHFGYSWGPCAWIIIAEIWPLSTRPYGVALGASSNWMNNFIVGQVTPEMLDGITYGTYILFGLLTMIGAAFIWFFVPETKRLSLEEMDIIFGSEGAAQADNERMAEINREIGLDDLIYRSGAVHSNEDIHQDVKDVKE

SEQ ID NO: 11692 - DNA, 1740 bp, Gibberella zeae PH-1
  CDS (1)..(1740)
atggccattgccatgggctggcagaaacccgacaatgtcgcgggctcgtcggcgccggccatcatggtcggtctcttcgttgcctctggcgggttactgttcggctacgatactggagccataaacggtatccttgccatgacagagttcaaggaacagttcggaaaacacacaaattgcgtcgatgaaaacggcgccgtcgacatttgcacaaaagactcatccatcattgtcgctattctaagtgctggcactgcccttggtgctctactcgccgcacctaccggcgactcactaggtcgtcgcaagactctacttctggccgtcgccatcttttgcgtcggtgccatcttccaagttgctgctaataatattgacttgttgctggttggaagattctttgctggtgtaggtgtcggtctcatctctgtcctcgtcccattgtatcagtctgaaatggcgcccaaatggataagaggcactcttgtctgcgcctatcaattatcaataacctttggtctccttgccgcctctattgtcaacattctcgcctctaaacttaacaactcatctgcataccgcatcccccttggccttcaaatcgtcccagccatcattctcaccggaggtctattactgctaccagaaacacctcgctttcttgttaaaaagggcttgcatgaagccgccggcctatcacttagtcggctacgacgactcgacatcacccatccggcactcgttgatgaattgcaagagatgattgccaaccatcaatacgaactaacattaggtccggacagctacaaacaactttttatcggctcaccacatcttggtcgacgaatgtttactggatgcggactccaaatgcttcaacaacttaccggtatcaactttataatgtattacagcacatcgttctttgacggcgccggcgttgaaagcccttacaccaagtcacttatcatcaacattatcaatgttgtatcgacaataccaggtctattggtcatcgagaaatggggccgacgaagacttttgatgataggagcccttggtatggctggttgccaacttctcatggcatcattcgatactgcgacaggacaaagctatgagaaggcgtcacaaaccatcctcatcgccttttgtgccatcaacattttctttttcgctgcatcttggggtcccgtggtctgggtcgtcacttctgaaatttaccctctaaaggtccgagcaaaggccatgtccgtttcaacagcatcaaactggcttctcaactttgccattgcttactgcgccccttacttggtcggcacaggaccgggcaacgcctcctttggtccaaaaatcttctttatctggggcgccttttgcattctggccgttttctttgtgtggtgcatggtgtacgagacgagcaagatcagcctggaacagatcgacgaaatgtacgagcgtgtgaaccatgcatggaacagtaaatcattcgaaccgagctggagtttccagcagatgctcaatgatggatggtcgccaagcgctcaacctccagctgatcacgagcttcaaacgacaacaagcgcatcaagcgcagatacaactttgggtgacggcgatgcgtcttccataaccgttagccagagcaacaacaacagttcatcgcctaataacaacaatgaccagaacaaaggtccaccggccatgtcaatggccaatgttgacttcagctactag

SEQ ID NO: 11693 - protein, 579 aa, Gibberella zeae PH-1
MAIAMGWQKPDNVAGSSAPAIMVGLFVASGGLLFGYDTGAINGILAMTEFKEQFGKHTNCVDENGAVDICTKDSSIIVAILSAGTALGALLAAPTGDSLGRRKTLLLAVAIFCVGAIFQVAANNIDLLLVGRFFAGVGVGLISVLVPLYQSEMAPKWIRGTLVCAYQLSITFGLLAASIVNILASKLNNSSAYRIPLGLQIVPAIILTGGLLLLPETPRFLVKKGLHEAAGLSLSRLRRLDITHPALVDELQEMIANHQYELTLGPDSYKQLFIGSPHLGRRMFTGCGLQMLQQLTGINFIMYYSTSFFDGAGVESPYTKSLIINIINVVSTIPGLLVIEKWGRRRLLMIGALGMAGCQLLMASFDTATGQSYEKASQTILIAFCAINIFFFAASWGPVVWVVTSEIYPLKVRAKAMSVSTASNWLLNFAIAYCAPYLVGTGPGNASFGPKIFFIWGAFCILAVFFVWCMVYETSKISLEQIDEMYERVNHAWNSKSFEPSWSFQQMLNDGWSPSAQPPADHELQTTTSASSADTTLGDGDASSITVSQSNNNSSSPNNNNDQNKGPPAMSMANVDFSY

SEQ ID NO: 11694 - DNA, 1650 bp, Candida glabrata CBS 138
  CDS (1)..(1650)
atgtctgaagaatcacaatctgcattctcagcttccaacagcaaagttgagagagaggaagacttcaaagcttacgctgatgaggatggtcaacccatggttgagattcccaaaaaaccagcttctgcttataccctcatctttatcctctgcttattcatcgctttcggggggttcgttttcggttgggatactggtactatttccggttttgttgctgaggaagacttcatcaaaagattgggtcaaagacgtgccaataacacttactacctatccaaggtcagaactggtctaattgtttctatatttaacattggttgtgctattggcggtgtcgtcttatccaagtttggagatatgtatggacgtaagatcggtttaattattgtcatcgttgtttatattgtcggtatcgtgattcaaattgctactattgacaagtggtaccaatacttcatcggtagaattgtttccggtctgggtgtcggtggtattgcggtattgtctcctatgttgatttccgaagtttctccaaaacatatgagaggtacattggtctcttgctaccagttaatggtgacttgcggtatcttcttgggttattgtaccaactacggtacaaaaaactaccccaactctgtacaatggagagttccactaggtctatgttttgcttgggctctattcatgataggtggtatgctgtgtgttccagaatctccacggtacttagttgaagtcggcaaatttgaagaagctagaagatccattgccatctctaacaaacttacaccagaagatccggcagtcactttcgagttagaaaatgttcaagcaggtgttgaagcagaaagattagctggttctgcttcctggggtgaattgttctctaccaagacgaaggtcttacaacgtttgattatgggcatcatgcttcaatgtttgcaacaattgacaggtgacaactacttcttctactatggtactactgttttcaaggctgttggcttggaagattctttccaaacttcaattgttattggtatcgttaactttgcatccacattcgtagctttgtacgttgttgaccgcttcggtcgtcgtaaatgtctcttgtggggagccgctagcatgactgcttgtatggttgtctttgcatcagttggtgtcaccagattatatccaaacggtatggaccaaccatcctccaagggtgctggtaactgtatgattgttttcacctgtttctacattttctgtttcgcaacaacttgggcaccaactccatgggtcatcaactccgaaacattcccattgagggttaaagccaagtgtatggcaatatgtcaagccgctaactggatctggggtttcttaattgccttcttcactccgttcatcacgggtgctatcaatttctactatggttacgtcttcatgggctgcctatgtttctcctacttctacgttttcttttttattccagaaacaaaaggcttaacattggaggaagtcaacactatgtgggaagaaggcgtcttgccatggaagtctccagattggattccaccatcaaagagagacgccacctatgatgctgatgccatgatgcacgatgataagccatggtaccggagaatgtggtaa

SEQ ID NO: 11695 - protein, 549 aa, Candida glabrata CBS 138
MSEESQSAFSASNSKVEREEDFKAYADEDGQPMVEIPKKPASAYTLIFILCLFIAFGGFVFGWDTGTISGFVAEEDFIKRLGQRRANNTYYLSKVRTGLIVSIFNIGCAIGGVVLSKFGDMYGRKIGLIIVIVVYIVGIVIQIATIDKWYQYFIGRIVSGLGVGGIAVLSPMLISEVSPKHMRGTLVSCYQLMVTCGIFLGYCTNYGTKNYPNSVQWRVPLGLCFAWALFMIGGMLCVPESPRYLVEVGKFEEARRSIAISNKLTPEDPAVTFELENVQAGVEAERLAGSASWGELFSTKTKVLQRLIMGIMLQCLQQLTGDNYFFYYGTTVFKAVGLEDSFQTSIVIGIVNFASTFVALYVVDRFGRRKCLLWGAASMTACMVVFASVGVTRLYPNGMDQPSSKGAGNCMIVFTCFYIFCFATTWAPTPWVINSETFPLRVKAKCMAICQAANWIWGFLIAFFTPFITGAINFYYGYVFMGCLCFSYFYVFFFIPETKGLTLEEVNTMWEEGVLPWKSPDWIPPSKRDATYDADAMMHDDKPWYRRMW

SEQ ID NO: 11696 - DNA, 1707 bp, Candida glabrata CBS 138; identical to SEQ ID NO: 4654
  CDS (1)..(1707)

SEQ ID NO: 11697 - protein, 568 aa, Candida glabrata CBS 138; identical to SEQ ID NO: 4655

SEQ ID NO: 11698 - DNA, 1692 bp, Candida glabrata CBS 138; identical to SEQ ID NO: 4652
  CDS (1)..(1692)

SEQ ID NO: 11699 - protein, 563 aa, Candida glabrata CBS 138; identical to SEQ ID NO: 4653

SEQ ID NO: 11700 - DNA, 1602 bp, Candida glabrata CBS 138
  CDS (1)..(1602)
atgatcagcggccctaaggaagaacttcaaaaggaggttgaagaagaactgcaccacaaaaagaagagtgacctaatatttgtctccttatgctgtattatggttgcctttggtggttttgtttttggctgggatacaggtactatttctggttttgttaaccaaacagattttctgagaagatttggacaacaaagaagtgatggtacctattacttgtctaatgttagaacaggtttaattgtcgctatctttaatatcggatgtgctattggtggtattaccctttcaaaacttggtgatatttggggaagaagattgggcttggttacggtcgtggttgtatatacaatcggcattgttatccaaatcgcctctattgataaatggtaccagtacttcatcggtagaattatctccggtttaggtgtcggtggtatcgctgtcttgtcaccaatgttaatctctgaggtttctccaaaacaattaagaggtacattagtttcttgctaccaactaatgattacatgtggtatctttttgggctactgtaccaattacggtacaaaaaactactccaactctgtccaatggagagttccattagggttatgtttcgcatgggcattatttatgatatttggtgttatgtgtgttcctgaatctccaagatatcttgtggaagtaggcaagttagaagaagccaagcgttctcttgccagagccaataaaacaactgtagattctccaatcgtccttttggaactggacaaatatcaagcatcagttgaagctgaacgtctggccggctctgcatcatggggagaattagtcacaggtaaaccacaaatgttaagacgtacaatcatgggtatgatgatccagtcgctacaacaattaacgggtgcaaactacttcttctactatggtactaccattttcagagctgttggattagatgattcattccaaactgcaattgttttaggtgttgtcaactttgtttcaacattctatgccttgtatactgtagaccactatggtcgccgtaattgtttaatgtggggttgtgttggtatggtatgttgttacgttgtctatgcctctgttggtgtaacgagactatggccaaatggtgagggtaacggctcttccaaaggtgctggtaactgtatgattgtttttgcatgtttctttattttctgttttgccactacatgggcaccaattgcctatgttattgtctctgagtcatacccactaagaattcgtggtaaggccatgtccatcgctattgctgctaactggatctggggtttcttgattgcttttttcactcctttcatcacatccgccattaatttctattacggatatgtcttcatgggctgtatggtatttgcatacttctacgtctttttctttgtccctgaaacaaaaggattaactctagaagaagttaatcaaatgtatgaagagggtgtacttccatggaagtcatccagttgggtgcctccagacagaagaactgccgagtacaatttggatgactattcccacgatgataagccatggtataagagagtattctcaagaaattga

SEQ ID NO: 11701 - protein, 533 aa, Candida glabrata CBS 138
MISGPKEELQKEVEEELHHKKKSDLIFVSLCCIMVAFGGFVFGWDTGTISGFVNQTDFLRRFGQQRSDGTYYLSNVRTGLIVAIFNIGCAIGGITLSKLGDIWGRRLGLVTVVVVYTIGIVIQIASIDKWYQYFIGRIISGLGVGGIAVLSPMLISEVSPKQLRGTLVSCYQLMITCGIFLGYCTNYGTKNYSNSVQWRVPLGLCFAWALFMIFGVMCVPESPRYLVEVGKLEEAKRSLARANKTTVDSPIVLLELDKYQASVEAERLAGSASWGELVTGKPQMLRRTIMGMMIQSLQQLTGANYFFYYGTTIFRAVGLDDSFQTAIVLGVVNFVSTFYALYTVDHYGRRNCLMWGCVGMVCCYVVYASVGVTRLWPNGEGNGSSKGAGNCMIVFACFFIFCFATTWAPIAYVIVSESYPLRIRGKAMSIAIAANWIWGFLIAFFTPFITSAINFYYGYVFMGCMVFAYFYVFFFVPETKGLTLEEVNQMYEEGVLPWKSSSWVPPDRRTAEYNLDDYSHDDKPWYKRVFSRN

SEQ ID NO: 11702 - DNA, 1659 bp, Candida glabrata CBS 138
  CDS (1)..(1659)
atgtctgatcaagaatcaagatcacaatctgtcttgtcagcctccaacagtaaggctgacagagaagacgaattcaaggcttatgtcgatgaggaaggtcaaccaatggttgaaattccaaagaagcctgcttccgcttacgtctctatttccatcttctgtctattcatcgctttcggtggtttcgttttcggttgggatactggtaccatttctggtttcgttgcccaaactgatttcatcagaagattgggtcaaactcgtgctaatggtactcactacttgtctaaggttagaactggtctagtcgtctccattttcaacatcggttgtgctatcggtggtattgttttgtctaagttgggtgatatgtatggtcgtaagatcggtttgatcagtgtcgttgtcatctacattgtcggtatcgttattcaaattgctaccattgacaagtggtaccaatacttcatcggtagaattatctccggtttgggtgttggtggtattgccgtcttgtctcctatgttgatttctgaagtctctccaaagcacatgagaggttctttggtttcctgttaccaactgatgattacctgtggtatcttcttgggttactgtactaactacggtaccaagaactactccaactctgtccaatggagagttccattgggcctatgtttcgcctgggctctattcatgatcggtggtatgaccttcgttccagaatctccacgttacttgattgaggttggtagagttgaagaagccagaagatccattgctatctctaacaaggtttctccagatgatccagctgtcactttcgaagttgaaaatgtccaagctgctgttgaagctgaaagattggctggttctgcttcctggggtgaattgttctctaccaagactaaggttttccaacgtttgattatgggtatcatgattcaatctttgcaacaattgacaggtgacaactacttcttctactatggtactactgttttcaaggctgttggtttggaagattctttcgaaacctccattgtcattggtattgttaacttcgcttccactttcgttgccttgtacgttgttgaccgtttcggtcgtcgtagatgtctattgtggggtgccgctgctatgactgcttgtatggttgtcttcgcttctgtcggtgtcaccagactatggccaaatggtcaagaccaaccatcctccaagggtgctggtaactgtatgattgttttcacctgtttctacattttctgtttcgctaccacctgggctccaattccatttgttgtcaactctgaaactttcccattgagagttaaggccaagtgtatggctattgcccaagcttccaactggatctggggtttcttgattgccttcttcactccatttattaccaatgccattaacttctactacggttacgtgttcatgggctgtctatgtttctcctacttctacgttttcttcttcattccagagaccaagggtctaactttggaagaagtcaacactttgtgggaagaaggtgtcttgccatggaagtctccaaactgggttccaccatccaagagagatgcttcttacgatgctgacgctatgatgcacgatgacaagccatggtacaagagatttgtttaa

SEQ ID NO: 11703 - protein, 552 aa, Candida glabrata CBS 138
MSDQESRSQSVLSASNSKADREDEFKAYVDEEGQPMVEIPKKPASAYVSISIFCLFIAFGGFVFGWDTGTISGFVAQTDFIRRLGQTRANGTHYLSKVRTGLVVSIFNIGCAIGGIVLSKLGDMYGRKIGLISVVVIYIVGIVIQIATIDKWYQYFIGRIISGLGVGGIAVLSPMLISEVSPKHMRGSLVSCYQLMITCGIFLGYCTNYGTKNYSNSVQWRVPLGLCFAWALFMIGGMTFVPESPRYLIEVGRVEEARRSIAISNKVSPDDPAVTFEVENVQAAVEAERLAGSASWGELFSTKTKVFQRLIMGIMIQSLQQLTGDNYFFYYGTTVFKAVGLEDSFETSIVIGIVNFASTFVALYVVDRFGRRRCLLWGAAAMTACMVVFASVGVTRLWPNGQDQPSSKGAGNCMIVFTCFYIFCFATTWAPIPFVVNSETFPLRVKAKCMAIAQASNWIWGFLIAFFTPFITNAINFYYGYVFMGCLCFSYFYVFFFIPETKGLTLEEVNTLWEEGVLPWKSPNWVPPSKRDASYDADAMMHDDKPWYKRFV

SEQ ID NO: 11704 - DNA, 1650 bp, Candida glabrata CBS 138
  CDS (1)..(1650)
atgtctgaagaatcacaatctgctctctcggcctccaacagcaaagttgaaagagaggacgagttcaaggcttacaccgatgaggatggccaaccaatggttgagatcccaaagaagcctgcttccgcttacgttgctatttccatcttctgtctattcatcgctttcggtggtttcgttttcggttgggatactggtaccatttctggtttcgttgcccaaactgatttcatcagaagaatgggtcaaactcgtgctaatggtactcactacttgtctaaggttagaaccggtttaattgtttctattttcaacatcggttgtgccattggtggtgttgtcttgtccaagctaggtgatgtttacggtcgtaagatcggtttgatcagtgtcgttgtcatctacattgtcggtatcgttattcaaattgctaccattgacaagtggtaccaatacttcatcggtagaattatctccggtttgggtgttggtggtattgccgtcttgtctcctatgttgatttctgaagtctctccaaagcacatgagaggttctttggtttcctgttaccaactgatgattacctgtggtatcttcttgggttactgtactaactacggtaccaagaactactccaactctgtccaatggagagttccattgggcctatgtttcgcctgggctctattcatgatcggtggtatgaccttcgttccagaatccccacgttacttgattgaggttggtagagttgaagaagccagaagatccattgctatctctaacaaggtttctccagatgatccagctgtcactttcgaagttgaaaatgtccaagccggtgttgaagctgaaagattggctggttctgcttcctggggtgaattgttctccaccaagaccaagattttccaacgtttgattatgggtatcatgattcaatctttgcaacaattgacaggtgacaactacttcttctactatggtactactgttttcaaggctgttggtttggaagattctttcgaaacctccattgtcattggtattgttaacttcgcttccactttcgttgccttgtacgttgttgaccgtttcggtcgtcgtagatgtctattgtggggtgccgctgctatgactgcttgtatggttgtcttcgcttctgtcggtgtcaccagactatatcctcacggtatgaaacagccatcatccaagggtgctggtaactgtatgattgttttcacctgtttctacattttctgtttcgctaccacctgggctccaattccatttgttgtcaactctgaaactttcccattgagagtcaaggccaagtgtatggctattgcccaagcttccaactggatctggggtttcttgattgccttcttcactccatttattaccaatgccattaacttctactacggttacgtgttcatgggctgtctatgtttctcctacttctacgttttcttcttcattccagagaccaagggtctaactttggaagaagtcaacactatgtgggaagaaggtgtcttggcttggaagtctccaaactgggttccaccatccaagagagatgcttcttacgatgctgacgctttgatgcacgatgacaagccatggtacaagagattctattaa

SEQ ID NO: 11705 - protein, 549 aa, Candida glabrata CBS 138
MSEESQSALSASNSKVEREDEFKAYTDEDGQPMVEIPKKPASAYVAISIFCLFIAFGGFVFGWDTGTISGFVAQTDFIRRMGQTRANGTHYLSKVRTGLIVSIFNIGCAIGGVVLSKLGDVYGRKIGLISVVVIYIVGIVIQIATIDKWYQYFIGRIISGLGVGGIAVLSPMLISEVSPKHMRGSLVSCYQLMITCGIFLGYCTNYGTKNYSNSVQWRVPLGLCFAWALFMIGGMTFVPESPRYLIEVGRVEEARRSIAISNKVSPDDPAVTFEVENVQAGVEAERLAGSASWGELFSTKTKIFQRLIMGIMIQSLQQLTGDNYFFYYGTTVFKAVGLEDSFETSIVIGIVNFASTFVALYVVDRFGRRRCLLWGAAAMTACMVVFASVGVTRLYPHGMKQPSSKGAGNCMIVFTCFYIFCFATTWAPIPFVVNSETFPLRVKAKCMAIAQASNWIWGFLIAFFTPFITNAINFYYGYVFMGCLCFSYFYVFFFIPETKGLTLEEVNTMWEEGVLAWKSPNWVPPSKRDASYDADALMHDDKPWYKRFY

SEQ ID NO: 11706 - DNA, 1671 bp, Candida glabrata CBS 138; identical to SEQ ID NO: 4656
  CDS (1)..(1671)

SEQ ID NO: 11707 - protein, 556 aa, Candida glabrata CBS 138; identical to SEQ ID NO: 4657

SEQ ID NO: 11708 - DNA, 1695 bp, Candida glabrata CBS 138; identical to SEQ ID NO: 4650
  CDS (1)..(1695)

SEQ ID NO: 11709 - protein, 564 aa, Candida glabrata CBS 138; identical to SEQ ID NO: 4651

SEQ ID NO: 11710 - DNA, 1668 bp, Candida glabrata CBS 138
  CDS (1)..(1668)
atgtcacaaagtgccatttcatccacatccgctactgatcctgagagacagaccccagaaactaagctggaaggcgaagatttccaactgaaggccgatgaagccagtattcaaggcgctgagattccaagaaagcccttaggcgcttactggaccgttatgtgtctatgtttaatgattgcctttggtggttttgtctttggttgggatacaggtactatctctggttttgttgctcaaactgatttcaaaagaagattcggtcaaagacactcagatggtacttactacttgtcaaatgttagaactggtctaattgtcgctatatttaatattggatgtgccttcggtggtctaactttaggccgtactggtgatttgtatggccgtaagaaaggtctagtcattgttgtttctgtctatgttgttggtattattattcaaatcgcttcggtagacaaatggtaccagtattttattggtagaattatttctggtctaggtgttggtggtattgccgttctttctccaaccttaatttctgaaacagctcctaaacatctaagaggtacttgtgtttcattctaccaattaatgattactctaggtattttcttgggttactgtacaaactatggtaccaagaattattctaactccgtccaatggagagtcccattgggtctatgttttgcctgggctttgttcatgattggtggtatgtccatggttccagaatctccaagatttttggttgaaaaaggcagattagaagaagccagacgttctattgctatttccaacaagctttccatggatgaccctggtgtaaccttcgaattagatactataagcgcaggtgttgaagctgaaagacttgctggtagtgcctcttggggtgaattattttctaataagggtaagattctacctcgtgttattatgggtgtaatgattcaatctttgcaacaactgacaggtaataactactttttctactatggtaccacaattttcaaggctgtcggtttggaagattcattccagacatccattgtcctaggtattgttaacttcgcttctacatttgtgggtttatggactgtcgagagatttggccgtcgtagatgtttgttgtggggttctgcaactatggctgcttgttttgtcatctttgcttcagtcggtgtaaagagtctgtatcctcacggtagagaccatgcatcctctaagggtgccggtaactgtatgattgttttcacatgtttcttcattttctgttttgctactacttgggctccaattgcctacgttattgtctctgaaacttatccattgcgtgttaagaaccgtgccatggctattgctgttggctctaactggatttggggtttcttgattggtttcttcactccattcattaccagtgcgattaacttctcttatggttatgtattcatgggttgtttggtattctcttacttctatgttttcttctttgtctgtgaaactaagggattaacattagaagaagttaatgatatgtatgaagaaggtgtcttaccatggaagtctccaaactgggttccaccatctagaagagatgcttcttacgatatcgacgctatgatgcacgatgacaagccatggtacaagagattcttgtaa

SEQ ID NO: 11711 - protein, 555 aa, Candida glabrata CBS 138
MSQSAISSTSATDPERQTPETKLEGEDFQLKADEASIQGAEIPRKPLGAYWTVMCLCLMIAFGGFVFGWDTGTISGFVAQTDFKRRFGQRHSDGTYYLSNVRTGLIVAIFNIGCAFGGLTLGRTGDLYGRKKGLVIVVSVYVVGIIIQIASVDKWYQYFIGRIISGLGVGGIAVLSPTLISETAPKHLRGTCVSFYQLMITLGIFLGYCTNYGTKNYSNSVQWRVPLGLCFAWALFMIGGMSMVPESPRFLVEKGRLEEARRSIAISNKLSMDDPGVTFELDTISAGVEAERLAGSASWGELFSNKGKILPRVIMGVMIQSLQQLTGNNYFFYYGTTIFKAVGLEDSFQTSIVLGIVNFASTFVGLWTVERFGRRRCLLWGSATMAACFVIFASVGVKSLYPHGRDHASSKGAGNCMIVFTCFFIFCFATTWAPIAYVIVSETYPLRVKNRAMAIAVGSNWIWGFLIGFFTPFITSAINFSYGYVFMGCLVFSYFYVFFFVCETKGLTLEEVNDMYEEGVLPWKSPNWVPPSRRDASYDIDAMMHDDKPWYKRFL

SEQ ID NO: 11712 - DNA, 2289 bp, Candida glabrata CBS 138
  CDS (1)..(2289)
atggattctagcttcgaaatactcccgtaccgtggtgacgatcaaataccgagagttgatagtggcgggttgcgaagacgagcatcacagacaataaatactaatcatgatgacacttgtgttgatatagatgcctacaatagtggtatagatgtgtcaagtaagaatgagtatcttggaatcaataccgcagacgatgataatgaatatggtaacggtggaatgcaaaattatgaaggacctgtgaatgagcaagctatccattgtcaaaccaacgatatatcagaaaatgaaaataatctacagttgcttggacagccattgccacttcgttcaactatgatgaccacgtttgtgggacttttcgttgccgttggtgggtttttatatggttatgatacaggtctgataaatagtataactgatatgaaatacgttaaagaacacattgcaccaaatcactcattctttactacaacacagatatcgatgctggtgtcatttttatcattgggcacatttgtaggcgccctcattgctccatggatttcagatatttatggaagaaagtcaacaattatattcagtactatgatcatcttttcgataggtaactctctgcaagtagcagctggcgggctggcattgttaattgttgggagggtaatatctggtattggaataggtataatatctgctgtagttcccctttatcaggctgaagctgcacagaagcacatgagaggagccattattactacctaccagttggctattactttaggattactcgtttcaagcgcagtgtcacaaggcacagagtctatcaatgctccgagttcatacagagttcccataggattacagtatgtctggtctgttgttttaggtgttggaatggtttttttaccagaaagtcctcggtattatataatgaaggatgagatagaagaagcagcgagaagtttatcgttcttgagaggtatctctttagaagatccaaggctcttagaggaactagtcgaaattaaagctaactacgattatgaatcctcatttggtcctgtatcaatatgggattgtttcagatccagtgagcaacgtccaaagcaggtgctgagaatgtttactgggatatctatacaagctttccaacaattttctggtattaatttcatcttttactatggtgtttatttcttcaacaagacaggtattaaaagtagttacctggtgtcgtttgtcacttatgctgtgaatgttgcattcaacataccagggatgtttttaattgactatttagggagaagaaaagtattaatcttcggtggcattgcaatgactgcttgcaactttattattgccattgtgggtgtttctgccaaatccattgtttcaaataatgtaatgattgcatttatttgtgttttcatagcagccttctcgagtacatggggtggtgttgtatgggtaatctctgcagagctatttcccttgggtgtgagatcaaagtgcactgctatatgtgcggcagccaattggctagttaactttgtctgtgcattgatgactccttatattgtcgatacaggatcaaactacacatcttcgatgggtaccaagatatacttcatttggggaagtctgaatgcccttggaactatagttgcatatctgacagtgtatgagacgagagggttgacgcttgaagaaatcaatgagttgtacgttaactcacccacaccatttgcgtcgaacgaatggaatagaaagattcgcacagaatccacgatcccacctatggtacatgaccatgaactagataaccacattgtgccaacaatggacaacattctccatagcagaaatccaaaccagccatactcttcagatgagaaccaagatgttatagtaggggaagacaagctggacttggagcaaggctacaataaggagattcacaaccacagggatgataacaacgtatcgccaataccattcctccaggaacaaaatgggaaagaattcagcaatggtgctgatttcagcccatcgacacactcaacttttgccttgaccgagcacataccagcgaactacgtggaattggggaacggatttggattaaacacatacaggggcgggcccccatccatctccgattctagtgatgacgatcattgcacacactggcaaagcccagagaatggatcacctatataccatgaaattctgtcctctaacgacacgaatagtggcacttacaacaagaactctgaaaatttatag

SEQ ID NO: 11713 - protein, 762 aa, Candida glabrata CBS 138
MDSSFEILPYRGDDQIPRVDSGGLRRRASQTINTNHDDTCVDIDAYNSGIDVSSKNEYLGINTADDDNEYGNGGMQNYEGPVNEQAIHCQTNDISENENNLQLLGQPLPLRSTMMTTFVGLFVAVGGFLYGYDTGLINSITDMKYVKEHIAPNHSFFTTTQISMLVSFLSLGTFVGALIAPWISDIYGRKSTIIFSTMIIFSIGNSLQVAAGGLALLIVGRVISGIGIGIISAVVPLYQAEAAQKHMRGAIITTYQLAITLGLLVSSAVSQGTESINAPSSYRVPIGLQYVWSVVLGVGMVFLPESPRYYIMKDEIEEAARSLSFLRGISLEDPRLLEELVEIKANYDYESSFGPVSIWDCFRSSEQRPKQVLRMFTGISIQAFQQFSGINFIFYYGVYFFNKTGIKSSYLVSFVTYAVNVAFNIPGMFLIDYLGRRKVLIFGGIAMTACNFIIAIVGVSAKSIVSNNVMIAFICVFIAAFSSTWGGVVWVISAELFPLGVRSKCTAICAAANWLVNFVCALMTPYIVDTGSNYTSSMGTKIYFIWGSLNALGTIVAYLTVYETRGLTLEEINELYVNSPTPFASNEWNRKIRTESTIPPMVHDHELDNHIVPTMDNILHSRNPNQPYSSDENQDVIVGEDKLDLEQGYNKEIHNHRDDNNVSPIPFLQEQNGKEFSNGADFSPSTHSTFALTEHIPANYVELGNGFGLNTYRGGPPSISDSSDDDHCTHWQSPENGSPIYHEILSSNDTNSGTYNKNSENL

SEQ ID NO: 11714 - DNA, 1713 bp, Candida glabrata CBS 138; identical to SEQ ID NO: 4648
  CDS (1)..(1713)

SEQ ID NO: 11715 - protein, 570 aa, Candida glabrata CBS 138; identical to SEQ ID NO: 4649

SEQ ID NO: 11716 - DNA, 2571 bp, Candida glabrata CBS 138
  CDS (1)..(2571)
atgacgatcatatcggaggatgagaagagtgtggcccgagatagagagggtgtgttggctcgggctatcaaagtggtaaacaggaagttcaggaggaaagatgtacggcgggaaaagctagagcgagcgcttagctgtgataaccagatgacgttgaactctacgaatctctacgcggcgcagcagcaagagtatcagcggagggaggagaatgatatagaggagaaccaggagccggagggtggtaatgacgatatagactacgacatctcaatactatcggacgagatgtctaccgtggacgacgcatctctgctttttgcggagccaccgcagaagcagtcgcatatgatgtctatagtggtgggtgcgtttgttgcagttggtggatttctgtttggctacgacacggggctcataaacagtatagtagacatgaggtatgtgcgggagaatatcgcgccaaatcacgttggattcacggcgcagcagctggccatattggtttcgttcctatctctgggcacttttgtaggtgctctgtcggcaccggtgatatctgataaatacggcaggaaaaagacaattatgtttagcacagcggtggtgttctcacttggtaattccttgcaggtgggggcacataacattcaattacttattgcaggcagagttatatctggtctaggtgttggcctggtatccgcagttgtaccattatatcaagcagaggctgctcataaatcgctgagaggtgccatcatttcaacttatcagtgggccatcacttggggtttgttggtgtcaagtgcagtatcgcaaggaacacataatagaaatgacgcttcctcgtataggatacccataggtcttcaatatgtctgggcatatatattagcagctggtatgctatggcttccggaaagccctcggtattatgttctcagagatcaactagacaaagctgcacaatcattatcattcttaagaggagttcctatccatgattcaggactactagaagaacttgtagaaataaaggcaacatttgactacgaatcatcattcggcaaaacaaccttctgggactgttttaaatcgaataagagtagacctaaacaaacacttagaatgtttacaggtattgctattcaggcattccagcaattttcaggtatcaattttatcttctactatggtgtaagtttcttcaatagatctggtgtcgaaaacagctacattgtttcattaataacgtacgcagtaaatgttgggttcagtgttcccgggatgttcctggtggaatattttggtagaagaagtgtgttgctatatggaggtgcgattatgactctatcgaatttcattatcgctatagtaggatcctcgacacaatccgtcgtggctaataaagttatgatagctttcatatgcttattcattgcatcatttgcggcaacctggggtggtgtagtgtgggttatatctgccgagttataccctcttggagtcagagccaaatgtactgccatctgtgcggcagctaattggctgattaattttgtttgtgctttcataactccttacattgttgatacgggcgaaagaagagcattgattggaccaaagatttattttatttggggtagcttgaacgctctaggtattctggtggtatatttcactgtttatgaaaccagagggctaaccttggaagaaatagatgaactatatacaaaatcacccaacggtattgtatcagctaagtggaataggagaataagacacagagaaaaaacatatggccacaaggagcaacaaaatagagatagaaatcaacaaactaccaaggaaaacctacgtaagaatgttgtaaatgaagacatgctaagtgatgacctaactcctcgcaatgactctataaacacccatcatagtgttgattctaatgaaaagtatcaaagtgaaaacaccgataacactttagcacccgcagttaacgataggagtatgatggattttggcaatgacatgatattacatatatgtaatagaggtcctccatctatctccactgcagctagtgtagaagagtttggcggaaactcaacccaaatggagaacctcagttataatgaaagtaacagtgtcgaaaagaaaaaagtgggcttgttttccaagttcaagctgggttcacgaaagtcttccattaatgggactgaagaagacagcaaaccaaaatctccgcaactgggtcaagccgaattttctccatctccattagatgtgaaggtatctgatgatgatcacaatgacttcgttgatttaggcaatggttttggtttgtacagtgttaccagaagactttcctcaggagtacctgatacaagtgacgaggaatctgcatatgatcttggtaatgcaccatcatcaacaaatacttatagaaatagaggtaacctggattcaataaacacgtatatgtcacaattaattcagagtaatacctataccagccaaaatacagggtactcacaaaacgacaacgatcagacgcagcaccatcaatga

SEQ ID NO: 11717 - protein, 856 aa, Candida glabrata CBS 138
MTIISEDEKSVARDREGVLARAIKVVNRKFRRKDVRREKLERALSCDNQMTLNSTNLYAAQQQEYQRREENDIEENQEPEGGNDDIDYDISILSDEMSTVDDASLLFAEPPQKQSHMMSIVVGAFVAVGGFLFGYDTGLINSIVDMRYVRENIAPNHVGFTAQQLAILVSFLSLGTFVGALSAPVISDKYGRKKTIMFSTAVVFSLGNSLQVGAHNIQLLIAGRVISGLGVGLVSAVVPLYQAEAAHKSLRGAIISTYQWAITWGLLVSSAVSQGTHNRNDASSYRIPIGLQYVWAYILAAGMLWLPESPRYYVLRDQLDKAAQSLSFLRGVPIHDSGLLEELVEIKATFDYESSFGKTTFWDCFKSNKSRPKQTLRMFTGIAIQAFQQFSGINFIFYYGVSFFNRSGVENSYIVSLITYAVNVGFSVPGMFLVEYFGRRSVLLYGGAIMTLSNFIIAIVGSSTQSVVANKVMIAFICLFIASFAATWGGVVWVISAELYPLGVRAKCTAICAAANWLINFVCAFITPYIVDTGERRALIGPKIYFIWGSLNALGILVVYFTVYETRGLTLEEIDELYTKSPNGIVSAKWNRRIRHREKTYGHKEQQNRDRNQQTTKENLRKNVVNEDMLSDDLTPRNDSINTHHSVDSNEKYQSENTDNTLAPAVNDRSMMDFGNDMILHICNRGPPSISTAASVEEFGGNSTQMENLSYNESNSVEKKKVGLFSKFKLGSRKSSINGTEEDSKPKSPQLGQAEFSPSPLDVKVSDDDHNDFVDLGNGFGLYSVTRRLSSGVPDTSDEESAYDLGNAPSSTNTYRNRGNLDSINTYMSQLIQSNTYTSQNTGYSQNDNDQTQHHQ

SEQ ID NO: 11718 - DNA, 1596 bp, Candida glabrata CBS 138
  CDS (1)..(1596)
atggagcaagtcactatcggtgttatatcattagattcatctcctacagaaaattacacgctgaacacagcagaaacaaggcaatcatttcagctctctggaaagagtgaagtaaataccataccgggagaaaaatatgaagaactaaagatgaagtacatacgccagcacactaaagcagtagtattatgttgtttaatatcatttggaggaatgatactaggctgggacatcggtaccgtgggtggtgtgtcgataatgccaagtttcaataatgcattcggtgatcaaacgacgattgtgtcctctgcaaaggaactctcaaatatgaaaagaggtctttacatttccatattcaacattggatgtgccttaggtggtattatgttttctaggttatcaaatactgtgggtcgtagagtaggaattctaaccgctatagcaaagtatactcttgtcctgacggtccagttattctcaaatggaaactttatccttcttctggcatctagatttgtattgggagtaactgttggcgcaataagtgttttggtgccgatgtttgtatcagaaagtgcgccaattaaaattcgaggagcattagtggtagtctatcaactagcaataacattgggaatactctttggaaatatactaaactacatgactaacaagcatttgtctatggtagatcccatgaacaatatggcatggaaaattccgatgctattcggttacctttgggctgccattgttgcagtgggcgcttgtattaccccggaatctgtccatttcctagccaaaattcgtaatgattatgaaagtgccaaaatatcatattcgatcatgaacaatatttcagtatttgaccatgaaactatcgattatgttaacaacttgctagtaaagcaagatgtgtataatgagaacgaccttaggaaccataaatttgagtttttatatggtaagccaaaatatggaaaacgcctacttattggcatcatggtgatggcctttcaacaactttctggtataaactacttcttctattatggaacctcattattcaaaagtgttggaatcaaagatacatacgccacggctatcatactttcatcagtcaattttattagtacttttgcaggcatctacttagtggaaagccttggaagaagatctacactaatttatggctcatttggcatgttcatatgtatgatattttatgcgtcttttggaactttaagtttgagaaaggatctattatcattcgtactgatcattgttacatgcttatttatctcgatcttcgccataactatcggcccagtatcatttgtagttgtagccgaattgttcccaacaagaactagatccgtttcaatgtctatatgctcttcctttaattggctagttaatttcgccattgctctggcaacaccagtgataatcaatagaataggcttcctttatgggtttttctttgcaggttgtcttctattagcaactggatttgaagcattctttgtaccagaaactaaaaataaaacagaagaagaaatagactatatgttccaaaacaacttgaaatcgtga

SEQ ID NO: 11719 - protein, 531 aa, Candida glabrata CBS 138
MEQVTIGVISLDSSPTENYTLNTAETRQSFQLSGKSEVNTIPGEKYEELKMKYIRQHTKAVVLCCLISFGGMILGWDIGTVGGVSIMPSFNNAFGDQTTIVSSAKELSNMKRGLYISIFNIGCALGGIMFSRLSNTVGRRVGILTAIAKYTLVLTVQLFSNGNFILLLASRFVLGVTVGAISVLVPMFVSESAPIKIRGALVVVYQLAITLGILFGNILNYMTNKHLSMVDPMNNMAWKIPMLFGYLWAAIVAVGACITPESVHFLAKIRNDYESAKISYSIMNNISVFDHETIDYVNNLLVKQDVYNENDLRNHKFEFLYGKPKYGKRLLIGIMVMAFQQLSGINYFFYYGTSLFKSVGIKDTYATAIILSSVNFISTFAGIYLVESLGRRSTLIYGSFGMFICMIFYASFGTLSLRKDLLSFVLIIVTCLFISIFAITIGPVSFVVVAELFPTRTRSVSMSICSSFNWLVNFAIALATPVIINRIGFLYGFFFAGCLLLATGFEAFFVPETKNKTEEEIDYMFQNNLKS

SEQ ID NO: 11720 - DNA, 1587 bp, Kluyveromyces lactis NRRL Y-1140
  CDS (1)..(1587)
atgtccttagatacagaatcatttgaaactgctgaaaaagcaattgaggtagtcacaaaggaaatggtatctttgacaaattactcagccattggatcattaaccagtcagttatctcagaatgacactaagtcaggtggaattgaacagaaaaagttaccgttgaaaccaatattattgtgtctggctacttcttttgcagggtttatctttggctgggatgttggcacaattggtgggattacaaacatggtatcatttcaaaacttttttggtaccaactttgattcttcgagtaatacacactactttccaaaacttcttattggattaatcgtttccattttcaatatcagttgcgcacttggtggattatttctagtgaagattgctgatattaatggaagaaaaccaggtatttatgctgcaatcactatctattcgttgggaacattgattggctggacatgtggctcctcttggtggtatttcttcttcgcaaggttcatttcaggacttggtgttggtgctactgcggtgatgataccaatgtttatagccgaatctgctcccatcaacattcgtggtgccatggttgtgctctaccagttaatgatcactcttggaattttgctcggaaatgtcatcaactattgttgcagatccactttacacgaaacagataatgccacatggaagatccctgtaggattaggaaacgtctgggccgctatcgtcgcgctaggtgttcattttatgcctgaatcaccagtttttcttaccaagaggttaggaagcgctctcaaagctaaggcagcttttgcccatatgaacaatttggacgtagatgatccaattgtggatagtcatattaggaagatgatggaatcagctgacgcggaggtatctactcacaatgatatgaagaacagcaggtttgaattcatactcggtcaaccaagattaggttttagactatttattggtattatggtgatggcgtttcaacagctatccggtgcaaattacttcttctattatggtacaacacttttcaactctgtgggaattgaagacccatacttaacgtcgattttattgtcttctgtcaacttcatatctacctttttcggtatttatttagttgaaaagttaggcagaaaagcatgcttaattcttggttccgcgggtatgtttacctgtatgtccgtgtatgcgtcagtcggatcgttcgcacttaataagtcgcctcaaaactctggtgcgattatggttaccttcacgtgtgtttacatcatgttctttgcatgcacatcgggacctgtgtcctttgtcgtcatttcggagttgtttccaagcaggacaaaagcgatatccatggcagtgtgtacctcaatcaattggctttgcaacttcttcatttctttatgcacaccatatgtcactgataagataggcttcaagtttgggttcgtttttgctggttgtctatttgtctcattctggttcttcactttcttattgaaggaaactaagaacaaaactcctgaacaggttgacgcattgtattctattgacaagcaatag

SEQ ID NO: 11721 - protein, 528 aa, Kluyveromyces lactis NRRL Y-1140
MSLDTESFETAEKAIEVVTKEMVSLTNYSAIGSLTSQLSQNDTKSGGIEQKKLPLKPILLCLATSFAGFIFGWDVGTIGGITNMVSFQNFFGTNFDSSSNTHYFPKLLIGLIVSIFNISCALGGLFLVKIADINGRKPGIYAAITIYSLGTLIGWTCGSSWWYFFFARFISGLGVGATAVMIPMFIAESAPINIRGAMVVLYQLMITLGILLGNVINYCCRSTLHETDNATWKIPVGLGNVWAAIVALGVHFMPESPVFLTKRLGSALKAKAAFAHMNNLDVDDPIVDSHIRKMMESADAEVSTHNDMKNSRFEFILGQPRLGFRLFIGIMVMAFQQLSGANYFFYYGTTLFNSVGIEDPYLTSILLSSVNFISTFFGIYLVEKLGRKACLILGSAGMFTCMSVYASVGSFALNKSPQNSGAIMVTFTCVYIMFFACTSGPVSFVVISELFPSRTKAISMAVCTSINWLCNFFISLCTPYVTDKIGFKFGFVFAGCLFVSFWFFTFLLKETKNKTPEQVDALYSIDKQ

SEQ ID NO: 11722 - DNA, 2364 bp, Kluyveromyces lactis NRRL Y-1140
  CDS (1)..(2364)
atgactactgattctgttccacgaaagaatatttctcaagctatcaaactagtgtttcttcgacggaaagcacaagagcgtaacgaggcaggctcctctgaagtaccgacgggtggtaaatcgaataatgcttccgctacatcgtcacccgaagaggcacttgagaatagtggagaaaacttcgaactcacaaatttcgcatctttatcagaaatggaatcagaaatctttcttgcacctcccgccaaacaatcgaagaagatctccattcttgttggtatgtttgttgctgtgggtggatttttgtttgggtatgatacaggattaataaataatatcagcgaaatgccttatgttaaccaaaagtttgcacctaacaagaatcatttcacaacaccacaaatctcgatattagtgtcttttttatccttggggacgttcattggagccttactggcacctttaatctccgactcttatggtcgaaagactacaatgatctttagtacgttcgtggtatttatgataggaaactctttacaggtggcagctggttctatgaccatacttgtagttggaagagtcctctctggtatgagtgttggactaatatcggctgcggtgccattatatcaaagtgaagctgcacagaaatctgttcgtggtgcaattatttcctgttaccagtgggccattacatgggggctacttgtagcaagtgcagtttcccaaggaacatataaaagaatggatgcatctagttaccaaataccgatcggattacagtatatttggtcctttctactcggtgtcggcattcttttcctccctgaaagcccaagatactatgttttcaaagataggctagacaaagcggcaaaatctttatcctttttacgtggcgtaccagaggatgactccggattacttgaagagttggttgagatcaaagcaacatatgattacgagatgtcattcggaaaaatctcttacctagattgtttcagatcaacgagatcaagaaccaaacagcgtctacgaatgttgaccggtatcgctcttcaggcttttcagcaagtgagtggtatcaattttatcttttattatggcgtagactttttcaataagagtggtgtcagcgaaagctatttggtttccttcgtcacatatgcagtaaatgttgcgtttaacattccggggttattcttggtcgaatatatcggacgaagaaaattgttattgatgggtggtattcttatgactatctccaatttcattattgctatagtcggattagcgactgactccatggttgcgaacaaagtgatgattgcattcatctgtttattcattgcatcattttcggccacctggggtggtggtgtgtgggtaatttccgctgaattatatccattgggtgttcgcgctaaatgcaccgccatctgtgcagcatcaaactggctaataaatttcatctgtgcattaataacgccttacattatgcacatagatagcagtgtcagacaaacgagtatcggtaccaaaatcttctttgtttgggggtcattgaacgctgttggggttcttgttgtgtacttcaccgtgtacgaaacgaatggattatcattggaagagatcgatgagttgtacaagaaatcttcttctggaataaactccatagaatggaacaagaagatcaaagcctttccagatttgtttcaaaggacaagaccgaacaatgaaggtgacggagaagctgatgataacatacatacagatgaaaattataaccatactatttccagctataatggaacccaaaacaatgaaaaatatcctattcaagtacagatgccacaatttggtgtacggaacatcgaatttttgaacaccacaggctcatctccgcaatcggatatgacagaacccaactttgtcgacttgggtaatggtcttggtataacaacgtatcaaagaggcccaccatccgtccttactgactcgagtgaagaagaggaagagggacaacaacaagagacagatgagactgaggaaggtaaatcattcaaacaccagtacactgacgctcgtaataaaaatcgtggcgagcgcggcagtttcaatagcaatagttcaacctcaggcactactcgatcttcttcccacaaggccagtgttcaaaggatggaagaaattaatctgtacatggcccaattaatgcatcgcggaggaacagaagatctttcgcgtaacactaccgataacactcatcaaccgatatcacatgatatcatgagtcaatggaactcctcatcccaaaataaaggacctagcactcaaaccgatattaatagtaacacttag

SEQ ID NO: 11723 - protein, 787 aa, Kluyveromyces lactis NRRL Y-1140
MTTDSVPRKNISQAIKLVFLRRKAQERNEAGSSEVPTGGKSNNASATSSPEEALENSGENFELTNFASLSEMESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 11724 - DNA, 2196 bp, Debaryomyces hansenii CBS767
  CDS (1)..(2196)
atgtggccatttctagataggatcatgtatgatcactcgacggaggaggaatattacaaaaagatgcaacagaagtcgtcttcgtcgagtgccattacagtggggctagtggcggcggtagggggatttttgtatgggtacgatactgggctcattaacgatattatggagatgacgtacgtgaaggataacttcccggcgaatggacatagcttcagcgtacacgagcgagcgttgataacggccatcttgtcactcggaacattttttggggcgttgatagcgccgttgatatcggatacgtggggtagaaagttttcgatcattgtatcgtcagctctcatatttaatgtgggaaacatcttgcaggtgtcatccacagaggtggtgcttttatgtgttgggagagctgtttcggggttgtcagtgggtatactctcagccattgtgccgttgtatcaagctgaagcttcgccaaaatgggtaagaggttccattgtgtatacttaccaatgggcgataacatgggggttgttgattgctagtgctatatgtcagggggcaaaaaacattatgaattcgggctcgtatagaataccggtgggaatacagttcttgtgggcaattattttgtctgtcgggatgctttttttacccgaatctcctcgattccatgtacagaaggataatatccaagaagcattgaaatgcttagctagactaagaaaagtgccgacagatgaccctgatttgatagaagaactagttgaaatcaaggccaactatgactacgagttatcgtttggaaaggcatcctatatagattgctttaagagtggtggaggaagaaataagcaactcacgaggatgctcacaggtattggggtccaggcatttcaacaaagttcaggaatcaattttattttctattacggggttaatttcttcgcaagttcaggaattaagaattattacttaatgtcatttgtaacttatgcagttaacacactttttacaataccagggataattttgattgaagtcataggaagaaggaaactattattatttggcggcattggaatggctgtttcaaatttcataatagcaattgttggtgttagtatgtcagatgagtcaatcagttctataatatgtgtgtcattttcgtgtgtctttattgcattttttgcatcatcatggggcggtgccgtatgggcgctctcttcagatatatttggtattggtattagacaaaaagcaatatcgctaacggcagcgacaaattggttagttaattttacctttgcatttataacgccatatttgattgatactggtaaacataccgcagcattgggtaacaaaattttttttatctggggtggttgtaatgctctaggcgtcgtatttgtgtactttatggtttacgaaacgaaaggattaaaattggaagaaattgatttcatgtacaaaaactgtgtgaacgctagagcttcgactaagttcaaatctcaaaagattgtatacgccaatcaaatttcaacaccgatctcagagcttcttaatcccaaccgatcgcatattgcgattgagaaatcaagtggaagtaacaataatggcgatgatgatgagaatagcgaagaaaatcaccatgattttggtttagagaacggaaacgtcttacacaacaatttggataataggaatataactcttatcccttataagaatattatttcacctctgcgatcattcagttcagattcttcaagcgattccgactcatcttcaccactcaatgattatgaaagatacttacatagcttgcaaaaagaaggcagccatcatgacacctctcaaacttcaacgtccttaattactgacaataagctaagtcatcttaattccatgcataatgcccactcacggggtaattttactgaggaggacttgaagtacctcaatgatgaatatgatttagcgatgtcgcagaaatacccaggcacaactacggcgcctctaaaaccaagcacgaatatgactgttatagcggcgccattttttgacgctccaccaagcgattcagacacggacgacgaaagcgacgacgatgaagtcggtgacgaagatagcgaaacagaaccagaaactactaagggctcaccggttgataccaaggactctagttcgtag

SEQ ID NO: 11725 - protein, 731 aa, Debaryomyces hansenii CBS767
MWPFLDRIMYDHSTEEEYYKKMQQKSSSSSAITVGLVAAVGGFLYGYDTGLINDIMEMTYVKDNFPANGHSFSVHERALITAILSLGTFFGALIAPLISDTWGRKFSIIVSSALIFNVGNILQVSSTEVVLLCVGRAVSGLSVGILSAIVPLYQAEASPKWVRGSIVYTYQWAITWGLLIASAICQGAKNIMNSGSYRIPVGIQFLWAIILSVGMLFLPESPRFHVQKDNIQEALKCLARLRKVPTDDPDLIEELVEIKANYDYELSFGKASYIDCFKSGGGRNKQLTRMLTGIGVQAFQQSSGINFIFYYGVNFFASSGIKNYYLMSFVTYAVNTLFTIPGIILIEVIGRRKLLLFGGIGMAVSNFIIAIVGVSMSDESISSIICVSFSCVFIAFFASSWGGAVWALSSDIFGIGIRQKAISLTAATNWLVNFTFAFITPYLIDTGKHTAALGNKIFFIWGGCNALGVVFVYFMVYETKGLKLEEIDFMYKNCVNARASTKFKSQKIVYANQISTPISELLNPNRSHIAIEKSSGSNNNGDDDENSEENHHDFGLENGNVLHNNLDNRNITLIPYKNIISPLRSFSSDSSSDSDSSSPLNDYERYLHSLQKEGSHHDTSQTSTSLITDNKLSHLNSMHNAHSRGNFTEEDLKYLNDEYDLAMSQKYPGTTTAPLKPSTNMTVIAAPFFDAPPSDSDTDDESDDDEVGDEDSETEPETTKGSPVDTKDSSS

SEQ ID NO: 11726 - DNA, 1731 bp, Debaryomyces hansenii CBS767
  CDS (1)..(1731)
atgaccaatacagaaccaaatacggagagcctgacagtagaagcaggtgtaaatgataatgtgagcacatctaatagtactactaattatggaactgaacctcaaggaacacatgagaagttagaaaattatggtgatattgaaaagcatgaaataccagataatgaagggcaaattccaaccgcagatgagattttaaataagttaccggtcatgccagaaaggtcaactaaggatcaactttcatctatagttctttgttttttcattgcttttggtggatttatttttgggttcgatacaggtaccatttctggattcaccaacatgcctgactatatagataggtttggtttacaagatgctaatggtgattctaagacttataagattggtttgatcgttgccatttttaatgttggttgtgcatttgggtgtattttcttatctaagattgcagatgtttatggacgtcgaattggattgatgtttgcaatgattgtatatatcgtgggcatcattattcagatttcagcacagtcttcttggattcagattgtttttggtcgtttgattgcaggatttgctgtgggtaccgtttctgtgttgtcgccgttgtttattagtgagacttcaccaaaagcatatagaggtacgttagtttgttgtttccaactttgcgtcacttttggtatttttattgggtactgtattaattatggtacatatcataactttaatgactctcgccagtggagaatttctctaggtttgtcttttgcgtgggctatatttttattcatcggtatggtcttcctgcctgaatcgccacgttacttgattgaaaaaggtaagattgaagaagcaaagaaatctatctctttctcgaatggtgtttcaccagaagagccaggcgtgtatactgaaatccaattaattcaaagtggtattgacagagaaaaacttgcggggaatgcatcatggggtcagttggttgttggtaagccaaggatacttatgcgtgttataactggtgttatgttgcaatcattgcaacagttaactgggaataactattttttctactatggtacatacatttttgatgctgtgggattgagtgattcattccagacatctattgtgttgggtgttgtgaactttgcatctacttttgttggtatctatgcaattgagaaactaggaagaagattatgtttattaagcggaggtgttgcgatggctatttgttttttgatctactcagtcttgggcactgtaggtgatgtgcatataaagccccaaggtaatgctcaaatttttattacaactcttttcattttcttcttcgcctcaacttgggcgggcggtgtctattcaattgtttccgaaatatatcctttgagaattaggtctaaagccatggccgttgcaacagccggtaactggacttggggattcttgatttccttctttaccactgcaattacaaatgagatccaatttgcatatggttttgttttcttcggttgtatttgcttcggtactgtgttcacatatttctttgtttatgaaactaaaggattgtcattggaagaagttgatcaattatatgcatcggggatacccgcatggaaatcaagttcatggaaggttccttcacaagaagacatggctttctctgcgggatacgctgcaaaagataagcctgaagataaaagacaggagtaa

SEQ ID NO: 11727 - protein, 576 aa, Debaryomyces hansenii CBS767
MTNTEPNTESLTVEAGVNDNVSTSNSTTNYGTEPQGTHEKLENYGDIEKHEIPDNEGQIPTADEILNKLPVMPERSTKDQLSSIVLCFFIAFGGFIFGFDTGTISGFTNMPDYIDRFGLQDANGDSKTYKIGLIVAIFNVGCAFGCIFLSKIADVYGRRIGLMFAMIVYIVGIIIQISAQSSWIQIVFGRLIAGFAVGTVSVLSPLFISETSPKAYRGTLVCCFQLCVTFGIFIGYCINYGTYHNFNDSRQWRISLGLSFAWAIFLFIGMVFLPESPRYLIEKGKIEEAKKSISFSNGVSPEEPGVYTEIQLIQSGIDREKLAGNASWGQLVVGKPRILMRVITGVMLQSLQQLTGNNYFFYYGTYIFDAVGLSDSFQTSIVLGVVNFASTFVGIYAIEKLGRRLCLLSGGVAMAICFLIYSVLGTVGDVHIKPQGNAQIFITTLFIFFFASTWAGGVYSIVSEIYPLRIRSKAMAVATAGNWTWGFLISFFTTAITNEIQFAYGFVFFGCICFGTVFTYFFVYETKGLSLEEVDQLYASGIPAWKSSSWKVPSQEDMAFSAGYAAKDKPEDKRQE

SEQ ID NO: 11728 - DNA, 1665 bp, Debaryomyces hansenii CBS767
  CDS (1)..(1665)
atgtctcaagaagaatatagttctggggtacaaaccccagtttctaaccattctggtttagagaaagaagagcaacacaagttagacggtttagatgaggatgaaattgtcgatcaattaccttctttaccagaaaaatcagctaaggattatttattaatttctttcttctgtgtattagttgcatttggtggttttgttttcggtttcgatactggtactatctcaggtttcgttaacatgagtgattacttggaaagattcggtgagcttaatgcagatggtgaatatttcttatctaatgttagaactggtttgattgttgctatttttaatgttggttgtgctgtcggtggtattttcttatctaagattgctgatgtttatggtagaagaattggtcttatgttttccatgattatttatgtgattggtataattgttcaaatctcagcttctgacaagtggtatcaaatcgttgttggtagagctattgcaggtttagctgttggtaccgtttctgtcttatccccattattcattggtgaatcagcacctaaaaccttaagaggtactttagtgtgttgtttccaattatgtattaccttaggtatcttcttaggttactgtactacatatggtactaaaacctacaccgactctagacaatggagaattccattaggtttatgttttgtttgggctatcatgttggttattggtatggtttgcatgccagaatcaccaagatacttagttgtcaagaacaagattgaagaagctaagaaatcgattggtagatccaacaaggtttcaccagaagatcctgctgtttacaccgaagtccaattgattcaagcaggtattgaaagagaaagtttagctggttctgcctcttggaccgaattggttactggtaagccaagaatctttcgtagagtcattatgggtattatgttacaatctttacaacaattgactggtgacaactatttcttctactatggtactactattttccaagctgtcggtatgactgattccttccaaacatctattgttttaggtgttgttaactttgcatctacatttctcggtatctacacaattgaaagattcggtagaagattatgtttgttaactggttctgtctgtatgttcgtttgtttcatcatttactccattttgggtgttacaaacttatatattgatggctacgatggtccaacttcggttccaaccggtgatgcgatgattttcattactaccttatacattttcttcttcgcatccacctgggctggtggtgtctactgtatcgtttccgaaacatacccattgagaattagatctaaggccatgtccgttgccaccgctgctaactggatttggggtttcttgatctctttcttcactccattcatcacctcggctatccacttctactacggtttcgttttcacaggatgtttgttattctcgttcttttacgtttacttctttgttgttgaaactaagggattaactttagaagaagttgatgaattgtatgcccaaggtgttgccccatggaagtcatcgaaatgggttccaccaaccaaggaagaaatggcccattcttcaggatatgctgctgaagccaaacctcacgatcaacaagtataa

SEQ ID NO: 11729 - protein, 554 aa, Debaryomyces hansenii CBS767
MSQEEYSSGVQTPVSNHSGLEKEEQHKLDGLDEDEIVDQLPSLPEKSAKDYLLISFFCVLVAFGGFVFGFDTGTISGFVNMSDYLERFGELNADGEYFLSNVRTGLIVAIFNVGCAVGGIFLSKIADVYGRRIGLMFSMIIYVIGIIVQISASDKWYQIVVGRAIAGLAVGTVSVLSPLFIGESAPKTLRGTLVCCFQLCITLGIFLGYCTTYGTKTYTDSRQWRIPLGLCFVWAIMLVIGMVCMPESPRYLVVKNKIEEAKKSIGRSNKVSPEDPAVYTEVQLIQAGIERESLAGSASWTELVTGKPRIFRRVIMGIMLQSLQQLTGDNYFFYYGTTIFQAVGMTDSFQTSIVLGVVNFASTFLGIYTIERFGRRLCLLTGSVCMFVCFIIYSILGVTNLYIDGYDGPTSVPTGDAMIFITTLYIFFFASTWAGGVYCIVSETYPLRIRSKAMSVATAANWIWGFLISFFTPFITSAIHFYYGFVFTGCLLFSFFYVYFFVVETKGLTLEEVDELYAQGVAPWKSSKWVPPTKEEMAHSSGYAAEAKPHDQQV

SEQ ID NO: 11730 - DNA, 1674 bp, Debaryomyces hansenii CBS767
  CDS (1)..(1674)
atgactactgctgttggattagaagataattccaaagggaatattattactgttatgagtaaagatccgttagtgttttgcataattgcgtttgcatctattgggggtttactctttgggtacgatcagggagttattagtggtatagttactatggagtcatttgcggcaaaattccccagaattttttccgatcctgattataagggttggtttgtttctacatttttgttgtgtgcttggtttggttcgttgataaactctcctgttgttgatcgatttggaagaagggatactataagaatagcttgcgttgtatttgttatcggatctgtctttcaatgtgcaggtacgtcggttagtatgcttttcgctgggagagcagttgctggtatcggtgtcggacaattgactatggtagtcccaatttatatgtcggaattagctccaccttcagtaagaggtggtttagttgtaatacagcaattttcaataacaataggtattttgatatcattttggataaattatggcactcaatttattggaggaactaaatgtgctcctgaccaagattacaaaggcgatactttcgacccatacattgatgttcctcaaggtggttgttacggtcaaaaagatgcttcctggagaattccatttgggttacaaattgcaccagctttcattttaggtattggtatgtctttttttccaagatcgccaagatggctcttatcaagaaaaagagaagaggaggcatgggaggctttgaattatttgaggagaagaaataatcctgatatgattgatgctgaattcaatgaaattaaatcggacgtattatttgaacaaaaatataacgagaggaaatttcaaggaaaaacaggaatgtctttctttataacatcgtattgggatctagtctctaccaaatcaaattttaagagagtttttataggctctgcggttatgttcttccaacaatttattggttgtaatgcaattatttattacgcaccaacaatatttagtcaattaggaatggattccaacaccacagcattgttaggaacaggggtctatgggattgttaattgcctttcaactattcctgctatctttgcgattgacagatttggtagaaaaactttattgatggctggggcagctggaacttttgtttcgttggttatagtaggtgcaattgtcggcacatatggtgatactttatctaagcataaaactgctggtagagcggcaatagcttttatttttatatatgatttcaacttttcatatagctgggcacctattggatgggttttaccatccgaaatcttctctattggaatcagatcaaaagctatatccattactacttcatcaacatggatgaataatttcataattggtttggtcaccccccgtatgttggagacaatgaaatggggaacatatatcttttttgcagcatttgctataattgcatttgctttcacttggtttgttatcccagaaactaaaggagtacctttagaagaaatggatttagtttttggtgatttagatgcgttgcaagaaaagcaaaacttctctcgcatgaatgaattatcaaaaatggattcaattaaagctacaacagatatttcggaagcacattattctgattaa

SEQ ID NO: 11731 - protein, 557 aa, Debaryomyces hansenii CBS767
MTTAVGLEDNSKGNIITVMSKDPLVFCIIAFASIGGLLFGYDQGVISGIVTMESFAAKFPRIFSDPDYKGWFVSTFLLCAWFGSLINSPVVDRFGRRDTIRIACVVFVIGSVFQCAGTSVSMLFAGRAVAGIGVGQLTMVVPIYMSELAPPSVRGGLVVIQQFSITIGILISFWINYGTQFIGGTKCAPDQDYKGDTFDPYIDVPQGGCYGQKDASWRIPFGLQIAPAFILGIGMSFFPRSPRWLLSRKREEEAWEALNYLRRRNNPDMIDAEFNEIKSDVLFEQKYNERKFQGKTGMSFFITSYWDLVSTKSNFKRVFIGSAVMFFQQFIGCNAIIYYAPTIFSQLGMDSNTTALLGTGVYGIVNCLSTIPAIFAIDRFGRKTLLMAGAAGTFVSLVIVGAIVGTYGDTLSKHKTAGRAAIAFIFIYDFNFSYSWAPIGWVLPSEIFSIGIRSKAISITTSSTWMNNFIIGLVTPRMLETMKWGTYIFFAAFAIIAFAFTWFVIPETKGVPLEEMDLVFGDLDALQEKQNFSRMNELSKMDSIKATTDISEAHYSD

SEQ ID NO: 11732 - DNA, 1584 bp, Debaryomyces hansenii CBS767
  CDS (1)..(1584)
atgggtttagaagataatgcgcttattagaaagtatgtcaatgtcggggaaaaaagggctgggtcagcatctatggggattttcgtaggtgccttcgcagctttcgggggtgttttgttcgggtatgatactggaaccatttcaggtatcatggccatgaactatgtcaaaggagaatttcctgccaataaggagagttttacgtcaaaagaaagttcgttgattgtttccatcttatcagcaggtactttcttcggtgcgttgttagcaccgtttatgtctgatactttaggtagaagatggtcattaattatttcaacattcattgttttcaacttgggagtgattttacaaactgtttcaactggtattccattactatgtgctggaagagctattgctggttttggtgttggtcttatatctgctgtcattccattatatcaatcagaagccactccaaaatggattagaggggctgttgtatcttgttatcaatgggccattactattggcttattgttagcggcttgtgttaaccaaggtactcataatagaaatgactcgggttcatacagaattccaattgctgttcaacttttatggtcgttaattttgggtactggtatgatcttcttgcctgacacgccacgtttctggatccacaaaggtaatgaatctgaagctaagaaatcgttgaagattttaagaaaattaccacttgaccacccagacttaattgaagaatacgaagacatcaaagctgcttacgatttcgagtgttctttcggaaaatcgtcttggatggatctttttaccacaaggaataggcaattgaagagattatttaccggtgttgctcttcaagcatttcaacaattaactggtgttaactttatcttctattttggtacctctttcttcaagagtgctggtattgaaaacgaatttcttatttctttagccaccagtattgttaacgtaggtatgactgttccaggtatctttttaattgaattagtgggtcgtcgttctatgttgttgtggggtgctgttggtatgtcggtttctcaatttatcgttgctattgttggtattgccactgatagtgccgacgctaacaaagtcttgatcgcattcacttgtttcttcattgcattctttgcttctacctggggtccaattgcttgggttgttgttggtgagattttcccattaagaactagagctaagtccgttgcattatctgccgcttccaactggctttggaactgggctatcgcatacgctactccatacttggtagaagatggtaagggtaatgctaacttaggaacaaacgttttcttcatctggggtggatgtaactttctttgtattttgttcacttacgtcttcatttacgaaaccaagggttactctttggaacaaattgatgaattatatgaaaaagttccacatgcttggaaatctcgtggcttcattccttctgcccatgctttcagagaagatgctccagagtcaatcagctctatgggaaaggatatggaaaaagttactgaaattgaaaccacttcagtctaa

SEQ ID NO: 11733 - protein, 527 aa, Debaryomyces hansenii CBS767
MGLEDNALIRKYVNVGEKRAGSASMGIFVGAFAAFGGVLFGYDTGTISGIMAMNYVKGEFPANKESFTSKESSLIVSILSAGTFFGALLAPFMSDTLGRRWSLIISTFIVFNLGVILQTVSTGIPLLCAGRAIAGFGVGLISAVIPLYQSEATPKWIRGAVVSCYQWAITIGLLLAACVNQGTHNRNDSGSYRIPIAVQLLWSLILGTGMIFLPDTPRFWIHKGNESEAKKSLKILRKLPLDHPDLIEEYEDIKAAYDFECSFGKSSWMDLFTTRNRQLKRLFTGVALQAFQQLTGVNFIFYFGTSFFKSAGIENEFLISLATSIVNVGMTVPGIFLIELVGRRSMLLWGAVGMSVSQFIVAIVGIATDSADANKVLIAFTCFFIAFFASTWGPIAWVVVGEIFPLRTRAKSVALSAASNWLWNWAIAYATPYLVEDGKGNANLGTNVFFIWGGCNFLCILFTYVFIYETKGYSLEQIDELYEKVPHAWKSRGFIPSAHAFREDAPESISSMGKDMEKVTEIETTSV

SEQ ID NO: 11734 - DNA, 1638 bp, Debaryomyces hansenii CBS767
  CDS (1)..(1638)
atgggatatgaagaaaagttggtcgcaccagctctaaaactaagattattcttagataaacttccaaacatttataatatttatgtcattgctactatttcgtgtatttcggggttgatgttcggtatcgacatttcatcgatgtcggcgttccttagtaatgacgcttaccttaaatattttggtacccctgaacctgatatgcaaggattcattactgctgctatgtctcttgggtcattctttgggtctcttgcatcggcattttgttcagagccatttggtagaagagcttcattgttgctttgtggattcttttggtctgttggggctgcaattcaatcttcatcacagaatgtcgcccagttaattattggtcgttttatttctggttttggaattggtttcggctcatctgtggcacccgtgtatggatcagagttggcacctagaaaaattagagggttaattggtggtcttttccaactttcagttaccttaggtattttgattatgttctatatctgttacgggttaggtaaaatccaagccgtcggctcattcagaactgcgtggggtttgcaaattatcccaggattgatcttaatacttggatgtttctttattccagaatcacctagatggttagccaaacagaactactgggaagaggcggaggacattgtcgctagagtccaagctaaaggtaacagagaagaccctgaagtattaattgaaatggctgaaattagagaccagattctgacgttagacaaagttaagtcttttacttatattgatttattcaaaaagaagtatcttcttagaactgtaacggcaatatttgctcaaatttggcaacaattaacaggtatgaacaccttaatgtattatattgtctatgttttcgaaatggctggttatcatggtgatgcaaatttggttgcctcttcaattcaatattgtatcaattttgccatgactattcctgcattgtacttaatggataaggtcggtaggagaccagtgttgttaactggagctgcgctcatgatggcctggcaatttgctatagggggcttgcttgccacttatgctgaacccaccgatatttttgggggtaataataccgttaaaatcagtatcccagaagatgaatctcctgccgccaaggctgttattgcatgttgttacttattcgttgtttcatttgcgtctacttggggtgttggtatctgggtttactgtgctgaagtctggggtgatagtgcctcaagacaaagaggtgcgtgtgttgcaactgctggtaattggatttttaatttcgcaattgcaatgttcactccgcacgctttcagtactattacttggaaaacatacatgatttttgctactttctgtgcatgtatgtttcttcatgttttcttctttttccctgaaactaagggtaaaagattggaagaaattggtcaaatgtgggacgagcatgttccagcttggaagtctgcttcgtggcaaccacacgtaccactcgtttcagataatgaaatacacgggaagatggattctgcgcatgatgaacattcatctcgttcggagtctactggagaaaaggtggtcgcagatcacattgcttga

SEQ ID NO: 11735 - protein, 545 aa, Debaryomyces hansenii CBS767
MGYEEKLVAPALKLRLFLDKLPNIYNIYVIATISCISGLMFGIDISSMSAFLSNDAYLKYFGTPEPDMQGFITAAMSLGSFFGSLASAFCSEPFGRRASLLLCGFFWSVGAAIQSSSQNVAQLIIGRFISGFGIGFGSSVAPVYGSELAPRKIRGLIGGLFQLSVTLGILIMFYICYGLGKIQAVGSFRTAWGLQIIPGLILILGCFFIPESPRWLAKQNYWEEAEDIVARVQAKGNREDPEVLIEMAEIRDQILTLDKVKSFTYIDLFKKKYLLRTVTAIFAQIWQQLTGMNTLMYYIVYVFEMAGYHGDANLVASSIQYCINFAMTIPALYLMDKVGRRPVLLTGAALMMAWQFAIGGLLATYAEPTDIFGGNNTVKISIPEDESPAAKAVIACCYLFVVSFASTWGVGIWVYCAEVWGDSASRQRGACVATAGNWIFNFAIAMFTPHAFSTITWKTYMIFATFCACMFLHVFFFFPETKGKRLEEIGQMWDEHVPAWKSASWQPHVPLVSDNEIHGKMDSAHDEHSSRSESTGEKVVADHIA

SEQ ID NO: 11736 - DNA, 1638 bp, Debaryomyces hansenii CBS767
  CDS (1)..(1638)
atgggatacgaagataaattactagggccagccttaaagtttagaaacttcttggacaaatttccgaacatccataatgtctatattgttgttggtatttcttgtatatctggtatgatgtttggcattgatatttcttcaatgtctttattcattggagatgataaatatttagactatttcaattcaccagattctacacttcaagggtttattacagcatccatgtctttagggtctttctttggggccttattttccgcatttatatcagaacctttcggtagaagaatgtcgttgatgttctgtgcatttttttggtgtgttggagctgccattcaatcatcgtcacagaacgtcgtccagttaattataggtcgttttatttctggttttggtgttggatttggatcctcagtagccccagtttatggtacagaattggcaccaagaaaaataagaggattaattggtggattatttcagctttcggtcactttgggaattttggttatgttctatgtttgttatgcattacattatatcaatggtgtggcttcttttagattatcttgggggttacaaatagttcctggtcttcttttgttcattggctgttttttcatccctgaatcacctagatggttagcaaagcaaggctgttgggaggaggctgaatacattgtggcaatgattcaggccaaaggcaatagggaagatcccgatgtcatgattgagattactgagatcaaagatcaaattttgacagaggaaaatattaaggctttcacttatgcagatttattcaagcgcaaatatctccttagaactgtcaccgcaacatttgctcaaatatggcaacaattaacgggtatgaatacattaatgtattatattgtttatgtttttgatatggctggctatcagggcgatgcaaatttaattgcatcttcaattcaatacgttctttttttcgttatgactgccccttcattatatttaatggataaacttggtagaaggcccattttgttaagcggtgctgcattcatgatgatatggcaattcgcagtcggtggtttgctttccacttatgctgagcccaccaatgatgttggtggaaatgatactgtcagattaaggatcccagctgataactcaaccgctgccaagggtgtaattgcatgttgctatttgtttgttgtatcatttgcatatagttggggtgtttgtatctggatgtattgtgctgaagtttggggtgatagcgcctcaagacaaagaggggcctgttttacaacttcagctaattggatttttaacttcgcgatcgcaatgtttaccccctctgcgttcaaaaacattacttggaaaacatacatgatttttgctacgttctgcggttgtatgttccttcacgtatttttctttttcccagaaactaaaggtaaaagattggaggaaattggccaaatgtgggatgaaggaattccagcatggagaacagccgcatgggagccatctattccattcttatctgataatgacttgcgtgaaaagctagaagtaaaacacgtcgaagattcaaactccagtaattcggatgctgaaaagcctagtgctgtccatattgcttag

SEQ ID NO: 11737 - protein, 545 aa, Debaryomyces hansenii CBS767
MGYEDKLLGPALKFRNFLDKFPNIHNVYIVVGISCISGMMFGIDISSMSLFIGDDKYLDYFNSPDSTLQGFITASMSLGSFFGALFSAFISEPFGRRMSLMFCAFFWCVGAAIQSSSQNVVQLIIGRFISGFGVGFGSSVAPVYGTELAPRKIRGLIGGLFQLSVTLGILVMFYVCYALHYINGVASFRLSWGLQIVPGLLLFIGCFFIPESPRWLAKQGCWEEAEYIVAMIQAKGNREDPDVMIEITEIKDQILTEENIKAFTYADLFKRKYLLRTVTATFAQIWQQLTGMNTLMYYIVYVFDMAGYQGDANLIASSIQYVLFFVMTAPSLYLMDKLGRRPILLSGAAFMMIWQFAVGGLLSTYAEPTNDVGGNDTVRLRIPADNSTAAKGVIACCYLFVVSFAYSWGVCIWMYCAEVWGDSASRQRGACFTTSANWIFNFAIAMFTPSAFKNITWKTYMIFATFCGCMFLHVFFFFPETKGKRLEEIGQMWDEGIPAWRTAAWEPSIPFLSDNDLREKLEVKHVEDSNSSNSDAEKPSAVHIA

SEQ ID NO: 11738 - DNA, 1689 bp, Debaryomyces hansenii CBS767
  CDS (1)..(1689)
atggttttgaagatttgggatagaactaatacgtttggtctcaggggcagatcccttagattggccattacagttaccgctgtgacaggtttctccttgttcggttatgatcaaggtttaatgtctggtattattactggtgatgattttagtaaggagtttcctgctgtaacaaatgagggtgctggctcggaacattgggctactgttaaccaaggtggggttgtttcatgttatgaaatcgggtgtttcttcggtgcattatttgctttatttagaggtgatagattcggaagaagacccatggtgattataggatcattacttattattcttggtacaattatttccactgcatcatttggcgctcattggggattgggtcaatttattattggtagagttatcactggattaggtaacggtatggatactgcaacgattccggtttggcaatctgaagtttctagagcggaaaatagaggtttcttagttaacttagaaggatcagttgttgcattcggtacatttattgcctattggttagattttggtttatcatacgttgagggtgaacatgcatctgttcaatggagatttcccgttgcgttccaaatatttttcgctgcagttttatttgtaggtattatcaatttacctgagtcaccaagatggttaattgctcatggctataaagatgaagcgaattatgtattagcatctttaaatgatgttgaaattgatgacgatttggttattgctgaaagtactgttataactgatggtgtcaacagatttgcaagatctcaagttggattcaaagagttattttctggtggtaagctgcagcatttttcaagaatggttattggtgcatctactcaattctttcaacaatttactggatgtaatgcttctatctactattcgactgttttatttgaacgtttgggaatggctgacacttatgaaaagttacctttggttatgggaggtgtattttctacagtttatgcattaatgactattccatcattctttttgattgataggttgggtagaagagctttatttttgatcggtgctgccggccaaggtttggcattcactatcgcatttgtgagtttgattccagaggatggtgatagtgacggtggtaaaaaagctgctgctgtgggtattttcttgtttattgccttctttgctttcaccattttgccattgccatgggtttacccaccagaaatcaatcctttgagaaccagaaccgttgcttctgccatttctacttgtaccaattggttaacaaattttgctgtcgttatgttcacgccacttttcatggcagaaagtcagtttggttgttatttgttctttgcgcttttcaattaccttttcattccaattattttctttttctatcctgaaacagctggtcgtactttggaagaaattgatatcatttttgcaaaggcatatgttgataagagacaaccatggagagttgccgctactttacctcatttaagcttgcaagaacaagaagacgaaggaaacaaattgggtatctttgatgagttcgataaggaaggatttgaacaaagtgaaaacatttcctctaattcatctaacaaatcacctgaagatggttcaaatgatgaacctttagttaagcctgctgaagtttaa

SEQ ID NO: 11739 - protein, 562 aa, Debaryomyces hansenii CBS767
MVLKIWDRTNTFGLRGRSLRLAITVTAVTGFSLFGYDQGLMSGIITGDDFSKEFPAVTNEGAGSEHWATVNQGGVVSCYEIGCFFGALFALFRGDRFGRRPMVIIGSLLIILGTIISTASFGAHWGLGQFIIGRVITGLGNGMDTATIPVWQSEVSRAENRGFLVNLEGSVVAFGTFIAYWLDFGLSYVEGEHASVQWRFPVAFQIFFAAVLFVGIINLPESPRWLIAHGYKDEANYVLASLNDVEIDDDLVIAESTVITDGVNRFARSQVGFKELFSGGKLQHFSRMVIGASTQFFQQFTGCNASIYYSTVLFERLGMADTYEKLPLVMGGVFSTVYALMTIPSFFLIDRLGRRALFLIGAAGQGLAFTIAFVSLIPEDGDSDGGKKAAAVGIFLFIAFFAFTILPLPWVYPPEINPLRTRTVASAISTCTNWLTNFAVVMFTPLFMAESQFGCYLFFALFNYLFIPIIFFFYPETAGRTLEEIDIIFAKAYVDKRQPWRVAATLPHLSLQEQEDEGNKLGIFDEFDKEGFEQSENISSNSSNKSPEDGSNDEPLVKPAEV

SEQ ID NO: 11740 - DNA, 1650 bp, Debaryomyces hansenii CBS767
  CDS (1)..(1650)
atgtataaaatatggtcaaaaactaacactatgggactcagaggtaaacctcttagagttgccatcactatatgctgtactattggattttcattattcggttacgaccaaggattaatgtcgggaattattactggtaaacaattcaatgaggaatttccacccactcacggtacagatcagcatgctactgttatacaaggtgcagtcacgtcgtgctacgagttaggctgtttttttggtgctttgtttgcgttgtttcaaggtgataagtatggtagaaggccaatgattattgttggatctctgctcattgtcataggtactgttattgcagtttctgcatttggtccgcaatggggattgggccaatttgttattggtagagttatcacaggattaggtaacggcatggatacggctactattccggtgtggcaatcggaaatttctaaggcagaaaatagaggtcttttggttaacttggaaggttccatggttgcggttgggacatttattgcatattggttagattttgggttatcatatgtcgatacttcagttcagtggagattcccagttgcttttcagatagtatttgctcttttcttgtttcttggcgttgcacaattaccggaatcacctagatggttaattgctcatggcctcaaggatgaagctcattatgtattggcaactttaaatgacgttgatattgatgatgagttcgtaattgaagaaagcgccattataactgatggtgtcaatagatttgccagaacccaaattgggttcaaagaactattttccggcggcaagcaacagaacttcgctagaatgataattggtgcatctacacaattctttcagcaatttactggatgtaacgcttccatctattattcaactgttttatttgaaaatagtattggattgaccggtaaattgcccttaattctaggaggtgtttttgctaccatttatgctttatctactattccatctttcttcttgattgataggctaggcagaagagctttgtttttgatcggtgccaccggtcaaggcatatcattcaccatcacttttgcatgcttgatccctgataatggacaaaataaggaaacagccaaaggtgctgccgttggtatcttcttgtttatcgttttttttgcgttcactattttaccattgccatggatttaccctccagaaatcaaccccttgagaacaagaacagttgctactgcggtatcaacatgtactaattggctaacaaactttgcagtcgttatgtttactcctatttttattggtgcaagtagttatggctgttacttattctttgctataatgaatttccttttcattcctgtcattttctggttttatcccgagactgctggtcgtgagttggaagagattgatattattttcgcaaaggcatacgttgataatagactaccatggagagttgctgctactttaccacacttgaatttcaaggaacaagaacaagagggaatcaaattgggtctttatgatgacttcgaaaaggaagcacctgaacatgtaaacactttgtccgacgcctcaggctcagaagatggctcaaatgaagccgcttcagttaagcctgcggaagtttaa

SEQ ID NO: 11741 - protein, 549 aa, Debaryomyces hansenii CBS767
MYKIWSKTNTMGLRGKPLRVAITICCTIGFSLFGYDQGLMSGIITGKQFNEEFPPTHGTDQHATVIQGAVTSCYELGCFFGALFALFQGDKYGRRPMIIVGSLLIVIGTVIAVSAFGPQWGLGQFVIGRVITGLGNGMDTATIPVWQSEISKAENRGLLVNLEGSMVAVGTFIAYWLDFGLSYVDTSVQWRFPVAFQIVFALFLFLGVAQLPESPRWLIAHGLKDEAHYVLATLNDVDIDDEFVIEESAIITDGVNRFARTQIGFKELFSGGKQQNFARMIIGASTQFFQQFTGCNASIYYSTVLFENSIGLTGKLPLILGGVFATIYALSTIPSFFLIDRLGRRALFLIGATGQGISFTITFACLIPDNGQNKETAKGAAVGIFLFIVFFAFTILPLPWIYPPEINPLRTRTVATAVSTCTNWLTNFAVVMFTPIFIGASSYGCYLFFAIMNFLFIPVIFWFYPETAGRELEEIDIIFAKAYVDNRLPWRVAATLPHLNFKEQEQEGIKLGLYDDFEKEAPEHVNTLSDASGSEDGSNEAASVKPAEV

SEQ ID NO: 11742 - DNA, 1668 bp, Debaryomyces hansenii CBS767
  CDS (1)..(1668)
atgggtttaaatatatggagtagaacaaatacaatgggtctaagaggcagagcccttagggtagccatcacattcacggccgttagtggattctcttttttcggttatgatcaaggtttaatgtcaggtattattactggtgaccaattcaacaaagaatttcctccaacagctggtaagagccatgatgctgtggttaaccaagggggagttgtttcatgttatgaaatcggatgtttttttggtgccttatttgcattatttcaaggtgacaagtatggtagaagaccaatgttgatcataggttccttacttattattcttggcactgttatttctgttgcatcctttggcccacattggggattaggtcaattcattatcggtagagtcattacaggattaggtaacggtatggatactgccacaattccagtatggcaatctgaaatttctcgagcagaaaatagaggaaaattggttaacttagaaggttccatgatcgcaataggtacatttgtggcatattgggttgtttttggattatcgtacgtcgatacttctgtgcaatggagatttccagtggcttttcaagcaatttttggtattgttttatttggggcaattatcaacatgcctgaatcaccaagatggttaattgcccatgataaaaaagatgaagctaattacgtcttagcggctttgagtgatgtggatattacagacgatattgttattgctgaaagcggtgtcataactgatggtgttaataggttttcaagatcagaagttggctttaaggaattattctcaggcggtaggctgcaacatttttcaagaatgattattggtgcctctacccaattttttcaacaattcactgggtgtaatgcttctatttactattctacagttttatttgagaacttgggaatgggtgaagattttgaaaaattgcccttaatcatgggaggagtatttgccaccgtttatgctttggctactattccatccttttttttaattgatagactaggtagaagagcattatttcttattggtgctactggtcaagctatagcattcacaattacttttgcatgtttgattcccgatgacggccaaaataaagaaacggctaaaggtgcagccgttggtatcttcttgtttattgccttcttcgctttcactcttttgccattgccatggatttatccaccagaaattaatccattgagaacgagaacggttgcttctgctatatctacttgtaccaattggttgagtaacttcacagttgttatgttcacacccctttttatgaatgagagccaattcggctgttacttattttttgctattttcaattacattttgatcccaactacgatttggttttaccccgaaactgctggtcgttcgttagaagaaattgatatcattttcgccaaggcatatgttgataagagaccaccatggagagtagctgctactatgcctcgcttatccttgcaagaacaagatgaagaagcaattaaattgggtctctttgacgagtttgaaaaagaaggatttgaacacagtgaaaatctttcatctcattcttcgcgtaagactccagaagatagatcacacgatgaatctttagtaagaccagaaggggtttag

SEQ ID NO: 11743 - protein, 555 aa, Debaryomyces hansenii CBS767
MGLNIWSRTNTMGLRGRALRVAITFTAVSGFSFFGYDQGLMSGIITGDQFNKEFPPTAGKSHDAVVNQGGVVSCYEIGCFFGALFALFQGDKYGRRPMLIIGSLLIILGTVISVASFGPHWGLGQFIIGRVITGLGNGMDTATIPVWQSEISRAENRGKLVNLEGSMIAIGTFVAYWVVFGLSYVDTSVQWRFPVAFQAIFGIVLFGAIINMPESPRWLIAHDKKDEANYVLAALSDVDITDDIVIAESGVITDGVNRFSRSEVGFKELFSGGRLQHFSRMIIGASTQFFQQFTGCNASIYYSTVLFENLGMGEDFEKLPLIMGGVFATVYALATIPSFFLIDRLGRRALFLIGATGQAIAFTITFACLIPDDGQNKETAKGAAVGIFLFIAFFAFTLLPLPWIYPPEINPLRTRTVASAISTCTNWLSNFTVVMFTPLFMNESQFGCYLFFAIFNYILIPTTIWFYPETAGRSLEEIDIIFAKAYVDKRPPWRVAATMPRLSLQEQDEEAIKLGLFDEFEKEGFEHSENLSSHSSRKTPEDRSHDESLVRPEGV

SEQ ID NO: 11744 - DNA, 1638 bp, Yarrowia lipolytica CLIB122
  CDS (1)..(1638)
atgattggaaacgctcaaattaaccaggtgggagccttacagcaccggttccccaaactccacaatccttacttaactgcggccgtggccaccatgggtggcctgcttttcggctttgatatctcgtctgtttctgcctttgtcgacaccaaaccctacaaggagtactttgggtaccccacctccatccagcagggcggtatcactgcctcaatggccggtggatccttcctgtcgtctctggtggccggctggatttccgaccgacttggtcgacgtttcgccatccactttgcttccttttggtgggtggttggagctgccatccagtcctcagcccaaaacaagggccaattgatcgccggtcgactcatttccggccttggtatcggtctgggctcctcggttatccccgtctacatctccgagctgtctcccaagaagattcgaggtcggcttgtcggtctcttccaatgggccgttacctggggtatcctcatcatgttctacatttccttcggtctcagtaacatccacggagtcgccggattcagagtcgcctggggtctgcagatcatccccggtctgctcatgtctctcggttgtttgttcctggaagagtctccgcgatggctagccaagcaggacaactgggacgagtccgtgcgagtgcttcgagccatccaccagggaggctacggcaccgaagaagacattttgttagagattgaagagatccgagaagcagtccgaatcgagcatgagaccaaaaacctgcgattctggcacctgttccaaaaggactctatcaaccgaacaatggtgggtatctgggcccagatctggcagcagctcaccggcatgaacgtcatgatgtattacattgtgctgattttcaccatggctggatacactggaaacgccaatctggtggcctcgtctatccagtacgtcatcaacatgatcatgaccatccccgctcttctgttcattgaccgagtgggacgacgacccctgctgctgttcggatcaatcgtcatgatgatctggctgtttgccgtcgctggtatccttgcagtgtacggaactcagatccccggtggactcgacggagacgcattcacaaccattgtcattgagcccactcacaagcctgcccaaaagggagtcattgcgtgctcgtacctgtttgtggccacctttgcgcctacctggggccccggtatctggctgtactgctccgagctgttccctctgaagcagcgagctgtggctgccggtgtaaccgcctctgccaactggatcttcaactttgctctcgctctattcgtgccctcggccttcaagaacatcaactggaagacctacatcatctttggagtcttctgtatcgtcatgaccatccacgtctttgtcctcttccccgaaaccaagggcaagaccctcgaagagattgatatgatgtgggccgcccgagttcctgcctggagaaccgcaaactgggtgcctgaccacgttcctggcgcccttcccgaagacgagaaacactcggaggagatggtcgaggccgtcgaatccaatgaagaggagcccaagatagccagtgctaacgtcgacgcccctccctctcaattgtaa

SEQ ID NO: 11745 - protein, 545 aa, Yarrowia lipolytica CLIB122
MIGNAQINQVGALQHRFPKLHNPYLTAAVATMGGLLFGFDISSVSAFVDTKPYKEYFGYPTSIQQGGITASMAGGSFLSSLVAGWISDRLGRRFAIHFASFWWVVGAAIQSSAQNKGQLIAGRLISGLGIGLGSSVIPVYISELSPKKIRGRLVGLFQWAVTWGILIMFYISFGLSNIHGVAGFRVAWGLQIIPGLLMSLGCLFLEESPRWLAKQDNWDESVRVLRAIHQGGYGTEEDILLEIEEIREAVRIEHETKNLRFWHLFQKDSINRTMVGIWAQIWQQLTGMNVMMYYIVLIFTMAGYTGNANLVASSIQYVINMIMTIPALLFIDRVGRRPLLLFGSIVMMIWLFAVAGILAVYGTQIPGGLDGDAFTTIVIEPTHKPAQKGVIACSYLFVATFAPTWGPGIWLYCSELFPLKQRAVAAGVTASANWIFNFALALFVPSAFKNINWKTYIIFGVFCIVMTIHVFVLFPETKGKTLEEIDMMWAARVPAWRTANWVPDHVPGALPEDEKHSEEMVEAVESNEEEPKIASANVDAPPSQL

SEQ ID NO: 11746 - DNA, 1698 bp, Yarrowia lipolytica CLIB122
  CDS (1)..(1698)
atgggcttcagaggccaaagactccatcactatgttgcgactgtcgcaggcatgggttttctactctttggatacgaccagggagtcatgggaggtcttcttactcttccctcctttgtcaagcagttccccaagatggacacttctgactatctaccgccggatgtcaagtccttcaacaccaccatccaaggcacagcaattgccatctacgagatcgggtgcatgatgggggctctattcaccatgtggggaggagacaaggtcggtagacggtacatcatcttctacggatcaatcatcatgaccattggagccgttctacaatgtgcctcatactctttgggcatgttcattacaggccgtgtcgtctcgggtgtcggtaacggattcatcaccgcaacagtccccatgctccagtctgagtgtgcgaaaccagagaaacgaggcaaactcgtcatgttggaaggagctcttatcaccgccggtatcgctctttcatactggatcgatttcggcttctattgggtcaaggccaacgacgctgactggcggttccctgtcgcattccaaattgtcttctgtctctttctcttcttcaccgttcttactatccccgaatctccaaggtggttggtcaaaaaggggcgattcgaagaagcagccggagtctttgctgccctcgaagatgtggacattgaagacccctacgttgtcacccagatcacatacgtcaaagaatccatcatgctggaacaattggctcagttgggtattgatggacctgctgctcgtgagaagattgcagcaggcgagttttcaatgggtgaggaactgcccttcctgtcccagatgaaactcatgttcacctttggcaagaagaagaatttccaccgaaccatgctggcctactggagtcaggtcatgcaacaaatcacaggtatcaatctcatcacatactatgcggcgtacatctatgagacgtctgtcggcatgacccctactaattctcgaattctcgctgcttgtaacggtaccgaatacttcctagcctcttggatcgccttctacaccatcgagcggttcggacgtcgaaaactcatgattttcggagctgctggtcaggcagctactatggctattctcacaggatgtgtctacgctgcatcttcaccggcagacggaggactcgacaatcagagcgccggtgttgctgctgccgtcttccttttcgtcttcaacaccttctttgccattggttggctgggcatgtcgtggctgtatcctgccgagatcagttccttggagattcgagctcccgccaacggcctttccacctctggaaactgggtcttcaacttcatggtcgtcatgatcacccccgtggccttcgacactatcaagtggaagacctacatcatctttgccgtcatcaacgcagccatggttccagtcgtctacttcttctatcccgagactgccggtcggtctctggaagagattgaccagatctttgccgactccaaccccaagacaccctgggacgttgtctggatcgccagacggctccctaagagcactgctgtcgaccacaacctcgttgagcctcgaatcttgctcgaagagaagactgcccttgagacggtcgagtctgtttcccccactccttctgatcaagaggaaaccagacatgtttaa

SEQ ID NO: 11747 - protein, 565 aa, Yarrowia lipolytica CLIB122
MGFRGQRLHHYVATVAGMGFLLFGYDQGVMGGLLTLPSFVKQFPKMDTSDYLPPDVKSFNTTIQGTAIAIYEIGCMMGALFTMWGGDKVGRRYIIFYGSIIMTIGAVLQCASYSLGMFITGRVVSGVGNGFITATVPMLQSECAKPEKRGKLVMLEGALITAGIALSYWIDFGFYWVKANDADWRFPVAFQIVFCLFLFFTVLTIPESPRWLVKKGRFEEAAGVFAALEDVDIEDPYVVTQITYVKESIMLEQLAQLGIDGPAAREKIAAGEFSMGEELPFLSQMKLMFTFGKKKNFHRTMLAYWSQVMQQITGINLITYYAAYIYETSVGMTPTNSRILAACNGTEYFLASWIAFYTIERFGRRKLMIFGAAGQAATMAILTGCVYAASSPADGGLDNQSAGVAAAVFLFVFNTFFAIGWLGMSWLYPAEISSLEIRAPANGLSTSGNWVFNFMVVMITPVAFDTIKWKTYIIFAVINAAMVPVVYFFYPETAGRSLEEIDQIFADSNPKTPWDVVWIARRLPKSTAVDHNLVEPRILLEEKTALETVESVSPTPSDQEETRHV

SEQ ID NO: 11748 - DNA, 1548 bp, Yarrowia lipolytica CLIB122; identical to SEQ ID NO: 4642
  CDS (1)..(1548)

SEQ ID NO: 11749 - protein, 515 aa, Yarrowia lipolytica CLIB122; identical to SEQ ID NO: 4643

SEQ ID NO: 11750 - DNA, 1485 bp, Yarrowia lipolytica CLIB122
  CDS (1)..(1485)
atggccattattgtggctgtatttgtggcttttggaggacttctctacggctacgacacaggaactattgctggaatcatgaccatgggctatgtgaaagaacactttacagactttgggaagaacgacttcacctcgggccaatcatctctcaccacatctatcctatctgtgggcacatttaccggagccatcgttgctcccttagctgctgacacggctggtcgacgtctgggtcttctgttgtattgtcttgtattctctgtgggtgctattttgcagaccgtcacaaccggaagagtcttgctaattgtgggacgggtgattgctggtcttggtgtgggaggtatctcgtccattgtgcctctctatcagtcagaagtgtctcccaaatggatcagaggggccgttgtttctgtctaccagtttgccatcactgtgggtcttctactggcagctattgtcaacaatgccactaaggaccgtccaaatacgtcatcataccgtatccctcttggtattcaactcatttgggctcttattctttcagcaggacttgtgtttcttcctgagactcctcgtttctgggtcaagaagaaccggccagagaaagccgccgaagcactctcacggctaagaaggctaccaacagactcgaaaccggtaaaaaaggaactgcttgaactacagaagtcgttcgaaatggaaatggaggttggaaactcctcctggaaggcttgtttcagtccacatggatcacagctcaaaagactgctgacaggagtctcaatccaggctctgcaacaactaacaggcatcaatttcatattctactatggaaccaactttttcaaaacagctggcataaaagatccctttgtggtgtccatgatcacctctgccgtcaatgtggccttcacccttccgggtattctgtttgtcgacaaagtgggccgaagaaagctgctcttgattggagccgtggtaatgtgtgtttcagaattaattgtggcagctgtaggagcagctctggatagccaggtgtcttccaaggtccttattgccttcacttgtacgttcatcgcaggctttgcatccacctggggacctatagcctgggtggttgttgcggagattttcccgcttcgaatccgggccaagggagtggctatcagtgtggctgccaactggattttcaactttgccattgcctttgcaactccgtacttggtcgacaagaaacctgggtctgccggtctcgagtccaaggtgtttttcatctggggaggttgcaattttctagccattgcctttgtgtacttgtttgtctatgaaaccaaagggttgtcactggagcaggtggacgaaatgtactcggaggtcaagtacgcctggcagagtgataggttccagaccgagatcatgtctggaaagacggaggtttcgccggatcagagctgcgattctggatttgattcggattag

SEQ ID NO: 11751 - protein, 494 aa, Yarrowia lipolytica CLIB122
MAIIVAVFVAFGGLLYGYDTGTIAGIMTMGYVKEHFTDFGKNDFTSGQSSLTTSILSVGTFTGAIVAPLAADTAGRRLGLLLYCLVFSVGAILQTVTTGRVLLIVGRVIAGLGVGGISSIVPLYQSEVSPKWIRGAVVSVYQFAITVGLLLAAIVNNATKDRPNTSSYRIPLGIQLIWALILSAGLVFLPETPRFWVKKNRPEKAAEALSRLRRLPTDSKPVKKELLELQKSFEMEMEVGNSSWKACFSPHGSQLKRLLTGVSIQALQQLTGINFIFYYGTNFFKTAGIKDPFVVSMITSAVNVAFTLPGILFVDKVGRRKLLLIGAVVMCVSELIVAAVGAALDSQVSSKVLIAFTCTFIAGFASTWGPIAWVVVAEIFPLRIRAKGVAISVAANWIFNFAIAFATPYLVDKKPGSAGLESKVFFIWGGCNFLAIAFVYLFVYETKGLSLEQVDEMYSEVKYAWQSDRFQTEIMSGKTEVSPDQSCDSGFDSD

SEQ ID NO: 11752 - DNA, 1737 bp, Yarrowia lipolytica CLIB122
  CDS (1)..(1737)
atgaagctacaagtacccgcgtttgcgcggtcgtcttctgacgtgaaaacgtcattcatgggagcccggggccagaaactgcacaatctcgtggcagcaattgcaggattgggattcttgctgtttggatacgaccagggagttatgggcggtcttctaactctcgacacgttcatccaacagtttcccaaaatggacacctccgactacctgcctccaaaggtcaagaccttcaacaccaccattcaaggcacagccgtgggcatctacgaaatcggatgcatgattggagctctgttcaccatgtgggctggagacaagcttggaagacgctacatgatcttctttggctccatcatcatgacgattggagcgattctgcaatgtgcttcctactctctgggacagttcattgccggaagagtcatttctggaattggaaacggcttcatcacagccacagtccccatgctccagtcggaatgcgccaaacccgaacgtcgaggaaagttggtcatgctggagggagctctcatcaccgctggaattgctctttcgtattggatcgactttggcttctattgggtgcggaccaacgacgccgactggcgtttccctatcgccttccagattgtcttctctctggttctcaccttcaccatcatgtctcttcccgagtctccccgatggctcgtgaagaaacagagattcgaagaagcggcaggagtttttgctgctctcgaggatgtgcctctggacgacccctacgtgattaaccagatcacctccgtcaaagaatcgatcatgatggagcagctggcccagttgggtgtcgatggtgtcgatgctcggcggaaaatccagtcgggcgagttccaaatgggccaggagctgtctttcatcggtcaaatgaaactcatgttcacctttggcaaaaagaaaaacttccaccgaacaatgctggcctactggaaccaggtgatgcagcaggtgaccggcatcaacctcatcacctactacgcagcttacatttaccaaaccagcgtgggaatgaatgccacagactcgcgaattctggccgcctgcaacggaacagagtactttatggcttcctgggtcgccttctacacaattgagcgatttggacgccgaaaactcatgctgtttggagccgtaggccaagcatgcactatggccattctcaccggatgtgtttacgcagcttcaaagcccgaagatggaggcttggacatgcagggggcgggaatcgctgcggccgtctttctgtttgtgttcaacactttcttcgccattggctggctcggtatgacctggctctaccctgcggaaatctcgtctttggagatcagagctccggcaaacggtctttccacctcgggcaactgggccttcaacttcatggtggtaatgatcacccccgtggctttcaactccatcaagtggaagacgtatatcatttttgcctgcatcaacgccttcatggtccccatggtgtactttttctaccccgagaccgccggacgaagcttggaagagattgatatgatctttgccgagtccaaccctcgaactccctgggacgtggttggtattgccaaccgtctgcccaagaactccgtggcaacttatgatgactacgaggctggtgaacaggaggagaaggccattgttgagacagcggaaagtgtctctcatgattcggccgagtttcagtga

SEQ ID NO: 11753 - protein, 578 aa, Yarrowia lipolytica CLIB122
MKLQVPAFARSSSDVKTSFMGARGQKLHNLVAAIAGLGFLLFGYDQGVMGGLLTLDTFIQQFPKMDTSDYLPPKVKTFNTTIQGTAVGIYEIGCMIGALFTMWAGDKLGRRYMIFFGSIIMTIGAILQCASYSLGQFIAGRVISGIGNGFITATVPMLQSECAKPERRGKLVMLEGALITAGIALSYWIDFGFYWVRTNDADWRFPIAFQIVFSLVLTFTIMSLPESPRWLVKKQRFEEAAGVFAALEDVPLDDPYVINQITSVKESIMMEQLAQLGVDGVDARRKIQSGEFQMGQELSFIGQMKLMFTFGKKKNFHRTMLAYWNQVMQQVTGINLITYYAAYIYQTSVGMNATDSRILAACNGTEYFMASWVAFYTIERFGRRKLMLFGAVGQACTMAILTGCVYAASKPEDGGLDMQGAGIAAAVFLFVFNTFFAIGWLGMTWLYPAEISSLEIRAPANGLSTSGNWAFNFMVVMITPVAFNSIKWKTYIIFACINAFMVPMVYFFYPETAGRSLEEIDMIFAESNPRTPWDVVGIANRLPKNSVATYDDYEAGEQEEKAIVETAESVSHDSAEFQ

SEQ ID NO: 11754 - DNA, 1779 bp, Yarrowia lipolytica CLIB122
  CDS (1)..(1779)
atgggacgaaactggctagcgttttcacaagcctccactgaggtcaagaccgagtttctgggtcttcgaggccagaagctccaccgagccgtggccttcattgccggtatgggtttcctgctgttcggatacgaccagggagtcatgggtggtctgctgaccctcccccggttcatccaccagttccccaagatggacacctccgactacgttcctgaggagacccgaaagttcaacaccaccatccagggtgtgtctgtcggtatttacgagattggatgtatgatcggcgctctgttcaccatgtgggccggagacaaactcggtcgacgacgtatgattttctggggctctatcatcatgactattggtgccattctgcagtgtgcttcttactctcttggtcagttcattaccggtcgagttgtttctggtgttggtaacggttttatcaccgccactgttcccatgttccagtccgagtgtgccaagcctgagcgacgaggagctctcgtcatgatggagggtgcccttatcaccggtggtattgccctctcttactggatcgattttggcttctactgggtcaacaacgatgccgactggcgattccctattgctttccagatcatcttctccatgttcctcaccttcaccgtcatgtctcttcccgaatctccccgatggcttgtcaagaagcaacgattcgacgaggctgctggtgtcttctctgctctcgaggatgtgcctattgatgacccttacgtgattgaccagatcgccgaggtcaaggagtccatcatgatggagcagcttgcccagcttggtgttgacggatccgaggctcgagagaagattgcctctggagagttccagatgggtgctgagctgcccttcttggaacagatgaagctgctcttcacctttggcaagaagaagaacttccaccgaaccatgctggcctactggaaccaggtcatgcagcagattaccggtatcaacctgattacctactacgccgcctacatttacgagacatctgttggtatgaacgccaccaactcgcgaattctcgctgcctgtaacggtactgagtacttcctcgcctcctgggttgccttctacaccattgagcgattcggaagacgaaagctcatgttgttcggagccattggtcaggcttgcaccatggctattcttactggaactgtctacgccgcttctcctcccgaggacggtggacttgacaactctggcgctggtattgcagctgccgtcttcctcttcgtctttaacaccttcttcgccattggctggctcggaatgacctggctgtaccctgccgagatcacctctctggagatccgagcccccgccaacggtctgtccacctccggtaactgggtcttcaacttcatggtcgtcatgatcacccccgttgccttcgatacaatcaagtggaagacttacatcattttcgcctgcatcaacgccgccatggtccccgtggtctacttcttctaccccgagaccgctggacgatctctcgaggagattgacaagatcttcgccgagtccaacccccgaactccctgggatgttgttggcattgcccgacgaatgccccgagagtctgctcttacccgacgaaagcagggtgtcaaccagaccttcgacaactccaacgagaaggctgtggtcgaggagaacaccgagtccgctgttggctccaccaccggctctgcctctccttcttttgagaacgtttctcaagcttaa

SEQ ID NO: 11755 - protein, 592 aa, Yarrowia lipolytica CLIB122
MGRNWLAFSQASTEVKTEFLGLRGQKLHRAVAFIAGMGFLLFGYDQGVMGGLLTLPRFIHQFPKMDTSDYVPEETRKFNTTIQGVSVGIYEIGCMIGALFTMWAGDKLGRRRMIFWGSIIMTIGAILQCASYSLGQFITGRVVSGVGNGFITATVPMFQSECAKPERRGALVMMEGALITGGIALSYWIDFGFYWVNNDADWRFPIAFQIIFSMFLTFTVMSLPESPRWLVKKQRFDEAAGVFSALEDVPIDDPYVIDQIAEVKESIMMEQLAQLGVDGSEAREKIASGEFQMGAELPFLEQMKLLFTFGKKKNFHRTMLAYWNQVMQQITGINLITYYAAYIYETSVGMNATNSRILAACNGTEYFLASWVAFYTIERFGRRKLMLFGAIGQACTMAILTGTVYAASPPEDGGLDNSGAGIAAAVFLFVFNTFFAIGWLGMTWLYPAEITSLEIRAPANGLSTSGNWVFNFMVVMITPVAFDTIKWKTYIIFACINAAMVPVVYFFYPETAGRSLEEIDKIFAESNPRTPWDVVGIARRMPRESALTRRKQGVNQTFDNSNEKAVVEENTESAVGSTTGSASPSFENVSQA

SEQ ID NO: 11756 - DNA, 1602 bp, Yarrowia lipolytica CLIB122
  CDS (1)..(1602)
atgtccactagtgctatgaccgacgattatcccatggctgaggtctccattactgaggagaccaagatgcctgagcctgccaagaaatcgcagcttcttgtcattctgctctgtctctttgccgccatgggcggttttgtctttggctatgacactggtaccatttctggcttcatcaacatggaccctttcctagagagctttggagaagccgatgagtctggcgttttctttctatcccgaatccgagctgggctcattgttggactcttttccattggtgctttccttggcacccttcttggtggcttccttgctgacaaggttggtcgaaagaagggaattgtctatgtcgccatggtctacattgttggtatgcttatccagatcacagccttcacagcctggtaccagattgccattggtcgtgtcatcggtggtgttggtattggtgcactctctgtgctggtccccatgttccagtcagagactgctccccagaatcttcgaggcgctcttgtctcttctttccagctgtttattactctcggcatcttcattggatttagtgtttgctacgctaccaagtcgcggctcgataccggtgcctaccgaatccccatgggtctttgcttcgcctgggcttttatccttctcattggcatgtgcttcatgccagagtcccctcgattcctggtttcaattggccgcattgaggaggcccgaaaggctatggccatgacaaaccaggttcctctccacgacgctgtcattgatgaggaactcaaggctattgagaactctgtcattagggaaaagagtgctggtaaggccacatggaaagaacttttcactggcgagccccgaatgggctaccggcttacccttggtattctcgtccaggttctccagcagctctgtggtgccaactactttttctattacggaacttctatcttcaaggccattggaatgtcggattctttcgctacttcgatgatctttggcggaatcaacctcctgtctacctttggaggtctctacattgttgatcgattcggtcgacgaaagtgccttcttggtggagccatggtcatgtttgtctgtttcctcgtctattctactgtcgggttcgctgctctttatcccaacggtgataccacccttcccgccagaaaggctgttggtgatgtcatgattctgttcacctgtatcttcatcgccgctttcgcctctacgtgggcccctattgccttcgtcgttgtttctgagaccttccctctcagaatgcgatcaaagggaatggctgttgctactggaggaaactggatgatcaacttcctcgtttctttcctgactcccttcatcaccagttccattgggttcaagtacggttatgtcttcactgcttgcattggtttcgccattatctttgtcttcttcttcatccctgagaccaagggtctgtcccttgaggatgttgacgagctgtacgcttcaggtgtcagtgctcgaaactcccccaactgggttccttcttccaagaagcaggaagtcaacgaacctaagaacagtatgaccgacttctccgagtcctcttag

SEQ ID NO: 11757 - protein, 533 aa, Yarrowia lipolytica CLIB122
MSTSAMTDDYPMAEVSITEETKMPEPAKKSQLLVILLCLFAAMGGFVFGYDTGTISGFINMDPFLESFGEADESGVFFLSRIRAGLIVGLFSIGAFLGTLLGGFLADKVGRKKGIVYVAMVYIVGMLIQITAFTAWYQIAIGRVIGGVGIGALSVLVPMFQSETAPQNLRGALVSSFQLFITLGIFIGFSVCYATKSRLDTGAYRIPMGLCFAWAFILLIGMCFMPESPRFLVSIGRIEEARKAMAMTNQVPLHDAVIDEELKAIENSVIREKSAGKATWKELFTGEPRMGYRLTLGILVQVLQQLCGANYFFYYGTSIFKAIGMSDSFATSMIFGGINLLSTFGGLYIVDRFGRRKCLLGGAMVMFVCFLVYSTVGFAALYPNGDTTLPARKAVGDVMILFTCIFIAAFASTWAPIAFVVVSETFPLRMRSKGMAVATGGNWMINFLVSFLTPFITSSIGFKYGYVFTACIGFAIIFVFFFIPETKGLSLEDVDELYASGVSARNSPNWVPSSKKQEVNEPKNSMTDFSESS

SEQ ID NO: 11758 - DNA, 1623 bp, Yarrowia lipolytica CLIB122; identical to SEQ ID NO: 4640
  CDS (1)..(1623)

SEQ ID NO: 11759 - protein, 540 aa, Yarrowia lipolytica CLIB122; identical to SEQ ID NO: 4641

SEQ ID NO: 11760 - DNA, 1602 bp, Aspergillus nidulans FGSC A4
  CDS (1)..(1602)
atgtccatcctcgccttggtcgaagaccgcccaactccccgcgaggtttacaactggcgcgtctacctcctggccgcagtcgcctccttcacatcatgcatgatcggctacgacagcgccttcatcggcacaacgctgtctctgcaatcctttcaaaatgaatttaattgggaatcgctcaatacggatctcatcagcgcgaatatcgtctcgctatatcaagcaggtgccttcttcggcgctcttttcgcgtaccccatcggccacttctggggccgccgttggggtcttatgttctctgctcttattttcttccttggtgccggcatgatgctcggtgcgaatggggatcgagggctagggctgatctatggtggccgagtgcttgcgggcattggcgtcggcgccgggtcgaacatctgtcctatctacatctcagaaatggcacctcccgctattcggggtcgccttgttggggtttatgagctgggttggcagattggtggcgtcgttgggttctggatcaattacggcgtggacgaaacccttgccccaagccacaaacaatggatcatcccctttgccgtgcaattgattcctgctggcctgctcattatcggcgccctcttgatccgcgaatctcctcgttggctcttcctccgcggtaaccgtgaaaagggcattgagaccctggcctggatccgcaacctgccagccgaccatatctatatggtcgaggaaatcaacatgatcgagcagtcgctcgaacaacagcgtgtcaaaattgggcttggtttctggaaaccctttaaagcagcctggacgaacaagcgtattctctaccgcctctttttggggtctatgttgttcctctggcagaacgggtcaggcatcaatgcgatcaactattacagcccgcgcgtcttcaagagtattggcgtatcgggtggcaatacctcactcttgacaacgggcattttcggtgtcgtcaaggcggtcattacctttgtttggctgttgtatttgatcgatcattttggacgacggaacttgctgcttgttggtgcggcgggcggttcagtctgcctttggattgtgggcggatacatcaagatcgcgaagccagagaacaaccccgagggaacgcagcttgatagcggtggcattgcggctatattcttcttctacctgtggacggccttctatacaccatcttggaacggcacgccttgggtcatcaactcggaaatgttcgatcccaccgtccgctcccttgcacaagcctgtgctgccgcctcaaactggctctggaactttctgatctctcgctttacgccccagatgttcacgtccatgggatacggagtctacttcttctttgcatcgttgatgatcctctcgatcgtgtttgttttcttcctcattcccgagacgaagggcgtgccgctggagagcatggagactctatttgacaagaaaccggtttggcacgcccattcgcagctaatcagggagctgagggagaatgaggaggcgttccgggcggatatgggtgcgagtgggaagggaggtgtgacgaaggagtatgtcgaggaggcttaa

SEQ ID NO: 11761 - protein, 533 aa, Aspergillus nidulans FGSC A4
MSILALVEDRPTPREVYNWRVYLLAAVASFTSCMIGYDSAFIGTTLSLQSFQNEFNWESLNTDLISANIVSLYQAGAFFGALFAYPIGHFWGRRWGLMFSALIFFLGAGMMLGANGDRGLGLIYGGRVLAGIGVGAGSNICPIYISEMAPPAIRGRLVGVYELGWQIGGVVGFWINYGVDETLAPSHKQWIIPFAVQLIPAGLLIIGALLIRESPRWLFLRGNREKGIETLAWIRNLPADHIYMVEEINMIEQSLEQQRVKIGLGFWKPFKAAWTNKRILYRLFLGSMLFLWQNGSGINAINYYSPRVFKSIGVSGGNTSLLTTGIFGVVKAVITFVWLLYLIDHFGRRNLLLVGAAGGSVCLWIVGGYIKIAKPENNPEGTQLDSGGIAAIFFFYLWTAFYTPSWNGTPWVINSEMFDPTVRSLAQACAAASNWLWNFLISRFTPQMFTSMGYGVYFFFASLMILSIVFVFFLIPETKGVPLESMETLFDKKPVWHAHSQLIRELRENEEAFRADMGASGKGGVTKEYVEEA

SEQ ID NO: 11762 - DNA, 1539 bp, Aspergillus nidulans FGSC A4
  CDS (1)..(1539)
atgggctttatgcttaggaagcctgatgatgcagcgggctctgcggcccctgctatcctgatcggcctgtttgtggcctttggtggcgtcttgtacggctatgatactggtactatcagcggcattctcgccatgaaatactggcggaggcagttctctaccggctacgttaaccccaacgaccatatccccgacgtcacctcctcccagtcctcgatgatcgtttctctcctgtccgccggtaccttcttcggtgccctcacggccgccccagttgctgattactttggtcgccgcattgccatgatcctcgactgttttgtattttgcttcggagtggtcttgcagacagcagccaccgccattcccttgttcgttgctggacgtttcttcgccgggtttggcgttggattgctctccgcaacagttcctttataccagtctgagacggctcccaagtggatccgtggcactattgtcggtgcttatcagcttgcgatcactatcggtctactccttgccgctattgtcaacaactctacaaaagaccgcaatgacaccggttgctaccgcattcccgtcgcggttcaattcgcctgggccatcatcctggttgtgggaatgatcatcctccctgaaaccccgagattcctgatcaaacaagacaaccatgaggctgctatcaagtctcttgcccgtcttcgtcgtctggacatcaacgatctcgctgttgtcgaagaacttgaagagattaaggcaaaccatgaatatgagctcagcgttggcaaagccagttaccttgagatactccgcgggtccattgtcacagtttactacggaacgacattcttccaacactctggcattaacaacagctttgtcattaccttgataacgaacatcgtcaatgtagtttcaaccctacccggactttggatggtcgagaaatggggccgtcgcccgctgctactttttggcgccgtcggtatgtgcgtcagccagttcattgtggctattgtcggcacaaccaccgactccggcgtcgcaaacaaggtccttatcgctttcgtctgcgtttacatcttcttcttcgcgtcctcatggggaccggtcgcgtgggttgtcactggtgagctcttcccgctcaaggctcgcgccaagtgtctctctatcactactgctgcgaactggctgcttaactgggcgatcgcctacgccaccccatatatggtcgactctggtccgggaaatgccaacctccagtcaaaggtgtttttcatctggggaggattctgcttgattgctggaatatttgtctggacctgcatctacgagaccaagggtcttacccttgaggaggtcgatgaactttacgccaaggttcccgttgcctggcgctctaaaggctttgttccgtccgtgcattacacagacgtgcgcgacgttgctgctgggcgtaagggtagtggcttggctgaattagaggcggacgcccaggccaagcagatctcggagcatgtcgagaaagcttcggtctaa

SEQ ID NO: 11763 - protein, 512 aa, Aspergillus nidulans FGSC A4
MGFMLRKPDDAAGSAAPAILIGLFVAFGGVLYGYDTGTISGILAMKYWRRQFSTGYVNPNDHIPDVTSSQSSMIVSLLSAGTFFGALTAAPVADYFGRRIAMILDCFVFCFGVVLQTAATAIPLFVAGRFFAGFGVGLLSATVPLYQSETAPKWIRGTIVGAYQLAITIGLLLAAIVNNSTKDRNDTGCYRIPVAVQFAWAIILVVGMIILPETPRFLIKQDNHEAAIKSLARLRRLDINDLAVVEELEEIKANHEYELSVGKASYLEILRGSIVTVYYGTTFFQHSGINNSFVITLITNIVNVVSTLPGLWMVEKWGRRPLLLFGAVGMCVSQFIVAIVGTTTDSGVANKVLIAFVCVYIFFFASSWGPVAWVVTGELFPLKARAKCLSITTAANWLLNWAIAYATPYMVDSGPGNANLQSKVFFIWGGFCLIAGIFVWTCIYETKGLTLEEVDELYAKVPVAWRSKGFVPSVHYTDVRDVAAGRKGSGLAELEADAQAKQISEHVEKASV

SEQ ID NO: 11764 - DNA, 1473 bp, Aspergillus nidulans FGSC A4
  CDS (1)..(1473)
atgggccggaagctcagtttattcagggccatctacctggcgtctgccagttgcatgggatctttcgcttttgcatttgatactggcgttatcagcggtgtcctcactctcgaatcgttccagagggactttcggtatactgaatcgcagaagacaaccgtcaattctaatgccgtctcaattctgcaggctggtgcgtttttcggctgtttcctcaccacgccagttgcatcgcgctttggccgtcgatcaggcttgatcatcagttctctggtcttcaccgttggaacaatcttgcaaatcatcaacgcgcatactctggcgacgttctacacaggtagagtaattgccggcgtcgggatcggcgcggcaactgtgttgattccgatgtactccgctgagatggccccgaaagagatccgcgggcgactcggtgcttgtttccagttattcttcgctttgggtgtaatgatcgcctactgggtcaccttcgccgtttcagagacccagccaccgaagcccaagcaatggcagatagcgctcggtctgcagctactgccatccactctgttgctgatcggaatggtcactgtcaaggaaagtgcccgctggctggcggtcaagggccggaacgaagaagcgtgggagtctctgaaatgggttcgaggtggagaggacacgccggagctgcagcaggaattcgatgaaattctcgcaggcattgcagaagaagcccgcgtcaaagaaaactttacttggcgtgaactccttctgcccgcgaatcggtaccgaatcttcattgccattacgattcagctctgtgcccagttgtccggtaatacttccttggcatactatgcgacccagatattctcggccgtcggcgcggggagctccgccaaactggtgactggcttctttggcgtggtcaaggtcgtaggtgtcagcatcttccaattgtttgtcattgacaagattggacgaagggtgccattcatggctggggctttcgcaatgggttcgttcatgcttattatcgcgtgcgtgcttgcaactcatcccacgagctcggatggggccgactcgggagcaacgccggccggtattgcaatgatcattatggtgtacgccgaagcctttagcttcaatatgtcctggggcgcgcttccatggctatacgtcggcgagattttctcgagtcggctgcgagaagtcggtgtgaccgttggagcggcgtcgcaatggctgtttaactttatgatgtctcaggtgacgccacacgccattagtaatattggctggcggatgttcttgatgtttgccatcttcaactatgcgatcgtggtatactcgtgggtattccttaaagagacgctgaaagtctcactcgaggagatgcaaggtatcttcggagcaggcactgagccagatggaaaacctacagtggaagcacatgaaagcctcacaaaatag

SEQ ID NO: 11765 - protein, 490 aa, Aspergillus nidulans FGSC A4
MGRKLSLFRAIYLASASCMGSFAFAFDTGVISGVLTLESFQRDFRYTESQKTTVNSNAVSILQAGAFFGCFLTTPVASRFGRRSGLIISSLVFTVGTILQIINAHTLATFYTGRVIAGVGIGAATVLIPMYSAEMAPKEIRGRLGACFQLFFALGVMIAYWVTFAVSETQPPKPKQWQIALGLQLLPSTLLLIGMVTVKESARWLAVKGRNEEAWESLKWVRGGEDTPELQQEFDEILAGIAEEARVKENFTWRELLLPANRYRIFIAITIQLCAQLSGNTSLAYYATQIFSAVGAGSSAKLVTGFFGVVKVVGVSIFQLFVIDKIGRRVPFMAGAFAMGSFMLIIACVLATHPTSSDGADSGATPAGIAMIIMVYAEAFSFNMSWGALPWLYVGEIFSSRLREVGVTVGAASQWLFNFMMSQVTPHAISNIGWRMFLMFAIFNYAIVVYSWVFLKETLKVSLEEMQGIFGAGTEPDGKPTVEAHESLTK

SEQ ID NO: 11766 - DNA, 2379 bp, Aspergillus nidulans FGSC A4
  CDS (1)..(2379)
atgtcgacggactatgagaaaaggctgagcctcgacgatatggccctcaagacaggcgatcacatcgagacaattggtaaggctgccgccgtcgatgccaccgtcgccgccaatgtcgatgacatcccgatcagcttgtacgtgtggatggttgctctgtctgcctcaattgcgggcatgctctttgggtacgacactggcatcatctcagcggtcttggtgtacataaaagacgcactgggtggtcggtatctcacaagttctgaaaaggaactgatcacatcgctctgctctggaggggcattctttggctccattttcgcaggaaataccgccgataggtggggccgtaaaactgcgctttacctaggttgcgtactcttcgtggtcggcgctgttttgcaggcagctgcctacaccatcgcacaaatggcggttggccgagtcattgttggcttcggggtagggtcagctgcaatgatagtgccgctatacgtcgccgagatcgccccgtcaaaagctcgtgggcgactggtgggtttgaacaatgtgtcgattactggaggacaggtcattgcatatgccatcggggccgcctttgctagtgttccccatggatggcgggttatggtgggcctagggggcttgccacctatcgtcctggcttgtctgctgccattctgccctgagtcaccccgtcatcttgtttacaatggccgtatggaggaggcacgcgcggtcctgcgcaagctgtaccgcggcgctaccgatgttcagatcgaatctgtgctcgcttcgattctggctgggtgcgaggaggcacgcgctatcagcggaaacgagggcggctgggcgaagattgtgcggctgcacacagttcccagcaacttccgagctctgctctgtgcctgcgggctaatggtcctctcccagatttctggattcaatacactgatgtattactcctccacgatattctcgttggtgggattcaccagtccaacagccgtcggcctcgttgtggctgggacgaacctgatcatgacttttgccaatatgatcttggtagatcgccttggccgccgacgtctgcttctgtccaccgtctggggaatgagcgccggcctgatagctgtttcggtggctttcagtttcatccatgttgatgtgaacgcaacggaagtcactcctcagtccgtgactacgcccgccatcgtggtgttaatattcattatctggtttgtggtcttttacggcgtatcggtggggaacacggcatggatgtctgccgacttcttccctctagaagttcgagcaatggggaccatgtggatgacttgttcgtcgtgggcgagcaatgtcatcgtctccagtacattcttgtccatgaccaacgccatgacgatggcaggaacgttcggtttctacgccggtatctgcggagtcagttatgttcttatctatttcttctaccccgaagtctcgggcctgatccttgaagaaatcaaggaggttttcgagcatggatttggcgtgagtacatatatccccactcccactatgcggagtaggcttagggtatggctacaaatcggaagacccattagcggcctgatcgaccggggggtggcggcttttgatggaggctatcggaaattccagcccgaaagcgcgcgttgtatcagagccaagccctcgatctccagtaaatgccgccctttcgaggtctttgtgtactatggctactctcaattaccaagtgtacatgcctcgcagaatcctgatattcaaaacagcgatgtcagaaagatatgggagcgacgtattcagttgggactgcttgggttacagcgtgtcacaacacggattgagagaaaagataaactgatgttggctcgcttacaggcagttcctcgattgtttttggaagctcggtccaaagcagcgtgtccgaccctggggaccacttcccctctaacctcgaaagcagctcacgtaccgatcactcgcagagattacaaaataatacttgccacccgccagtcagcagaagataacggcgatagacatgatgagaaaatgccttggagatgtgagagaaggaagcgctccagattccgctctgtgacgacacgagacgaatcaaacgagcgtcaaattacggtctacttcctcgattaccttctatatctcacaacgctgctgcaagagtcatgctggaagattgtgcaccctgcctatgggctcgatttgaaacacttcgatgatgaagctgccgacccgagaacagagcgtcatgcagtattttcgaccgggctgcgtgtttccgacgattataccacaaagaaatggaacattgggttgggaagcctacaatga

SEQ ID NO: 11767 - protein, 792 aa, Aspergillus nidulans FGSC A4
MSTDYEKRLSLDDMALKTGDHIETIGKAAAVDATVAANVDDIPISLYVWMVALSASIAGMLFGYDTGIISAVLVYIKDALGGRYLTSSEKELITSLCSGGAFFGSIFAGNTADRWGRKTALYLGCVLFVVGAVLQAAAYTIAQMAVGRVIVGFGVGSAAMIVPLYVAEIAPSKARGRLVGLNNVSITGGQVIAYAIGAAFASVPHGWRVMVGLGGLPPIVLACLLPFCPESPRHLVYNGRMEEARAVLRKLYRGATDVQIESVLASILAGCEEARAISGNEGGWAKIVRLHTVPSNFRALLCACGLMVLSQISGFNTLMYYSSTIFSLVGFTSPTAVGLVVAGTNLIMTFANMILVDRLGRRRLLLSTVWGMSAGLIAVSVAFSFIHVDVNATEVTPQSVTTPAIVVLIFIIWFVVFYGVSVGNTAWMSADFFPLEVRAMGTMWMTCSSWASNVIVSSTFLSMTNAMTMAGTFGFYAGICGVSYVLIYFFYPEVSGLILEEIKEVFEHGFGVSTYIPTPTMRSRLRVWLQIGRPISGLIDRGVAAFDGGYRKFQPESARCIRAKPSISSKCRPFEVFVYYGYSQLPSVHASQNPDIQNSDVRKIWERRIQLGLLGLQRVTTRIERKDKLMLARLQAVPRLFLEARSKAACPTLGTTSPLTSKAAHVPITRRDYKIILATRQSAEDNGDRHDEKMPWRCERRKRSRFRSVTTRDESNERQITVYFLDYLLYLTTLLQESCWKIVHPAYGLDLKHFDDEAADPRTERHAVFSTGLRVSDDYTTKKWNIGLGSLQ

SEQ ID NO: 11768 - DNA, 1611 bp, Aspergillus nidulans FGSC A4
  CDS (1)..(1611)
atggccatcggcaacatctacgtgatcgcggccatcgccgtcattggcggtggtcttttcggttttgatatctcttctatgtctgccatcatcaacacagacgcatatctgtgctacttccaacaaggccccttaaaaaccaatgacaagggggagcaagtgtgcagtggtcctactgctgacgtccagggtggtatcaccgcggccatgcccggtggctcctggctcggtgcgctggtttcggggttcctgtctgatatttttggccgcaagacgacgatccagatcgggtctgttatttggtgcattggctccatcatcgtttgcgccgcgcagaacatccctatgctcattgtcggccgcatcatcaacggattcagtgtcggaatctgctctgctcaggttcccgtctacatttctgaactggcaccacccaccaaacgtggccgcctcgtcgggctccagcagtgggccatcacttggggcatcatgatcatgttctacatctcctacggaaccagctatatcgacggtacagccgccttccgcatcccttggggtctgcaaatgatcccggccgtcctcctcttcttcggcatgatggtccttcctgaatccccccgctggctcgcccgcaaagaccgctgggaagagtgtcttgcggttctcaccctcgtccacggacatggcgatcccaacgctcccttcgtcgttcgcgaatacgaggaaattaaggcaatgtgcgaatttgagcgcaacaatgccgacgtcagctacctcgaacttatcaagccgaacatgatcaaccgcacacatgtcggtgtcttcacgcagatctggtcccaactgaccggaatgaacgtcatgatgtactacattacctatgtcttcgctatggctggactccaggggaacaacctcctcgtgtcgagctccatccagtacgttattaacgtcgttatgaccatccctgccattctttgggtcgaccgctggggccgccgccctaccctcctcctcggcgctgccggaatgctcgcattcctgtttgccaatggcggtctcatgtctagctacggacaccccgctccccccggcggcctcgacggcatcgagcagcaaagctggatcgtgcgcggtcccccctccaaagccgtcatcgcctgcacctacctcttcgtcgcggtgtacgcgatctcctggggtcctgtgtcttgggtgtacccgcccgagctgttcccgctccgcgtccgcggcaaagccaacgccctctgcacctcgtctaactgggccttcaacttcgcgctcgcgtacttcgttccaccggcgttcgtaaacatccagtggaaggtatacatcattttcggtgtcttctgcacggccatgttcctgcatgtcttcttcatgttccccgagacggcaggtaagaccctcgaagatgtagagggcattttcacgaatccggctgggatcaagtacattggaacgccggcttggaagacgaagaatgaacggggtcgtgccgcgatgctggagcagactggctttgatgtcgatgaggagaagagagcggaggctgttgccgtgcatgaggagtcccagccgaaatga

SEQ ID NO: 11769 - protein, 536 aa, Aspergillus nidulans FGSC A4
MAIGNIYVIAAIAVIGGGLFGFDISSMSAIINTDAYLCYFQQGPLKTNDKGEQVCSGPTADVQGGITAAMPGGSWLGALVSGFLSDIFGRKTTIQIGSVIWCIGSIIVCAAQNIPMLIVGRIINGFSVGICSAQVPVYISELAPPTKRGRLVGLQQWAITWGIMIMFYISYGTSYIDGTAAFRIPWGLQMIPAVLLFFGMMVLPESPRWLARKDRWEECLAVLTLVHGHGDPNAPFVVREYEEIKAMCEFERNNADVSYLELIKPNMINRTHVGVFTQIWSQLTGMNVMMYYITYVFAMAGLQGNNLLVSSSIQYVINVVMTIPAILWVDRWGRRPTLLLGAAGMLAFLFANGGLMSSYGHPAPPGGLDGIEQQSWIVRGPPSKAVIACTYLFVAVYAISWGPVSWVYPPELFPLRVRGKANALCTSSNWAFNFALAYFVPPAFVNIQWKVYIIFGVFCTAMFLHVFFMFPETAGKTLEDVEGIFTNPAGIKYIGTPAWKTKNERGRAAMLEQTGFDVDEEKRAEAVAVHEESQPK

SEQ ID NO: 11770 - DNA, 1653 bp, Aspergillus nidulans FGSC A4
  CDS (1)..(1653)
atgggtgtcgagtcttcttcttaccatggggagtctatcaccccggctcctgctccccagccgcaacaatactccagccaggagtcgattgggagcaccaagcctgaacccggggtcgatactcctatcccccgcatcactttgcgagccaccatcatgggcttgttcgtctccatgggtggcttgcttttcggatacgacactggtcagatctctggtttccaggaaatgtctgacttccttgaacgttacggtgaactccagtccgatggttcatattccttcagccacgtccggtccggtctgattgtcagtcttctgtctatcggaacgcttattggtgctctctgtggtgctcctctcgctgataagctgggccggaaatggtccatcactgtctggtgtattatcctcatggtcggaatcattgttcagatttccgccccttccggtaactgggtccaaatcgtcatgggccgctggaccactggtcttggtgtcggcggatgctccctggttgttcccatgtaccaaggagagagtgcccccaagcacgtccgtggtgccatgatcagttcctaccagctgttcgtcacgcttggtatcttcctagcatactgtatcaaccttggaacggagagcttggatggtagtgcccaatggcgtatcactctaggtctgaccttcctgttcgcactcatccttggtctcggcatggccatgtttcctgaaagccctcgcttcaactaccgtcacggcaagattgacactgcccgtacgactatggcccgtctttatggtgtcccagagaaccacgtcgtcatcgtccgcgagctggctgaaatccaatcgcagctcgacgctgaaaaggagcagtcccagaaatggaacgaattcatcaccgccccacgcatgctgtaccgtattcttctgggtattgttctccaagctctgcagcagctcactggcgccaactacttcttctactatggtaccaccatcttccagggtgccggtatctccaactctttcatcactcaggtcattctcggagctatcaattttggaaccacctttggtggtctctacgttgttgagaactttggtcgccgcaagtccctcattgctggtgcttccttgatgttcatctgcttcatgatcttcgcctccatcggacactttatgctcgacgttgagcaccctgagaacacccccggacccggcaagggcatggttgtcgtcgcctctttcttcgttctcttctacgctacgacctggggtcccatcgtctggtccatcgttgctgagctcttcccctccaaataccgtgccaagggtatggctctcgccactgcttccaactggctttggaacttcctcattggttgccttagtttcttcactcccttcatcaccggagccatcgatttcgcgtacggctacgtcttcgcgggctgtctcctcgtcgctgtcttcgtggtctacttcttcgttattgagggtaaagaccgaactctcgaggagctcgactggatgtacgtcaaccacgtcaaaccctgggagagcagcaagtacgagatcccgcggatcacctaccacgatgacgctcgcggagccaggaaggagaatactgagcacgctgaagttgcttag

SEQ ID NO: 11771 - protein, 550 aa, Aspergillus nidulans FGSC A4
MGVESSSYHGESITPAPAPQPQQYSSQESIGSTKPEPGVDTPIPRITLRATIMGLFVSMGGLLFGYDTGQISGFQEMSDFLERYGELQSDGSYSFSHVRSGLIVSLLSIGTLIGALCGAPLADKLGRKWSITVWCIILMVGIIVQISAPSGNWVQIVMGRWTTGLGVGGCSLVVPMYQGESAPKHVRGAMISSYQLFVTLGIFLAYCINLGTESLDGSAQWRITLGLTFLFALILGLGMAMFPESPRFNYRHGKIDTARTTMARLYGVPENHVVIVRELAEIQSQLDAEKEQSQKWNEFITAPRMLYRILLGIVLQALQQLTGANYFFYYGTTIFQGAGISNSFITQVILGAINFGTTFGGLYVVENFGRRKSLIAGASLMFICFMIFASIGHFMLDVEHPENTPGPGKGMVVVASFFVLFYATTWGPIVWSIVAELFPSKYRAKGMALATASNWLWNFLIGCLSFFTPFITGAIDFAYGYVFAGCLLVAVFVVYFFVIEGKDRTLEELDWMYVNHVKPWESSKYEIPRITYHDDARGARKENTEHAEVA

SEQ ID NO: 11772 - DNA, 1755 bp, Aspergillus nidulans FGSC A4
  CDS (1)..(1755)
atgaagaagttatcaacaatatttcttaataaccgatctgaggaagcgcaatgtcgtcttggccgctcgggggagcagcaccatcaggagcagctcgatagagagaagcaagatgaaatgaatgaaagtcctgtaccattcgtgacctggcgatctctagctctaggtgcctttgtttccataggaggcattatattcggctatgacactggtcagatctccggctttctcgaaatggacaattttaaacgacgattcggccagcggcagctggatggaacttacgctttcaataacgtgcgatcagggctgatagtgtccatgttgtccatcggtacgcttctgggagccctgatggctggtccactggctgaccggcttggccgcaaatggtccattgcattttggtgcattattcttcatgttggcctcatcattcagatctcgtcgccacaccctaagtggtaccaattcatgatgggtcgtttcgtgaccggttttggtgtgggcgcttgctctttactagtgccattatatcaaggcgagacatccccaaaacagatacgtggggccatggtctgctcgtaccaattgttcgttaccctgggtatctttgttgcctactgcataaactatgggacagagggcatgagcaactcggcatcctggcgtattcctctcggaatcacgtttctgtgggctttgcttctcggtattggaatcatatttttcccagagagccctcgctatgacttcaggcacgggcgcgcggacaaagcccgacaaaccatgtcaaaactttatggcgtgccccagaaccaccgggctatcatagaggaacttactgagattagggaacaactcgaggctgaaagctcctccagaggtggttttcatgggtggatagagatgttccaggggcctcggatgttttatcgcataaccctaggcattgtactgcaggcactacaacagctgactggagctaactatttcttctattacggtacaactgtcttcaatggagcgggtatctcaaacgtgtttgtcacgcagatgatcttgggcggagtgaacttcggcactactttcttcggcctttatgttgtcgagcattttggaagacgaaaaagtttggtgacaggaggaatatggatgtttgtgaatttcatggtttttgcctcagttggccacttttctctgaatgtggaagatccttctgctactcctggcgctggcaaggcaatggttgtcttcgcctgtttgtttattactggtttcgcgactacgtggggccccatgatttgggctatcgtggcagagctttacccatcccgctatcgagctaaggctatggccatggccacggcttcgaactggctgtggaattttcttattgggcatcgggaaatcaggttctttacgccctttatcacgggagatatcgatttcgcttatggctatgtgttcgccggctgccttttcgcagccatactcatagtctacttctttgtactcgagggcaaagggaagacgcttgaagaaatggacatgatgtatgtgatgcgcgtacctccctggaaaagcagcaaatgggtccctccccccccggaagaacgcgtaacaacggcgcatattctggaccagcgagcggcccgtgaatttgccaatgaagatgagtcgagcaaaagaaaccaggtgccagcacatcagcatattgaccaaaatgatgctggagttgggccgtcggcgtaa

SEQ ID NO: 11773 - protein, 584 aa, Aspergillus nidulans FGSC A4
MKKLSTIFLNNRSEEAQCRLGRSGEQHHQEQLDREKQDEMNESPVPFVTWRSLALGAFVSIGGIIFGYDTGQISGFLEMDNFKRRFGQRQLDGTYAFNNVRSGLIVSMLSIGTLLGALMAGPLADRLGRKWSIAFWCIILHVGLIIQISSPHPKWYQFMMGRFVTGFGVGACSLLVPLYQGETSPKQIRGAMVCSYQLFVTLGIFVAYCINYGTEGMSNSASWRIPLGITFLWALLLGIGIIFFPESPRYDFRHGRADKARQTMSKLYGVPQNHRAIIEELTEIREQLEAESSSRGGFHGWIEMFQGPRMFYRITLGIVLQALQQLTGANYFFYYGTTVFNGAGISNVFVTQMILGGVNFGTTFFGLYVVEHFGRRKSLVTGGIWMFVNFMVFASVGHFSLNVEDPSATPGAGKAMVVFACLFITGFATTWGPMIWAIVAELYPSRYRAKAMAMATASNWLWNFLIGHREIRFFTPFITGDIDFAYGYVFAGCLFAAILIVYFFVLEGKGKTLEEMDMMYVMRVPPWKSSKWVPPPPEERVTTAHILDQRAAREFANEDESSKRNQVPAHQHIDQNDAGVGPSA

SEQ ID NO: 11774 - DNA, 1575 bp, Aspergillus nidulans FGSC A4
  CDS (1)..(1575)
atgtccttccttctcagaaagctcgtccacaatgaggcgatgcgaacagacccacgtgagatatacgggtggagggtgtatgcattggcttgctcggcatgtttcggcggcatgttgtttggcgtggaaactggaatcatcggcggtgtcctcacaatggacacgttcaaagcaaaatacgggttgaatgagttgggtgacacgggaagagctaatctttccgccaacatcgtgtcaacccttcaagctggatgtttctttggtgctctcgcagcgtcttgggtggctgataaatatggaagacggcttggcctgatcgccgcttcttttgtagcgctcgtgggagtcatcatgcaagttgcggcgagcggtcacctggaagctatgtatattggacgcctgctctgtggtataggtgtcggcttcgcgtctatggtcaatccactctatgtctcggaaaatgcccctcgagccatccgtggtggtctcacaggtctataccaactgttcattacaatgggaattatgcttgctttttggatcaattacggctccctgcttcacatctccggcgcaggtcagtacctcgtcccgctagccatgcaaggtcttccggcaatcctcctcctcgtcggcatgctcctctgcaatgaatcccctcggtggctagccaagcaagaccgctgggaagaagcacgcgcaacactatcccgcgtccgcaacctcccatcgactcacccctacgtcgagaacgaatttcaagacatcgtccgccagctcgaattcgaacgccagctcatcagcggctctagcttcgtcgacctcctcaaggaaatgtggttcatccccggaaaccgcaagcgagctctcatcagcatctggctcatgatctgccaacagatgacaggaactaatgcaatcaactactacgctccccagatctttgagaacctcggaatcaccggcagtgccaacggcctcttcgccacaggcgtgtacggcattgtcaaggtcgtcggttgcgcgtgcttcctcgtcttcgtcgctgactctcttggccgtcgccgttccctcctctggacgtccatcgcccaaggcctcgcaatgctctatatcgggttatatgttcgcattgcaccccccaaagagggtgagcccgttattcctgctggctactttgcactcgtctgcatcttcctcttcgccgcattcttccagttcggctggggccctgtttgctggatctatgtctctgagatcccgacaacgcggctccgcagtttgaatgtttcctttgctgctgccacacagtggctgttcaactttgttgttgcgcgcgctgtgcctaacatgctggctaccgtgggtgccaatggttatggggcgtatatcatatttgcttgcttctgtttctccatgtttgtcttcgtttggttcttcgtcccggagacaaagggtctctctctcgagaagatggacgacctctttggcatcagccatggcagcacaaaggagagcgccgatgagagccctgccgagaagcaagaggagattcgcattgagaagacggcctag

SEQ ID NO: 11775 - protein, 524 aa, Aspergillus nidulans FGSC A4
MSFLLRKLVHNEAMRTDPREIYGWRVYALACSACFGGMLFGVETGIIGGVLTMDTFKAKYGLNELGDTGRANLSANIVSTLQAGCFFGALAASWVADKYGRRLGLIAASFVALVGVIMQVAASGHLEAMYIGRLLCGIGVGFASMVNPLYVSENAPRAIRGGLTGLYQLFITMGIMLAFWINYGSLLHISGAGQYLVPLAMQGLPAILLLVGMLLCNESPRWLAKQDRWEEARATLSRVRNLPSTHPYVENEFQDIVRQLEFERQLISGSSFVDLLKEMWFIPGNRKRALISIWLMICQQMTGTNAINYYAPQIFENLGITGSANGLFATGVYGIVKVVGCACFLVFVADSLGRRRSLLWTSIAQGLAMLYIGLYVRIAPPKEGEPVIPAGYFALVCIFLFAAFFQFGWGPVCWIYVSEIPTTRLRSLNVSFAAATQWLFNFVVARAVPNMLATVGANGYGAYIIFACFCFSMFVFVWFFVPETKGLSLEKMDDLFGISHGSTKESADESPAEKQEEIRIEKTA

SEQ ID NO: 11776 - DNA, 1689 bp, Aspergillus nidulans FGSC A4
  CDS (1)..(1689)
atgggtgtggacatcaagggcctcttcaagcccaaagctgaacaacaagaacactcccaagccacaacgccttcaaggaccgactcaattgcggagaaggacaatggcatcatcgacgacagccctgtcaagtacctaacatggcggtcattcatcctgggtatcgttgtgtccatgggtggtttcatcttcggttactctactggtcaaatttccggcttcacaacaatggcagatttcaagaagcgcttcgccgagcgccaagcaaacggcgagtacgtcttcagcaacgtccgcaacggtctaatcgtcggtcttctctgcattggaaccatgatcggagccctcgtcgccgcccccatcgccgaccgcattggccgcaaactctccatgtccttctggtcgatcatccacatcgtcggtatcattatccagatcgccactgactccaactgggtccagattgccatgggccgttgggttgccggtctcggtgtcggtgccctctccagcgtcgtccccatgtaccaatccgaagctgcaccccgccaggtccgtggtgccatgatctcggccttccagcttttcgtcgcctttggtatcttcatctcttatatcatcaactacggtaccgagtcgatccaatccactgcctcgtggagaatcaccatgggcatcggtttcgcttggccactgatcttaggtctcggagctcttttcctgcccgagtccccccgttacgcttaccgtcttggccgtattgacgaggcccgcaaggtcatggccaagctctatggtgttgaggttaaccaccgcgttgtcgtccaagaaatgaaggacatgaaggataagctcgaggaggagcgcgctgctggtgttgctccctggcacgaggttgtgactggcccccgtatgctctatcgtactcttcttggtattgctctgcagtccctgcagcagctctctggcgcaaacttcatcttctactacggtaactccattttcacctccaccggtctcaacaacagttacgtcacccagatcattcttggtgccgttaacttcggtatgaccctgcctggtctgtacattgtcgagcactttggtcgccgtgctagtctgatggtcggtggtgcctggatggccatctgcttctacatctgggcttctgtgggcaactccgttcttgatcttgacaacccgcagaacacccccaaggccggagccgccatgatcgtgttcacctgcttcttcatcgccggtttcgccaccacatggggtcccatcgtctggtccatctgctctgagatgtaccccaaccgcagccgcgccacaagcattggcattgccacttgtgccaactggacatggaacttcctgatctccttcttcaccccatttatctcaggctccatccactttgcctacggctacgtgtttgcctcctgctgtgttgttggtgtccttatcgtcttcttcttcgtcaacgagacccagggccgtaccctcgaggaagtcgacaccatgtatgtcttgcatgttgtcccctggaagagtgcttcctgggttcccgatgagagcatcgtccgtgatctccaccctggttccgatgctaacaagactgagggccttgggcaggcggagcatggtgaggagagcaggccggagcctgtggagattcgggagtga

SEQ ID NO: 11777 - protein, 562 aa, Aspergillus nidulans FGSC A4
MGVDIKGLFKPKAEQQEHSQATTPSRTDSIAEKDNGIIDDSPVKYLTWRSFILGIVVSMGGFIFGYSTGQISGFTTMADFKKRFAERQANGEYVFSNVRNGLIVGLLCIGTMIGALVAAPIADRIGRKLSMSFWSIIHIVGIIIQIATDSNWVQIAMGRWVAGLGVGALSSVVPMYQSEAAPRQVRGAMISAFQLFVAFGIFISYIINYGTESIQSTASWRITMGIGFAWPLILGLGALFLPESPRYAYRLGRIDEARKVMAKLYGVEVNHRVVVQEMKDMKDKLEEERAAGVAPWHEVVTGPRMLYRTLLGIALQSLQQLSGANFIFYYGNSIFTSTGLNNSYVTQIILGAVNFGMTLPGLYIVEHFGRRASLMVGGAWMAICFYIWASVGNSVLDLDNPQNTPKAGAAMIVFTCFFIAGFATTWGPIVWSICSEMYPNRSRATSIGIATCANWTWNFLISFFTPFISGSIHFAYGYVFASCCVVGVLIVFFFVNETQGRTLEEVDTMYVLHVVPWKSASWVPDESIVRDLHPGSDANKTEGLGQAEHGEESRPEPVEIRE

SEQ ID NO: 11778 - DNA, 1605 bp, Aspergillus nidulans FGSC A4
  CDS (1)..(1605)
atggcggacggtgtcgttgcgggtacccgggttgaggcccccgtcacctggaagacctacctcatgtgcgcgtttgccgcctttggtggtatcttttttggttatgattctggttatatcaacggtgttatggcaatggactacttcattcacgagttttcaggaaaggtcaaagccgagtatgaagccgccgataacctgagcggctatgtgatctcctcctccaacaagtcccttatcacctcgattctctctgcgggtaccttcttcggtgccatcattgccggtgacctggccgattggttcggccgtcgaacaacgatcatcagcggatgtggaatcttcatggttggtgtcgccctgcagactgcctccaccactgttgccttgctggttgtcggccgtttgattgctggattcggtgtcgggtttgtctctgccatcctgattctgtacatgtcggaaatcgcgccccgcaaggtccgtggtgccattgtttccggctaccagttctgcgtcaccgttggtctgatgctggcttcctgcgtggactacggtaccgagaaccgcaccgattccggctcgtaccgtattccaattggtctccagctgctctgggctatcatccttgctgttggtctcttcctccttcccgagtcgcctcgttactatgtgcgcaagggcgatgtgtctagcgccgccaaagtgcttgctcgcgtccgtgaccaggacgttgagtcggactatgtcaaggaggagcttgctgagatcgtcgccaacaacgagtacgaaatgagccttatccctcagggtggttactttgccacttggttcaactgcttccgcggaagtatctggtccccgaacagcaacctgcgccgtaccatcctgggcacctcgcttcagatgatgcagcagtggactggtgtcaacttcgtcttctacttcggtactaccttcttcaccaacctcggcactatttccgaccccttcctcatcagtatgatcaccaccatcgtcaacgtcttctccactccgatctctttctacacgatggagaagattggtcgtcgtcctctccttctctggggcgccctgggcatggttatctgccagttcattgtcgccattgccggtgtcgttgatggatctaacaacaagaccgtcagcgctcagatcgcatttatctgcatttacatcttcttcttcgcctccacctggggtcccggtgcctgggtcgtcatcggcgagatctacccgttgccgatccgttcccgtggtgtcgctctctccactgcctccaactggctctggaactgcatcattgctgtcatcaccccctacatggtcgacgaggacaagggcaacctcaagtccaaggtgttcttcatctggggctccctctgcgcgtgcgcttttgtctacacctacttcctgattcccgagaccaagggtcttactcttgagcaggtcgacaagatgatggaggagaccacccctcgcacttcttccaagtggaagccccacggcaccttcgcggccgagatgggtatgactgagaaggatgtgactcagactgtggaggacattgctaagaaggcgtaa

SEQ ID NO: 11779 - protein, 534 aa, Aspergillus nidulans FGSC A4
MADGVVAGTRVEAPVTWKTYLMCAFAAFGGIFFGYDSGYINGVMAMDYFIHEFSGKVKAEYEAADNLSGYVISSSNKSLITSILSAGTFFGAIIAGDLADWFGRRTTIISGCGIFMVGVALQTASTTVALLVVGRLIAGFGVGFVSAILILYMSEIAPRKVRGAIVSGYQFCVTVGLMLASCVDYGTENRTDSGSYRIPIGLQLLWAIILAVGLFLLPESPRYYVRKGDVSSAAKVLARVRDQDVESDYVKEELAEIVANNEYEMSLIPQGGYFATWFNCFRGSIWSPNSNLRRTILGTSLQMMQQWTGVNFVFYFGTTFFTNLGTISDPFLISMITTIVNVFSTPISFYTMEKIGRRPLLLWGALGMVICQFIVAIAGVVDGSNNKTVSAQIAFICIYIFFFASTWGPGAWVVIGEIYPLPIRSRGVALSTASNWLWNCIIAVITPYMVDEDKGNLKSKVFFIWGSLCACAFVYTYFLIPETKGLTLEQVDKMMEETTPRTSSKWKPHGTFAAEMGMTEKDVTQTVEDIAKKA

SEQ ID NO: 11780 - DNA, 1686 bp, Aspergillus nidulans FGSC A4
  CDS (1)..(1686)
atgagttctgtcgtagagagtccgcccaagactggcttcagcctggtgctgcagaacccctatctatgtggcgtggcttcgttctcaacgctcggtggattgctttttggctatgaccagggagtcatcagtggtgtcattaccatggagtccttcggggctcggttccctcacatcttcacagacagtggatttaaaggctggtttgtgtcaacgctcttgttggccgcatggtttggatcgcttatcaatgggccaattgccgacaggctcgggcgaaagatgtcgattaacctggcggtcgtcatcttcatagtgggatctgccatccagtgcgctgcagtcaacgtcgggatgctctttgctggcagagcggtagctggtttggctgtcggcatgctcaccatggtcgtgccgctgtatatctctgaggtatcgattcctgagatccgtggtggactcgtggttgttcaacagctctctgtcaccatcggtatcctggtcagttactggatcgactatggctccaactacatcggcggcgctcgctgcgcgccgaacgtcccctacgctggcagttcctttgatccctataccgacgtcccggcaggtggctgtacaggacagtctgaggcatcctggcgtctgccgctcgctgtacagatcgcgcccgcaatcatactcggtgctggaatgctcttctttcccgactcgcctcgatggcttttgatgaaggagcgcgatgacgaggcgctgtctgcgctctcgagactgcgacggcaggctcgcgatgctcctgttctgcgaaacgagtacctggagattcgcgcgtcgatcatgcttgagaatagtttcgcgcgcgagaactttccgaacctttctggtatcaggcttcatgctgctcagtatctttccttcctcacaacctgggcgcgcttcagacgtttagctatcggctgctgcgttatgttcttccagcagttcatgggctgcaatgccataatttactatgccccaaccatattcagccagctcggactcgatggcaacacgtcttcgctccttgcgaccggggtctacggcatcgtcaactgcctcagcactctaccagccctcttcttcatcgataaggtcggccgccgcgtgctcctgatggctggcgccactggcacttgtatctccctcgttattgtgggagcgattgtcggggcgtatggtgccagcctcgtggaccacaaggccgctggctgggctgggattgcgtttatttatatctatgacgtgaacttctcttattcctttgcgcccatcgggtgggttctcccctccgaaatctttaacctctctatccggtcaaaggccatttccatcacgacctctgcgacttggatgtgcaactttattatcgggctcgtcacaccagacatgctggactcgatctcctggggcacgtacattttcttcgcggcattttgtcttctcgcgctcgcattcacgttcttcttcattcctgagacccgtggcaagactctcgaagacatggacctcatcttcggcgacacggctgcgcatgaggagaagacgcgcatcaagcgcatcgaggcggaactgcatgggacaggtctagatgaagatgaggctcagaagcctatgaagcagcacgccgaggttgtggatgctgtttga

SEQ ID NO: 11781 - protein, 561 aa, Aspergillus nidulans FGSC A4
MSSVVESPPKTGFSLVLQNPYLCGVASFSTLGGLLFGYDQGVISGVITMESFGARFPHIFTDSGFKGWFVSTLLLAAWFGSLINGPIADRLGRKMSINLAVVIFIVGSAIQCAAVNVGMLFAGRAVAGLAVGMLTMVVPLYISEVSIPEIRGGLVVVQQLSVTIGILVSYWIDYGSNYIGGARCAPNVPYAGSSFDPYTDVPAGGCTGQSEASWRLPLAVQIAPAIILGAGMLFFPDSPRWLLMKERDDEALSALSRLRRQARDAPVLRNEYLEIRASIMLENSFARENFPNLSGIRLHAAQYLSFLTTWARFRRLAIGCCVMFFQQFMGCNAIIYYAPTIFSQLGLDGNTSSLLATGVYGIVNCLSTLPALFFIDKVGRRVLLMAGATGTCISLVIVGAIVGAYGASLVDHKAAGWAGIAFIYIYDVNFSYSFAPIGWVLPSEIFNLSIRSKAISITTSATWMCNFIIGLVTPDMLDSISWGTYIFFAAFCLLALAFTFFFIPETRGKTLEDMDLIFGDTAAHEEKTRIKRIEAELHGTGLDEDEAQKPMKQHAEVVDAV

SEQ ID NO: 11782 - DNA, 1584 bp, Aspergillus nidulans FGSC A4
  CDS (1)..(1584)
atggcagacgcggtgattgctggtcagcgcgtggaggccccggtcacatggaaggcgtaccttatgtgcgtgttcgcggcctttggtggtatattcttcggctacgactctggctatattaatggagttatgggcatggattatttcatccaagaatttacaggaaaggtcaaaagcgaaactcccgccgcgcagtttgtgatttcatcgtcgaataaatcccttatcacctctatcctgtctgcggggacgttctttggcgctattattgccggtgacctggcagactggtacggccgtcgcatcacgattatcaatggctgcggagtctttatggctggtgtggcttttcagattgcctctaccaccgtgcccatgcttgtcgtcggccgattgatcgcaggcgttggtgtcggttttgtctctgcgatcatcattctgtacatgtctgagatttctcctcgaaggttccgtggtgctatcgtatcgggctatcagttttgcatcaccattggtttgatgctggcctcctgcgtgaactatgggacggagaaccggaatgattcgggctcataccgtatcccgattgccctccaactcctctgggcgatcattcttgggataggtctgttcgtccttccagagtctccccgttattatgttcggaaaaacaatctggctgaagcagccaaaaccctcgctcgcgtgcgaggccagcccccggagtcagagtatatcacgcaagagctggcagaaatcgtggccaacaatgaatacgagatgcaggttattccccagggcggctattttgctacgtggttgaactgcttccgtggaggtctccggtctcctaacagcaaccttcgtcgtgttatccttgggacctctcttcagatgatgcaacaatggactggagtgaacttcgtcttctattttggtactacgtttttccagaacctcggtaccattgacgaccctttcctcatcagcatgatcaccacgattgtcaatgtcttttctactccgatctccttttacacgatggagaagctcggtcgtcgccctctactgctttggggcgctctgggcatggtcgtctgccaatttattgtggcgatcgctggaaccgtggatggagacaacagtaaaaccgtctcggcgcaaatctcgtttatctgcatttatatctttttctttgcttccacttggggccctggcgcttgggtcgttattggcgagattttcccgctgcccattcgttctcgtggcgttgcgctatcaacagcctccaactggctttggaactgcattattgcagttatcacaccgtacatggttgatatcgacaaggggaacctcaagtcccgagtgttctttatctggggatccctgtgtgcctgcgcatttgtctatgtctacttcctgattcccgagacaaaaggcctcaccctcgaacaagtcgacaagatgatggaggagactactcctcgcacatctgccaaatggaagcctcactctacctttgcgaccgagatgggtatgactgagaaaaatgcgagtacaaccgtggaaagcgctgcctaa

SEQ ID NO: 11783 - protein, 527 aa, Aspergillus nidulans FGSC A4
MADAVIAGQRVEAPVTWKAYLMCVFAAFGGIFFGYDSGYINGVMGMDYFIQEFTGKVKSETPAAQFVISSSNKSLITSILSAGTFFGAIIAGDLADWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 11784 - DNA, 1596 bp, Aspergillus nidulans FGSC A4
  CDS (1)..(1596)
atgggcttcgtctttgccaacatctacgtgatcacgaccattgcggtcattggtggtgccctgtttggtttcgacattgcgtctatgtctgccattctgggcactcaacagtacaaatgtttcttcaaccagggcggcatcggtgaagacgggaagtgtgccggaccgacctccagcaaccagggaggcatctctgcctcgatgcccggaggatcctttgccggagctctgtgttctggtatcctcaccgactggcttggccgtcgacgagcaatccaggtgggcgctgtgatctggtgcatcggcagtgcgattacctgctcctcgttcagtatcgggcagcttgttgtcggccggttcatcaacggggtatccgtcggcatctgcagcgcgcaggtgcctgtgtacgtctccgaactggcgcagcctagcaagcgtggaactgttgtcggtgcccaacagtgggccattacttgggggatcatgatcatgttctacatctcctacggcagcagctacatggagggccccgccgcatggagactgccatggggcctgcagatgattcccgccgtcttcctcttcttcgctctgttcttcatgcccgagagccccagatggttggccaagaaggaccggtgggaggagtgccacgagaccctcgcgctcgtccacgccaaggggaatcacaacgaccctttcgtccggacggagctgcgcgagatccgcgagatgtgtgagtttgaacgcgccaatgcagatgccagctacctggatctgtttaagcccaatatgatcaaccgcacacatatcgggatgtttacccagatctggtctcaactgacgggcatgaacgtaatgatgctgtacatcacgtacgtctttggtatggccggcctttccggcaacgccaaccttgttgcctcgtcgattcagtacgtgattaacgtggtaatgaccatttttgccctggtcttcatcgaccgctggggtcgccgcatcccgctgctgatcggatccaccctgatgatgaccttcatgttcgcaaacgccggcatcatggcttcatacggcaagccagcgcccccgggcggagtcgacaacgtccctgaagagtcctgggacatgtcagaggccaagtccgcagccaagggggtcattgcatgcacctacctcttcgtcgcatcgttcgcgcctacgtggggtcctgtcagctggatctatccccccgagctgttccccttgcgccttcgcggtaaagccgtagccgtgacgaccgcctcaaactggatcttcaattttgcgctttcttactttgtgcctcctgcattcgagaacattaaatggaaagtgtacattgtattcggtgtcttctgcgccgctatgacactgcacgtcttcttcctctttcctgagacggccggcaagacccttgaggatgttgatgcgatgttccatacgaatgtcaagccatggcagaccagggtgcagtatcgcgatatcaagaatgtagagcgaggcggtgttggggctcggatgctcgagaaggagaacgccgttggggtggagagggaggagagggaggttgctgcttga

SEQ ID NO: 11785 - protein, 531 aa, Aspergillus nidulans FGSC A4
MGFVFANIYVITTIAVIGGALFGFDIASMSAILGTQQYKCFFNQGGIGEDGKCAGPTSSNQGGISASMPGGSFAGALCSGILTDWLGRRRAIQVGAVIWCIGSAITCSSFSIGQLVVGRFINGVSVGICSAQVPVYVSELAQPSKRGTVVGAQQWAITWGIMIMFYISYGSSYMEGPAAWRLPWGLQMIPAVFLFFALFFMPESPRWLAKKDRWEECHETLALVHAKGNHNDPFVRTELREIREMCEFERANADASYLDLFKPNMINRTHIGMFTQIWSQLTGMNVMMLYITYVFGMAGLSGNANLVASSIQYVINVVMTIFALVFIDRWGRRIPLLIGSTLMMTFMFANAGIMASYGKPAPPGGVDNVPEESWDMSEAKSAAKGVIACTYLFVASFAPTWGPVSWIYPPELFPLRLRGKAVAVTTASNWIFNFALSYFVPPAFENIKWKVYIVFGVFCAAMTLHVFFLFPETAGKTLEDVDAMFHTNVKPWQTRVQYRDIKNVERGGVGARMLEKENAVGVEREEREVAA

SEQ ID NO: 11786 - DNA, 1779 bp, Candida albicans SC5314
  CDS (1)..(1779): transl_table=12
atgtctgacgagaaaacaactgcaacatacgagtcacataccaaacaggattctatgtcatcaacaagctcccagtctattgaacaaatatcatcaccaaccaaatcagaaccaaaaaagaaatcatggtttaaaatgaaaaacttgtttgaaaaggtggaagatagaccaactccaccacaggtttataattatagaatttatatgactgctattatggcatctgctgctgccattatcatcgggtatgatggtgggtttatcggtggtactgttgccttagattcttttaaaaacgagtttggtcttgacaagtcagctcattctagttttattatttccaatgtcatctcggttttccatgctggttgtttctttggggccttgttctcttatccattttcattctatcttggtagacgtattccattaatctttgctgcatttttaattactgctgggtctggtatcatgttggctgcaaactcaagtgtcgggttgggccccatctatgctggtagagtcatggcaggtgtggcagttgggttttccactaacttgacagtggtgtatatatcggaaattgccccgccagcaatcagaggtcaattaaccagtagttacgagattggttggagagttggtgatcttgttgggttttggatcaactatggggttgactcgcatattcctgaaggtaaaagacaatggtacataccgtttgctattcaattaattcctagtgggttgtttttacttgggagtatcttcatgaaggaatctcctagatggttaatgcaagttggtagatatgacgaagccatcaagaacttgacttggttcagacaattaccagaggacgatgaatatattgtttacgaagtcaatcaagtcaaagaatccattgaagaacaaaaacagaaaatcgggcttggaatcatggatccattttatgaagtgtttttcaacaataaactagtcttgcgtcgtttgttaatcaccatgaccatctatgttgtttgtaactttttgggtattcaatctatcaattactattctccaattcttttccaaggtttaggtgttaagggaaccaatgcttcattattttcaacgggtatgtttggtgttgtcaagtttatttgtacattcatttacattttgtttattgtcgacacagttggaagaagaaaggcatttatggcttcgtctactgtttgttccctttgtttttggtacattggtgcatacttgaaattgaacgatcctacaaaaccaggtgttctggccggtccaggaggcaaagctgccattgctatgatgtatatttggattgcttcatttatcttagcctggtcaggaggtccatttgttgttggcagtgaagtgtttgatcaaaatatcagatcttttgttcaagctataaatgccgctatgtcatgggtgccgatctttatcatgtcaagattcacaaccaacatgattcgtgccatggattatggtatttatttctttttcgctgctttggcagtggccaccatcccatttcttttcttctgcttgccagaaacaaaaggtattgccttggaagatatggatagattatttagtccagaattacctgcctggagagcacatgatattcttatgaaacgtgtgcaacacgaaactgaagaagttttccatgaaaaccacaaacacggtttatttgaagctgttgataataaaccagtttcagaaaacgttgaggacattttggtcaacaaagaggaaaaatag

SEQ ID NO: 11787 - protein, 592 aa, Candida albicans SC5314
MSDEKTTATYESHTKQDSMSSTSSQSIEQISSPTKSEPKKKSWFKMKNLFEKVEDRPTPPQVYNYRIYMTAIMASAAAIIIGYDGGFIGGTVALDSFKNEFGLDKSAHSSFIISNVISVFHAGCFFGALFSYPFSFYLGRRIPLIFAAFLITAGSGIMLAANSSVGLGPIYAGRVMAGVAVGFSTNLTVVYISEIAPPAIRGQLTSSYEIGWRVGDLVGFWINYGVDSHIPEGKRQWYIPFAIQLIPSGLFLLGSIFMKESPRWLMQVGRYDEAIKNLTWFRQLPEDDEYIVYEVNQVKESIEEQKQKIGLGIMDPFYEVFFNNKLVLRRLLITMTIYVVCNFLGIQSINYYSPILFQGLGVKGTNASLFSTGMFGVVKFICTFIYILFIVDTVGRRKAFMASSTVCSLCFWYIGAYLKLNDPTKPGVSAGPGGKAAIAMMYIWIASFILAWSGGPFVVGSEVFDQNIRSFVQAINAAMSWVPIFIMSRFTTNMIRAMDYGIYFFFAALAVATIPFLFFCLPETKGIALEDMDRLFSPELPAWRAHDILMKRVQHETEEVFHENHKHGLFEAVDNKPVSENVEDILVNKEEK

SEQ ID NO: 11788 - DNA, 1638 bp, Candida albicans SC5314
  CDS (1)..(1638): transl_table=12
atgtcgtccaagatcgaaagaatcttttctggacctgctttaaaaatcaatacttatttggacaagcttccaaaaatttacaatgttttcttcattgctagtatatccaccattgctggtatgatgtttggttttgatatttcgtcaatgtctgcctttattggtgctgaacattatatgaggtatttcaattctccaggatcggatatccaagggttcattacttcatccatggctttgggttctttctttggttctattgcctcctcatttgtttctgaaccctttggtagaagattatcattattgacttgtgctttcttctggatggtcggtgctgctattcaatcatcagttcaaaatcgtgctcaattgattattggtagaatcatttctggtattggtgttggtttcggttctgctgttgctccagtttatggtgctgaattggctccaagaaaaatcagaggtcttatcggtggtatgttccaattctttgtcaccttgggtatcatgatcatgttttacttatccttcggattgggccacattaatggtgttgcttcattcagaattgcttggggacttcaaattgtccctggtctttgtttgttcttgggttgtttctttattccagaatctcctcgttggttggctaaacaaggtcaatgggaagctgctgaagaaattgttgccaagatccaagctcatggtgatcgtgaaaaccctgatgttttgattgaaatttctgaaatcaaagatcaattattattggaggagtccagtaaacaaattggttatgctactttattcaccaaaaagtacattcaaagaaccttcactgctattttcgcccaaatttggcaacaattgactggtatgaacgttatgatgtactatatcgtttatattttccaaatggctggttattctggtaacagtaacttggttgcttcatccattcaatatgttatcaacacttgtgtcaccgttcctgcattatattttattgataaagtaggtagaagaccattattgattggtggtgccactatgatgatggctttccaattcggtcttgctggtattttgggtcaatactcaattccttggccagatagtggtaacgactcagtcaacattagaattccagaagacaataagtctgcctccaaaggtgccattgcttgttgctacttgttcgttgcttcctttgcctttacttggggggtcggtatctgggtctattgtgctgaaatctggggtgacaacagagttgctcaacgtggtaatgccatttccacttctgctaattggattttgaatttcgctattgccatgtataccccatctggtttcaagaatattagttggaaaacatatatcatttatggtgtcttctgtttcgctatggctacccatgtctactttggattcccagaaaccaagggtaaaagattggaagaaattggtcaaatgtgggaagaacgtgttcctgcttggagatcaagatcttggcaaccaaccgttcctattgcttccgatgccgaattggcaagaaagatggaagttgaacacgaagaagataaattgatgaatgaagactctaactccgaatccagagaaaatcaagcctaa

SEQ ID NO: 11789 - protein, 545 aa, Candida albicans SC5314
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPSGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 11790 - DNA, 1638 bp, Candida albicans SC5314
  CDS (1)..(1638): transl_table=12
atgtcgtccaagatcgaaagaatcttttctggacctgctttaaaaatcaatacttatttggacaagcttccaaaaatttacaatgttttcttcatcgctagtatatccaccattgctggtatgatgtttggttttgatatttcttcaatgtctgcctttattggtgctgaacattatatgaggtatttcaattccccaggatcgaatatccaagggttcattacttcatccatggctttgggttctttctttggttctattgcctcctcatttgtttctgaaccctttggtagaagattatcattattgacttgtgctttcttctggatggtcggtgctgctattcaatcatcagttcaaaatcgtgctcaattgattattggtagaatcatttctggtattggtgttggtttcggttctgctgttgctccagtttatggtgctgaattggctccaagaaaaattagaggtcttatcggtggtatgttccaattctttgtcaccttgggtatcatgatcatgttttacttatccttcggattgggccacattaatggtgttgcttcattcagaattgcttggggacttcaaattgtccctggtctttgtttgttcttgggttgtttctttattccagaatctcctcgttggttggctaaacaaggtcaatgggaagctgctgaagaaattgttgccaagatccaagctcatggtgatcgtgaaaaccctgatgttttgattgaaatttctgaaatcaaagatcaattattattggaggagtccagtaaacaaattggttatgctactttattcaccaaaaagtacattcaaagaaccttcactgctattttcgcccaaatttggcaacaattgactggtatgaacgttatgatgtactatatcgtttatattttccaaatggctggttattctggtaacagtaacttggttgcttcatccattcaatatgttatcaacacttgtgtcaccgttcctgcattatattttattgataaagtaggtagaagaccattattgattggtggtgccactatgatgatggctttccaattcggtcttgctggtattttgggtcaatactcaattccttggccagatagtggtaacgactcagtcaacattagaattccagaagacaataagtctgcctccaaaggtgccattgcttgttgctacttgttcgttgcttcctttgcctttacttggggggtcggtatttgggtctactgtgctgaaatctggggtgataacagagttgctcaacgtggtaatgccatttccacttctgctaattggattttgaatttcgctattgccatgtataccccaactggcttcaagaatattagctggaaaacatatatcatttatggtgtcttctgtttcgctatggctacccatgtctactttggattcccagaaactaagggtaaaagattggaagaaattggtcaaatgtgggaagaacgtgttcctgcttggagatcaagatcttggcaaccaaccgttcctattgcctccgatgccgaattggcaagaaagatggaagttgaacacgaagaagataaattgatgaatgaagactctaactccgaatccagagaaaatcaagcctaa

SEQ ID NO: 11791 - protein, 545 aa, Candida albicans SC5314
MSSKIERIFSGPALKINTYLDKLPKIYNVFFIASISTIAGMMFGFDISSMSAFIGAEHYMRYFNSPGSNIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 11792 - DNA, 1638 bp, Candida albicans SC5314
  CDS (1)..(1638): transl_table=12
atgtcgtccaagatcgaaagaatcttttctggacctgctttaaaaattaatgcttatttggataagcttccaaaaatttacaatgttttcttcattgctagtatatccaccattgctggtatgatgtttggttttgatatttcctccatgtctgccttcattggttctggtccatatatgaaattctttcattctccaggatcagacattcaagggtttattaccgcatctatggcattaggttcattctttggttccattgcttcttcttttgtttctgaacctttcggtagaagattatcattgttaatttgtgctttcttctggatggttggtgctgctattcaatcctcatctcaaaatcgtgctcaattaattattggtagaatcatttctggtgttggtgttggtttcggttctgctgttgctccaatttacggtgctgaattggccccaagaaaaattagaggtttcattggtggtatgttccaattctttgtcactttaggtatattgattatgttttatatctcatttggtttaggtcacattaatggtgttgcttcatttagaattgcatggggacttcaaattgtccctggtctttgtttgttcttgggttgtttctttattccagaatctcctcgttggttggctaaacaaggtcaatgggaagctgctgaagaaattgtcgccaaggttcaagctcatggtgatcgtgaaaacccagatgttttgattgaaatctctgaaatcaaagatcaattattgttagaacaatcaagcaagcatattggatacgctactttattcaccaagaaatatatttacagaactttcactgctattttcgcccaaatttggcaacaattgactggtatgaacgttatgatgtattatattgtttatattttccaaatggctggttattctggtaacagtaacttggttgcttcatccattcaatatgttattaatacttgtgttactgccccagctttatactttattgataagattggtagaagaccattattgattggtggtgctactatgatgatggctttccaattcggtcttgctggtatcttaggtaattattctgttccttggccagatagtggtaacgactcagtcaacattagaattccacttgacaacaaatctgcttctaaaggtgccattgcttgttgctacttgttcgttgcatcctttgcctttacttggggggtcggtatctgggtctattgtgctgaaatctggggtgacaacagagttgctcaacgtggtaatgccatttccacttctgctaattggattttgaatttcgctattgccatgtataccccatctggtttcaagaatattagttggaaaacatatatcatttatggtgtattctgtttggccatgggtacccatgtctactttggattcccagaaaccaagggtaaaagattggaagaaattggtcaaatgtgggaagaaaatgttcctgcttggagatcaagatcttggcaaccaaccattcctattgcctccgatgccgaattggcaagaaagatggaagttgaacatcaagaagataaattgatgaatgatgattctaactcagaatcaaaagaaaaccaagtctaa

SEQ ID NO: 11793 - protein, 545 aa, Candida albicans SC5314
MSSKIERIFSGPALKINAYLDKLPKIYNVFFIASISTIAGMMFGFDISSMSAFIGSGPYMKFFHSPGSDIQGFITASMALGSFFGSIASSFVSEPFGRRLSLLICAFFWMVGAAIQSSSQNRAQLIIGRIISGVGVGFGSAVAPIYGAELAPRKIRGFIGGMFQFFVTLGILIMFYISFGLGHINGVASFRIAWGLQIVPGLCLFLGCFFIPESPRWLAKQGQWEAAEEIVAKVQAHGDRENPDVLIEISEIKDQLLLEQSSKHIGYATLFTKKYIYRTFTAIFAQIWQQLTGMNVMMYYIVYIFQMAGYSGNSNLVASSIQYVINTCVTAPALYFIDKIGRRPLLIGGATMMMAFQFGLAGILGNYSVPWPDSGNDSVNIRIPLDNKSASKGAIACCYLFVASFAFTWGVGIWVYCAEIWGDNRVAQRGNAISTSANWILNFAIAMYTPSGFKNISWKTYIIYGVFCLAMGTHVYFGFPETKGKRLEEIGQMWEENVPAWRSRSWQPTIPIASDAELARKMEVEHQEDKLMNDDSNSESKENQV

SEQ ID NO: 11794 - DNA, 1665 bp, Candida albicans SC5314; identical to SEQ ID NO: 4610
  CDS (1)..(1665): transl_table=12

SEQ ID NO: 11795 - protein, 554 aa, Candida albicans SC5314; identical to SEQ ID NO: 4611

SEQ ID NO: 11796 - DNA, 1665 bp, Candida albicans SC5314; identical to SEQ ID NO: 4612
  CDS (1)..(1665): transl_table=12

SEQ ID NO: 11797 - protein, 554 aa, Candida albicans SC5314; identical to SEQ ID NO: 4613

SEQ ID NO: 11798 - DNA, 1641 bp, Candida albicans SC5314
  CDS (1)..(1641): transl_table=12
atgggtgggttcatagataatattttcaaaagaaccacaactgctggattaaccggtagaaaattacgtgcagcagtcactattactgccacacttgggttttcacttttcggatatgatcaaggtttaatggccggattaatttctgctgaacaattcaattgggaattccctgctactaaagataatagtgttatccaaggtgctgttactgcatcttatgaattgggatgtttctttggtgctatttttgctttacttagaggtgatgctttaggtagaaaaccaattattttctttggtgctactattattattcttggtacaattatttccgttactccatttagaccacattggccattaggtcaatttgtggttggtagagtcatcactggtattggtaatggtatgaatactgctaccattccagtgtggcaatcagaaatgtcaaaaccagaaaatagaggtaaattggtcaatttagaaggtgccgtagtggcatttggtacttttattgcttattggttagattttgggttatcttatgttgattcttcagtttcttggagattcccagttgctttccaaattttctttgccttatgggttatttttggaattattcaattgcctgaatctcctcgttggttgatttctaaagatagaaaaccagaagcttttgaagttttagctgctttaaatgatactactccagatgatgatgctattgttgctgaagctagtgttattattgacgccgttagaagaaacgctaaagtccaagctggtttcaaagatttgtttactggtggtaaaactgctcatttccaaagaatgcttattgggtcatcaacccaatttttccaacaattcactggttgtaatgctgctatttattattccactttgttgttctacgaaaccgttttccatcatactaaataccgtttatcaatgattttgggtggggtatttgctactatttatgctttagccactcttccatcattctttttaattgatactttgggtagaagaaatttgtttttaattggtgcaattggtcaagggatttcattccttatttcatttgcttgtttgattaacccaactgaacaaaatgctaaaggtgctgccgttggtatttatttgtttattgttttctttgccttcaccattttaccattaccatggatttacccaccagaaattaatccattgagaacaagaactactgcttctgccgtttccacttgtaccaattggttaaccaatttcgccgttgttatgtttactccaccatttatttctgctagtggttggggttgttatctttattttgccgttatgaatttcttgtttgttccaatcatctttttcttttatcccgaaactgctggtagatcattagaagaaattgatattatttttgctaaagcttacgttgaaaaaagacaaccatggagagttgctgctactttaccaaaattatcattacaagaagttgaagatgaatctaaaagcttgggtctttatgatgatgattttgaaaaagataatttcgaaactaaagaagatgtttctgatggtactgcttcaaacagtaatggtgtttttgaaaaaccagaaaatgtttaa

SEQ ID NO: 11799 - protein, 546 aa, Candida albicans SC5314
MGGFIDNIFKRTTTAGLTGRKLRAAVTITATLGFSLFGYDQGLMAGLISAEQFNWEFPATKDNSVIQGAVTASYELGCFFGAIFALLRGDALGRKPIIFFGATIIILGTIISVTPFRPHWPLGQFVVGRVITGIGNGMNTATIPVWQSEMSKPENRGKLVNLEGAVVAFGTFIAYWLDFGLSYVDSSVSWRFPVAFQIFFALWVIFGIIQLPESPRWLISKDRKPEAFEVLAALNDTTPDDDAIVAEASVIIDAVRRNAKVQAGFKDLFTGGKTAHFQRMLIGSSTQFFQQFTGCNAAIYYSTLLFYETVFHHTKYRLSMILGGVFATIYALATLPSFFLIDTLGRRNLFLIGAIGQGISFLISFACLINPTEQNAKGAAVGIYLFIVFFAFTILPLPWIYPPEINPLRTRTTASAVSTCTNWLTNFAVVMFTPPFISASGWGCYLYFAVMNFLFVPIIFFFYPETAGRSLEEIDIIFAKAYVEKRQPWRVAATLPKLSLQEVEDESKSLGLYDDDFEKDNFETKEDVSDGTASNSNGVFEKPENV

SEQ ID NO: 11800 - DNA, 1653 bp, Candida albicans SC5314
  CDS (1)..(1653): transl_table=12
atgtcattagataattcaacagaaaaccgtgatttggaagaaaaggaagaaattccaaagaacgaacataacgaacaaggcgaacaaaacgagaacaatgagcatatacctactttggaagataaaccattgaaggaatatattggtattagtattttgtgtttccttattgcctttggtggtttcgttttcggtttcgatactggtaccatttctggtttcattaacatgactgactttttagaaagatttggtggtactaaagctgacggtactctttacttttccaacgttagaactggtttattgattggtttgttcaatgtgggttgtgccattggtgcattattcttgtctaaagtcggtgatatgtatggtagaagagttggtatcatgactgctatgatcatttatattgttggtattattgttcaaattgcttctcaacatgcttggtatcaaatcatgattggtagaattatcactggtcttgctgttggtatgttatcagttttgtgtccattatttatctcagaggtttctcccaaacatttaagaggtacattagtttattgtttccaattgatgattaccttgggtattttcttgggttactgtaccagttacggtactaagaaatattctgactccagacaatggagaattccattgggtttatgctttgcttgggccttgtgtttgcttggtggtatggtaagaatgccagaatctccacgttaccttgtcggtaaagatagaattgacgatgctaagatttcacttgccaaaactaacaaggtttctccagaggaccctgcattataccgtgaacttcaattaatccaagctggtgttgaaagagaaagattggccggtaaggcatcttggggtgctttaatcactggtaaaccaagaatccttgaaagagttattgttggaggtatgttgcaatcattgcaacaattgactggtgataactatttcttctactacagtaccaccattttcaagtctgtcggtttaaatgattccttcgaaacatctattatccttggtgtcatcaactttgcttccacttttgttggtatttatgccattgaaagattgggtagaagactctgtttattaactggttccgttgccatgtccatttgtttcttaatttactcattgattggtactcaacatctttacattgatcaaccaggtggtccaaccagaaaaccagatggtaacgctatgattttcattactgcactttatgttttcttcttcgcttctacatgggctggtggtgtctactccattgtttctgaactttatccattaaaagtcagaagtaaggctatgggttttgctaatgcatgtaactggttgtggggtttcttgatttccttcttcacttcatttatcactgatgctatccacttctattatggttttgtgtttatgggctgtttagtgttttccattttctttgtttactttatgatttacgaaactaaaggtcttactttagaggaaattgatgaattatactctaccaaggttgttccatggaaatcagccggttgggttccaccttctgacgaagaaatggttcgtgcaaaaggctatactggtgatatccacgcagatgaagagcaagtttaa

SEQ ID NO: 11801 - protein, 550 aa, Candida albicans SC5314
MSLDNSTENRDLEEKEEIPKNEHNEQGEQNENNEHIPTLEDKPLKEYIGISILCFLIAFGGFVFGFDTGTISGFINMTDFLERFGGTKADGTLYFSNVRTGLLIGLFNVGCAIGALFLSKVGDMYGRRVGIMTAMIIYIVGIIVQIASQHAWYQIMIGRIITGLAVGMLSVLCPLFISEVSPKHLRGTLVYCFQLMITLGIFLGYCTSYGTKKYSDSRQWRIPLGLCFAWALCLLGGMVRMPESPRYLVGKDRIDDAKISLAKTNKVSPEDPALYRELQLIQAGVERERLAGKASWGALITGKPRILERVIVGGMLQSLQQLTGDNYFFYYSTTIFKSVGLNDSFETSIILGVINFASTFVGIYAIERLGRRLCLLTGSVAMSICFLIYSLIGTQHLYIDQPGGPTRKPDGNAMIFITALYVFFFASTWAGGVYSIVSELYPLKVRSKAMGFANACNWLWGFLISFFTSFITDAIHFYYGFVFMGCLVFSIFFVYFMIYETKGLTLEEIDELYSTKVVPWKSAGWVPPSDEEMVRAKGYTGDIHADEEQV

SEQ ID NO: 11802 - DNA, 1641 bp, Candida albicans SC5314
  CDS (1)..(1641): transl_table=12
atgtctcaagacaacgtctcatcaacatctacagctgaggctgtaaataatgaaatcaaagtcaaagatgaatttcgacaagaagaacaagctcatactagtttagaagataaacctgtgagtgcatacattggtatcatcattatgtgtttccttattgcctttggtggtttcgtttttggtttcgatactggtactatttccggtttcattaatatgtctgactttttagaaagattcggtggtactaaagctgacggtactctttacttttccaatgtcagaactggtttaatgattggtttgttcaacgctggttgtgccattggtgcattattcttgtctaaagtcggtgatatgtatggtagaagagttggtatcatgactgctatgattgtctatattgttggtattattgttcaaattgcttctcaacatgcttggtatcaagtcatgattggtagaattatcactggtcttgccgttggtatgttatcagttttatgtcctttgttcatttccgaggtttctccaaaacatttgagaggtactttggtgtgctgtttccaattgatgattaccttgggtatcttcttgggttattgtactacctatggtactaagagttactcagactctagacaatggagaattccattaggtttatgttttgcttgggctttatgtttggttgctggtatggttagaatgccagaatctccacgttaccttgtcggtaaagacagaattgaagatgctaaaatgtcacttgctaaaactaacaaagtttccccagaggacccagccttataccgtgaacttcaattaattcaagctggtgttgaaagagaaagattagccggtaaggcatcttggggtactttattcaatggtaaaccaagaatctttgaaagggttgttgttggtgtcatgttacaagccttacaacaattgactggtgataactatttcttctactacagtaccactattttcaagtccgttggtatgaatgattctttccaaacttctatcattattggtgttattaactttgcgtccacttttgttggtatttatgctattgaaagaatgggtagaagactctgtttgttaactggttccgttgccatgtctgtctgtttcttaatctattccttggttggtactcaacatctttatattgacaaaccaggtggtgctagtagaaaaccagatggtgatgccatgatctttatgacttcactttatgtgttcttctttgcttctacatgggctggtggtgtttactccattatttctgaactttatccattgaaagttagaagtaaggctatgggtttagctaatgcttccaattggacctggggtttcttaatttctttctttacttcatttattactgatgctatccacttctactacggtttcgtctttatgggatgtttagttttctccattttctttgtctactttatggtttacgaaactaaaggtcttaccttggaagaaattgatgaattgtactccaccaaagtccttccatggaaatcagctggttgggtgccaccttccgaagaagaaatggcaacctctacgggatatgctggtgatgccaaaccagaagaggaacacgtttaa

SEQ ID NO: 11803 - protein, 546 aa, Candida albicans SC5314
MSQDNVSSTSTAEAVNNEIKVKDEFRQEEQAHTSLEDKPVSAYIGIIIMCFLIAFGGFVFGFDTGTISGFINMSDFLERFGGTKADGTLYFSNVRTGLMIGLFNAGCAIGALFLSKVGDMYGRRVGIMTAMIVYIVGIIVQIASQHAWYQVMIGRIITGLAVGMLSVLCPLFISEVSPKHLRGTLVCCFQLMITLGIFLGYCTTYGTKSYSDSRQWRIPLGLCFAWALCLVAGMVRMPESPRYLVGKDRIEDAKMSLAKTNKVSPEDPALYRELQLIQAGVERERLAGKASWGTLFNGKPRIFERVVVGVMLQALQQLTGDNYFFYYSTTIFKSVGMNDSFQTSIIIGVINFASTFVGIYAIERMGRRLCLLTGSVAMSVCFLIYSLVGTQHLYIDKPGGASRKPDGDAMIFMTSLYVFFFASTWAGGVYSIISELYPLKVRSKAMGLANASNWTWGFLISFFTSFITDAIHFYYGFVFMGCLVFSIFFVYFMVYETKGLTLEEIDELYSTKVLPWKSAGWVPPSEEEMATSTGYAGDAKPEEEHV

SEQ ID NO: 11804 - DNA, 1623 bp, Candida albicans SC5314
  CDS (1)..(1623): transl_table=12
atgtcctcaactaattcaacagaaaaccatgctgtggaggagaagtatgaagatccacaacaacaacaacaacaaaaagatgccttggccaaaaagcctatgtctgcgtatattggtatcagtataatgtgtgttcttattgcctttggtggttttgttttcggtttcgataccggtaccatttctggttttattaatatgtctgactttttagaaagattcggtggtactagagctgacggtactctttacttttccaatgtcagaactggtttattaattggtttgttcaatgtgggttgtgccattggtgcattgtttttatctaaaatgggtgacatgtacggtagaagagtcggaattatgggagcaatggtcatttatattgttggtattattgtccaaattgcttctcaacatgcttggtatcaagttatgattggtagaatcattactggtcttgctgttggtatgttatcagttttgtgtccattatttatctcagaagtctcaccaaaacatttgagaggtactttggtgtgctgttttcaattgatgattaccttgggtattttcttgggttactgtactacttatggtactaagacctattcagactccaggcaatggagaattccattgggtttatgttttgcttgggccttgtgtttgcttggtggtatggttagaatgccagaatccccacgttaccttgttggtaatgacagaattgaagatgccaagatttcacttgccaaaactaacaaagtttccccagaggacccagccttataccgtgaacttcaattaatccaagctggtgttgaaagagaaagattggctggttcagcatcatggaaatcattgataaccggtaaaccaagaattcttgaaagagtctttgtgggtgccatgttacaatcgttgcaacaattgactggtgataactatttcttctactacagtaccaccattttcaagtctgtcggtttaaatgactctttccaaacgtccatcattattggtgtgattaactttgcgtccacttttgttggtatctacgctattgagaaattaggtagaagacattgtttgttaatcggttccgttgcgatgtccatttgtttcttaatttactcattgattggtactcaacatctttacattgacaaaccaggtggtgctagtagaaaaccagatggtgatgctatgattttcattactgcactttacgttttcttcttcgcttctacatgggctggtggtgtttattcgatcatgtcagaactttatccattgaaggttagaagtaaggccatgggtatagctagtgcttctaactggttatggggtttcttgatttctttctttacttcattcattactgatgctatccacttctattatggttttgtgtttatgggctgtttagtgttttccattttctttgtttactttatggtttatgaaactaaaggtcttactttagaggaaattgatgaattatactctactaaggttgttccatggaaatcagccggttgggtgccaccttcagaagaagaaatggcgacctctactggttatgccggtgatgccaaaccaacagaggaacacgtttaa

SEQ ID NO: 11805 - protein, 540 aa, Candida albicans SC5314
MSSTNSTENHAVEEKYEDPQQQQQQKDALAKKPMSAYIGISIMCVLIAFGGFVFGFDTGTISGFINMSDFLERFGGTRADGTLYFSNVRTGLLIGLFNVGCAIGALFLSKMGDMYGRRVGIMGAMVIYIVGIIVQIASQHAWYQVMIGRIITGLAVGMLSVLCPLFISEVSPKHLRGTLVCCFQLMITLGIFLGYCTTYGTKTYSDSRQWRIPLGLCFAWALCLLGGMVRMPESPRYLVGNDRIEDAKISLAKTNKVSPEDPALYRELQLIQAGVERERLAGSASWKSLITGKPRILERVFVGAMLQSLQQLTGDNYFFYYSTTIFKSVGLNDSFQTSIIIGVINFASTFVGIYAIEKLGRRHCLLIGSVAMSICFLIYSLIGTQHLYIDKPGGASRKPDGDAMIFITALYVFFFASTWAGGVYSIMSELYPLKVRSKAMGIASASNWLWGFLISFFTSFITDAIHFYYGFVFMGCLVFSIFFVYFMVYETKGLTLEEIDELYSTKVVPWKSAGWVPPSEEEMATSTGYAGDAKPTEEHV

SEQ ID NO: 11806 - DNA, 2247 bp, Candida albicans SC5314
  CDS (1)..(2247): transl_table=12
atgaaaaatttatctgtgtttccatttttaactcgtataatgtacgatgcttcattggaagacgagtattatcgtcaaatgagacaaaaatcatcgtcgatatcggcattcaaagtagggttggtggcagctatgggtgggtttctttatgggtatgatactggtttaatcaatgacctattagaaatggaatatgtttacactcatttccctagcaacaacaaaagtttcacttctcatgaacgatctattcttgtggcaattttatcattaggtacttttattggtgcattgattgcacctttagcatctgaccgatatggcagaaaattttctattatgatgtcatcaggactaatattcattactgggaacattctacaaattgcatcagctagtattgccctaatgtgtgtggggagatttgtatctggggtatcagtagggatcctttctgctattgttccgttatatcaagctgaagtgtcgccaaaatggctgagaggttcagtggtgtttacttatcaatggagtataactgccggacttttagtttcgagtgccgtgtgtcaaggcacaaggaaaataaataattcagaatcatatcgaatacctataggtttacagtttttatgggcccttattttattttttggaatgtcttttctaccggaatccccacgttattatgtacaacaggataatttacaactggcattggattcattatgtaaattacggaaactaccgcctgatgacgacgatctaatagaagaattggtcgatataaaagctaattatgattatgaattatcttatgggaaaacgactgttttggattgtttcaaaagtggaggtggtcgacataaacaaggtttaaggatgctaactggtattggtgtccaatttttccaacaatgttccgggataaattttattttctattatggagtcaattttttttcatcaacagggataaataattattatattatgtcattcattacctatttggtcaatgttattttcacagtaccggggatcatgatgattgatgtcgttggtagacgaccgttattgttttggggaggtgttgggatggccgtgtgtaatttcattattgccattgctggtgtcagtgttaaaaatgatgaagttaatgggattttgtgtgtttcatttgcatgtgttttcattgcattttttgctagtacttggggtggttgtacttgggccctttgttcagatatttatggtatatctattagacaaaaggcagttgctttgacagcagctacaaattggttagtcaattttatttttgcgttcatcactccatatttaattgatacaggtcaacatactgccgccattggtagtaagatttttttcatctggggtagttttaatgcttgtggtgccatatttgtctttttcaccgtttatgaaactaaagggttaaaattagaagaagtcgattacatgtatgttcattgtgataatgctagagtttccactaaatttatatctacgaaaattgattttgctcatttagatgagaattataatccaataccaatgacacaattaccagactcgacatcatctaatgaaatgtaccacgataaaggatcagatgagaattcatcgcctcaacaactaccacactaccaccagcaacaaccattgtataatggcgaagatcagaataatttaacaataattccatacgacaattccctgacaatatctagtgttaattctattgaagaaagacgagattctattccatcaactaacgggttatctttcacgtcatcgtcacaatcacatccacaatcaaactcatattctcattctaattcacattcagcaacgtatcgatccaaaagtcataattcaatgatatccaacgattatcaactgtatttagaatcaattcaacgagaatattctcaacattatcaaaactcttcggctatgataaaacaattatctcgcaatagtcgaaacaatgggtccgatcaagaggaaagacatgaaccaatacaaaaacaagaaatcattgatagtccattgaatattaatagtattaaccatatcaataatatacctactacagtgatagcaacaccattttttgctcatcctccaagtgattcagattcgagtgatgatgaagaggaagaggaagtggtggtggaacaagaaggggtaaaaataaacgacgttactactattaaataa

SEQ ID NO: 11807 - protein, 748 aa, Candida albicans SC5314
MKNLSVFPFLTRIMYDASLEDEYYRQMRQKSSSISAFKVGLVAAMGGFLYGYDTGLINDLLEMEYVYTHFPSNNKSFTSHERSILVAILSLGTFIGALIAPLASDRYGRKFSIMMSSGLIFITGNILQIASASIALMCVGRFVSGVSVGILSAIVPLYQAEVSPKWSRGSVVFTYQWSITAGLLVSSAVCQGTRKINNSESYRIPIGLQFLWALILFFGMSFLPESPRYYVQQDNLQSALDSLCKLRKLPPDDDDLIEELVDIKANYDYELSYGKTTVLDCFKSGGGRHKQGLRMLTGIGVQFFQQCSGINFIFYYGVNFFSSTGINNYYIMSFITYLVNVIFTVPGIMMIDVVGRRPLLFWGGVGMAVCNFIIAIAGVSVKNDEVNGILCVSFACVFIAFFASTWGGCTWALCSDIYGISIRQKAVALTAATNWLVNFIFAFITPYLIDTGQHTAAIGSKIFFIWGSFNACGAIFVFFTVYETKGLKLEEVDYMYVHCDNARVSTKFISTKIDFAHLDENYNPIPMTQLPDSTSSNEMYHDKGSDENSSPQQLPHYHQQQPLYNGEDQNNLTIIPYDNSSTISSVNSIEERRDSIPSTNGLSFTSSSQSHPQSNSYSHSNSHSATYRSKSHNSMISNDYQSYLESIQREYSQHYQNSSAMIKQLSRNSRNNGSDQEERHEPIQKQEIIDSPLNINSINHINNIPTTVIATPFFAHPPSDSDSSDDEEEEEVVVEQEGVKINDVTTIK

SEQ ID NO: 11808 - DNA, 1737 bp, Ustilago maydis 521
  CDS (1)..(1737)
atggctggagcagtgccagcagcttctccaggcggtgtcaccgtcggagagaccaagctctggtctcaagctaatgtccgcccgatcttcttctgtgccctcgccgtcatcggtgccatcctgtacggttacgatggtacctatttcaccggtattctcgagatggaccgcttcaagcgcgatttcggtgtcatcaacccagataatggccagtacgagattccttccaacgaccagtcgctctacgcttccatcgtacaagccggtgaagtggttggctccctcctcgctgctcccctgggtgactacgtcggtcgacgaggtggtttctttggtgcttgtactcttgttgcccttggcgttgtcctgcaactcgtcacggttggttccaaggcactcctcacgctcggtcgaggtgtgctgggtgccggtgtcggtgtcatctccaactgcacccccctctacctctccgaaattgctcccactgccatccgcggtgccatcgtctcgtcttggcagctcatgctcgccattggccaagtcatcggcgcctgcatcgctcagggaaccaaggacattgactcgacgtggtcgtaccgcatcccgatcattttcaatctcttttttgtagctgttcttgtcgcggctcagttcatcattcccgagtcgccacgatggctcatccagaagaaccgcgacgaaaaggcgctcgccgccctcaagcgtgtcaacaagggacagaaagacgatgtgcgcgacaaggtcattgctctcgagtacaatgcttttcggcaggcccgcgccgacgagctcgagctttccggtgaaggcggctggaaatcacttatgcacggcgtcgagctgcgcaagtttgcctgcgttctgggtattctgattggccagcagattggaggtgtacaatttatcttttcgtacactgtcacctttatgacggccgtcggactcaaggacgctttcattatcacgatcattgtcgatgtcattgaggtggtcggtgtcctgtgctcgttccttctggtcaaccgctttggccgccgaccgttgatcctatggacctcggtgcccatgtttatctctctctttgtcgtggctggtatcggcaccaagggtcttcctccgcgcggcgagtcgcttccttggccaggcgtcatcagcgtcaccgagggtcgcaccatcgctgctatgatctgcatctatgtgtttttcttcaacctggcttggggacctctggcttgggtcgtcgcttccgagctggctgtcggcaagaaccgcagcaagatcatgtcggttggcacggcttgcttctggatcattgcatgggctgtcaccttcacgttgccttacctcttctacaacgccggacttggtgctcagattggttggatctacggtgtcggtacgctgattgctatgacatttgtctacttttacattcccgagacgtttggtcgctcgctcgaagagatcaacgagatgctcgaggcgcgcgtcccaacgcgcaagtggaccacctacatgacgcagcaggaacgtgtgctcgtcgaccagagccgacatttggacgacgactcggcgctcggcaccaagccaagtaatgtttcattgactgcgtcgaatgcggatgacaagaagctcgatgctaaagatggctctggcgcaccttctcaggatcgaaacccaacgcgattggggacttctgatgtggatagtgtctag

SEQ ID NO: 11809 - protein, 578 aa, Ustilago maydis 521
MAGAVPAASPGGVTVGETKLWSQANVRPIFFCALAVIGAILYGYDGTYFTGILEMDRFKRDFGVINPDNGQYEIPSNDQSLYASIVQAGEVVGSLLAAPLGDYVGRRGGFFGACTLVALGVVLQLVTVGSKALLTLGRGVLGAGVGVISNCTPLYLSEIAPTAIRGAIVSSWQLMLAIGQVIGACIAQGTKDIDSTWSYRIPIIFNLFFVAVLVAAQFIIPESPRWLIQKNRDEKALAALKRVNKGQKDDVRDKVIALEYNAFRQARADELELSGEGGWKSLMHGVELRKFACVLGILIGQQIGGVQFIFSYTVTFMTAVGLKDAFIITIIVDVIEVVGVLCSFLLVNRFGRRPLILWTSVPMFISLFVVAGIGTKGLPPRGESLPWPGVISVTEGRTIAAMICIYVFFFNLAWGPLAWVVASELAVGKNRSKIMSVGTACFWIIAWAVTFTLPYLFYNAGLGAQIGWIYGVGTLIAMTFVYFYIPETFGRSLEEINEMLEARVPTRKWTTYMTQQERVLVDQSRHLDDDSALGTKPSNVSLTASNADDKKLDAKDGSGAPSQDRNPTRLGTSDVDSV

SEQ ID NO: 11810 - DNA, 1620 bp, Ustilago maydis 521
  CDS (1)..(1620)
atggtcttccaggttcgagggacgcctattggcgccctcaccatcttcattgcagcactcgcctccatgggtggcttcctcttcggctgggacactggtcagatcagcggtttactcgagatgtccgactttcgtgctcgcttcgctaccatcgacgacccttcggccacaggcggaaagagctggaacccgtggatcgaaggcgttgtcgtctcgctgttgagtgtcggaactgctattggcgtactcatcggtgctccccttgccgacaagctgggtagaagatacgccatggtcgtcgaatgcatcgtctttgacattggcgtcatcattcaggtgacctccttctacgcttggtaccaggtcgccatcggtcgtctcgtcactggactcggagtcggcgcactctctgctgctgttcccttgtaccaatctgaaacggtaccacgacaggtacgaggtgctcttgttggaacctatcagcttttcatcacgctgggcatccttttggcctattgcaccaacattggtacccgagactactctaactcgggccagtggagagttcctatcgcccttggcatcttcttctcctcgattctcgccatcggcattctcttctgccccgaatcacctcgatggctcgccgctcagggccgcaacgaggaggcgtacaaggcatgcgctgcggttcgtggtgccaagtacggcgacggaaatccatgggtggaagctgaataccgcgagatcgtctccatggtcaaggcagacgagaagctagaggaggctggctggctggactgcttcaagccgcagcacaagactctctatcgaacgcttctcggaatggcactccaagccggtcagcagtttaccggtgccaactacttcttctacttcggaaccgcgatcttccgaagcgctggtcttgatgattcgttcgtcacacagatcattctgggtgctgtcaactttgtatgcactttcctcggtctctacgtactcgagcgtttcggccgtaggtggcctctcatctacggtgcggcttggcagtcgttctggctctttgtatttgctattgctggtgtagtaggcggcccacagcccgagcagatctcgtcgggtatcggaaagctgctgattgtggctgcttgcttcttcattctcggttacgcttccacctgggctcccggtatctggatttggatcggcgagagcttcagttaccgcacacgtgccaagcaagcttcattggcgaccctcagcaactggatcagcaatttcctcatctcgtacttcagttcgcccatcgccaacgatatcaactttgcctacggctttgtgttcgctggctgtaatttggccaactgtctaatcgcctttttctttgtttacgagtcggctgacctgacgcttgaggacgtagacgccatgtacaacgaccccaactgtaagccttggaactcaaccaagtgggtgcctgctggctacacttcgcgagaccagatcaaggagaaggattcgggtcaggcaagcgaggtgggcgagtggagcaactctccttcggcgctacctgacgagcaggagaagaacaagtccaatcctcttcaagtggcgtga

SEQ ID NO: 11811 - protein, 539 aa, Ustilago maydis 521
MVFQVRGTPIGALTIFIAALASMGGFLFGWDTGQISGLLEMSDFRARFATIDDPSATGGKSWNPWIEGVVVSLLSVGTAIGVLIGAPLADKLGRRYAMVVECIVFDIGVIIQVTSFYAWYQVAIGRLVTGLGVGALSAAVPLYQSETVPRQVRGALVGTYQLFITLGILLAYCTNIGTRDYSNSGQWRVPIALGIFFSSILAIGILFCPESPRWLAAQGRNEEAYKACAAVRGAKYGDGNPWVEAEYREIVSMVKADEKLEEAGWLDCFKPQHKTLYRTLLGMALQAGQQFTGANYFFYFGTAIFRSAGLDDSFVTQIILGAVNFVCTFLGLYVLERFGRRWPLIYGAAWQSFWLFVFAIAGVVGGPQPEQISSGIGKLLIVAACFFILGYASTWAPGIWIWIGESFSYRTRAKQASLATLSNWISNFLISYFSSPIANDINFAYGFVFAGCNLANCLIAFFFVYESADLTLEDVDAMYNDPNCKPWNSTKWVPAGYTSRDQIKEKDSGQASEVGEWSNSPSALPDEQEKNKSNPLQVA

SEQ ID NO: 11812 - DNA, 1914 bp, Ustilago maydis 521
  CDS (1)..(1914)
atggcacaaacaccgtccacatcatcccacgaggacatgtacaaaaatgaaaagatcgacctcaaagtcgttcaagccgacgaggtccacgtccaccaggtccagggctacgacgcccccgaaccttccaaaatgactcgccgtgcccagatcctcgccattaccatctgtgtaggaggtctactgtttgggtttgacataggcatcatttctggctgcttcatcatggatcccttcatcaaagtctttggcgattgcggtgctcaaggctgctctataccagaagggcgtatctcgatcatcaactcgtctctctcgatcggtacttttgtcggggctctccttcaagcgcccgtttctgacttctttggtcgtaagccttcgatgatcacctgggccaccacgttcaccgtcggcgccatcattcagaccgccacgatcagctcttggcatcaatttgccgtaggccgtgccgttgccggtcttggtattggtgctctttccggtctttgccctctctacctcggcgaaaccgcgcccaagcacatccgcggcaccatggtcactttctatcagcttctcatcatctttggcatcttcatctcctacggcgtctcgtgggccacacagaacttcaagacatcaaacgccagctggaagatccccgtcggtctccagctgctttggggcgttgccatgctctctctcatgaccttgcttccagagtcgcctcgctactgcctcaaaaacggtcaagtggaccgcgctcgcgagatcatggccaagatgcgtgatgtggtgctgcagccgatcaatggccagcctcgcggagacaagtggatggaagccgagcttgcagagatgaagcagggtatcgatgaggagaacaacatctttgccggtcgcagctacctgggctcttaccttgtctgcttttccgccaagaaccagatgtggaagcgtaccatcaacggaatgatgctccagactttgcagcagcttaacggtcagaacttctactactactacctgcctcttctcagctccaccctggcgcttccgctcgaccccttccagatccagtttatcctcggttctgcttcgctcgtcgctacgctccctgcactagttgctatcgaaaagctcggccgtcgcccgcttctcctcatcggagcggcttgtgaagcggcctgtgctttcatcgtcgctttcgtaggacactacaagaccgcacccaaggacacacctgcggacctcatcactgcatcgcaacaccaagcgggcgcagtatttatctcctttgcgatcatccatctgctcttctacagctgctgttggggtccaggtccttggctgtacctctccgagtcgttcaactcacctacaagagccaaagcaatttctctcgggtcggcgagtaactggctgttcaatttcctgctcagcttcttttcaaacaaggtcgcggcgcaatacgggccgttcatcatgctcatctttggctcagtgctcgtctttgcgtttgtctgggtatacttcatggtacctgaaacaaaaggcatctcactcgaagatgtcgaggtgctgtattccgagaacgtcaagccgtggaagtcggcagcttggatggccatcactcgtgactgtcgtcgtgaactgagcctctttgggaagcaggaggtgggcagccaaaccgtcgtccgtcgtccgtcgtgcgtcttttgcgcgctgcaactctggcggctttatgacccagtcgagcccagcgacacccaaagaacaatagtgacgataaaatacgcgtgtgggtttgcatgcgtcaaagaccgatcaaacccgttcaactacgcgaccatgtgctcgctaccaacgagcgtggcactcgtgactgtgtgcagtcgtcacgcttgttag

SEQ ID NO: 11813 - protein, 637 aa, Ustilago maydis 521
MAQTPSTSSHEDMYKNEKIDLKVVQADEVHVHQVQGYDAPEPSKMTRRAQILAITICVGGLLFGFDIGIISGCFIMDPFIKVFGDCGAQGCSIPEGRISIINSSLSIGTFVGALLQAPVSDFFGRKPSMITWATTFTVGAIIQTATISSWHQFAVGRAVAGLGIGALSGLCPLYLGETAPKHIRGTMVTFYQLLIIFGIFISYGVSWATQNFKTSNASWKIPVGLQLLWGVAMLSLMTLLPESPRYCLKNGQVDRAREIMAKMRDVVLQPINGQPRGDKWMEAELAEMKQGIDEENNIFAGRSYLGSYLVCFSAKNQMWKRTINGMMLQTLQQLNGQNFYYYYLPLLSSTLALPLDPFQIQFILGSASLVATLPALVAIEKLGRRPLLLIGAACEAACAFIVAFVGHYKTAPKDTPADLITASQHQAGAVFISFAIIHLLFYSCCWGPGPWLYLSESFNSPTRAKAISLGSASNWLFNFLLSFFSNKVAAQYGPFIMLIFGSVLVFAFVWVYFMVPETKGISLEDVEVLYSENVKPWKSAAWMAITRDCRRELSLFGKQEVGSQTVVRRPSCVFCALQLWRLYDPVEPSDTQRTIVTIKYACGFACVKDRSNPFNYATMCSLPTSVALVTVCSRHAC

SEQ ID NO: 11814 - DNA, 1605 bp, Ustilago maydis 521
  CDS (1)..(1605)
atggctggaggtgctgttgccgatgtcggctacacctcgactggccctgtggcccgccccgtcaacgtgaggcagtcgcttcctgctatcctggtcgctgctgcttccgctttcggcggtgttcttttcggttatgacactggtacaatttcgggtcttctcgtcatgaagaacttcaaggagacttttggtcagcttttgcccgacggaaaggttgacctcaccaccaacgacacttcgcttgttgtctcgattctttcggctggtaccttcgtcggtgcccttgccggtgctcctctatctgacatcctcggtcgtcgatggggtatgcaggtcgctcttttcgtcttcaccatcggtgtcgtcatgcagatggccaccactaacctagacgttttcatcggtggccgtgtcgttgccggtctcggtgtcggtatcctctccactattgtacccatgtaccagtccgagactgctccccgctggatccgtggtgcggttgtttccggctaccagtgggccatcaccatcggtctcctctgcgcctcgcttgccacctacggtaccaagaaccacgataactctggcgcgtggcgtattcccgtcggtattcagctcgccttcgccatcattctttgcatcttcttcacgattctccccgaatcgccccgttggctcgtcaagaagggtaaccacgaacgtgcctccaagtcgcttgcccgcctcaactcgactgacgttgacgaccccattgtccgctccgagctctcggtcatccagaccaacctcgacattgagctgacccactcgaccggctcttacctcgactgcttcaagaccaacgatcgaaagtacttgctccgatccctcaccggtatctttatccaggccttccagcagctcaccggtatcaacttcatcttctactttggcaccaagttcttcgagaccgctctccccggctctgaccccttcatcttctcggtcatctccaacgttgtcaatgtcgtttccaccatcccaggcatgtacatgatggagcgtctcggtcgtcgtaagctcctcatctggggtgccgtctggatgtgtctctgcgagctcattgttgccgttgtcggtaccgctgtccccaaggagaacacttcgggtggtaagaccgccgtcgctttcgtctgcatctacattgccggtttcgcctccacctggggtcctgctgcctgggtcgtttgcggtgagattttccctctcgccatccgcgccaaggctctctcgctctgcactgcctccaactggctctggaactttggtatcggctacgccaccccttacctcgtcgactctggtcgcggcaaggctggtctcggtgccaaagtgttcttcatctggaccggtacctgcgcctgctgtgccgtctttgcctacttccttatctacgagacccgtctgctctcgctcgaggaggtcgacgagatgtacgctcagaccaaccccatcaagtcgaccgctgccaacgccgagatccgcgctcgtcgctccgacctcgagggtgccgttgcccccgtcaaggaagacgagctggccacccacgacgagaaaaagtactaa

SEQ ID NO: 11815 - protein, 534 aa, Ustilago maydis 521
MAGGAVADVGYTSTGPVARPVNVRQSLPAILVAAASAFGGVLFGYDTGTISGLLVMKNFKETFGQLLPDGKVDLTTNDTSLVVSILSAGTFVGALAGAPLSDILGRRWGMQVALFVFTIGVVMQMATTNLDVFIGGRVVAGLGVGILSTIVPMYQSETAPRWIRGAVVSGYQWAITIGLLCASLATYGTKNHDNSGAWRIPVGIQLAFAIILCIFFTILPESPRWLVKKGNHERASKSLARLNSTDVDDPIVRSELSVIQTNLDIELTHSTGSYLDCFKTNDRKYLLRSLTGIFIQAFQQLTGINFIFYFGTKFFETALPGSDPFIFSVISNVVNVVSTIPGMYMMERLGRRKLLIWGAVWMCLCELIVAVVGTAVPKENTSGGKTAVAFVCIYIAGFASTWGPAAWVVCGEIFPLAIRAKALSLCTASNWLWNFGIGYATPYLVDSGRGKAGLGAKVFFIWTGTCACCAVFAYFLIYETRLLSLEEVDEMYAQTNPIKSTAANAEIRARRSDLEGAVAPVKEDELATHDEKKY

SEQ ID NO: 11816 - DNA, 1653 bp, Cryptococcus neoformans var. neoformans B-3501A
  CDS (1)..(1653)
atgggcggtggtgctgctgttggtggaggctttgatgctctcctcactcaaaaccaggatcgaggctttcgaggtctcttcaagaaccgccgagcccttggtctggcttgtttcgcctctctcggtggtgtcctctatggttacaaccagggcgttttcggtcaagtccaagtcatgtacagctttaaggagcgatacaccgctactttgacaaacaccgacaccaagggtcttttgactgctattctcgaacttggtgctttcctcggtgcccttatggctggtcctttatctgacaagttttcccgaaaatactccatttccgcttggtgtatcgtctttatgatgggtactgctgttcaaactggtgccaactacaatatcgcgtgcatctacgctggtcgatggttcgcagggatgggtgttggcgctctttctatgcttgttcctatgttcaatgccgagttggcacctcctggtattcggggttctttggtcgctcttcaacaactggccattactttcggtatcatgatttcttactggatcggttacggtactaactacattggcggtactggtgctggccagagtaccgccgcttggcgagttcccctcggtatccagctcgttcctgctattgttctttgtatcggttcttgcttccttcccttctcccctcgatggctcatgcttaagggtcgtgaggaggaatgtcttacgaacttggctaagctccgaaactctaccgaggatgcccccgaaatccagtacgagttccgtgcccttcaggctgagcgtcttgttgagcgtgaggccgccaaggagcgatacggccaggaagacgtcaacttccgagtcacattggccgagtacaagaggttgttcactaccaagccccttcttcaccgactgatgcttggtgctggttgccagactttgcaacaatggactggtatgaacgccatcacctattacgctcctaccatcttcgagcagatcggtcttagtggtgccggtgctggtggtactatcagtcttttggccactggtatcattggtatcgtcaaatttgtcttcactatccctgccgtccttttcgtcgacaacttcggtcgaaagcctctccttgcctggggtgaagccaacatggccatctctcacgctatcattgccgctatagttgccgtctacggtgacaagttcgatacccacaaatcggctggtaatgccgctgttttcttcatttactggatatctgccaatttcgcctgcacctggggtcccttggcgtgggttgtatcctctgaagtcttccctctcgacatgcgtggtaagggtatgagtgtctcttccggtgccaattggattatgaacttcacggtcgccatgattacccctcacatgatcggaagcattggctataagacctacatcgtcttcatgtgcttctgtattgtcggcttctttttctccatattcatccttcccgaactcaagggtctctctctcgaagagatcgacaacgtcttcaacgacgattctggtgttgaggaccgagcacgacgagagcgtattgcagcccagattggtttggacaaggtcgccgaccagatccagcatcaggaaaaggtcgatgattctgaagtttaa

SEQ ID NO: 11817 - protein, 550 aa, Cryptococcus neoformans var. neoformans B-3501A
MGGGAAVGGGFDALLTQNQDRGFRGLFKNRRALGLACFASLGGVLYGYNQGVFGQVQVMYSFKERYTATLTNTDTKGLLTAILELGAFLGALMAGPLSDKFSRKYSISAWCIVFMMGTAVQTGANYNIACIYAGRWFAGMGVGALSMLVPMFNAELAPPGIRGSLVALQQLAITFGIMISYWIGYGTNYIGGTGAGQSTAAWRVPLGIQLVPAIVLCIGSCFLPFSPRWLMLKGREEECLTNLAKLRNSTEDAPEIQYEFRALQAERLVEREAAKERYGQEDVNFRVTLAEYKRLFTTKPLLHRLMLGAGCQTLQQWTGMNAITYYAPTIFEQIGLSGAGAGGTISLLATGIIGIVKFVFTIPAVLFVDNFGRKPLLAWGEANMAISHAIIAAIVAVYGDKFDTHKSAGNAAVFFIYWISANFACTWGPLAWVVSSEVFPLDMRGKGMSVSSGANWIMNFTVAMITPHMIGSIGYKTYIVFMCFCIVGFFFSIFILPELKGLSLEEIDNVFNDDSGVEDRARRERIAAQIGLDKVADQIQHQEKVDDSEV

SEQ ID NO: 11818 - DNA, 1638 bp, Cryptococcus neoformans var. neoformans B-3501A
  CDS (1)..(1638)
atgaagagctcgatcatcttctgcttctttgctgccttcggcggctgggtattcggttacgatattggatacatctcaggatgtctgatcatgcctaactttatccaatacatgggagaacaagatcctaccacaggggaatggattctctcctcacagcggcaaagtatcatcacctctttgctgtccgccggtactttctttggcgctctcctgcaaagttttaccagtgacagacttggtagaaggggatcgatcatcttctggtccattatcttctctgttggaatcattatccaagtatcttccttcggtcttgctcagatcactgtcggtcgattcgtagccggtctcggtgtcggtgcactctcagctatcgtcccgctttacgtgggggaagcggcccccaagaaattgcgaggtgctcttctcgtattgtaccaagtccagatcgcatccggtctcttcttggcctacatcgtcgatcttggaacacatcacctcaagtcctcagcttcatggcgtattcctgttggtcttcagctcgtttggggtgcattcctaattgtcggcggtttactcctccctgaatcaccgcgtcttctgctcggtagaggtgacgagaaaggcgccctcaaggctatcgcgaggttaaatgactgtgaagtggacgatcccttgacgagagatgttatcaaggatttggaagaagccatcagggaggagaatgagggtggaaaggctggatggttagagtgtttcagcacgaggagtatgatactatcagtgtggaagagaactctgaacggttgcatggtacaattcttgcagcaactcaacggacagaacttctactactactacggcccagtattctttgagagtgctgacgtccctctttctgcgtactctatccaagccattctcggcggtatctccctcgccacagtcatccccgccatgtggaccatcgagcaccttgggcgacgtaaatcactccttttcggcgccgctattcaagctgcctgtgccctcatcgccggcttggttggtcattactacaccgatgtggcgggtgtcaccgattccatggtcaagacgggtggtaacgttttaattgcgtttgctgtcattcatgtttccatgtacagtttgttctggggacctacaccctgggtcatcctgggcgagacttaccctctccgtgttcgaccaaaggcgattgctcttgctgctgctgttaactggctttggaatttccttctctcttacttctcgcctttgattgctgatgacatcggccctcttattctcttgatcttctttggatgtcttatcttcgctttcgtctacgtcttctttatgcttccagagactcgaggaattaccctcgaagaagtcgatgagctctaccgatccaaaatacccgcatggaagtccaatagctggaaaccttcatcccatcacgcggctctcgacgcccttgaaggcgaaagccgaaaaccagttgaggtgcctgctcaggctcctggcacgctggatgagacgaagcctgcggatgagcacttggaaaatgcgcctgcggctaaggctaggattgagggggaaagaggagcgagggaaaagagtattgtgtaa

SEQ ID NO: 11819 - protein, 545 aa, Cryptococcus neoformans var. neoformans B-3501A
MKSSIIFCFFAAFGGWVFGYDIGYISGCLIMPNFIQYMGEQDPTTGEWILSSQRQSIITSLLSAGTFFGALLQSFTSDRLGRRGSIIFWSIIFSVGIIIQVSSFGLAQITVGRFVAGLGVGALSAIVPLYVGEAAPKKLRGALLVLYQVQIASGLFLAYIVDLGTHHLKSSASWRIPVGLQLVWGAFLIVGGLLLPESPRLLLGRGDEKGALKAIARLNDCEVDDPLTRDVIKDLEEAIREENEGGKAGWLECFSTRSMILSVWKRTLNGCMVQFLQQLNGQNFYYYYGPVFFESADVPLSAYSIQAILGGISLATVIPAMWTIEHLGRRKSLLFGAAIQAACALIAGLVGHYYTDVAGVTDSMVKTGGNVLIAFAVIHVSMYSLFWGPTPWVILGETYPLRVRPKAIALAAAVNWLWNFLLSYFSPLIADDIGPLILLIFFGCLIFAFVYVFFMLPETRGITLEEVDELYRSKIPAWKSNSWKPSSHHAALDALEGESRKPVEVPAQAPGTLDETKPADEHLENAPAAKARIEGERGAREKSIV

SEQ ID NO: 11820 - DNA, 1404 bp, Cryptococcus neoformans var. neoformans B-3501A
  CDS (1)..(1404)
atgaagagctcgatcatcttctgcttctttgctgccttcggcggctgggtattcggttacgatattggatacatctcaggatgtctgatcatgcctaactttatccaatacatgggagaacaagatcctaccacaggggaatggattctctcctcacagcggcaaagtatcatcacctctttgctgtccgccggtactttctttggcgctctcctgcaaagttttaccagtgacagacttggtagaaggggatcgatcatcttctggtccattatcttctctgttggaatcattatccaagtatcttccttcggtcttgctcagatcactgtcggtcgattcgtagccggtctcggtgtcggtgcactctcagctatcgtcccgctttacgtgggggaagcggcccccaagaaattgcgaggtgctcttctcgtattgtaccaagtccagatcgcatccggtctcttcttggcctacatcgtcgatcttggaacacatcacctcaagtcctcagcttcatggcgtattcctgttggtcttcagctcgtttggggtgcattcctaattgtcggcggtttactcctccctgaatcaccgcgtcttctgctcggtagaggtgacgagaaaggcgccctcaaggctatcgcgaggttaaatgactgtgaagtggacgatcccttgacgagagatgttatcaaggatttggaagaagccatcagggaggagaatgagggtggaaaggctggatggttagagtgtttcagcacgaggagtatgatgtggaagagaactctgaacggttgcatggtacaattcttgcagcaactcaacggacagaacttctactactactacggcccagtattctttgagagtgctgacgtccctctttctgcgtactctatccaagccattctcggcggtatctccctcgccacagtcatccccgccatgtggaccatcgagcaccttgggcgacgtaaatcactccttttcggcgccgctattcaagctgcctgtgccctcatcgccggcttggttggtcattactacaccgatgtggcgggtgtcaccgattccatggtcaagacgggtggtaacgttttaattgcgtttgctgtcattcatgtttccatgtacagtttgttctggggacctacaccctgggtcatcctgggcgagacttaccctctccgtgttcgaccaaaggcgattgctcttgctgctgctgttaactggctttggaatttccttctctcttacttctcgcctttgattgctgatgacatcggccctcttattctcttgatcttctttggatgtcttatcttcgctttcgtctacgtcttctttatgcttccagaggtgagtaaccttcgggacacattcaggttcacgcgttga

SEQ ID NO: 11821 - protein, 467 aa, Cryptococcus neoformans var. neoformans B-3501A
MKSSIIFCFFAAFGGWVFGYDIGYISGCLIMPNFIQYMGEQDPTTGEWILSSQRQSIITSLLSAGTFFGALLQSFTSDRLGRRGSIIFWSIIFSVGIIIQVSSFGLAQITVGRFVAGLGVGALSAIVPLYVGEAAPKKLRGALLVLYQVQIASGLFLAYIVDLGTHHLKSSASWRIPVGLQLVWGAFLIVGGLLLPESPRLLLGRGDEKGALKAIARLNDCEVDDPLTRDVIKDLEEAIREENEGGKAGWLECFSTRSMMWKRTLNGCMVQFLQQLNGQNFYYYYGPVFFESADVPLSAYSIQAILGGISLATVIPAMWTIEHLGRRKSLLFGAAIQAACALIAGLVGHYYTDVAGVTDSMVKTGGNVLIAFAVIHVSMYSLFWGPTPWVILGETYPLRVRPKAIALAAAVNWLWNFLLSYFSPLIADDIGPLILLIFFGCLIFAFVYVFFMLPEVSNLRDTFRFTR

SEQ ID NO: 11822 - DNA, 1590 bp, Cryptococcus neoformans var. neoformans B-3501A
  CDS (1)..(1590)
atgcctcttccaaagttagctgtgatcttaggagctttcgcttctttctctggtttcttattcggttacgacacgggttacatctcaggatgtaaggagatggaaacttttgttcgaacttttggtcttctccaacctgacgggacttatgtcttgagctcgggtagagactccttgataacttcaattttatctgtcggtacttgcttgggagccttatgtggctcaatggtcggggatcgtattggcagaagattcggtattgtgttttacatctgccttttcttcatcggggtagctttgcaaaccggatgtaaaaaccttgcaggattcgctatcggtcgggtattcgcaggtctgggtgtaggaggcacatcatgtttagtaccaatctatcaagccgaatgttcacccaaagcaatccgtggcttcgtcgttgctgcttatcaattcttcgtaaccgtcggattattggtagctgcgtgtgtggtttacgctacaaagggtcgtccagacaactcagcatacgagatccccattgctatacaattcgtctggggtgctctcatcatcggtggtatgtgcatcttacccgaatcaccaagatggttacttctcaaagataaacaagaccaagcgaaaaaaaatttatccagattactgggtcaagctgagaacagtcaagctgtaatcactgagtttgccgaaatctcagccaatttggaacatgaacgatcgctcggtaaaggtacctggatggattgcttcaaatacggtgaaagtaaaactaggctgagaatcttcaccggtatggcccttcaagcgttacagcaattgactggtgtaaatttcatcttctactacggaacgacctttttctccaattcgggtatatcaaaccctttcctaactacaatcgccacaaacgtagtcaacgtaggaatgagtgttcctgggatgctcgctgctgataggatcggccgaaggcccttgatgatgtacggtgcagcaggtatggcagtatctcaacttatcgtcgctgccgtgggtgtggctgtcgacacttccaaccaagctggacaaaaagccctggtcgcttttgtctgtatctatatcgctcatttcgcttctacatggggtatcctggcttgggtcatcacgagtgagatttacccttacgagttgagaggtaaaggtatgagtttgtctactgctacccagtggttattcaactttgctattggctacgcaacaccttacctcgttgatgttgctccaggaagtgcaggtttgaaaaccaacgtcttctggatctggggtggctgctgttgtatcgctttcgtattcgcttatttcttcattcctgagacaaaagagctctccttggagcaatgtgatttgctctatcgaaactctaccgtactcaaatcagccgcctatcgaagacagatcctcgagcatgatatgcacgatgatgagattgcgcattacgactctaacaaaatgcccagaacggagcatgttgaagattcaaaagctgtggaggatgtgaaagcgcaacaaagtcaattggacgagtgggacgcgtga

SEQ ID NO: 11823 - protein, 529 aa, Cryptococcus neoformans var. neoformans B-3501A
MPLPKLAVILGAFASFSGFLFGYDTGYISGCKEMETFVRTFGLLQPDGTYVLSSGRDSLITSILSVGTCLGALCGSMVGDRIGRRFGIVFYICLFFIGVALQTGCKNLAGFAIGRVFAGLGVGGTSCLVPIYQAECSPKAIRGFVVAAYQFFVTVGLLVAACVVYATKGRPDNSAYEIPIAIQFVWGALIIGGMCILPESPRWLLLKDKQDQAKKNLSRLLGQAENSQAVITEFAEISANLEHERSLGKGTWMDCFKYGESKTRLRIFTGMALQALQQLTGVNFIFYYGTTFFSNSGISNPFLTTIATNVVNVGMSVPGMLAADRIGRRPLMMYGAAGMAVSQLIVAAVGVAVDTSNQAGQKALVAFVCIYIAHFASTWGILAWVITSEIYPYELRGKGMSLSTATQWLFNFAIGYATPYLVDVAPGSAGLKTNVFWIWGGCCCIAFVFAYFFIPETKELSLEQCDLLYRNSTVLKSAAYRRQILEHDMHDDEIAHYDSNKMPRTEHVEDSKAVEDVKAQQSQLDEWDA

SEQ ID NO: 11824 - DNA, 1653 bp, Cryptococcus neoformans var. neoformans B-3501A
  CDS (1)..(1653)
atgggtggtggtgctcctgccggcggtgactttgaggctctcctcactcaacgtcagaacgaaggctggcgaggtcttttcaagaacggccgagctctcggtttggcatgtttcgcttctcttggtggtgtcctctatggctacaaccagggtgttttcggtcaagtccaagtcatgtacaattttgagcagcgatacactgctactttgacaaaccccgacaccaaaggtctcttgacttctattcttgaacttgctgcttttgtcggtgccctcatggccggtcctttgtctgacagatattcccgaaagtactccatttccgcttggtgtgtcgtcttcatgatgggtactgccattcaaaccggtgccaactccaacgtcgcgtgcatttacgctggtcgatggtttgccggtatgggtgtcggtgctctttctatgcttgttcctatgttcaacgccgagttggctcctcccggtatccgaggttctttggtcgctcttcaacaactggccattacattcggtatcctcatttcttactggattggctacggtaccaactatattggcggtacaggtgccggtcagactaccgccgcttggcgaattccccttggtctccagcttatccctggtgtggttctttgtgtcggtgcttgcttccttcccttctccccccgatggctcatgcttaggggtcgtgaggaggaatgccttaccaacttggctaggctccgaagctctaccgaggaagcccccgaaatccaatacgagttccgtgctcttcaggctgagcgtcttgtcgagcgtgaggccgccaaggagcgatatggtcaggaggacgtcaacttccgagtcaccatgcttgagtacaagaggttgttcaccaccaggccccttcttcaccgactcatgcttggtgctggcgcccaggctttgcaacaatggacgggtatcaacgccattatctattacgctcccaccatctttgcgcagataggtcttactggtagcggtgctagtggtactatcagtcttttggccacaggtatcgtcggcgtcgtcaatttcgtcttcactattcctgccgtccttttcgtcgataactttggtcgaaggcctctccttgcctggggcgaagccaacatggccatttctcacgctattattgccgctatcgttgccgaattcggtgacaggtttgatagcaacaagaaggctggtaacgccgctgttttcttcatctattggtacattgccaacttcgctgtcacctggggtcccttggcttgggttgtttccgctgaagtcttccctctcgacatgcgtgctaagggtatgagtatttcttccggtgtgaactggcttatgaacttcactgtcgctatggttacccctcacatgatcgataacattggctacaagacctacatcgtctttatgtgcttctgtgtcgttggcttcctgtattccatcttcatccttccagaacttaagggtctctctctcgaagaggtcgacagggtcttccacgacgagtccggtgccgaggaccgagcacgacgagagcgtgttgctgcccagatcggtttggacaaggttgccgagcagattcagcacaaggagaaggtcaacgattccgaagcttaa

SEQ ID NO: 11825 - protein, 550 aa, Cryptococcus neoformans var. neoformans B-3501A
MGGGAPAGGDFEALLTQRQNEGWRGLFKNGRALGLACFASLGGVLYGYNQGVFGQVQVMYNFEQRYTATLTNPDTKGLLTSILELAAFVGALMAGPLSDRYSRKYSISAWCVVFMMGTAIQTGANSNVACIYAGRWFAGMGVGALSMLVPMFNAELAPPGIRGSLVALQQLAITFGILISYWIGYGTNYIGGTGAGQTTAAWRIPLGLQLIPGVVLCVGACFLPFSPRWLMLRGREEECLTNLARLRSSTEEAPEIQYEFRALQAERLVEREAAKERYGQEDVNFRVTMLEYKRLFTTRPLLHRLMLGAGAQALQQWTGINAIIYYAPTIFAQIGLTGSGASGTISLLATGIVGVVNFVFTIPAVLFVDNFGRRPLLAWGEANMAISHAIIAAIVAEFGDRFDSNKKAGNAAVFFIYWYIANFAVTWGPLAWVVSAEVFPLDMRAKGMSISSGVNWLMNFTVAMVTPHMIDNIGYKTYIVFMCFCVVGFLYSIFILPELKGLSLEEVDRVFHDESGAEDRARRERVAAQIGLDKVAEQIQHKEKVNDSEA

SEQ ID NO: 11826 - DNA, 1638 bp, Cryptococcus neoformans var. neoformans B-3501A
  CDS (1)..(1638)
atggtcggttttggatctaagcgccttcgccaggaagcaatggaggcctccatggttcccacatctgattcggagcgacgaccatggcatgcccactctcgagcgtatctgctggctagtgtaggcttcctaggtatcttccttttcggttacgacactggtcttggtggaggcgtcatcgctctttcttcttttgccacatcttttaacatcactggaaccagtgacgaaattgcggatttgcagggtaacattgttgctatcctacaaggcggagccttcttcggtgccattattgccgcttgggtcaacgactggttgggtcgaaagtactctcttatggttggatgctggatcttcatcatcggtgcctgcttccaaactgcggccagctctcagctgtcatgggtatacggaggacgattcacttcaggtttcggagtaggtctcatgtcagctgtttgccctacctatgccagtgagattgcgcctaaggaaattcgtggccgaatcactggtatgttccaggttattgtcgtcatcggcgttgccttctcctactggattaattatggtgtaaccttcatggaccaaaaccgagggaacattgtgtggcgaatccccatcggcttccagctcgtccctgttggtatcatggtcatgctcttgcctctcctcaaagaatcccctcgatggctcgcaaccaagcacaaggacgaaagagcacttgccaacctcgcttggattaggaagcttcccgtcaccgaccagtctgttcagcttgaatatgctgaaatcgccgctgctatcagggaggaggaggaggctaccaagggcgcctcttggagggaagtttttgccaagggtaaccccatccgattcatcatcgctttcgttgtcttcacccttcagcaatggagtggtcagaactctatttcttactatgctcccattattttccagtctatcggtatcagaggtagcaagtctggattgctcgccagtggtatctacggtatcgtcaagattattgccaccggtactttcatcgccttcggtattgagagattcggcaggaagaagcctttgctcttgggtgtcagccttatgtccttgttcctttggatcatcggtgccatcttcaacacccaccttcctgacaaaaacgccactactacttccgctgcttccatcgctatggctgtcatgatttaccttttcgtcatcccttactgcttctctgttggtcctcttccatgggttatctgttctgagatcttcaacaaccgcacacgtcattatggtctcatgactgccgccgccacccaatggctctggaactttgctgttaccaaggctacccctctcatggtcattcacatgcctaagggtgggatcttcttctttttcgctgctatcaatataatttcgttctgtctcgccatgttccttcccgagacatcaggtgtctctttggagtctatggatgtcatctttggttccgtcaccaaggaggaacgagaggccgagattgcgagacgagcagtcgagctcgaaggccgaacactcgacgaggaggagaagcatggagctgagcacctggagcactttgacgaaaaggaaaaggaaagggtttaa

SEQ ID NO: 11827 - protein, 545 aa, Cryptococcus neoformans var. neoformans B-3501A
MVGFGSKRLRQEAMEASMVPTSDSERRPWHAHSRAYLLASVGFLGIFLFGYDTGLGGGVIALSSFATSFNITGTSDEIADLQGNIVAILQGGAFFGAIIAAWVNDWLGRKYSLMVGCWIFIIGACFQTAASSQLSWVYGGRFTSGFGVGLMSAVCPTYASEIAPKEIRGRITGMFQVIVVIGVAFSYWINYGVTFMDQNRGNIVWRIPIGFQLVPVGIMVMLLPLLKESPRWLATKHKDERALANLAWIRKLPVTDQSVQLEYAEIAAAIREEEEATKGASWREVFAKGNPIRFIIAFVVFTLQQWSGQNSISYYAPIIFQSIGIRGSKSGLLASGIYGIVKIIATGTFIAFGIERFGRKKPLLLGVSLMSLFLWIIGAIFNTHLPDKNATTTSAASIAMAVMIYLFVIPYCFSVGPLPWVICSEIFNNRTRHYGLMTAAATQWLWNFAVTKATPLMVIHMPKGGIFFFFAAINIISFCLAMFLPETSGVSLESMDVIFGSVTKEEREAEIARRAVELEGRTLDEEEKHGAEHLEHFDEKEKERV

SEQ ID NO: 11828 - DNA, 1563 bp, Cryptococcus neoformans var. neoformans B-3501A
  CDS (1)..(1563)
atggctcccaggagttccaagaaggctttgaccctctgtcttttccagagtttggcgggtgttattttcggatggagtaactctgaaggttctggtctgttctccatgtcaaagtaccaagaacgattcggtgaatgtatcgacggcgtttgcaccctttcaactactcgacaatctgccattaccggtcttttgtctgtcggcgccgtcattggtgctgttggttctggttctatcgctgaccgattcggtttgcgattgacctgtatggttttcatcttcatctacctttgtggtgctgccatcgagacttctgcctttaacacctatggtcaactatgcgtggctcgtcttctcaccggtctcggtgtcggtgctacttctggtcttgttcccgttttccaggctgaggcttctcctcctcgataccgaggtctcgtcactggttctttccagctttgtgttactcttggtatctggggtgttgccatgaccaactggggtatgagctcttatgccggtgatgtctcatggcgaatccccgtatctcttcaaatggtctgggctgctttgttgctcgtcggtttcctcttttcccctgagtctcctcgattccttgccaagaagggcagatgggaccactgccgaaagaaccttgccaatctccgtggtcttcctactgatcaccctgacatcgataccgagatggaagaagtccgtgaggctaccatcaaagaccaggagcgcggtcaggccagctatgtcgaatgtttctctaccaaggaccgaattctctggcgaactatgatcggtatctgtgtccaaattggccagcaaatcaccggtatcaacttcttcttctcttacggtgtccagttcgcccagactgccggtcttgacgacacctacgtcttccagatcattctcgcttccgtcaacgtcgttttctctttccccggtattcttgctgtcgaccgagcgggtcgacgacctatcctcctcattggtggcattctcatgtttattggtcagattgttgtcggtgctgtctccaaggcctaccctgatgacaagattgccggtgatgttctcattgccttcacctgtcttttcattgcctctttcgcgtcttcttggggtcccattgcctgggttgtctgcggtgagactttccccattaggttgtcttctaggtgtgtcaccctcggtaccggtgccaactggctcttcaacctcatcatcgcctttgccgctcctcagattcaggcccgaatcggtactggtatcacttttgtttgggccggttgtctcgctctcgctatctcttttgccttcttctgcattcccgagacgagatcgatgagtatcgaggcgattgacgccctctatctctcccacaccccagcttggcgatctcataagtttgtcgacgagcagctcacgaggactcaaaacgcgcaagagaagcactactctcgatctatccacgccgagaacgagcaggtcaagtctagccagcagactagcgcccgaacgagtgctgaggacggcaggatggtctaa

SEQ ID NO: 11829 - protein, 520 aa, Cryptococcus neoformans var. neoformans B-3501A
MAPRSSKKALTLCLFQSLAGVIFGWSNSEGSGLFSMSKYQERFGECIDGVCTLSTTRQSAITGLLSVGAVIGAVGSGSIADRFGLRLTCMVFIFIYLCGAAIETSAFNTYGQLCVARLLTGLGVGATSGLVPVFQAEASPPRYRGLVTGSFQLCVTLGIWGVAMTNWGMSSYAGDVSWRIPVSLQMVWAALLLVGFLFSPESPRFLAKKGRWDHCRKNLANLRGLPTDHPDIDTEMEEVREATIKDQERGQASYVECFSTKDRILWRTMIGICVQIGQQITGINFFFSYGVQFAQTAGLDDTYVFQIILASVNVVFSFPGILAVDRAGRRPILLIGGILMFIGQIVVGAVSKAYPDDKIAGDVLIAFTCLFIASFASSWGPIAWVVCGETFPIRLSSRCVTLGTGANWLFNLIIAFAAPQIQARIGTGITFVWAGCLALAISFAFFCIPETRSMSIEAIDALYLSHTPAWRSHKFVDEQLTRTQNAQEKHYSRSIHAENEQVKSSQQTSARTSAEDGRMV

SEQ ID NO: 11830 - DNA, 1668 bp, Cryptococcus neoformans var. neoformans B-3501A
  CDS (1)..(1668)
atgatatcagtgcctggtggtcctggcgtcctctcggcgcctctcagccccgagcgggtggaggctcctgtgactgttaaggcttatctcctttgtgtctttgcctctttcggtggtatctttttcggcttcgattctggttacatgaacggcgtgttgggtatgaattacttcatcaacatgatgacgggtcttcctattcctggcgccgatgcggatcaggcgaccaaagatgccttcactctgccagcttgggagaagtctttgatcacttccattctttctgccggaacgttctttggtgcgatcatcgctggtgaccttgccgactacttcggtcgaaggattactatcgtttctggttgttgtgtatttatcgttggttgctgtctgcagactgcttcaactggcctcggcttgctggtggccggtcgtctcatcgctgggtttggtgtcggtttcatttcagcgatcatcattctctacatgtcggagatcgctcctcgaaaggttcgaggtgctattgtctcgggttaccagttttgcatcactattggtcttcttctttcctcttgtgtatgttacgcaactcagaaccggaccgatagcgggtcataccgtatccccatcgccattcagtttgcctgggctcttatcctcggtggtggtctccttttgcttccagagtctcctcgttggtatgtcaaggccggcaagatcgaacaggcaagaaaggcactgtctcgagtccgaggtcaacctgtggactctgattacatcaaggatgaaatcgccgaaattgtggccaatcacgagtacgagactgagcttactcccaatgtgacttacctctcctcttgggctgcctgtttcactggtggtattcgcaaccctggttctaaccttcgtcgaacccttctcggtatttccatgcaaatgatgcagcaatggactggtgtcaacttcatcttctactttggaaccaccttcttcaccgaccttgggactatctcgaaccccttcttgatttctctcatcactactttagtcaacgtctgctccacacctgtgtccttctggactatcgagcgatttggtcgacgaccccttcttatctatggtgccctcggtatgcttatctgcgagttcattgtcggtatcatcggtgtcgccaagcctggagacactacagtcgttaaggtgcagatctccttcatttgcatttacgtcttcttcttcgcgtcaacttggggtccaggcgcttgggtttctattggtgaaattttcccattgcctatcagagcgcgaggtgttggtctctccaccgcctctaactggctatggaactgtattatcgccgtcattactccttatcttgttggaactgacgaggctaacctcggttcaaaagtctttttcctttggggttcaacctgtattctctgctttatctacgcctatctctttgtatgggagaccaagggcctcactctggaacaggttgataggatgatggaagaatgcgggagccccagacgctcagcgggttggaaaccccataccacgtttgcagctgaagctgcccagggtacacatgggcttgaccagaatgagaaagcgaaagttggacctgtgttatcacagtcagagatgttggagcaagtttaa

SEQ ID NO: 11831 - protein, 555 aa, Cryptococcus neoformans var. neoformans B-3501A
MISVPGGPGVLSAPLSPERVEAPVTVKAYLLCVFASFGGIFFGFDSGYMNGVLGMNYFINMMTGLPIPGADADQATKDAFTLPAWEKSLITSILSAGTFFGAIIAGDLADYFGRRITIVSGCCVFIVGCCLQTASTGLGLLVAGRLIAGFGVGFISAIIILYMSEIAPRKVRGAIVSGYQFCITIGLLLSSCVCYATQNRTDSGSYRIPIAIQFAWALILGGGLLLLPESPRWYVKAGKIEQARKALSRVRGQPVDSDYIKDEIAEIVANHEYETELTPNVTYLSSWAACFTGGIRNPGSNLRRTLLGISMQMMQQWTGVNFIFYFGTTFFTDLGTISNPFLISLITTLVNVCSTPVSFWTIERFGRRPLLIYGALGMLICEFIVGIIGVAKPGDTTVVKVQISFICIYVFFFASTWGPGAWVSIGEIFPLPIRARGVGLSTASNWLWNCIIAVITPYLVGTDEANLGSKVFFLWGSTCILCFIYAYLFVWETKGLTLEQVDRMMEECGSPRRSAGWKPHTTFAAEAAQGTHGLDQNEKAKVGPVLSQSEMLEQV

SEQ ID NO: 11832 - DNA, 1581 bp, Candida albicans SC5314
  CDS (1)..(1581): transl_table=12
atgagtgcaaatatccaagctcttatgaaaagctatgtcaattttgacgaacacacttctggttccgctgccagaggtattttaatcggtatgtttgctgcttttggtgggtttttgtttggttacgacactggtactatttctggtgtattgtctatggactacgttaaagccagattccccaacaacaaaaccgatttcacttctggtgaaagttcccttattgtctccattttatcagtcggtacttttgttggttccttgattgccccattgttttccgatagaattggtcgtagatggacattgattttatctactttgattgtttttaacttgggagttcttttacaaactgttgccactgaaaagaaattgcttattgcaggtagagccattgccggtactggtgttggtttaatttcatctgttattcctaattatatttcggaaacaacaccaaagtgggctagaggtgctgtcactgcttcataccaatggatgatcacctggggtcttttaattgctgcttgtgccaacaagggttcccaaggtagaaaagactctggttcctatagaatacccattggtattcaatttttgtgggcattgattttgggtattggtttcttgtttctcccagaaaccccaagatactgggtttccaagtctgaagaaactaaagctaaagattctttgagaagaattagaaacttgcctgttgatcacccagatttggtgctggaatacgatgacattaaagcaaactttgatttcgaatccaaatatgccacttcttcttggacccaagttttcaaaaacgttaacaaacaacaccacagattattcactggggttgccatccaagctttgcaacaacttactggtattaatttcatcttctactatggtactcaattcttcaagcgttctggtattgaagatcctttccttatccaacttgccactaatattgttaatgttggtatgactgtgccgggtattattttggttgaaacctggggtagaagaccattgttgatggccggtagtgttgttatggctgtctcccaattgattgttgccattgttggtgttgctgctagcagtcatgctgcaaatcaatgtttagttgctttcagttgtattttcattgctggtttcgcagcaacttggggacctctttgttgggctatttgtggtgaatcctttgctttgaacgtgagactgaaatcaatctccttgtgtaccgcaagtaactggctttggaatttcggtattggttatgctactccttatatggttgattcaggtaaagggaacgccgacttgggttcaaaggtgtttttcatttggggtggatgtaacgtcattggtgggttgtttgcatactttatggtttacgaaaccaagagtcttacattagaacaagttgatgaattgtacttgaaagttgatcacgcttggcaatctaaaggatttgttcctagtgtccacgcatttagagatgatggcgatattgagcacatctcttctgatggaaaagccgaaatggttgaagttgatgaaaattccgtttaa

SEQ ID NO: 11833 - protein, 526 aa, Candida albicans SC5314
MSANIQALMKSYVNFDEHTSGSAARGILIGMFAAFGGFLFGYDTGTISGVLSMDYVKARFPNNKTDFTSGESSLIVSILSVGTFVGSLIAPLFSDRIGRRWTLILSTLIVFNLGVLLQTVATEKKLLIAGRAIAGTGVGLISSVIPNYISETTPKWARGAVTASYQWMITWGLLIAACANKGSQGRKDSGSYRIPIGIQFLWALILGIGFLFLPETPRYWVSKSEETKAKDSLRRIRNLPVDHPDLVSEYDDIKANFDFESKYATSSWTQVFKNVNKQHHRLFTGVAIQALQQLTGINFIFYYGTQFFKRSGIEDPFLIQLATNIVNVGMTVPGIILVETWGRRPLLMAGSVVMAVSQLIVAIVGVAASSHAANQCLVAFSCIFIAGFAATWGPLCWAICGESFALNVRSKSISLCTASNWLWNFGIGYATPYMVDSGKGNADLGSKVFFIWGGCNVIGGLFAYFMVYETKSLTLEQVDELYLKVDHAWQSKGFVPSVHAFRDDGDIEHISSDGKAEMVEVDENSV

SEQ ID NO: 11834 - DNA, 1443 bp, Prochlorococcus marinus str. MIT 9303
  CDS (1)..(1443): transl_table=11
ttgcagttagcaaataagcagcttttggatccctctaatcagctttctgatcagagaaataagagacgacgtttacgtttcattcttcagatcgcaatttcagcagccttaggagggtttctctttggctacgacacggcagtgatcaatggagctgtcggtgcgatcggtaccgccttcaccgtctccaaggaaaccctcggctttgctgtggcctcagctttgctgggttccgcattgggagcgttcaccgctggctggctgtctgatcgaatcggtcgtcgcaacagcatgctggttgctgcactgatgtttcttgttggttccctcggttctgctcttgctccaacgatcaccaccctgatcctctggcgggtcgttggtggtctggccgtcggtttcgccagtgtgttggcgcccgcttatatcgccgagatctctcctgcatcgatgcgtggacagcttggctcactacagcagctggcgattgttatcggtattttcctggcgttgctgttcgattacgtcatcgttcttttgactgctgatcagaatcccgtttcattgatcggtcctctagcggcctggcgctggatgttcatgtctgaaatcatccctgcagctctttacgcagtactggtgatcggcattccagagagtcctcgctatctcgtgcagaaaggtttgacgcagcgtgccaaggcggtgattgaaaaaacgctgcatgaacctgcagatcaggtgatcgccaggatccagagcagcctggttaacacccatcaaggcaagttaagtgaactgttcgatcgccacaccatcctgctgccgatcatctggactggcgtgatgctggcgatcttccagcagtttgtgggcatcaatgtgatcttctattactccagcgtcctgtggcaggccgttggtttcagcgccaaggacagtctgattgtcacggtgatcacctcgatcacaaatgtcgtcaccaccttcattgcgattgcatttattgatcgtctcggccgcaaacccctgcttttggctggttcggttgtgatggcggtgaacctcggtgtgatgagctgggcctttgccggtgcccctctcgtcaacggtgcgccccaccttgccggggcaggagccattgtggctttgattgccgccaatctgtttgtgttcgccttcggtttctcctggggaccggtgatgtgggtgatgctcggagaaatgttcaacaaccgcatccgtgcggtggcaatcgggctgtgcgccatggtcaattggattgccaatttcttaatttccgacaccttccctggcttgctggaacgctcgggacctgcactcgcctacggcctgtacgccacggctgctgcgatctcgttcttcctcgtgctgtttttcgtcagggagaccaaaggcatggagctcgaggagatggcctga

SEQ ID NO: 11835 - protein, 480 aa, Prochlorococcus marinus str. MIT 9303
MQLANKQLLDPSNQLSDQRNKRRRLRFILQIAISAALGGFLFGYDTAVINGAVGAIGTAFTVSKETLGFAVASALLGSALGAFTAGWLSDRIGRRNSMLVAALMFLVGSLGSALAPTITTLILWRVVGGLAVGFASVLAPAYIAEISPASMRGQLGSLQQLAIVIGIFLALLFDYVIVLLTADQNPVSLIGPLAAWRWMFMSEIIPAALYAVLVIGIPESPRYLVQKGLTQRAKAVIEKTLHEPADQVIARIQSSLVNTHQGKLSELFDRHTILLPIIWTGVMLAIFQQFVGINVIFYYSSVLWQAVGFSAKDSLIVTVITSITNVVTTFIAIAFIDRLGRKPLLLAGSVVMAVNLGVMSWAFAGAPLVNGAPHLAGAGAIVALIAANLFVFAFGFSWGPVMWVMLGEMFNNRIRAVAIGLCAMVNWIANFLISDTFPGLLERSGPALAYGLYATAAAISFFLVLFFVRETKGMELEEMA

SEQ ID NO: 11836 - DNA, 1503 bp, Leifsonia xyli subsp. xyli str. CTCB07
  CDS (1)..(1503): transl_table=11
atgtctgagcaaaacagggaacccgcggagacgagcgaggagagcgcactacagcccacggccgcgatgcggcggaaagtcaccggtctggcgcttgcggcagcggtcgggggcttcctgttcgggttcgattcgtccgtcatcaatggggccgtcgactcgattcagaggaatttcgcactgaacgccttcgtcacagggttcatcgtcgctatcgccttcttcgggtgcgccgtcggcgcgtttgtcgcggggcggctcgccgaccggtggggccggttgcgggtcatgcttctgggcgccgttctcttcctcatcagctcggtcggggccgggctcgcgttctccgtatgggatctcggtctgtggcgcatcgtcggcggtctcggaatcggaatcgcctccgtcgtggctccggcgtacatcgccgagatctccccgcggcagtcgcggggacgcctcgggtccctgcaacagctcgcgatcaccctcggcatcttcgtggcgctgctgtccgacgctctgctcgcagggatcgcggggtcggcgtccagccagctctggctcgggctcgaagcgtggcgctggatgttccttgtcggcgtcatcccgtcggtggtctacggcgtcctggcactgacgctgccggagtcgccgcgctatctgctgacgaccggccggcacaaagatgcacgggccattttctcgacgatggtgccagagggcgatgtcgaccggcaggtccgcgacatcgagcgcgtgatcgaggaagacaaagagggcaggagggggaccctcgccggaaaccgcttcggcctcaaaccgatcgtgtggatcggagtcatcctctcggtgttccagcagttcgtcggcatcaacgtgatcttctactactcgacaacgctctggcgtgcggtcggctttacggagagcaactccctcctgatcacggtgatcacctcggtgaccaacgtcgtcgtgacgatcgtggcgatcctcctggtcgaccgggttgggcgccggccgatcctgcttacgggatcggtcgggatggcgctggcgctcggcgtcatggctctctcgttcaccttcgcggtcaagcaggacggggctgtctccctcccgagtccgtggggtccgctcgcactggtggccgccaacgtgttcgtcgtctgcttcggtgcgtcgtgggggccgctggtgtgggttctgctgggcgagattttcccctcccgcatccgaggcaaggcgctcggagtcgccgcagcggcccagtggatcgcgaacttcctggtcaccgtctccttcccgccgatgtcggacttctcgctgccgttcacctacgggatgtacgctgtattcgcggccctgtcgtggttcttcgtgttcttcaagatcccggagacgaacggcatggcgctggagcacgctgagacgctcttccaggaggcaggtggccgtcggcgtggcatccaggtacgttccagcggcgactcggtctag

SEQ ID NO: 11837 - protein, 500 aa, Leifsonia xyli subsp. xyli str. CTCB07
MSEQNREPAETSEESALQPTAAMRRKVTGLALAAAVGGFLFGFDSSVINGAVDSIQRNFALNAFVTGFIVAIAFFGCAVGAFVAGRLADRWGRLRVMLLGAVLFLISSVGAGLAFSVWDLGLWRIVGGLGIGIASVVAPAYIAEISPRQSRGRLGSLQQLAITLGIFVALLSDALLAGIAGSASSQLWLGLEAWRWMFLVGVIPSVVYGVLALTLPESPRYLLTTGRHKDARAIFSTMVPEGDVDRQVRDIERVIEEDKEGRRGTLAGNRFGLKPIVWIGVILSVFQQFVGINVIFYYSTTLWRAVGFTESNSLLITVITSVTNVVVTIVAILLVDRVGRRPILLTGSVGMALALGVMALSFTFAVKQDGAVSLPSPWGPLALVAANVFVVCFGASWGPLVWVLLGEIFPSRIRGKALGVAAAAQWIANFLVTVSFPPMSDFSLPFTYGMYAVFAALSWFFVFFKIPETNGMALEHAETLFQEAGGRRRGIQVRSSGDSV

SEQ ID NO: 11838 - DNA, 1395 bp, Bacillus licheniformis ATCC 14580
  CDS (1)..(1395): transl_table=11
atggttaatgaaaagaaaatctcaagtggcttcatttacttttttggggcttttgcgggcattcttttcggttatgatatcggcgttatgacgggtgctttgccttttctgcaaaatgattggaaccttcaagacaacgccggggttattggatggattacctcttcggtaatgttaggcgctatttttggaggcgcccttgccggacaactttctgatcgtttgggacggcgcaaaatgattttaatttccgctatcatttttgttgttggatccattttgtcaggaatagcacctcataatgggatactatttttgattgtttctcgggttttattgggattggccgttggtgccgcttctgcattggtcccagcctatatgtcggaaatggcgcctgcacgtttacgtggacggctgtcaggaattaatcaaacaatgatttgttctggaatgttgctttcttacattgttgattttctattgaaagatttgccggaaacaatggcgtggcggttgatgcttggtttggctgctgtacctgctttgatcttatatgttggaatgctaaaattacccgaatcaccacgttttttaataaagaacaataaacttgatgaagctcgcaaggtgttgagctatattcgctctaacaaaggagagattgattctgaaataacgcaaattcaagaaactgccagagaagaagcgaaggcaaatcaaaatgcatcatgggctaccctcttaagcaataaatatcgttttttattaattgccggtgtgggtgttgctgcttttcaacaattccagggtgcaaacgcaattttttattacattcctttaattgtagaaaaagcaacaggaaatgcagcaagttcagctttgatgtggccgattattcaaggagttattctcgtgctaggttcattaatattcttagtgattgctgataaatttaatcgccgtactttattaacagtaggcggaacaataatggggctgtcctttattttgccggcaatattgaatatattaattcctaatgcgaatccgatgatgatggttgtctttttgagtatctatgtagcactttattcattcacatgggctcctttaacttgggtcatagttggagaaattttcccgctggtaattcgcgggcgtgcgtctggtttagcttcatcatttaactggattggttctttcttggttggattgctatttcctgttatgaccgcttcgatgtctcaagaagctgtgtttgcaatcttcggtgtgatttgtttgcttggagttgtatttatccggacacgcgtccctgaaactcgaggtcgcagtttagaggaaatcggaaaaaatggagaaaataaacgagttgacggaaaaagcgcgtaa

SEQ ID NO: 11839 - protein, 464 aa, Bacillus licheniformis ATCC 14580
MVNEKKISSGFIYFFGAFAGILFGYDIGVMTGALPFLQNDWNLQDNAGVIGWITSSVMLGAIFGGALAGQLSDRLGRRKMILISAIIFVVGSILSGIAPHNGILFLIVSRVLLGLAVGAASALVPAYMSEMAPARLRGRLSGINQTMICSGMLLSYIVDFLLKDLPETMAWRLMLGLAAVPALILYVGMLKLPESPRFLIKNNKLDEARKVLSYIRSNKGEIDSEITQIQETAREEAKANQNASWATLLSNKYRFLLIAGVGVAAFQQFQGANAIFYYIPLIVEKATGNAASSALMWPIIQGVILVLGSLIFLVIADKFNRRTLLTVGGTIMGLSFILPAILNILIPNANPMMMVVFLSIYVALYSFTWAPLTWVIVGEIFPLVIRGRASGLASSFNWIGSFLVGLLFPVMTASMSQEAVFAIFGVICLLGVVFIRTRVPETRGRSLEEIGKNGENKRVDGKSA

SEQ ID NO: 11840 - DNA, 1446 bp, Mannheimia succiniciproducens MBEL55E
  CDS (1)..(1446): transl_table=11
atgtctggtgaaaaaacaagccgttatgttctcggtgtgacattagtggcaacattaggcggacttttatttggttatgataccgcagttatttcgggtacggtatcttcgttggatacggtatttattcaacctaaaggactgcccgaaattagcgcaaactcgttactaggtttctgcgtggccagtgcattaatcggctgtattatcggtggcgcctgtggcggttatctcagtagtaaatatggaaggaaaaaagccttattaattgcagcgctcctctttcttatctcggctttcggttccgcgtatcctgaatttggtctaaaaacaatcaatgaaacgaataacattccttattatttaagtaattttctgattcagtttgttatttatcgcattatcggtggtattggagtaggcatcgcatccatggtttctcctatgtatattgcagaaatcacgccggcccgtattcgcggtaaaatggtttcgttcaaccagtttgccattatcgcagggcaattaatcgtttattttgttaactatttcattgcgttaaatggagataatacatggttaaatatgctcggatggcgatatatgttcctttcggaaatggttccggcggcattatttttaatcctgttgtttttcgtaccggaaagtccgcgttggttagtattacaaaataaattttctcaagctgaaattactttattaaaattattaggcgaacgctcaggtaaaaccgaattacagaatatcgtttcttcattagaacatcgcgttgtaaaaggagcaccgttattttcctttggattgggcgttattgttatcggtattgcgctctctgtattccaacaatttgtcggtatcaacgttgctctttactatgcccctgaaatatttaaatccctgggtgcaagtacaaacaatgcattattacaaaccattattatgggtaccattaatctgtcttgtactacaattgcaatttttactgtggataaatacggacggaaaccgttacaaatcattggcgccttaggtatggcaatgggtatgtttgtactcggcatggcattttacgcaaatttatccggaactattgccttaaccggcatgcttttctatgtcgcggcatttgctatctcatggggcccggtatgttgggtacttttagccgaaatattccctaatgcaattcgtagtcaggctttagctatcgccgtagcggcacaatggattgcaaactacattgtttcctggacattcccgatgatggataaaagttcttatttagttgaacgctttaatcacggatttgcgtactgggtctacggcttaatggctattctggccgcattattcatgtggaaattcgttccggaaacaaaaggcaaaacgctggaagaactggaattattatggaataaaaagtag

SEQ ID NO: 11841 - protein, 481 aa, Mannheimia succiniciproducens MBEL55E
MSGEKTSRYVLGVTLVATLGGLLFGYDTAVISGTVSSLDTVFIQPKGLPEISANSLLGFCVASALIGCIIGGACGGYLSSKYGRKKALLIAALLFLISAFGSAYPEFGLKTINETNNIPYYLSNFLIQFVIYRIIGGIGVGIASMVSPMYIAEITPARIRGKMVSFNQFAIIAGQLIVYFVNYFIALNGDNTWLNMLGWRYMFLSEMVPAALFLILLFFVPESPRWLVLQNKFSQAEITLLKLLGERSGKTELQNIVSSLEHRVVKGAPLFSFGLGVIVIGIALSVFQQFVGINVALYYAPEIFKSLGASTNNALLQTIIMGTINLSCTTIAIFTVDKYGRKPLQIIGALGMAMGMFVLGMAFYANLSGTIALTGMLFYVAAFAISWGPVCWVLLAEIFPNAIRSQALAIAVAAQWIANYIVSWTFPMMDKSSYLVERFNHGFAYWVYGLMAILAALFMWKFVPETKGKTLEELELLWNKK

SEQ ID NO: 11842 - DNA, 1422 bp, Bacillus licheniformis ATCC 14580
  CDS (1)..(1422): transl_table=11
atgaatgaacagggaaatcagaaatcatttttgcgtactattattttagtctcgacgttcggcgggcttctattcgggtatgataccggagtaatcaacggagccttgccttatatgtctgaaggagatcagctgaacctgacagcatttacagaaggattggtcgcgagttcgcttctcctgggagccgcattgggagcggtgttcggcggaaggctatccgattatatcggacgccgcaagaacatcatttttctagctgtacttttctttttctcgacgcttggatgtacgcttgcgcctgatgtgacggttatggttatctcacggttcctgctcggagttgccgtaggaggagcatctgttacagtcccgacttacttggctgaaatgtctccttcagaaaaaaggggacgaatggttacccaaaatgaattaatgattgtctccggacagcttttggcatttaccttcaatgccatcctcggaaccacaatgggcgattcctcacatgtttggcgttacatgctggccattgccgcagtcccggctgtattcttgttctttggtatgctgagaatgcccgaaagtccgcgatggcttgtctctaaagggaaaaatgaagcggcgctgggtgttctgaaaagaatccgcaaggaaaaaagggcgcattcggaagttgctgaaatcgaagctgcagtcatgaaagaatcggaaatgaaaaaagcgaattataaggacctggctgttccttgggtgcgccgaatcgtatttcttggaatcggtatcgctgtcgttcagcagattaccggtgtaaactctattatgtattacggaacagaaattcttaaaaatgccgggtttgaaactaaagctgcactcatcggcaatattgcaaacggtgtcatttcagtattggcgacgttcgtggggatttggcttttaggaaaagtgggacgcagaccgatgctgttgaccggtttaataggaacgacatcagctttgctgcttatcggcatcttctcaaacgtccttcaaggttcagctgctcttccttatgtcgtacttacgctgactgtaaccttccttgcattccaacaaggcgccatttctcctgtaacatggctcatgctttctgaaatattcccgcttcgcgtacgcggcctcgggatgggcgtcaccgtgttttgtttgtggatcgccaatttctttgtcggattctcgtttccgatactgcttgaatcgattgggctgtcctcgacattctacatttttgtcggacttggacttctttccattgcattcgtgaaaaaattccttcctgaaacaaaaggcctcacgcttgaacagcttgagcataatttccgcaactataaatcggaaacagcacaaagcggtgcaagcgctaaaatcagcgggtga

SEQ ID NO: 11843 - protein, 473 aa, Bacillus licheniformis ATCC 14580
MNEQGNQKSFLRTIILVSTFGGLLFGYDTGVINGALPYMSEGDQLNLTAFTEGLVASSLLLGAALGAVFGGRLSDYIGRRKNIIFLAVLFFFSTLGCTLAPDVTVMVISRFLLGVAVGGASVTVPTYLAEMSPSEKRGRMVTQNELMIVSGQLLAFTFNAILGTTMGDSSHVWRYMLAIAAVPAVFLFFGMLRMPESPRWLVSKGKNEAALGVLKRIRKEKRAHSEVAEIEAAVMKESEMKKANYKDLAVPWVRRIVFLGIGIAVVQQITGVNSIMYYGTEILKNAGFETKAALIGNIANGVISVLATFVGIWLLGKVGRRPMLLTGLIGTTSALLLIGIFSNVLQGSAALPYVVLTLTVTFLAFQQGAISPVTWLMLSEIFPLRVRGLGMGVTVFCLWIANFFVGFSFPILLESIGLSSTFYIFVGLGLLSIAFVKKFLPETKGLTLEQLEHNFRNYKSETAQSGASAKISG

SEQ ID NO: 11844 - DNA, 1395 bp, Bacillus licheniformis ATCC 14580
  CDS (1)..(1395): transl_table=11
atggttaatgaaaagaaaatctcaagtggcttcatttacttttttggggcttttgcgggcattcttttcggttatgatatcggcgttatgacgggtgctttgccttttctgcaaaatgattggaaccttcaagacaacgccggggttattggatggattacctcttcggtaatgttaggcgctatttttggaggcgcccttgccggacaactttctgatcgtttgggacggcgcaaaatgattttaatttccgctatcatttttgttgttggatccattttgtcaggaatagcacctcataatgggatactatttttgattgtttctcgggttttattgggattggccgttggtgccgcttctgcattggtcccagcctatatgtcggaaatggcgcctgcacgtttacgtggacggctgtcaggaattaatcaaacaatgatttgttctggaatgttgctttcttacattgttgattttctattgaaagatttgccggaaacaatggcgtggcggttgatgcttggtttggctgctgtacctgctttgatcttatatgttggaatgctaaaattacccgaatcaccacgttttttaataaagaacaataaacttgatgaagctcgcaaggtgttgagctatattcgctctaacaaaggagagattgattctgaaataacgcaaattcaagaaactgccagagaagaagcgaaggcaaatcaaaatgcatcatgggctaccctcttaagcaataaatatcgttttttattaattgccggtgtgggtgttgctgcttttcaacaattccagggtgcaaacgcaattttttattacattcctttaattgtagaaaaagcaacaggaaatgcagcaagttcagctttgatgtggccgattattcaaggagttattctcgtgctaggttcattaatattcttagtgattgctgataaatttaatcgccgtactttattaacagtaggcggaacaataatggggctgtcctttattttgccggcaatattgaatatattaattcctaatgcgaatccgatgatgatggttgtctttttgagtatctatgtagcactttattcattcacatgggctcctttaacttgggtcatagttggagaaattttcccgctggtaattcgcgggcgtgcgtctggtttagcttcatcatttaactggattggttctttcttggttggattgctatttcctgttatgaccgcttcgatgtctcaagaagctgtgtttgcaatcttcggtgtgatttgtttgcttggagttgtatttatccggacacgcgtccctgaaactcgaggtcgcagtttagaggaaatcgaaaaaaatggagaaaataaacgagttgacggaaaaagcgcgtaa

SEQ ID NO: 11845 - protein, 464 aa, Bacillus licheniformis ATCC 14580
MVNEKKISSGFIYFFGAFAGILFGYDIGVMTGALPFLQNDWNLQDNAGVIGWITSSVMLGAIFGGALAGQLSDRLGRRKMILISAIIFVVGSILSGIAPHNGILFLIVSRVLLGLAVGAASALVPAYMSEMAPARLRGRLSGINQTMICSGMLLSYIVDFLLKDLPETMAWRLMLGLAAVPALILYVGMLKLPESPRFLIKNNKLDEARKVLSYIRSNKGEIDSEITQIQETAREEAKANQNASWATLLSNKYRFLLIAGVGVAAFQQFQGANAIFYYIPLIVEKATGNAASSALMWPIIQGVILVLGSLIFLVIADKFNRRTLLTVGGTIMGLSFILPAILNILIPNANPMMMVVFLSIYVALYSFTWAPLTWVIVGEIFPLVIRGRASGLASSFNWIGSFLVGLLFPVMTASMSQEAVFAIFGVICLLGVVFIRTRVPETRGRSLEEIEKNGENKRVDGKSA

SEQ ID NO: 11846 - DNA, 1434 bp, Bacillus licheniformis ATCC 14580
  CDS (1)..(1434): transl_table=11
atgaagggaaaaagatcgaatgcctggctttatttttttggagccttgggcggtgtgctctacggttatgatacaggcgtcatttccggggcgattttgtttatgaaagatgaacttgggctcaatgcctttacagaagggctggttgtcagcgcaatattaatcggggcgattttcggatcgggtttgtcaggcaggctgacagaccgcttcggccgaagaagggcgattatgtcagcggctgtgctgtattgcatcggggggctcggaacggccctggcgccaagcacggaatatatggtggctttcaggatcgtgctcggccttgcagtcggctgttcaacgaccatcgttcctttgtacctttcagagcttgctccgaaggaatcccggggcgcgctttcttcattaaatcagctgatgattacgatcgggattctgctctcttatttgatcaactatgcatttagtgatgcaggcgcatggcgctggatgctgggattggcccttattccgtcaatcggccttttaatcggtatctttttcatgccggaaagcccgcgctggctcttaacaaaaggaaaagaagagaaagcaaggcgggttttgtcaaagatgagaggaggagagcgggtcgatcaggaagtcaaagaaattaaggaagcggaaaagcaggaccaggggggcttgaaagagctgctggaaccgtgggtgcgcccggcgttaatcgcaggggtcggactggcatttctgcagcaatttattggaaccaacacgattatttactatgccccaaaaacgtttacgaatgtcggatttgaagattcggcggccattttagggacagtcggcatcggaacggtcaatgtcctgatgacgcttgtggcgatccgcttcattgacaggattggccggaagccgcttttattatttggaaatgccggaatggtcatcagtttgatcgtgctttctttttctaatctctttttcggcaatacctctggtgcggcatggacgactgtcatctgcttaggtgtgttcatcgtcgtatttgccgtcagctgggggccgatcgtctgggtgatgctgcctgagctgttcccccttcatgtcagagggataggaaccggagtatcgactttaatgctccatgcagggaacttaattgtgactttgagttttccggtcctcatggaagcgatgggcatcagttacctgtttctgtgctatgcggccattggaatcgcggccttcctgttcgtcttctttaaagtaacagaaacaaaaggaaaagtctggaagagatcgagcaggatttgcgggacaagcaccgcggaatcacggcaactgacacacagccggttgaacgataggcaaaaggatgggcaaggccccatccttttttgtgtgaagaggccggccgatcatggctga

SEQ ID NO: 11847 - protein, 477 aa, Bacillus licheniformis ATCC 14580
MKGKRSNAWLYFFGALGGVLYGYDTGVISGAILFMKDELGLNAFTEGLVVSAILIGAIFGSGLSGRLTDRFGRRRAIMSAAVLYCIGGLGTALAPSTEYMVAFRIVLGLAVGCSTTIVPLYLSELAPKESRGALSSLNQLMITIGILLSYLINYAFSDAGAWRWMLGLALIPSIGLLIGIFFMPESPRWLLTKGKEEKARRVLSKMRGGERVDQEVKEIKEAEKQDQGGLKELLEPWVRPALIAGVGLAFLQQFIGTNTIIYYAPKTFTNVGFEDSAAILGTVGIGTVNVLMTLVAIRFIDRIGRKPLLLFGNAGMVISLIVLSFSNLFFGNTSGAAWTTVICLGVFIVVFAVSWGPIVWVMLPELFPLHVRGIGTGVSTLMLHAGNLIVTLSFPVLMEAMGISYLFLCYAAIGIAAFLFVFFKVTETKGKVWKRSSRICGTSTAESRQLTHSRLNDRQKDGQGPILFCVKRPADHG

SEQ ID NO: 11848 - DNA, 1416 bp, Legionella pneumophila subsp. pneumophila str. Philadelphia 1
  CDS (1)..(1416): transl_table=11
atgaacaagggaatgaacgcatttgtattcctgatcgcggtaattgccggatttggcggttttttattcggatttgattccagcgtcatagctgatgtgaaagatcaggttatctcccaattggcattaacagactggcaatgggcgcaagttgtcagcagtagtttattgggatgtatattgggaatacccataagtggtcttgtcgcagataagttaagcagacgatccttattaaaagttgtagctttaggctttatactggggagtagtttgtgtgctttggctcccggcttcgtttcgatattactcggtcgatttattatcggcatttgcataggtattgcctcctatattgctcctttattcattgcagaaatcgcgccgcctcatcagaggggaactttagtattgattaatggactaaccatcacgtttggtcaggctatcgcctatttaattggctattttctccatgactattctttaatgagttggagatatttattttggataggaagtctacctgctctcgttttattttcaggaatgtattttgtccctcattcaccccgctggataatgattaaatatggagctgatgctactttaaagaccttaaagcaaattaggccagttgggtataatattcagcaggaattgactgaaattagtaataatttagttaatcctgcaccagcctatatccagatgtttaaaaaaccaattgtttttgttctcttattaggagttggtttaggactattccagcaattttccgggatcaatgctttgatgtattatggacctgttgtctttgaatcatttgggttttctccagttaaaaatgcaattctcgctaccttttttttgggtctggtcaattttatttttacagtggttacccttttttatgttgataaattaggcagaaggtttttgttaatcagtggtactttgatcgcatcaattagcttatattttgttagcttactatcgtgccactctttatttgtcaataaattctggattttaggtggtttatcattttatgtgatggggtattgtattagcctggggtctctgttctgggttttaatatccgaaatataccccttatcagtgcgtggtttggcaatgagcattgctactatgtttcaatggggcgctaattttgttgtatcacttttgtttcttcccatttatcaattctcaggtcaaacagttacctttgctatgttcgctaccttttgcttgttggcatgctggtttatttattattttgtcccggaaactacatcagtatcgttggaaaaactggaagaaaatttaagctctggaaaaaaagtaagagatataggtcaaccagtatcgaaaaatataaaaatagcaaaatttaatttaattatggattaa

SEQ ID NO: 11849 - protein, 471 aa, Legionella pneumophila subsp. pneumophila str. Philadelphia 1
MNKGMNAFVFLIAVIAGFGGFLFGFDSSVIADVKDQVISQLALTDWQWAQVVSSSLLGCILGIPISGLVADKLSRRSLLKVVALGFILGSSLCALAPGFVSILLGRFIIGICIGIASYIAPLFIAEIAPPHQRGTLVLINGLTITFGQAIAYLIGYFLHDYSLMSWRYLFWIGSLPALVLFSGMYFVPHSPRWIMIKYGADATLKTLKQIRPVGYNIQQELTEISNNLVNPAPAYIQMFKKPIVFVLLLGVGLGLFQQFSGINALMYYGPVVFESFGFSPVKNAILATFFLGLVNFIFTVVTLFYVDKLGRRFLLISGTLIASISLYFVSLLSCHSLFVNKFWILGGLSFYVMGYCISLGSLFWVLISEIYPLSVRGLAMSIATMFQWGANFVVSLLFLPIYQFSGQTVTFAMFATFCLLACWFIYYFVPETTSVSLEKLEENLSSGKKVRDIGQPVSKNIKIAKFNLIMD

SEQ ID NO: 11850 - DNA, 1341 bp, Staphylococcus epidermidis RP62A
  CDS (1)..(1341): transl_table=11
atgaaagcaaataagtatttaatctttattttgggagcacttggtggcttattatatggttatgataatggtgtgatttccggtgctttattatttatacataaagacatacctctcaatagtacaactgagggtatcgttgtgtcttcaatgttaattggcgcaatagtcggtgcgggaagcagtgggccacttgctgataaattaggtcgtcgacgtctagtaatgctcatcgctattgtatttattattggggcactgattcttgctgcatcaaccaatttagcattattaattattggacgtttaattattggtttagcagtaggtggttcgatgtctacggtacctgtttatttaagtgaaatggcaccgacagaatatcgtggctcactaggttcacttaatcaactaatgattacaattggtattttagcagcatatttagtcaactatgcatttgcggatattgagggttggcgttggatgctaggattagcagttgttccatcggttattttacttgtgggtatttattttatgcctgagagtccaagatggttacttgaaaatagaaacgaagaagccgctcgtcaagtgatgaagattacttatgacgatagcgaaattgataaagaacttaaagagatgaaagaaattaacgctatctctgaatctacatggacagtcattaaatcaccatggttaggtagaatattaattgtaggttgtatatttgctattttccaacaatttattggtatcaatgcagtcattttctattcatcttcaatctttgctaaggctggactgggtgaagcggcgtctatattaggttcagttggtataggaactattaatgttcttgtaacaatagttgccatttttgtagtagataagattgatcgtaaaaaactacttgttggtggtaatattggtatgattgcctcattattaattatggcaatcttaatttggacaattggaattgcttcatcagcgtggattattattgtttgtttatcattatttattgtattctttgggatttcttggggacctgttctatgggttatgctacctgaattattcccgatgcgcgcacgtggcgctgctacgggcatttcagcgcttgtgctaaatatcggaacgcttatcgtgtcattgttcttcccaatattaagtgatgcattaagtacagaatgggtatttttaatctttgcattcataggtgttttagcgatgattttcgtaattaaattcttaccagaaacacgcggacgtagtttagaagaaatagaatatgaattacgtgaacgtacaggagcaagaactgaataa

SEQ ID NO: 11851 - protein, 446 aa, Staphylococcus epidermidis RP62A
MKANKYLIFILGALGGLLYGYDNGVISGALLFIHKDIPLNSTTEGIVVSSMLIGAIVGAGSSGPLADKLGRRRLVMLIAIVFIIGALILAASTNLALLIIGRLIIGLAVGGSMSTVPVYLSEMAPTEYRGSLGSLNQLMITIGILAAYLVNYAFADIEGWRWMLGLAVVPSVILLVGIYFMPESPRWLLENRNEEAARQVMKITYDDSEIDKELKEMKEINAISESTWTVIKSPWLGRILIVGCIFAIFQQFIGINAVIFYSSSIFAKAGLGEAASILGSVGIGTINVLVTIVAIFVVDKIDRKKLLVGGNIGMIASLLIMAILIWTIGIASSAWIIIVCLSLFIVFFGISWGPVLWVMLPELFPMRARGAATGISALVLNIGTLIVSLFFPILSDALSTEWVFLIFAFIGVLAMIFVIKFLPETRGRSLEEIEYELRERTGARTE

SEQ ID NO: 11852 - DNA, 1380 bp, Bacteroides fragilis NCTC 9343
  CDS (1)..(1380): transl_table=11
atgaaacagacacgaggctatttactacttatctgcatcgtctcagccatgggcggattactgttcggctatgattgggttgttatcggaggagctaaaatcttctacgaaccctactttggtattgaaaactctgcggctctacgtggctgggctatgagcagcgcactgataggctgcctggcaggagccttgctctcaggaatctggagcgacaaatacggacgcaaaaagatgcttgtcatagcctcattcctgtttgcactttcggcttggggtacgggagcagtcgatcatttttcctacttcatcttctatcgcattgtaggaggattgggcatcggcatcgcatccaacatttctcccgtatatattgcagaggtatctcctgcccatgtacgcggcaaattcgtatcgctcaaccagctcaccatcgtattaggtatcttattggcacaattggccaactggcaaatcggggaatactacacacaaggttccgatatactcagcgaaacaagtgtgcaatgggcctggcgatggatgttctgggcagaactgatcccggcaggaattttcttcctgttatcgttcatcatccccgaaagtccccgttggctggctaccgtccatcaacaggagaaagcacaaaagacactgacacgcatcggaggggaaacgtatgcccgccaaaccctggaagaactgaaccaactcactcaatctcaaggcaaccggcaaaacaatgaatggaaatcggtcttccgcccggaaatgcgcaaagtactgatcattggaatcgttctggccatattccagcaatggtgcggcattaatgttatcttcaattatgcccacgagatcttttcatcagccggatatgccgtttccgatgtactgatgaacatcgtagtgaccgggattactaatgtgatatttacgttcgtcgccatctatacggtagacaaatggggacgtcgtacactgatgctgatcggttcggcaggattagcgctgatttaccttatattgggaacctgctacttcctggatgtaaacggtttacccatgcttctactggtggtacttgccatcgcttgctatgctatgtcacttgccccggtagtctgggtggtgttatccgaaatcttccccgtgaaaatacgaggtatggctatagccatctctaccttcttcctttgggtggcttgtttcatactgacctatacctttccggtattgaatgaaagtataggtgccgaaggaactttctggctatacggtggtatctgcctggccggattcctgttcatacgccaaaacctgcccgaaacaaaagggaaaacactggaagaaatagaaaaagaattaatcaaataa

SEQ ID NO: 11853 - protein, 459 aa, Bacteroides fragilis NCTC 9343
MKQTRGYLLLICIVSAMGGLLFGYDWVVIGGAKIFYEPYFGIENSAALRGWAMSSALIGCLAGALLSGIWSDKYGRKKMLVIASFLFALSAWGTGAVDHFSYFIFYRIVGGLGIGIASNISPVYIAEVSPAHVRGKFVSLNQLTIVLGILLAQLANWQIGEYYTQGSDILSETSVQWAWRWMFWAELIPAGIFFLLSFIIPESPRWLATVHQQEKAQKTLTRIGGETYARQTLEELNQLTQSQGNRQNNEWKSVFRPEMRKVLIIGIVLAIFQQWCGINVIFNYAHEIFSSAGYAVSDVLMNIVVTGITNVIFTFVAIYTVDKWGRRTLMLIGSAGLALIYLILGTCYFLDVNGLPMLLLVVLAIACYAMSLAPVVWVVLSEIFPVKIRGMAIAISTFFLWVACFILTYTFPVLNESIGAEGTFWLYGGICLAGFLFIRQNLPETKGKTLEEIEKELIK

SEQ ID NO: 11854 - DNA, 1449 bp, Bacteroides fragilis NCTC 9343
  CDS (1)..(1449): transl_table=11
atgaatcataccaacgagggtagcaagctctacctgtattccattacatcggtagccatcctgggcggattgctgttcggctatgataccgctgtaatttcaggagctgagaaagggctcgaagccttcttcctcacagccacagattttcaatacgacaaagtgatgcacggcatcacctcctcgagtgcactgatcggttgcgtcttgggtggtgcattgtccggcatcttcgcttcacggctggggcgccgcaactcactacggctggccgccgtacttttcttcctttcggcactggggtcttattatcctgaattcctgttctttgaatatgggaaggctaatatgaacttgcttatcacctttaatctctaccgcattctgggaggcatcggagtgggactggcgtccgctgtttgtcccatgtatattgccgagatagctccctccaacattcgcggtacactggtgtcatgcaatcagtttgccataatcttcggcatgcttgtggtttactttgtaaactacctgatcttgggcgaccaccagaatcctgttatcctgaaagatgctgctggcacactttctgtaagtagtgagtcggatatgtggaccgttaccgaagggtggcgctatatgttcggttccgaagcctttccggcagctttcttcggcatgttactcttcttcgtacccaaaactccccgttatctggtaatgattgatcaggatcagaaggcttattccattctcaaaaaagtgaatggagccacaaaagcacaagagattcttgccgaaataaaagccacttcgcaggaaaagacagagaagctgttcacctacggtgcggcggtgattgttatcggtattctgctttctgtcttccagcaagccatcggcatcaacgccgtgctctattatgcgccgcgaatattcgaaaatgccggtgccgaaggcggaggaatgatgcaaaccgtcatcatgggcattgtcaatatcgtctttacactgatagctattttcaccgtcgaccgtttcggacgaaaaccgttgcttatcatcggttccgtcggtatggctgtcggagcctttgcagtcgccttgtgtgacagtatgggtatcaaggggatacttcccgtactgtcggtcattgtatatgcagctttcttcatgatgtcatggggacccatctgttgggtactgatatccgaaatctttcccaacaccatccgtggcaaagcggtggccattgctgtggcatttcaatggatattcaactacattgtttcatctacgttccccgcgctctatgatttcagtccgatgtttgcctacagtctttacggaatcatttgtgtgattgccgccctcttcgtatggcgttgggtgccggaaaccaaaggaaaaacattggaggatatgagcaaactttggaagaagcgttaa

SEQ ID NO: 11855 - protein, 482 aa, Bacteroides fragilis NCTC 9343
MNHTNEGSKLYLYSITSVAILGGLLFGYDTAVISGAEKGLEAFFLTATDFQYDKVMHGITSSSALIGCVLGGALSGIFASRLGRRNSLRLAAVLFFLSALGSYYPEFLFFEYGKANMNLLITFNLYRILGGIGVGLASAVCPMYIAEIAPSNIRGTLVSCNQFAIIFGMLVVYFVNYLILGDHQNPVILKDAAGTLSVSSESDMWTVTEGWRYMFGSEAFPAAFFGMLLFFVPKTPRYLVMIDQDQKAYSILKKVNGATKAQEILAEIKATSQEKTEKLFTYGAAVIVIGILLSVFQQAIGINAVLYYAPRIFENAGAEGGGMMQTVIMGIVNIVFTLIAIFTVDRFGRKPLLIIGSVGMAVGAFAVALCDSMGIKGILPVLSVIVYAAFFMMSWGPICWVLISEIFPNTIRGKAVAIAVAFQWIFNYIVSSTFPALYDFSPMFAYSLYGIICVIAALFVWRWVPETKGKTLEDMSKLWKKR

SEQ ID NO: 11856 - DNA, 1374 bp, Bacteroides fragilis NCTC 9343
  CDS (1)..(1374): transl_table=11
atgaacagagagaacaaacctttattcctatatacttttatcaccgtttttggtggattgattgtagggttaaatatggcaggtatttccggagccgttccttttttacaggaacaatttatgttggatgatatggctttgggattggtggtaagtattctgaccgtaggttgcctttgcggtgctttgctgggaggaggttttagcgaccgttatggcagacagaaagtcatgttctcgtcagctgtcttttttattgtttcttctttgggctgcgcattatccggtaatttggtttcactgctggtttttcgcctgatatgcgggctgggtatcggagtgatctctgccgtagcacctatttatatatctgaaatatctcctgcccggctgaggggaacactggtttcctacaatcagttggctattgtgataggaattctaattgcttacattgtagattatatattgctggactatgagcggaactggcgcctgatgttgggattcccgttcttctttagtgtggcctatctgttgttattgggtatattgcctgagagcccacgttggctttcggctcgtggaaaagcaggtagagccaggcaggtggccagtaaactgaacctggaagccggtgagatgaccgtgtccgacacaaacacacaagaaggtagagataggataaaggtaactgaattgtttaagggtaacttggctaaagtggttttcataggttctatactggccgccttacagcaaatcacgggtattaacgtcatcatcaattatgcaccttccatcttcgagatgacaggtgttgccggggatattgcccttgtgcaatctatcctggtgggagtggtgaatctgctgtttaccctgattgctgtgtggctggtcgataaagtagggcgtaagattctgcttctttgcggaagtctggggatgggcatctcattgctgtacctggtttacactttcgtagttccggcagccaatggtatcggtgccttaatagccgtgttatgctatatcggattctttgccgcttcactggcacctttgatgtgggtggtgacttccgagatttacccttctcgtattcgtggaacagctatgtcactctccaccggaatcagctggttatgtacttttctcaccgttcagtttttcccctggatactgaataacttgggcggatcggttgctttcggaatctttgccattttcagcattgctgcattcgcattcattttgttttgtgtgcccgagaccaagggcaagtcactggaggcaatagaaaaagagctgggagtggataaagaggctgaggagaatgtgaaagaagaacatgctttctcgaaaatataa

SEQ ID NO: 11857 - protein, 457 aa, Bacteroides fragilis NCTC 9343
MNRENKPLFLYTFITVFGGLIVGLNMAGISGAVPFLQEQFMLDDMALGLVVSILTVGCLCGALLGGGFSDRYGRQKVMFSSAVFFIVSSLGCALSGNLVSLLVFRLICGLGIGVISAVAPIYISEISPARLRGTLVSYNQLAIVIGILIAYIVDYILLDYERNWRLMLGFPFFFSVAYLLLLGILPESPRWLSARGKAGRARQVASKLNLEAGEMTVSDTNTQEGRDRIKVTELFKGNLAKVVFIGSILAALQQITGINVIINYAPSIFEMTGVAGDIALVQSILVGVVNLLFTLIAVWLVDKVGRKILLLCGSLGMGISLLYLVYTFVVPAANGIGALIAVLCYIGFFAASLAPLMWVVTSEIYPSRIRGTAMSLSTGISWLCTFLTVQFFPWILNNLGGSVAFGIFAIFSIAAFAFILFCVPETKGKSLEAIEKELGVDKEAEENVKEEHAFSKI

SEQ ID NO: 11858 - DNA, 1449 bp, Bacillus cereus E33L
  CDS (1)..(1449): transl_table=11
ttgataagggtaggaggagaatggatgtatacagagacaaaagagaagaagcaaagccctaacaaaatggtaagaaaaattgccttcatatccacattcggaggtctactctttggatatgataccggggttataaacggggcactaccgtatatgtcggattcaaatcaacttgatttaaatccgtttacacaagggctcgtcgctagttcccttttattgggtgcagcttttggtgcattatttgggggacgtttgtcagattataatggtcgtcgtaaaaacatcttatatctcgcactattattttttatatcaacccttggatgcactcttgcaccaaatactacattaatggttatttgccgattcatattaggacttgctgtgggcggtgcatctgtaactgttccaacctttctagctgaaatgtcaccagctgaaacaagaggacagattgttacacaaaatgaattaatgatcgttacaggccagtttttagcttttacatgcaatgcaatccttggtaacgtattaggagatgtagggtatgtttggaggcttatgttagttattgcatcattaccagccgttgttttatggtttgggatgctgattgttccagagagtccacgttggcttgcatcaaaaggtaaaattggtgattccttaagagtgcttaaacaaatccgagaagaaaatcaagcaaatatagaactggaagaaataaaatcggcacttgctgaagattccaaattagaaaagtccagttttaaagatttgtctactccttgggtacgtcgcattttatttttaggaattggagttgctattgttaatcaaattaatggcgtaaatgctattatgtattatggaacagaaatactcaaaaacacggggtggggaacaaaagcggcattaattggaaacgttgctaacggtgttatttctatagctgcgatgcttgttggaatatggttacttggtagagtgagaaggcgtccaatgttgattattggcttatgtggtactaccacttctcttttccttattggttttttctctttcattctcaatggttccgttatgcttccttatattgttctctctttaactgttatttttttagcttttatgcaaggggcaataggaccagttacatggctaacacttgcggaaatatttccgctaagaatgcgcgggcttggtatgggctttagtgtattttggatgtggattgttaattttttaattagtttgtcattccctgtattgcttagcaagattggcttgtctgcaacttttttgctattcggcattttgggtttagtagccattgcgtttgttaataagtatttaccagaaacaaagggaaaatcgcttgaagaactggaacattattttcgttcctatgacgatcaaggattagaaaataaacaggctaggtaa

SEQ ID NO: 11859 - protein, 482 aa, Bacillus cereus E33L
MIRVGGEWMYTETKEKKQSPNKMVRKIAFISTFGGLLFGYDTGVINGALPYMSDSNQLDLNPFTQGLVASSLLLGAAFGALFGGRLSDYNGRRKNILYLALLFFISTLGCTLAPNTTLMVICRFILGLAVGGASVTVPTFLAEMSPAETRGQIVTQNELMIVTGQFLAFTCNAILGNVLGDVGYVWRLMLVIASLPAVVLWFGMLIVPESPRWLASKGKIGDSLRVLKQIREENQANIELEEIKSALAEDSKLEKSSFKDLSTPWVRRILFLGIGVAIVNQINGVNAIMYYGTEILKNTGWGTKAALIGNVANGVISIAAMLVGIWLLGRVRRRPMLIIGLCGTTTSLFLIGFFSFILNGSVMLPYIVLSLTVIFLAFMQGAIGPVTWLTLAEIFPLRMRGLGMGFSVFWMWIVNFLISLSFPVLLSKIGLSATFLLFGILGLVAIAFVNKYLPETKGKSLEELEHYFRSYDDQGLENKQAR

SEQ ID NO: 11860 - DNA, 1437 bp, Colwellia psychrerythraea 34H
  CDS (1)..(1437): transl_table=11
atgacctcctctgagcctgataattcaattcaaaaactgcacgacactgaagaagttcaaacttcatttttatacgtactatttatctcctctgtggctgccatcggtgggtttctatttggttttgattccggtgttattaacggcacagtaactgcgttaggaaatgcttttaacgctagcgacgtagctagtggctttaatgtcgcctcggtactgttaggttgtgctgttggtgccttgatggctggaccgatatctgatcggtttggacgtaaacccatcatgattattactgcgattatctttgccattagcgcctttggatcgggtatatcaagttcgtctgctgaatttattttttatcgattgattggcgggttaggcataggtgctgcatcagtattagcccctgcttacatcgctgaagttgcacccgctgctttacgaggccgtttagctactttgcaacaattagccatcgtacttggcttgtttgctgcttttttaagtaatttccttattgcctctgtgtctggtggtgctgaagctatgctgatgttagatatcgctgcctggcgttggatgttttgggtagagttattgccggctgtgctatttttagttggtgtgatatttattccagaatcaccacgttatttagtcgctcaaggtaagattgaagaagccagaaccatattcaaacgcatagcaaccggcgttgaaaatgagcaaattgaagaagttaaaaaatcgctgcacggcgataaaaaacctagcatcagggatctttttattgatggtaagaaaaaaattcatcctatcatttggatcggtatcggactgtcggtattccagcaatttgtcggtattaacgtggtgttttattatggagctgagctttggcaagctgcgggttttgacgaatcacaatcgttatttattaaccttatcgcaggtacaaccaatatcatttctactttcatagctatcgccttagtggacaaaattggccgtaaaccgttattactggtcggtagtgtcggcatgtttatcagcttaggtgctctgacctttatctttggtaccggtggtctagatgaagcaggtaagttggcattaagtgatacgacaggcacagtggctttaatcatggctaatttatttgtggtgttttttggcttaagttggggacctattgtttgggttttattaggcgagatgtttaataatcgtatccgtggtgctgctttagctattgctgcaagtgctcaatggctagcaaattttgccattaccatgactttcccgatattgttgggcagctttggtttggctggcgcctatggcttatacacagtatcagcattactaagtattttctttgtaatcaaatatataaaagaaacacgcggcattcgtttagaggaaatgtaa

SEQ ID NO: 11861 - protein, 478 aa, Colwellia psychrerythraea 34H
MTSSEPDNSIQKLHDTEEVQTSFLYVLFISSVAAIGGFLFGFDSGVINGTVTALGNAFNASDVASGFNVASVLLGCAVGALMAGPISDRFGRKPIMIITAIIFAISAFGSGISSSSAEFIFYRLIGGLGIGAASVLAPAYIAEVAPAALRGRLATLQQLAIVLGLFAAFLSNFLIASVSGGAEAMLMLDIAAWRWMFWVELLPAVLFLVGVIFIPESPRYLVAQGKIEEARTIFKRIATGVENEQIEEVKKSLHGDKKPSIRDLFIDGKKKIHPIIWIGIGLSVFQQFVGINVVFYYGAELWQAAGFDESQSLFINLIAGTTNIISTFIAIALVDKIGRKPLLLVGSVGMFISLGALTFIFGTGGLDEAGKLALSDTTGTVALIMANLFVVFFGLSWGPIVWVLLGEMFNNRIRGAALAIAASAQWLANFAITMTFPILLGSFGLAGAYGLYTVSALLSIFFVIKYIKETRGIRLEEM

SEQ ID NO: 11862 - DNA, 1419 bp, Thermobifida fusca YX
  CDS (1)..(1419): transl_table=11
gtgtctacaacgggagaggcccccagcagcggtgaagtgaacatcgcccacgtggtgatgattgcggcagccgcggcgatgggcggattcctgttcgggtacgacagtgccgtcatcaacggtgcggtgagcgcgatccaggacacctttcgggtcggctccactgtcatcgggttcacggtggccgctgccctgatcggttccgcggtgggggcggcgatcgcgggtgccctggccgaccggatcggtcggatccgggtcatgcagctcgcggctgtgctgttcgcggccagcgcggtcggatccgcgctccccttcaccgtctgggacctggcctggtggcgcgtggtcggcggcgtggcgatcggtatcgcctcggtgatcgccccgacctatatcgccgaagtgtccccgcccgcgttccgcggccgcctcgcctcgctgcaacagctcgccatcgtcctcgggatcgccacctcccaactggtcaactacgggctggccgccgcggtgggtggcagcgccctccaccggctcggcccgctgcaggcctggcagtggatgctcggcatcgaagtgctgcctgccgccacgtactttgtactgaccctggtcattcccgagtcgccccgccacctcgtccgcatcggccgcgatgcccgcgcacgccgcgtcctcgctgaagtcgaaggcggtgacgtggacggccgtgtggcggagatccgccgggtgctcggccgggaacgccgcccccgcctgcgcgacctgcgcggccgctacgggctgctggccatcgtgtgggtgggcatggccctgtccgcgttccagcagctcgtcggcatcaacgtgatcttctactattcggcggtgctgtggcagtcggtgggtatcgcggaaaccgactcgctgctgctgagcctgttcacgtccatcgtgaacatcgtcggcaccctgatcgcgatcggcctggtagaccgggtgggacgcaaacccttgctgctggccggatcggcggggatgacggtggcgctggccttcaccgcattcgcgttcagccacgcccgaggggaaggagacgacgtggtgctgtcaacggcgtgggccttgaccgccctggtctccgccagcacgttcgtcctgttcttcgcgctctcttggggagtggtcacctgggtgctgctcggcgagatgttcccgctgcggattcgcgctgcagccatggccgtggccaccgccacccagtggatcaccaactggctggtgaccgtcaccttcccgtcgctgcgtgactggagccttcccggcacctacctggtgtacacggcgttcgcgctgctgtccttcgggttcgtgctccggttcgtgcgggaaaccaaaggccggacactggagtcgatggacgaactcgccggacagtga

SEQ ID NO: 11863 - protein, 472 aa, Thermobifida fusca YX
MSTTGEAPSSGEVNIAHVVMIAAAAAMGGFLFGYDSAVINGAVSAIQDTFRVGSTVIGFTVAAALIGSAVGAAIAGALADRIGRIRVMQLAAVLFAASAVGSALPFTVWDLAWWRVVGGVAIGIASVIAPTYIAEVSPPAFRGRLASLQQLAIVLGIATSQLVNYGLAAAVGGSALHRLGPLQAWQWMLGIEVLPAATYFVLTLVIPESPRHLVRIGRDARARRVLAEVEGGDVDGRVAEIRRVLGRERRPRLRDLRGRYGLLAIVWVGMALSAFQQLVGINVIFYYSAVLWQSVGIAETDSLLLSLFTSIVNIVGTLIAIGLVDRVGRKPLLLAGSAGMTVALAFTAFAFSHARGEGDDVVLSTAWALTALVSASTFVLFFALSWGVVTWVLLGEMFPLRIRAAAMAVATATQWITNWLVTVTFPSLRDWSLPGTYLVYTAFALLSFGFVLRFVRETKGRTLESMDELAGQ

SEQ ID NO: 11864 - DNA, 1407 bp, Novosphingobium aromaticivorans DSM 12444
  CDS (1)..(1407): transl_table=11
atgtcgcaacaaccgcagccgggcggcaatctcggcttcatcgggcttatcgtggcggttgccacgattggcggcttcatgttcggctacgattcgggtgccatcaacggcacgcaggacgggctcaagcatgccttcggactgggcgaagccgagcttggcctgaccgtcagcgcactcctgcccggttgcgcgctcggcgcgttcctggcgggacggtttgccgacatctggggccgccgcgcggtcatgatgatggcggcagcgctgttcattctctcggcgctcggctcgggggcagcgccctcggccatcgttcttgcagttgcgcgcttcttcgcgggcgcggcggtgggtgccgcaagcgtgctttcgccggcctatatctccgaagtcactccggcccacgtgcgcggacgtctgtcgagcgcgcagcaggtcatgatcatttcgggcctgaccggagctttcctcgcaaactactggctggctggggccgccgggtcctcgctcggtgcgttctggtgcggttatccggcatggcgctggatgttctgggtccaggcagcgccggccatcctgttcctcgtcacgcttctgctcatccccgaaagcccgcgcttcctcgtggcgaagggccgcaccgaagaagcccgctcggttctcgcccgtctgttcggcgatgccaccgcggacgccaagctcggcgaaatccgcgcctcgcttgccgccgatcaccagccgagccttgccgacatccgcaagccgggcggcggctggcgccccatcgtctgggtcggcatcggccttgccgtgttccagcagctcgtcggcatcaacgtggtgttctactatggcgcggtgctgtggcaggcggtcggcttttccgaggcggacgcgctcaagatcaacatcctttcgggcgtcgtctcgatcgcggcctgcctcgtctcgatcggcctcgtggacaagcttggccgcaagccgctgctgctgatcggttcggcggggatgaccgcgacgctgggcgcgcttgcctggtgctttgcgcaggcatcgaccggccccgacggcgcgcttgtcctgcccgagggcgtcggcaccatcgcgctctacgcggccaacatctacgtcgttttcttcaacatgagctggggcccggtgatgtgggtcatgctgggtgaaatgttccccaaccagatgcgcggatcggccctggcggtggcgggcgcggcgcagtggctggcgaatttcgcggtcagctcgagcttcccgtggctggcaggcaacatcggcctgcccgtcacttacgccgcctacaccctgttcgccgccatctcgctggtcttcgtctggacctcggtcaaggagaccaagggcaaggaactcgaggccatggaaggctga

SEQ ID NO: 11865 - protein, 468 aa, Novosphingobium aromaticivorans DSM 12444
MSQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAMEG

SEQ ID NO: 11866 - DNA, 1380 bp, Francisella tularensis subsp. holarctica
  CDS (1)..(1380): transl_table=11
atgcaaactgaaaaaataaattttgtggtcgttcgtgtggctataatagcagcacttgcaggtctgctttttggtatggatattggttatgttaacggctcgttgcatttcatatcagaaacatttggtttaagtgttgagcaaagtggacatgtatcaagtgtcttgctgcttggcgctgcttgtggagcattatttagtggttttttatcaaagcgctatggacgtagaaaggtacttctaattgcagcagctattttttctatttttacaatagtgggaatgttggcacctaactaccaaatttttattagctcaagatttatcttgggtattgcggtaggtattgcttcatttattgcacctttgtatctatcagaaattgccccaaaagagtttagaggcgctttgattgctttgtaccagttaatgataactattggtttatttttggttttcttaactaactctgcattagaaaggacaggttcttggagggttatgcttacagttttagcaattccttcagtaataatgttctttggctgcttgacattacctagaagtccaagatggcttattttaaaaggtaacgataatgaggctgctttggttctcaaaaaaataagatcaagcgaagcagaagcattagaagagcataatgagattaaacaaacaacacatagaagtgttagtgttttttctttactcaagcagaagttttttataaaagttgtactactaggtatagctttgcaggcatttcaacagttcactggtatgaatgcttttatgtattactcaacagatatctttaaattagcaggatttactaatccttcaacatcaacaatagtgatcggtttacttaatatgcttacaacctttttggcaattaagtatgttgataaatttgggcgtaagccaattttatactttggcttaagcttattgataatctcatgtattattgttggttttatctttaaaacacactttgtttatggtcaagcaatggtcttatcacaaacattacaatggactgccttgatattttgtttattgttcatattcgggtttgcaatttctatggggcctgtgatttggattttatgttcagaaatccaaccaattgagggtagagattttggggtaacagcatcgactatgagtaattggatttgtaatgctattataggtaattttgcacttacttggctaacatttcaccctgatagtactttctttggttttgcgatttcttgtataatttgtatattatttgttaagttttttatacctgaaactaaggatgtttcattagaggaaattgaaaacaatcttaggtcaggaaaatctttagcaaaaatcggtcgttaa

SEQ ID NO: 11867 - protein, 459 aa, Francisella tularensis subsp. holarctica
MQTEKINFVVVRVAIIAALAGLLFGMDIGYVNGSLHFISETFGLSVEQSGHVSSVLLLGAACGALFSGFLSKRYGRRKVLLIAAAIFSIFTIVGMLAPNYQIFISSRFILGIAVGIASFIAPLYLSEIAPKEFRGALIALYQLMITIGLFLVFLTNSALERTGSWRVMLTVLAIPSVIMFFGCLTLPRSPRWLILKGNDNEAALVLKKIRSSEAEALEEHNEIKQTTHRSVSVFSLLKQKFFIKVVLLGIALQAFQQFTGMNAFMYYSTDIFKLAGFTNPSTSTIVIGLLNMLTTFLAIKYVDKFGRKPILYFGLSLLIISCIIVGFIFKTHFVYGQAMVLSQTLQWTALIFCLLFIFGFAISMGPVIWILCSEIQPIEGRDFGVTASTMSNWICNAIIGNFALTWLTFHPDSTFFGFAISCIICILFVKFFIPETKDVSLEEIENNLRSGKSLAKIGR

SEQ ID NO: 11868 - DNA, 1413 bp, Saccharophagus degradans 2-40
  CDS (1)..(1413): transl_table=11
atgacagattcagcacttccctcgggggaaaataaatcgtttgtaattctcattagttgtattgcaactattggtgggttcctgttcggcttcgacagcggcgtaattaatggcaccgttgatggcctagtcacgtcatttggcgtaacaaaaacggcagtgggtgtgcacgttgcctttatgttactaggttgtgccgtaggtgccgcagcagccggtcgccttgccgatttatacggccgcagggcaatgcttattgttgcagccatattatttattgtttctgcttggggctcgggcgtagcaacaggcattgtggaatttgatatttatcgtctacttggcggtttagccgtgggcgcagccagtgttatggctccagcctatattagtgaggtagcgccagcgcgatatcgcggcaggctcaccactattcagcaggttgccattattagtggtttaaccgctgcatttttaagtaactatgtgcttgcgcatactgcaggttcttctttagagcctttttggatgggcattgccacgtggcgctggatgttttggatagaaattgcgccggctgctatcttcttttttgcacttatggttattccagaaagcccgcgctttcttgttgccagcggcaaaaaagacaaagcacttactgtgttaactaaattgtacggcgcgcaagcagccccaggtaaagttgcagaaattgactcatcgttagatcacgaccacaaacctcgcctttccgatttaattagtaaagttactggcaaggtgcgccccattgtttgggtgggtattggtcttgctaccttccagcagcttgtgggcattaacgtaattttttattacggctctattctttggcaatcggtgggtttctcagaagatcacgctctgttaattaacgttgtatctggtgcggtaagtattggcgctgtggtgttatcacttgtattagtagataaaattggccgcaagcccctattgtggattggctctgcgggtatggctgttacccttaccttaaccgcaattgcatttgccacgggcacactcgatgcgaatggcgacctacaactaagtgacaatatgggcattctcgcccttgtggcagccaacgtgtatgttattttctttaacatgagttggggccctgttatgtgggttatgttgggcgaaatgttccccaaccaaattcgcgggtctggcttggcggttgcaggtttattccaatgggggtctaactgggccatcaccatgagcttcccggccctactggctggcttgggcttagcggttacctacgggttctacgccttgtgtgcctttatttctatcatctttgttattaagtatgtaaacgaaacaaatggtgtagagctggaagatatggaaggctaa

SEQ ID NO: 11869 - protein, 470 aa, Saccharophagus degradans 2-40
MTDSALPSGENKSFVILISCIATIGGFLFGFDSGVINGTVDGLVTSFGVTKTAVGVHVAFMLLGCAVGAAAAGRLADLYGRRAMLIVAAILFIVSAWGSGVATGIVEFDIYRLLGGLAVGAASVMAPAYISEVAPARYRGRLTTIQQVAIISGLTAAFLSNYVLAHTAGSSLEPFWMGIATWRWMFWIEIAPAAIFFFALMVIPESPRFLVASGKKDKALTVLTKLYGAQAAPGKVAEIDSSLDHDHKPRLSDLISKVTGKVRPIVWVGIGLATFQQLVGINVIFYYGSILWQSVGFSEDHALLINVVSGAVSIGAVVLSLVLVDKIGRKPLLWIGSAGMAVTLTLTAIAFATGTLDANGDLQLSDNMGILALVAANVYVIFFNMSWGPVMWVMLGEMFPNQIRGSGLAVAGLFQWGSNWAITMSFPALLAGLGLAVTYGFYALCAFISIIFVIKYVNETNGVELEDMEG

SEQ ID NO: 11870 - DNA, 1452 bp, Rhodococcus sp. RHA1
  CDS (1)..(1452): transl_table=11
atgactgaaaacgtcctgttgcccggcgcggaatcgcccggcgacacagcagagggcacttcggttcccgtccgtatcgcggtggtcgccgcactcggcgggttgctgttcggctacgacagcgcagtcatcaacggcgcggtgtcggcgatcgagggcaagttccaggtcgattccgctctcctcggattcgcgatcgcctcggcactgctgggcgccgcggcgggagcgatgctggccgggcggatcgccgaccggtacggacgcctcgtcaccatgcgggccgccgcggtgatgttcctgctgagcgccatcggcaccggattcgcggccaacgtcgagatgctggtgacgttccgaatcgtcggcggcatcggtgtgggtctggcctcggtcatcgcacccgcctacatcgccgagatctcgcccgcccgggtgcgtggacgtctcgggtcgctgcagcaactcgcgatcgtcacgggcatcttcgtctcgctcctggtcgactacgctctcgcggccatcgccggcgggtcgcaggaagaactctggttcgggctcgaggcctggcgctggatgttcctcgcgatgtgcgtacccgcactggcctacggactgctgtcgctgacgattcccgaatctccccgctacctgatcgcccagggccgcctcggtgaggcccgcggcatcctcgcggtcctgctcggcgagaagggtctggacctcaagatcgagagcattcgctcgacgctggcccgggagacgcaaccgtcgatccgtgatctgaagggctccgcgttcggccttatgccgatcgtgtggatcggtatcggactctccgtctttcagcagttcgtcggtatcaacgtgatcttctactactccagcgtcctgtggcaggccgtcggcttcgacgagggcagctcactgcagatcacggtcattacgtcggtggtcaacatcgccaccaccctcatcgccatcgcctacatcgaccgggtgggccggcgaccgctgctgatcatcggctccgccggtatggctgtgacactcgcgaccatggcgttcatcttcggcaccgcgtccaccaccgtggtggacggcgtcacgacgccgcagctgaccggactgcagggtccgatcgccctcgtcgccgccaacctcttcgtggtggccttcggaatgtcgtggggccccgtggtgtgggtcctgctcggcgaggcgttccccaaccgcatccgggccgccgccctgtcgctcgccgcgggcgcccagtgggcagcgaactggctgatcaccgtgacgttcccgtccatgaaggacttctcgctgggaatttcgtacggcttctacgcggtgtgcgcggtgctgtccctcgtcttcgtgttgcgctgggtcaaggagacgaagggcgtggaactcgaagccatgcattcggattcggtcgcgtaa

SEQ ID NO: 11871 - protein, 483 aa, Rhodococcus sp. RHA1
MTENVLLPGAESPGDTAEGTSVPVRIAVVAALGGLLFGYDSAVINGAVSAIEGKFQVDSALLGFAIASALLGAAAGAMLAGRIADRYGRLVTMRAAAVMFLLSAIGTGFAANVEMLVTFRIVGGIGVGLASVIAPAYIAEISPARVRGRLGSLQQLAIVTGIFVSLLVDYALAAIAGGSQEELWFGLEAWRWMFLAMCVPALAYGLLSLTIPESPRYLIAQGRLGEARGILAVLLGEKGLDLKIESIRSTLARETQPSIRDLKGSAFGLMPIVWIGIGLSVFQQFVGINVIFYYSSVLWQAVGFDEGSSLQITVITSVVNIATTLIAIAYIDRVGRRPLLIIGSAGMAVTLATMAFIFGTASTTVVDGVTTPQLTGLQGPIALVAANLFVVAFGMSWGPVVWVLLGEAFPNRIRAAALSLAAGAQWAANWLITVTFPSMKDFSLGISYGFYAVCAVLSLVFVLRWVKETKGVELEAMHSDSVA

SEQ ID NO: 11872 - DNA, 1398 bp, Rhodococcus sp. RHA1
  CDS (1)..(1398): transl_table=11
atgacgcagatgtccgaaagacacaccgcgaaggtcatcggcgtcaccgtcgccgccgcggtaggtggatttctcttcggtttcgacagctcggtcatcaacggtgccgtcgactccattcagggccacttcgagctcgggtcgttcttcacgggcttcgccgtggcgatcgccctgctcggatgtgctgtgggcgcatggtttgcgggtcgtctcgcggaccgctggggccgcaagaaagtgatgctgctcggttcggtgctgttcgtcgtgtcctcactcggagcgggtctcgcgttcagcgtccccgacctgatgctgtggcgcgtcctcggcggcctcggcatcggtatcgcgtcggtcattgcgcccacgtacatctcggagatcgcgccggcccgctaccgcggcgcattggcgtcgctgcagcagttggccattactctcggcatcttcgccgcgctgctgtcggacgcggtgctgcagaacgccgccggcggcgcctccaacgagttgtggctgaacctcgaagcctggcgctggatgttcatcgtcggtgtggtccccgcggtcgtgtacggcattctcgccctgctcattcccgagtctccgcggtacctcgtgggcaagcacctcgatcaggaggcggccgacatcctcgcgaacatcaccggcgaactcgacccgcacgagcgcgtctccgagatccggctgaccctccgccacgaatcgacggcgtcgttcgacgatattcgcggcccgaagttcgggctgcagcccatcgtctgggtcggcatattcatggccatcttccagcagttcgtgggcatcaacgcgatcttctactactccaccacgctctggaagtcggtgggcttcaccgagaacgagtcgttcaccacgtcggtgatcaccgcgatcatcaacgtgggcatgacgttcgtcgccatcctgttcgtcgaccggatcggcaggcgcatcctgctcatggtcggctcgctcggcatgttcgcgagcctgctcatggccgcaatcgccttctcccaggcgagtggcagcggcgacgacgtcgtgctccccagcccgtggggggcggtcgccctgatcggcgccaacctgttcgtgatcttcttcgcctccacctggggcccggtcatgtgggtgatgctgggcgagatgttccccaacaacatgcgcgcctacgcactcggcatcagcacggcggcgaactggatcgcgaacttcaccgtcacgctggcattcccgccgctcacccgctcggtggggctgtggttcctgtacggactgttcgcgttcttcgcgttgctctccttcttcttcgtccggtcgaaggtccgggagacgaaggggatggagctcgaggagatgcacacctga

SEQ ID NO: 11873 - protein, 465 aa, Rhodococcus sp. RHA1
MTQMSERHTAKVIGVTVAAAVGGFLFGFDSSVINGAVDSIQGHFELGSFFTGFAVAIALLGCAVGAWFAGRLADRWGRKKVMLLGSVLFVVSSLGAGLAFSVPDLMLWRVLGGLGIGIASVIAPTYISEIAPARYRGALASLQQLAITLGIFAALLSDAVLQNAAGGASNELWLNLEAWRWMFIVGVVPAVVYGILALLIPESPRYLVGKHLDQEAADILANITGELDPHERVSEIRLTLRHESTASFDDIRGPKFGLQPIVWVGIFMAIFQQFVGINAIFYYSTTLWKSVGFTENESFTTSVITAIINVGMTFVAILFVDRIGRRILLMVGSLGMFASLLMAAIAFSQASGSGDDVVLPSPWGAVALIGANLFVIFFASTWGPVMWVMLGEMFPNNMRAYALGISTAANWIANFTVTLAFPPLTRSVGLWFLYGLFAFFALLSFFFVRSKVRETKGMELEEMHT

SEQ ID NO: 11874 - DNA, 1437 bp, Synechococcus sp. CC9311
  CDS (1)..(1437): transl_table=11
ttggcaagatcattcatgcccaagaagagtgcagagctaatggggaatgaacaggggaatcgacgggttcaattcattctgcgaatagcaatttccgccgccttaggcggttttctatttggttatgacacggccgtcatcaatggggctgtgtctgctattcaatccacattcaatgcgtctgcagtgaatctcggacttgcggtgtcatcagcactgttggggtctgcagctggtgccttgggcgctggttggcttgctgatgggattggacgtcgccgaagcatgtggcttgcggcgattttgtttgttgtgagtgcactgggctctgcattggcgccccacttgattgatctggtgatctggcgcgtgattgggggtgtggcggtgggttttgccagtgtgcttgcgcctgcctatatcgcagaaatctcaccatcggagatgcgtggccgcacggggtctttgctgcaattggccattgttctggggatttttattgcgcttttaagtgactatttattggttctttccaccccagatcaaacctccttgtcggctttggggccgatggcggcatggagatggatgttgatgtctgagctggttcctgctgtgatttatggagcgatggtgttgcgaataccagaaagtcctcgttatctggttcaaaaaggtcggattgagcaggctcgtcttgtgatctgccaaacccttggcgagccgacgcaaccggtgattgatcggattcaattcagtcttggcaaccataaagggagctcaattgctgaccttttttcaaggcgatcattgcttttgcctattgtttggacagggatattgctagcgatatttcagcagtttgtgggtattaatgtcatcttttattattcaagctcattatgggagtccgttggtttcagtactacggacagcttggttattactgttgttacttcggtcacgaatgttgtaacgacaatcctggcgatccttacgattgatcgattggggcggcgtcctttgctgctgatcggttctgttgtgatcacgatcagtttggggctaatgagttgggcctttgccggagctcccatcgtgaatggagcacctgtgcttgcaggtgcttcctcatgggtggccttgatgtcagccaacgtttttgtatttgcttttggcttctcttggggaccggtgatgtgggttctgttgggagagatgttcaataaccgcattcgtgccctcgccttggggttgtctgccaccgtgaattggcttgctaattttgtgatctcaaccacgttccctgtcttccttgagacctcaggaccgtcctttgcctatgccctttatgccacggctgctgcgatttcatttttctttgttctattcatggtccgggaaaccaaggggctagaacttgaggatatggtctga

SEQ ID NO: 11875 - protein, 478 aa, Synechococcus sp. CC9311
MARSFMPKKSAELMGNEQGNRRVQFILRIAISAALGGFLFGYDTAVINGAVSAIQSTFNASAVNLGLAVSSALLGSAAGALGAGWLADGIGRRRSMWLAAILFVVSALGSALAPHLIDLVIWRVIGGVAVGFASVLAPAYIAEISPSEMRGRTGSLLQLAIVLGIFIALLSDYLLVLSTPDQTSLSALGPMAAWRWMLMSELVPAVIYGAMVLRIPESPRYLVQKGRIEQARLVICQTLGEPTQPVIDRIQFSLGNHKGSSIADLFSRRSLLLPIVWTGILLAIFQQFVGINVIFYYSSSLWESVGFSTTDSLVITVVTSVTNVVTTILAILTIDRLGRRPLLLIGSVVITISLGLMSWAFAGAPIVNGAPVLAGASSWVALMSANVFVFAFGFSWGPVMWVLLGEMFNNRIRALALGLSATVNWLANFVISTTFPVFLETSGPSFAYALYATAAAISFFFVLFMVRETKGLELEDMV

SEQ ID NO: 11876 - DNA, 1371 bp, Pediococcus pentosaceus ATCC 25745
  CDS (1)..(1371): transl_table=11
atgagtaaggaaaagaagattccaagtggatttatttatttctttggttcatttggtggaattttatttggttatgatattggtgtaatgacaggagcacttcccttcttacaaactgattggaacttgcaaaataatgcgggggtaattggttggattacatctgccgtaatgtttggggccatttttggtggcgctttagccggaaatttgtctgacaaacttggtcgtcggaagatgattttgatttcatcgttagtttttgcgatcggctcacttttgtcagcgctttctccacacgatggacaaatttatttaatcgctgtacgtattttcttaggacttgcagtaggtgctgcatcggcccttgtaccggcttatatgtcagaaatggctccagctcgtttaagaggtcgtctatcaggtattaaccaaaccatgattgtttcaggaatgttgctatcatatattgttgactttttacttaaagatttaccagaacaaatggcttggcgtttaatgcttggtttagccgctgtaccagcagttatcctttatttcggagttttgaaattaccagaatcaccacgtttcctagttaaaagtaatgatattgacggagcaagaagaacgttatcttacatccgtcctgaaaatgaagttgatgcagaattaaaaacaatcagagaaacagcagctgaagaagaatcagctaatactagctcaacattcttagatttattaagcggtaaataccgttacttagtaatcgctggtgttggggtagccgctttccaacaattccaaggtgcaaatgccatcttctattacattccattaattgttgaaaaagcaaccggaaatgctgcaagttcagcattgatgtggcctattatccaaggtgtcattttggttcttggttcactagtattcctatggattgctgataaatttaaacgtcggacattgttaaccatgggtggaacggttatgggactttcatttatccttcccgctgttcttaacatgttcatcaaagatatgaacccaatgatgatcgttgtattcctatgtatctacgtagccttctattcatttacttgggcgccattaacatgggtgatcgtcggagaaatcttcccactagcaattcgtggtaaagcttccggagttgcatcatcattcaactggattggttcattcttagttggtcttttattcccaatcatgacagctaacatgcctcaagaagccgtgttcgcaatctttggaattatttgtttgttaggtgttctatttatcagaacacgtgtacctgaaacaaagggtcacacactagaagaaattgaagaacaaggacttggaaaataa

SEQ ID NO: 11877 - protein, 456 aa, Pediococcus pentosaceus ATCC 25745
MSKEKKIPSGFIYFFGSFGGILFGYDIGVMTGALPFLQTDWNLQNNAGVIGWITSAVMFGAIFGGALAGNLSDKLGRRKMILISSLVFAIGSLLSALSPHDGQIYLIAVRIFLGLAVGAASALVPAYMSEMAPARLRGRLSGINQTMIVSGMLLSYIVDFLLKDLPEQMAWRLMLGLAAVPAVILYFGVLKLPESPRFLVKSNDIDGARRTLSYIRPENEVDAELKTIRETAAEEESANTSSTFLDLLSGKYRYLVIAGVGVAAFQQFQGANAIFYYIPLIVEKATGNAASSALMWPIIQGVILVLGSLVFLWIADKFKRRTLLTMGGTVMGLSFILPAVLNMFIKDMNPMMIVVFLCIYVAFYSFTWAPLTWVIVGEIFPLAIRGKASGVASSFNWIGSFLVGLLFPIMTANMPQEAVFAIFGIICLLGVLFIRTRVPETKGHTLEEIEEQGLGK

SEQ ID NO: 11878 - DNA, 1383 bp, Pediococcus pentosaceus ATCC 25745
  CDS (1)..(1383): transl_table=11
atgaacgctaataaaaaaagaattagtccatatgtaatattgatttcctgtgcagccgctttgggaggacttctgtttggatatgatacagcagttatttcaggagctgttgggttcttacagataaagtttactttgagtagcgcgcaagttggatgggttacgtcttgtatcttaattggatgcgcactaggtgtttcgattgcaggtattttaagtgatttatttggacgcaagaaaatattggcgctttctgcagttatttttgcactttcttctttaggtgctgctttcgcaggaagttatatgattttagtgatttggagaatgcttgcaggtattggtataggattgacttccttaataacacctttatatattgcagaaatggcaccgtcaaatgtgcgtggaaaattggtatccgttaatcaattagctatcacgattggaatttttattgtctattttgttaatgcagcaattgcgtcaaatgcaacgcaattatggaatgtttcaacaggatggagatggatgatgggggttggagtaataccatcgttattatttttaattgcattgatcccggctggtgaaagtccacgttggttatcacaacacggaaaatctgaggctgcttataaagtattacaaaaagttgaaataagtgatgaggctgcagaaaagagcttagaagaaattcagatgtctgaggaagttgttgatgatacaaaatttagagatttatttaataagacttggttaccagtacttattattggagtattgttagccttgttccagcaattttctggaagtaatgcaataatgtattatgctcctgaaatatttaagggtgcaggatttggacaaagtggtgcattcatggctactgtatcaatcggagtaattaatatggtaatcaccattgtcgcattaggtttagtagacaagataggccgtaaaaagttattaggatggggatcttttgcgatgtcatgttgtttacttgttgtttcaatttgtttctttgtacatgctgctactagcataacattgacttttgttttattagcaattgccgcatacgcagtttctttagctcctgtaacgtggatactaatttcagaaatttttccattaaaaatcagaggtagagcaatgtcaatttgtacggcagttttatggctaagtgattttaccttaagttataccttcccaattctgactcagaatataggagaaggatggacttttatgctttatgtagtagttactgcattgtcggctatatttgtatggaaattagttccagaaacaagaggtaagtctttagaggaaatcgaagtatattggcatgctaaaagtaaaacccatgttaaataa

SEQ ID NO: 11879 - protein, 460 aa, Pediococcus pentosaceus ATCC 25745
MNANKKRISPYVILISCAAALGGLLFGYDTAVISGAVGFLQIKFTLSSAQVGWVTSCILIGCALGVSIAGILSDLFGRKKILALSAVIFALSSLGAAFAGSYMILVIWRMLAGIGIGLTSLITPLYIAEMAPSNVRGKLVSVNQLAITIGIFIVYFVNAAIASNATQLWNVSTGWRWMMGVGVIPSLLFLIALIPAGESPRWLSQHGKSEAAYKVLQKVEISDEAAEKSLEEIQMSEEVVDDTKFRDLFNKTWLPVLIIGVLLALFQQFSGSNAIMYYAPEIFKGAGFGQSGAFMATVSIGVINMVITIVALGLVDKIGRKKLLGWGSFAMSCCLLVVSICFFVHAATSITLTFVLLAIAAYAVSLAPVTWILISEIFPLKIRGRAMSICTAVLWLSDFTLSYTFPILTQNIGEGWTFMLYVVVTALSAIFVWKLVPETRGKSLEEIEVYWHAKSKTHVK

SEQ ID NO: 11880 - DNA, 1443 bp, Oenococcus oeni PSU-1
  CDS (1)..(1443): transl_table=11
atggaaaataagaaaacgaatatatcaaaaacaaattatgctttgaattttatcaagacaaaatccaaagccgaacgacatttaaaaataatagccttgtgtgtcacccttggtggtttgctgttcggggttgacactggagtaattaacggggcgctgccctacatggctaaaaaacaagaattaaatctcaaccctgcaactgaaggattagttactagcagtattactttaggagcagcttttggggcaatatttgccggaagattggctgatcgttatggaagaaaaagaattctattttatctatcgattgtcttctttttttgtactgcaatttgttcattagcacctaatgcaataatcatgatgattttcagatttctacttggcttggcagtcggcagtgcatcagtaattgttccaacttttctatccgaaatagctacggttaaactacgtggacctttggtcactcaaaacgaaataatgattaccggaggccagttattggcttttgtggtcaatgcgattttaggaaatatttttgttaacgtatcgaatatttggcgttacatgattgcttttggtatgattccttctgcattgctttttatcggtacactgatcgttcctgaatctccccgctggctgattatgaaaggcaaaaccaagactgctttaaaaatactaaaaggaattcgatcagataagagacaaagccaacaagaagtcactcaaattcaagctactctaaaaaaagaaaaagaagtttcccatataagttggtatgatctcaaaaagccctggattaaaaaactaattatcttaggtagtgggcttggaattgttcaacaaatcgttggaattaatatcattatgtattacggaacaaccgtattaatcaaggccggtttcacccataatatcgccttaattacgaatattgccaacgggattgtttcagtcttggctacatataccggtatgcatttaatgaatcacatcaatcgtcggaaaatgttgctaacgggaattgcaggtacaggtggtgccctggcattgattacactcgtttctcaaatattgccgcattcaaaattgcttccagtatgtgtagtcttcttaacattgatttttttaagtttctttcagggatgcatttcaccaacgatttggcttttgatgtcagaaatttttcctcaaaacctgcgtggtttagggatgggaatctcgactttttttctttggatggcaaatttcctagttggttttcttttccctatatttttaaactattttggtttttcgataactttcggaattttcgttctttgtaacttgatttcattcatttttgtctataaatttgccccggaaacaaggaataaatcactagaacgtgttcaattggaacttagaacaagaattgataagaattag

SEQ ID NO: 11881 - protein, 480 aa, Oenococcus oeni PSU-1
MENKKTNISKTNYALNFIKTKSKAERHLKIIALCVTLGGLLFGVDTGVINGALPYMAKKQELNLNPATEGLVTSSITLGAAFGAIFAGRLADRYGRKRILFYLSIVFFFCTAICSLAPNAIIMMIFRFLLGLAVGSASVIVPTFLSEIATVKLRGPLVTQNEIMITGGQLLAFVVNAILGNIFVNVSNIWRYMIAFGMIPSALLFIGTLIVPESPRWLIMKGKTKTALKILKGIRSDKRQSQQEVTQIQATLKKEKEVSHISWYDLKKPWIKKLIILGSGLGIVQQIVGINIIMYYGTTVLIKAGFTHNIALITNIANGIVSVLATYTGMHLMNHINRRKMLLTGIAGTGGALALITLVSQILPHSKLLPVCVVFLTLIFLSFFQGCISPTIWLLMSEIFPQNLRGLGMGISTFFLWMANFLVGFLFPIFLNYFGFSITFGIFVLCNLISFIFVYKFAPETRNKSLERVQLELRTRIDKN

SEQ ID NO: 11882 - DNA, 1395 bp, Oenococcus oeni PSU-1
  CDS (1)..(1395): transl_table=11
ttgaaacaagctattgagacaattccagcgaataaaaaattaaaatatataaagaaaattgccattttagccacttttggagcttttttgttcggttacgatacgggagtcattaatggctctctttcttttatggctcgaggcgatgagcttaatctctctccgtttatggagggactggtcaccagctctttgttatttggagcggcaattggggccgttatttggggccgtttggctgatagatacggtcgtaaatcaattttacgtgtcttggcgataattttctttttttctacacttggttcttctatcgcaccgaattcatacgttttgattattggcagattgttcatgggtctagcagttggcggagttgccggaattgtgccggtctatttgggagaaatggcaccatccaatattcgtggaagcctggtatgccaagatcaaatgatgattgttttaggacaattactggcttatgtcatgaatggcattttgggaaacgcctttaatgtttcctatatctggcgttttatgattgcactggcagcgattcctgcgattatcctctggatagggacttatattattcccgagacgccccgttggttggcaatcgagaaaaaaagtgatcaggctttagtcgttcttagaaataccagagacgataaaactgctgatcaggatttaaagcatattgaacaaaacattaaaaaagaaagttcaagagggcatgcgagcctgcacgattttcacactccttggattaaaagaattttaattattggaattacgattgcggtaatgcaacaactggccggtatcaatatcatgatgtattatggaacgaccattttggaaaaaacgggtttcagcacgaaggcagctttgattgccaatatcggtaacggagttctatctgttttgggtaccactatatatatgttcttccttgctaaccgaattaaacgtcgacttgcttggattggcggcttctgtttcacgacgactatattagctgccattgcgattttgagtcactatgctgctggactttcgattttgccttatattgttatcacctgtacgatgctgtttgtctttgttgatcaaatgactcttggaccggtttgctggctgcttttatccgagatttttccattgcatgtgcgtggattgggggtcggaattgcgactttcggcatgtggataatggacttcggcgttggcttctttttcccgattttaattgagatctttggtttatcaaatactttttggatttttgccgtgatcggtgtgatttgcataattatttctttctttattattccagaaacatccggaagaagcttggaacagttggaagattcattccgtcgttcataa

SEQ ID NO: 11883 - protein, 464 aa, Oenococcus oeni PSU-1
MKQAIETIPANKKLKYIKKIAILATFGAFLFGYDTGVINGSLSFMARGDELNLSPFMEGLVTSSLLFGAAIGAVIWGRLADRYGRKSILRVLAIIFFFSTLGSSIAPNSYVLIIGRLFMGLAVGGVAGIVPVYLGEMAPSNIRGSLVCQDQMMIVLGQLLAYVMNGILGNAFNVSYIWRFMIALAAIPAIILWIGTYIIPETPRWLAIEKKSDQALVVLRNTRDDKTADQDLKHIEQNIKKESSRGHASLHDFHTPWIKRILIIGITIAVMQQLAGINIMMYYGTTILEKTGFSTKAALIANIGNGVLSVLGTTIYMFFLANRIKRRLAWIGGFCFTTTILAAIAILSHYAAGLSILPYIVITCTMLFVFVDQMTLGPVCWLLLSEIFPLHVRGLGVGIATFGMWIMDFGVGFFFPILIEIFGLSNTFWIFAVIGVICIIISFFIIPETSGRSLEQLEDSFRRS

SEQ ID NO: 11884 - DNA, 1377 bp, Oenococcus oeni PSU-1
  CDS (1)..(1377): transl_table=11
ttgaaagcacatcatttaaatatattttttatttttgtttttggtgccttgggaggtttgctcttcggttttgatactgggattatttccggtgcatcatctttaatcgaaagtgatttcagtctaaatatcgaacaaactggcttcattacatcttctgttttgatcggatcatcgattggggccctgtctgttggttctttatccgacaagttcggtcgtaaaaaattgttaattctggcctcggttttattcttaatcggatctgggctatcaatgtcggctgtcggttttgtttcaatggttatcgctcgtatcattctgggttttgccgtgggatccgcttcagccttaactccggcttacttggccgaattagctgatgccccacatagaggatcattaggaagcatgttccagctaatgattacccttggtattttattggcatatgtttctaatctcggcttcctgggtcacaatttgttagggcttcgtgattggcgttggatgctcggatcggcattaataccggctttaattttattcataggttcgattgtcctaccggaatcaccacgttatctggtagaaaaaggaagaatcgatgaagctcgaagtgtccttcactacttgcgtgaaaaaaccaacgaagatcctgataaggaactagcagatattaaaaaagtttccaatcagcccaaaggcggttttaaagaactttttacttttgcccgtccagccgtcattgttgcgattggactgatgcttttacaacaattggttggtattaattccgttatctactttttgccacaggtctttattaaaggattcggctttcaagcaggcaatgctatctggatctcagtcggcattggtgttgttaattttctatgtaccgttttggcatacaatatcatggacaaatttaaccgtcgcacaatccttttgtttggatcgattgtaatgtcagtatcaattggaattttgtccgtgcttaactttactctcagtattaaacaagcggccattccgacaatgattctcattgcgatatatatctttggttttgccgtttcctggggaccaatttgctggttaatgattggtgaaatcttcccattgaatattcgtggagtcggcacatcgataggatcagctgctaactggattgcaaactttattgtttctcaattctttctcgtattattggcaactttccattacaatgtcggtgggccgtttgcaatcttcactttctttgccattctttcaatattcttcgtgatctatctcgttccagaaaccagaggaaaatcacttgagcaaattgaaatggatatgcgtcgtaagccgctgccaaagaaaaactga

SEQ ID NO: 11885 - protein, 458 aa, Oenococcus oeni PSU-1
MKAHHLNIFFIFVFGALGGLLFGFDTGIISGASSLIESDFSLNIEQTGFITSSVLIGSSIGALSVGSLSDKFGRKKLLILASVLFLIGSGLSMSAVGFVSMVIARIILGFAVGSASALTPAYLAELADAPHRGSLGSMFQLMITLGILLAYVSNLGFLGHNLLGLRDWRWMLGSALIPALILFIGSIVLPESPRYLVEKGRIDEARSVLHYLREKTNEDPDKELADIKKVSNQPKGGFKELFTFARPAVIVAIGLMLLQQLVGINSVIYFLPQVFIKGFGFQAGNAIWISVGIGVVNFLCTVLAYNIMDKFNRRTILLFGSIVMSVSIGILSVLNFTLSIKQAAIPTMILIAIYIFGFAVSWGPICWLMIGEIFPLNIRGVGTSIGSAANWIANFIVSQFFLVLLATFHYNVGGPFAIFTFFAILSIFFVIYLVPETRGKSLEQIEMDMRRKPLPKKN

SEQ ID NO: 11886 - DNA, 1380 bp, Leuconostoc mesenteroides subsp. mesenteroides ATCC 8293
  CDS (1)..(1380): transl_table=11
atggaaaatggatccacaaaaagaatcgccagttcatttatatatttctttggtgcatttggcggcattttatttggttacgatattggcgttatgactggcgctttaccatttttacaaaaagactggcatctaacagatgcaggaactatcggttggatcacttcaacccttatgttaggagcaattcttggcggcgcattagctggacaactgtcagatagattaggtcgtcgtcgaatgatactggcttcatcatttatctttgcagttggtgcaattatggctggtgtttctccaaataatggggtggtgtggttattaattgctcgcttcctcttgggcttagcagttggtgcagcttcggcattagtaccttcatatatgtccgaaatggcacctgccaaaaatagaggtcggctatccgggttgaatcagctgatgattgtttctggaatgcttttatcatatatcgttgactatttgctacaaggcttgccgcatacgattgcttggcgattaatgcttggattagcagctgtgccggcaatcatacttttcgttggtgttcttcgtttacctgagtcaccacgatttttagtgaaaacgcacaaattagccgaagcacgacaagtgttaacttatattcgtactgccagtgaagtggatccagagctagaagacatacaaaatactgtagcaattgagtccggtgcgcaaaaaaatattactttaagtacattattttccagtaagtatcgatatttagtcaccgcgggtattggtgtggcagctttccaacagtttatgggtgccaacgcaatattttactacattccgttgattgttgaaaaagcaagtggacaagctgcgtcaagcgcattactatggccaatcgtacaaggtgtgatacttgtcctaggcgcgttgttgtatatggtaatagcagacaagttcaaacggcgtacgctactgatggtcggtggaaccgtaatggcattgtcattcttaatgccatcagcactcaatgcattggtgggtgcagacaagtttccacctatgctgatagtggtatttctgtcaatatttgttgctttctattcattcacttgggcaccactcacctgggtattagttggtgaggtatttccgctagcaattcgcggtcgtgctagtggattggcatcgtcatttaattggcttggttcctttgctgtagggttattatttcctatcatgacggctgccatgccgcaagcaacggtatttgctatctttggtgtaatttcaatcatcgccgtcttatttattaagtttgccgtacccgaaactcatggcagaacgcttgaagaaatagaagcgcaaggaacaaaccattaa

SEQ ID NO: 11887 - protein, 459 aa, Leuconostoc mesenteroides subsp. mesenteroides ATCC 8293
MENGSTKRIASSFIYFFGAFGGILFGYDIGVMTGALPFLQKDWHLTDAGTIGWITSTLMLGAILGGALAGQLSDRLGRRRMILASSFIFAVGAIMAGVSPNNGVVWLLIARFLLGLAVGAASALVPSYMSEMAPAKNRGRLSGLNQLMIVSGMLLSYIVDYLLQGLPHTIAWRLMLGLAAVPAIILFVGVLRLPESPRFLVKTHKLAEARQVLTYIRTASEVDPELEDIQNTVAIESGAQKNITLSTLFSSKYRYLVTAGIGVAAFQQFMGANAIFYYIPLIVEKASGQAASSALLWPIVQGVILVLGALLYMVIADKFKRRTLLMVGGTVMALSFLMPSALNALVGADKFPPMLIVVFLSIFVAFYSFTWAPLTWVLVGEVFPLAIRGRASGLASSFNWLGSFAVGLLFPIMTAAMPQATVFAIFGVISIIAVLFIKFAVPETHGRTLEEIEAQGTNH

SEQ ID NO: 11888 - DNA, 1497 bp, Mycobacterium smegmatis str. MC2 155
  CDS (1)..(1497): transl_table=11
gtgaatgtgatcggtatcactctcctgccgagagggcgcatcatgtcacacggtccggtaagcgacgacaccccgtcgatcttcggtgacgacgatcaggcggcctcctccggtcgcaccgcggtccggatcgcggcggtcgcggccctcggcggtctcctgttcggctacgacagcgccgtcatcaacggtgccgtggactcgatccaggaggacttcggcatcggcaattacgccctgggccttgccgtggcgtcggcgctgctgggtgctgccgcaggcgctctgtcggccggccgtatcgccgaccgcatcgggcgcatcgcggtgatgaaaatcgccgccgtcttgttcttcatcagcgccttcggaacgggtttcgcacccgaaacggtcactctcgtggtgttccgcatcgtcggtggtatcggcgtgggtgtggcatcggtgatcgcacccgcctacattgccgagacctctccgccgggaatccggggacgcctcggatcgctgcagcaactggccatcgtgctgggcatcttcacgtcctttgtcgtcaactggctgttgcagtgggcggcgggcggtcccaacgaggtgctggcgatgggactcgacgcatggcgctggatgttcctggccatggccgtaccggccgtcctgtatggggcgctcgcgttcaccatcccggagtcgccgcgttatctcgttgccacacacaagatcccagaagcacgccgggtgctgagcatgctgctcgggcagaagaacctggagatcaccatcacgcgtatccgcgacacccttgagcgcgaggacaaaccgtcgtggcgtgatctgaagaaacccaccggcgggatctacgggatcgtgtgggtcggtctcggtctgtcgatcttccagcagttcgtcggtatcaatgtgatcttctactactcgaatgtgctgtggcaggccgtcggtttcagcgccgaccagtccgcgatctacaccgtgatcacgtcggtggtcaacgtgctgacgacgttgatcgcgatcgcgctgatcgacaagatcggccgcaaaccgctcctgctgatcggctcgtccggcatggcggtcacgctggccaccatggcggtcatcttcgccaatgccacggtcaagcccgacggcacgcccgacctgcccggcgcgtccggcttgatcgcactcatcgcggcgaacctgttcgtggtcgctttcggtatgtcgtgggggccggtggtctgggtgctgctgggggagatgttccccaaccgcttccgtgcggccgcgctgggcctggcggcggccgggcagtgggccgcgaactggttgatcaccgtcagcttccccgagctgcgcaaccacctgggcctggcctacggcttctatgccctctgtgcggtgctgtcgttcctcttcgtgagcaagtgggtcgaggagaccaggggtaagaatctggaggacatgcacgccgaagcgctggggcactga

SEQ ID NO: 11889 - protein, 498 aa, Mycobacterium smegmatis str. MC2 155
MNVIGITLLPRGRIMSHGPVSDDTPSIFGDDDQAASSGRTAVRIAAVAALGGLLFGYDSAVINGAVDSIQEDFGIGNYALGLAVASALLGAAAGALSAGRIADRIGRIAVMKIAAVLFFISAFGTGFAPETVTLVVFRIVGGIGVGVASVIAPAYIAETSPPGIRGRLGSLQQLAIVLGIFTSFVVNWLLQWAAGGPNEVLAMGLDAWRWMFLAMAVPAVLYGALAFTIPESPRYLVATHKIPEARRVLSMLLGQKNLEITITRIRDTLEREDKPSWRDLKKPTGGIYGIVWVGLGLSIFQQFVGINVIFYYSNVLWQAVGFSADQSAIYTVITSVVNVLTTLIAIALIDKIGRKPLLLIGSSGMAVTLATMAVIFANATVKPDGTPDLPGASGLIALIAANLFVVAFGMSWGPVVWVLLGEMFPNRFRAAALGLAAAGQWAANWLITVSFPELRNHLGLAYGFYALCAVLSFLFVSKWVEETRGKNLEDMHAEALGH

SEQ ID NO: 11890 - DNA, 1401 bp, Nostoc punctiforme PCC 73102
  CDS (1)..(1401): transl_table=11
atgtcttctactactgttcgtcgtaaatccaacacgttttatgtcattttgattgctggtgctgctgccctcggcgggtttttattcggttttgataccgctgtgattaacggcgcggttttatcattagccaaagcttttaacaccagtagttgggtgacaggactggcagtgtctctcgcgttactaggatctgcggtaggagccttttttgccggacagattgcagaccgttatggtcgagtcaaggcaatggtggtcgcttcggtgttgtttactatcagtgccattggctctgggatggccttcacaatttgggattttatcttttggcgagtattgggtgggattggaatcggcgttgctagcgtaatcgccccagcttatattgcggaatgttctcctacccatttgcggggaaggttaggatctctgcaacaattagcgatcgtagtgggaattttcgttgccttattgagcgactactttatcgctacgtcagcaggttcagcagactcgccgtttttgtttggggttgcagcttggcgctggatgttttggacagcagtcccaccagcagtattctacgggatggtagctttaacaattcctgaatctccccgttatttggttgccaaaggacgagaatcagaagctgttaacgttctgaccaagattttgggaggtgacgtactgccaaaaatcgaagaaattcggcagacagtgcttcgcgaacgccaacccaaattttctgacctcttaagcagaagtggcggactcctccccattgtttggataggaatcggcttatctgtattacaacaatttgttgggattaatgtaatcttttactacagtagtgttttgtggcgggcagtcgggttttccgaaaaagattccctatcaatcacggtgattacaggagccgtcaacattattacaacactgattgcgatcgcctttgtggataaatttggtcgcaagccgttgctaataataggttcaattggcatgaccctgaccttggggacaatggcttatatttttggtaatgctcccctagatgctgctggaaatccttccctcgccggaagcgctgggactgtggctctcatcgccgccaacctctacgtgttttgcttcggtttctcctgggggccgatagtttgggtgttgttgggagaaatgtttaataacaagattcgagcggctgcactttcagttgctgctgcaatccaatgggttgcgaatttccttatttccacaacatttcctcccatactccaatatttcggtctaggttctgcctatggactttatacaattgcggcggctacctcattctttttcattctcttttttattaaagaaaccaaaggaattgagttggaagacatgtaa

SEQ ID NO: 11891 - protein, 466 aa, Nostoc punctiforme PCC 73102
MSSTTVRRKSNTFYVILIAGAAALGGFLFGFDTAVINGAVLSLAKAFNTSSWVTGLAVSLALLGSAVGAFFAGQIADRYGRVKAMVVASVLFTISAIGSGMAFTIWDFIFWRVLGGIGIGVASVIAPAYIAECSPTHLRGRLGSLQQLAIVVGIFVALLSDYFIATSAGSADSPFLFGVAAWRWMFWTAVPPAVFYGMVALTIPESPRYLVAKGRESEAVNVLTKILGGDVLPKIEEIRQTVLRERQPKFSDLLSRSGGLLPIVWIGIGLSVLQQFVGINVIFYYSSVLWRAVGFSEKDSLSITVITGAVNIITTLIAIAFVDKFGRKPLLIIGSIGMTLTLGTMAYIFGNAPLDAAGNPSLAGSAGTVALIAANLYVFCFGFSWGPIVWVLLGEMFNNKIRAAALSVAAAIQWVANFLISTTFPPILQYFGLGSAYGLYTIAAATSFFFILFFIKETKGIELEDM

SEQ ID NO: 11892 - DNA, 1551 bp, Bifidobacterium longum DJO10A
  CDS (1)..(1551): transl_table=11
atgacgacgacggcatcacccgtatcgaagcagacggcatccgcggcacaggagaccggcgcaaccggtgcagcggccaccgcaatcgaaaccatcgaaaccggcgtggccggggtggcggacgcggccacaaacgcggcagcaaacgcaatcgaggacctcgaagccgccgaatcacgcggcttctccacgcgcttcccgctcaacagcgcattcatcttcaccttcggcgcgctcggcggcatgctgttcggtttcgacaccggcattatctccggcgcctccccgcttatcgaatcagacttcggcctgagcgtctcccagaccggcttcatcacctcctcggtgctgatcggctcgtgcgcaggcgcgctgtcgatcggcgcactgtctgaccggttcggccgcaagaagctgctcatcgtctccgcgctgctgttcctgctcggctcaggcctgtgcgcctcctccaccggattcgcgatgatggtgtgcgcccgcatcatcctgggtctcgccgtcggcgcggcctccgccctgaccccggcgtacttggccgaactggcgccgaaggagcgtcgcggctcactgtccacgctgttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgttgctgcccgaatccccgcgttatctggtgaacaagggcgacacccgcaacgccttcaaagtgcttacgctgattcgcaaggacgtggatcagacccaggtgcagattgagctggacgaaatcaaggccgtggccgcacaggacaccaagggtggtgtgcgcgaactgttccgtatcgctcgtccggcgctggtggccgccatcggtatcatgctgttccagcagctcgtgggcatcaactcggtgatctacttcctgccgcaggtgttcatcaagggcttcggcttccctgaaggcgacgcgatctgggtgtcggtgggcatcggcgtggtgaacttcgtgagcaccatcgtggccacgcttatcatggatcgtttcccgcgcaagggcatgctgatcttcggttccatcgtgatgaccgtttcgctcgcggtgctcgccgtgatgaacttcgtgggcgacgtggccgtgctggcagtgccgacgatgattctcatcgctttctatatcctcggctttgcggtctcgtggggcccgatcgcctgggtgcttatcggcgagatcttcccgctgagcgtgcgcggcatcggctcatccttcggctcggcggcgaactggctgggcaacttcatcgtctcccagttcttcctcgtgctgctcgatgcgttcggcaacaatgtgggcggcccgttcgcgattttcggcgtgttctcggccctgtccatcccgttcgtgctgcgcttggtgcccgagaccaagggcaagtcgctggaggaaatcgagaaggaaatgaccaagcgctag

SEQ ID NO: 11893 - protein, 516 aa, Bifidobacterium longum DJO10A
MTTTASPVSKQTASAAQETGATGAAATAIETIETGVAGVADAATNAAANAIEDLEAAESRGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 11894 - DNA, 1461 bp, Kineococcus radiotolerans SRS30216
  CDS (1)..(1461): transl_table=11
atgtcccaggagaacgggcgcggtcccgaccgcgccgacgccgaggagcggcagcgcaccacgacgaaggtcgtgctcatctcggtcgtcgccgccatcggggggttcctcttcggcttcgacaccgccgtcgtcaacggcgcggtggacgccgtcgccgaggagttccgcctcgcggcggggctgaagggcttcgcggtgtcctgcgcgctgctgggggcggcggtgggggcctggttcgccggccggctggccgaccgcttcggccgcaaggcggtcatggtgatcgccggggcgctcttcgccgtcagcgccgtcgggtccgccttcgccttcggcgtgtgggacctgatcctgtggcgcgtcgtcggcggtgtcggcgtcgggatcgcctcggtcatcgccccgacctacatcgccgaggtcgcccccgcccacatccgcggccggctggcctcgctgcagcagctcgccatcaccgtcggcatcttcgccgccctgctctccgacgccttcatcgccaacaccgccggcggggcctcggagacgacgtggttcgggtgggacgcgtggcggtggatgttcgtggtcggggtcatcccctcgctggtctgggcgttgctggccctgcagatcccggagtccccgcgctacctcatcgcccaggggaagacccagcgcgccggcgaggtgctgcgcgaggtcctgggcacccgcagcctggaggccgtgcagcgcaaggtcgccgacatcaagaactcgatgcgccgcgaggacgagcccagcctgcgcgacctgcgcgggccgaggttcggcctgctgcccatcgtctgggtcgggatcctgctgtcggtgctgcagcagggcatcggcatcaacgtgatcttctactactccaccacgctgtggaaggccgtcggcttcgacgagtccgacgccttcaccacctcggtcatcacctcggtcaccaacgtcgtcgtgacgttcatcgccatcgccaccgtcgacaggatcgggcgcaagccgctgctgaccgtcggctcggcgggcatgttcctctcgctcacggtcatggcgatcgccttctcccaggccagcggcagcggccaggacgtctcgctgccgcagccgtgggggaccatcggcgtcatcgccgccaacgtctacgtcatctccttcggcgccacctggggcccggtcgtgtgggtgctgctgggcgagatgttccccaacaggatccgggccgccggtctggccgtggccgcggccgcgcagtggctggcgaacttcgcgatctcgacgagcttcccgtcgctggccaagctgggcctgcagtacgcctacggcctctacgccgtcatcgcgctgctgtcgttcgtcttcgtccgccgggccgtgcaggagaccaagggccgcgagctggaggagatcggcgccgagaccacgagcaccgcgccgtga

SEQ ID NO: 11895 - protein, 486 aa, Kineococcus radiotolerans SRS30216
MSQENGRGPDRADAEERQRTTTKVVLISVVAAIGGFLFGFDTAVVNGAVDAVAEEFRLAAGLKGFAVSCALLGAAVGAWFAGRLADRFGRKAVMVIAGALFAVSAVGSAFAFGVWDLILWRVVGGVGVGIASVIAPTYIAEVAPAHIRGRLASLQQLAITVGIFAALLSDAFIANTAGGASETTWFGWDAWRWMFVVGVIPSLVWALLALQIPESPRYLIAQGKTQRAGEVLREVLGTRSLEAVQRKVADIKNSMRREDEPSLRDLRGPRFGLLPIVWVGILLSVLQQGIGINVIFYYSTTLWKAVGFDESDAFTTSVITSVTNVVVTFIAIATVDRIGRKPLLTVGSAGMFLSLTVMAIAFSQASGSGQDVSLPQPWGTIGVIAANVYVISFGATWGPVVWVLLGEMFPNRIRAAGLAVAAAAQWLANFAISTSFPSLAKLGLQYAYGLYAVIALLSFVFVRRAVQETKGRELEEIGAETTSTAP

SEQ ID NO: 11896 - DNA, 1410 bp, Synechococcus sp. RS9917
  CDS (1)..(1410): transl_table=11
atggcccccagtcttcagcgccgcgaagccgatcagcggatccaattcatcctgcggcttgcgattgcggcggccttgggcggcttcctcttcgggtatgacacggcggtcatcaatggggccgtgtcctcgattcaggccacattcaacgcctcggcgatggggctcggtctggcggtgtcgtcagccttgctcggttcagccgctggtgctctcggagccggctggctggcggatcgcatcggtcgccggcgcagcatgtggcttgcggcggtgctcttcatcgccagtgcggtcgggtccgccctggcaccgacgctgcgcgatctggtgatctggcgtgtgatcggtggtgtggccgttggttttgccagcgttctggcgccggcttacatcgctgagatttctccggccaacttgcgggggcgcaccggttcgctgcagcagttggcaattgtggtggggatttttatcgcgcttctgtttgattacgtgatcgtgctggccacggtggatcaggagccgctctccagtgtgggcccgctgcccgcctggcgctggatgttgatgtctgagctgatcccggcgttgttgtacggcggcatggtgctgaggattcccgaaagccctcgctatctggttcagatcggttgcattgagcatgcccgcgaggtgattctcaagactctgggtgaacccacccaggaggtgattgatcgcattcaggccagcctcggccatcgcaatggtggacagattcaggatctgttctcgaagcgttccctgcttttgcccgtggtgtggactggcgtgctgttggcgatcttccagcaattcgttggcatcaacgtgatcttctactactccagttctctctggaaggcggtgggattcagcaccaccgacagcctcagcatcacggtggtgacgtcgatcaccaatgtggtcaccacatttttggcgattgccacgattgaccgcctcgggcggcggcccctgctgctggctggctccgtggtgatcacgatcagcctgggattgatgagctggacgtttgccggcgctccgattgtcaacggcgaaccgcagctgaccggcgccgcctcgttggtggccctgatttcggcgaatgtgtttgtgtttgccttcggtttctcctgggggccggtgatgtgggtgcttttgggtgagatgttcagcaatcgcatccgcgccctggccctggggctctccgccaccgtcaactggctggctaatttcctcatttccaccaccttccccgtgttgctccagtcatcggggcctgcgctcgcctatggcttgtatgccacagctgcagcgatctccttcttcttcgtgttgttcatggtgcgggaaacgaaggggcgtgagctggaagacatggcctga

SEQ ID NO: 11897 - protein, 469 aa, Synechococcus sp. RS9917
MAPSLQRREADQRIQFILRLAIAAALGGFLFGYDTAVINGAVSSIQATFNASAMGLGLAVSSALLGSAAGALGAGWLADRIGRRRSMWLAAVLFIASAVGSALAPTLRDLVIWRVIGGVAVGFASVLAPAYIAEISPANLRGRTGSLQQLAIVVGIFIALLFDYVIVLATVDQEPLSSVGPLPAWRWMLMSELIPALLYGGMVLRIPESPRYLVQIGCIEHAREVILKTLGEPTQEVIDRIQASLGHRNGGQIQDLFSKRSLLLPVVWTGVLLAIFQQFVGINVIFYYSSSLWKAVGFSTTDSLSITVVTSITNVVTTFLAIATIDRLGRRPLLLAGSVVITISLGLMSWTFAGAPIVNGEPQLTGAASLVALISANVFVFAFGFSWGPVMWVLLGEMFSNRIRALALGLSATVNWLANFLISTTFPVLLQSSGPALAYGLYATAAAISFFFVLFMVRETKGRELEDMA

SEQ ID NO: 11898 - DNA, 1386 bp, Photobacterium sp. SKA34
  CDS (1)..(1386): transl_table=11
atgaaacatcctaatgttttacaaataaccctagtggtcgcacttggcggtctcctcttcggttatgatactgctgtcatttcaggagcaacagaatctctacaaacattctttaaccttaatccagcagaacttggctttgccgctgcatcggcactaataggctgtgtaattggtgcaatcgccgcaggttataccagtacaaaatacggacgccgtggtgcgttacttattgctgcattattattcttcatttcggcgttaggctcagctatcccagaccaatattggacctttattttctatcgcattattggtggtattggtgtgggtatcgcttcaatggtttcacctatgtatattgctgaaatagcaccgccacaaaaacggggcgcgcttgtatcatgtaatcagtttgcgattatttttggtatgttagtggtatattttgtcaattatggtattgccttaatgggctctgaatcttggctaaatgagatgggctggcgttatatgtttggttcagaaatgatccctgcaggtctatttttctgcttattatttagcgttccagaaacacctcgatggcttgcaatgcgcggacgtgatgaacaagcaaaagaattattatctaaaattagtaaaggaaaagactttgataaccaatggaaagagataaaggattcattggttgaagttggtaccgcaagtgtcacctctcgaaaaattttacctattttagtgatcggaataatgttgagcgttttacaacaagtcactggtattaatgtttttctttactatgctccagtaattttgaaaagctttagttcatcaagtactgatctagcacttctccaaacaatattagttggtgcggtaaatcttacctttactgttattgcgattatcactgttgataaatacggtcgaaagccactcatgatgttaggatctggcttgatggctgttagtatgatagcgatcggtacagctgcttatttgaacgcaattggtggatacctactcttctttgttctcacttatattgctgcatttgcattatcgttaggtccagttacttgggtacttctttctgagatattcccgaataatgttcgttcaaaagccttgtcaatcgccgtttttgcgcaatgggtcgctaactatgctgtatctcaaacattcccaatgatgaatgatcaaaatagttggctatttaaagaatttaacggtggttttccattctggttctatggtgttatgggcttagtgacaatttattttgttcatcgctttgttccagaaacaaaaggaaagtcgttagaagaattagaagaattatgggaaaagcctgatgagttagagacagtcactcacaattaa

SEQ ID NO: 11899 - protein, 461 aa, Photobacterium sp. SKA34
MKHPNVLQITLVVALGGLLFGYDTAVISGATESLQTFFNLNPAELGFAAASALIGCVIGAIAAGYTSTKYGRRGALLIAALLFFISALGSAIPDQYWTFIFYRIIGGIGVGIASMVSPMYIAEIAPPQKRGALVSCNQFAIIFGMLVVYFVNYGIALMGSESWLNEMGWRYMFGSEMIPAGLFFCLLFSVPETPRWLAMRGRDEQAKELLSKISKGKDFDNQWKEIKDSLVEVGTASVTSRKILPILVIGIMLSVLQQVTGINVFLYYAPVILKSFSSSSTDLALLQTILVGAVNLTFTVIAIITVDKYGRKPLMMLGSGLMAVSMIAIGTAAYLNAIGGYLLFFVLTYIAAFALSLGPVTWVLLSEIFPNNVRSKALSIAVFAQWVANYAVSQTFPMMNDQNSWLFKEFNGGFPFWFYGVMGLVTIYFVHRFVPETKGKSLEELEELWEKPDELETVTHN

SEQ ID NO: 11900 - DNA, 1422 bp, Photobacterium sp. SKA34
  CDS (1)..(1422): transl_table=11
atggcgacagtaataacagaagagcgatccaatggaacgctttctttagaaaaaagtgacctcaataaaaatgtctttattgcctgtcttattgcggcattagcgggcttattatttggcctagacattggtgtgatttctggcgcgttgccttttattgctaaagaattcggtttagcgacacacacacaagagtgggttgttagttcaatgatgtttggagccgcttttggtgcgattggctctggaccgctatcaaacaagtttggtcgtaaatatagcttagttgttgcttcaatattatttacgataggttctttgggctgtgcattagcgaataacactgaaatattaattatatttcgtattttcctcggactagctgtaggcgttgcttcattcactgccccattatatttgtctgaaattgcgccacaaaaactgcgtggtagcttaatctccatgtatcaattgatgattactattggtatcgtcgttgcctttttgtctgataccgcttttagctatgagggacaatggcgctggatgttaggtgtgattacagtaccagctttaattttattaattggcgtacttatgctacctcgaagcccacgttggttagctttaaaagggcgtcatactgaagcaaaggaagtgcttgaattattgcgtggtagtgatgagactgcaaaacatgaactcgacgctattcgtgaaagtttaaaggtaaaacaaagtggctggtcattatttaaaaccaatcgtaattgtcgccgagctgtttatttaggtgtcacattgcaggtaatgcaacagtttactggtatgaacgtaattatgtattacgcaccaaaaatcttcaagattgccggctttgcaagtactgaacaacaaatgtggggaactgtgatcgtaggtttagtgaatgtatttgcgacctttattgcgataggtttagttgataagttaggtcgtaaaccaattttgaaacttggctttttagtcatgtctgcgagtatggctacattaggttttcttttaaaccaaggagtaacaacatctttcgaacaatatttcgcagccttcgttttacttatctttatcgttggttttgcaatgagtgcaggtccgcttatttgggtattatgctctgaaattcagccactgaaagcacgtgactttggcataactgtgagtactgcaactaactggattgcaaacatgattgttggcgctactttccttactttcttacaggtactcggaaattcgcaaacgttctggctttatgctgtgcttaatataatcttcctttttgttacccttatcttaatccctgaaacaaaagggattagtctggagaagattgagcaaaacctaatgactggtgtacctttgtctaaacttggaaaaaaataa

SEQ ID NO: 11901 - protein, 473 aa, Photobacterium sp. SKA34
MATVITEERSNGTLSLEKSDLNKNVFIACLIAALAGLLFGLDIGVISGALPFIAKEFGLATHTQEWVVSSMMFGAAFGAIGSGPLSNKFGRKYSLVVASILFTIGSLGCALANNTEILIIFRIFLGLAVGVASFTAPLYLSEIAPQKLRGSLISMYQLMITIGIVVAFLSDTAFSYEGQWRWMLGVITVPALILLIGVLMLPRSPRWLALKGRHTEAKEVLELLRGSDETAKHELDAIRESLKVKQSGWSLFKTNRNCRRAVYLGVTLQVMQQFTGMNVIMYYAPKIFKIAGFASTEQQMWGTVIVGLVNVFATFIAIGLVDKLGRKPILKLGFLVMSASMATLGFLLNQGVTTSFEQYFAAFVLLIFIVGFAMSAGPLIWVLCSEIQPLKARDFGITVSTATNWIANMIVGATFLTFLQVLGNSQTFWLYAVLNIIFLFVTLILIPETKGISLEKIEQNLMTGVPLSKLGKK

SEQ ID NO: 11902 - DNA, 1371 bp, Xanthobacter autotrophicus Py2
  CDS (1)..(1371): transl_table=11
atgatgtatctcatcgccgctatagccggcatcgccggggcgctgttcggcttcgacgaaggcgtcatcgccggcgccttggcaccgctgcgccgcgacctcggtatcgaccccgtcgccgagggcatgatgacggccgccgtgccgttcggcgcgttcctcggcgccattgtcggcggccgcctcgccctggccctgggtcggcgccggctgctgctggccgccgccgtcctgttcgtggtcggcgcgctcctgagcgccttcgccttcgggttgtggaccctcaccttcgcccggctcatcatcggcctcggcgtcggcgtcgccgccatgatggcgccgctctacatttccgaatgcgcgccggctgcgcagcgcggcatgctggtctccatctaccagctcgccatcacgctcggcatcctcggcgcctatgtggtgggctacgccttccacgaatcctggcgctggatgttcgcggtgggcgcggtgccggccatcgccctgttcgtgggcatcttcggcctgtcggacacgccgcgctggctcgccgtgcgcggccgggaagccgaggcccgggcggcgctggcccgcgtgcgcgagaagtccgagagcgacccggcggtgaaggccgagttcgccgagatcctcaccggcgccacccaggacgagaaccgcaaggcgcgcctgtccgacctgctcaccccgcgggtgcggccggcgctcatcgtcgccatggggctgttcctgttgcagcagctttcgggcatcaacgcggtgatctattacgcccccaccgtgttcgagctgtccggcttcagctccaccaccacccagatcctggccaccgccggcatcggcgtggtcaacgtgctgatgaccctcgtcggcatggccctcatcgaccggctgggccggcgactgctgctgctgatcggctttgccggcacggcggtggcgctgagcgtcatcgccatcggcgcggccaccggcagcgagatgatgggcaagctcgcccttggcgggctggtgctttacatcgcctccttcgccatcgccatcggcccgctgccttgggtgatgatgtccgaggtgttcccgctcgacgtgcgggcgctgggcatgagcatcgcctcgctggtcaactggggcttcaacttcctggtggtgttcagcttcccggtgctggtggcggagttcggcctggccggcgtgttcggcctctatgcggtggtctgcgtggtcggcctcgccttcacccaatggctggtgcccgaaacctccggcgtgagcctggaggagatcgagcgccatctcgacagcggccgccccctgcgggacctcggccgcttcacgccccgtgccgcctga

SEQ ID NO: 11903 - protein, 456 aa, Xanthobacter autotrophicus Py2
MMYLIAAIAGIAGALFGFDEGVIAGALAPLRRDLGIDPVAEGMMTAAVPFGAFLGAIVGGRLALALGRRRLLLAAAVLFVVGALLSAFAFGLWTLTFARLIIGLGVGVAAMMAPLYISECAPAAQRGMLVSIYQLAITLGILGAYVVGYAFHESWRWMFAVGAVPAIALFVGIFGLSDTPRWLAVRGREAEARAALARVREKSESDPAVKAEFAEILTGATQDENRKARLSDLLTPRVRPALIVAMGLFLLQQLSGINAVIYYAPTVFELSGFSSTTTQILATAGIGVVNVLMTLVGMALIDRLGRRLLLLIGFAGTAVALSVIAIGAATGSEMMGKLALGGLVLYIASFAIAIGPLPWVMMSEVFPLDVRALGMSIASLVNWGFNFLVVFSFPVLVAEFGLAGVFGLYAVVCVVGLAFTQWLVPETSGVSLEEIERHLDSGRPLRDLGRFTPRAA

SEQ ID NO: 11904 - DNA, 1434 bp, marine gamma proteobacterium HTCC2207
  CDS (1)..(1434): transl_table=11
atgtctatcgccgcaagctccagtactaaaaaactcagtattttacaaatcaccattgtcgctgcattaggcggtttattgttcggatatgacaccggtgtgatagcgggcagtcagctttatttcaccaaatattttaacctttctgccgccgagcagggttgggcagtcagcagtgcgctctatggttgtctagtgggtgcactggcaggtgggtatctcactaagcgcatcagcagaaagtacacgttgatccttgcggcttctctctttgctgtttcggcctggggttctggtatggcagcaaccctcaatgagctggcgatttaccgaattattggtggtcttgccgtgggcatggcctcactggcggcacctatgtacattgctgaaatggcgccacctaaataccgtggtcgtatggtttcctactatcagttggccgtggttattggtttttttgtagtgtttttggcgacctattttatcggcggtggcgacacgcagaatatgaccccagaagtgcttgcgcagcttcatgagcacaatgtcaatcagggctggcgcattatgctctggtctgagctattgccggcactggctttcttggggctgttatttactgtgccgcacagcccccgctggttgatctcacagggccgcactgaagaggctaaaactgtgctggctcagataacctcaagcgagcaagaggcggcgtctgagtttgctgatatagaggcgtctctgacccatagtccagccccaaacctggccatgttgtttggtaaaggtattggttttgctctatttctcggtgttatgttgtcgatattccagcaggtcactggtatcaatgcgattctctattacggtgcggaaatatttagtaacgccctaggttatggcccagaagatgcgcttaagcagcagctatggctgggggcggtcaatctgatctttacctttgtcgctatttacaaagtcgatagctggggccgcaagccactgtttattgccggtagtataggtatgtgtgccggtttaactgtgctcggtctgacaatttacactcagcagatgggtgttgtttccctgatcgcggtactggtctttatcgcctcatttgccatgtctatgggcccagttgtgtgggtaatgttgtcggaaatgtttccgaataatgtacgcagtgtcgctatgtcgatcgctgttgcggcgcagtggctattcaatgctctggtagccaatagcttccctctggtaaaccaaagtaccttgaatcaggaaggctttaacggcgcgctgccatactttatctttgcctcgttctgtgtagttgcgatgatatttgtctggaagctggttcccgagaccaagggtaagacacttgaggaaatggaagcactttggtccgccaaggacgcaggctaa

SEQ ID NO: 11905 - protein, 477 aa, marine gamma proteobacterium HTCC2207
MSIAASSSTKKLSILQITIVAALGGLLFGYDTGVIAGSQLYFTKYFNLSAAEQGWAVSSALYGCLVGALAGGYLTKRISRKYTLILAASLFAVSAWGSGMAATLNELAIYRIIGGLAVGMASLAAPMYIAEMAPPKYRGRMVSYYQLAVVIGFFVVFLATYFIGGGDTQNMTPEVLAQLHEHNVNQGWRIMLWSELLPALAFLGLLFTVPHSPRWLISQGRTEEAKTVLAQITSSEQEAASEFADIEASLTHSPAPNLAMLFGKGIGFALFLGVMLSIFQQVTGINAILYYGAEIFSNALGYGPEDALKQQLWLGAVNLIFTFVAIYKVDSWGRKPLFIAGSIGMCAGLTVLGLTIYTQQMGVVSLIAVLVFIASFAMSMGPVVWVMLSEMFPNNVRSVAMSIAVAAQWLFNALVANSFPLVNQSTLNQEGFNGALPYFIFASFCVVAMIFVWKLVPETKGKTLEEMEALWSAKDAG

SEQ ID NO: 11906 - DNA, 1599 bp, marine gamma proteobacterium HTCC2207
  CDS (1)..(1599): transl_table=11
atggaatatcgatcctactacgcaatttattgcgcaatttttgtatctctgggcggctttgtttttggcttcgacgcctcagtggtctcgggcattatcggcccggtcaccattgaatttggcctgacgcctattcaagccgggtttgtggtcgccgcaccgaccctctccagtgccattggaacattgatgatcggccccttgagtgatgcttttggccgcaaaaagatccttatgtttattgccgttctctacctgatatctgccgtttcctcggcactttctacctcttactatatgttgctggcagcgcgagcgctgggtggatttgcctttacctcattggttattgccccgatgtacattgccgagattgccccagccaagcggcgcggcaaactggtatcggtaaatcagttaaatattgttataggcctttcagccgcctatttcgccaactactacattctcggcctaagctcatccggtgcagactgggtcagcgcctggggcgttgatcagcatgcctggcgctatatgctgggctttgaaattgtccccgcgctgatatatttggtcgccctgtttgctattcccgacagccctcgctggttgatccaaaaagggagagaacaggaagcccgagcagtgatcgctaagctggtaccagcggaccaagttgatagtgaaatgtcgctgatcactcagagctctgccacggtaaccgaatcactgtgggcgcgcattggcggtatttttggacccaagatgcgactggctttaatagtcggcattattgtggctgtggtacaacagattaccggtatcaatgcgatcttcttttatgcgccaaccatttttgaacagagcggaattggcaccgatgccgccttcgctcaagctgtattggtgggcttaatcaatgttgtgttcactctggttgcgattgctctgattgatcgctggggccgcagaccattactgctggttggcctgtctggtatcgccattagcatggcgctctgcacctacggtttctctcaagccacatatgaattgaagtcagagtctgtggtgcaaatgcaacagatggaaaccgctgatgccaactttgatgccagccaactcaactcattggtaggcgtggtctatcagagtgatgtggaatttaagacggcggtctccgaggccataggtatcgaggctgcacgcaagtatgagagtgaactcatcaagagctccgctcaaatgaatgctctgttgatactggtcggcatactggggtttgtcgcgtcgtttgcgatgtcgctgggcccggtgatgtgggctctgttcagtgaaatattccccaatcagttgcgcggcgtggccatctcttttgtcggcatgatcaatagcatggtcagctttatggttcagctgttgttcccgcttgagcttagtgtgctgggcgcagccctgactttcttctcatactttgtatttgcggtaatcggcctgattctggttgcctggctactgccagaaactaaaggcaagtctcttgaagaactggagacgatgtttggcacaaaagcctcgacaggtagccctgcttaa

SEQ ID NO: 11907 - protein, 532 aa, marine gamma proteobacterium HTCC2207
MEYRSYYAIYCAIFVSLGGFVFGFDASVVSGIIGPVTIEFGLTPIQAGFVVAAPTLSSAIGTLMIGPLSDAFGRKKILMFIAVLYLISAVSSALSTSYYMLLAARALGGFAFTSLVIAPMYIAEIAPAKRRGKLVSVNQLNIVIGLSAAYFANYYILGLSSSGADWVSAWGVDQHAWRYMLGFEIVPALIYLVALFAIPDSPRWLIQKGREQEARAVIAKLVPADQVDSEMSLITQSSATVTESLWARIGGIFGPKMRLALIVGIIVAVVQQITGINAIFFYAPTIFEQSGIGTDAAFAQAVLVGLINVVFTLVAIALIDRWGRRPLLLVGLSGIAISMALCTYGFSQATYELKSESVVQMQQMETADANFDASQLNSLVGVVYQSDVEFKTAVSEAIGIEAARKYESELIKSSAQMNALLILVGILGFVASFAMSLGPVMWALFSEIFPNQLRGVAISFVGMINSMVSFMVQLLFPLELSVLGAALTFFSYFVFAVIGLILVAWLLPETKGKSLEELETMFGTKASTGSPA

SEQ ID NO: 11908 - DNA, 1422 bp, Rickettsiella grylli
  CDS (1)..(1422): transl_table=11
atgataaaaatatcaaatcctaatgggttggtttatacaatttctggatttgccgctttagcaggattgttatttggctatgatacaggaattatttcgggcgctattttatttattaaaaaagatttttttttaacgaattttcaaattgagtgcgttgttagtgctgttttgttgggtgctttaatcggttcgggcgtcagtggtcgagtcagtgatttatttggtcgacgtaaaatacttctatttacttcaatgacgtttatcttaggatctttaattacagcgttttcacctaatttaacttttttaatgataggcagaatagtattgggacttgctatcggtatcggttcttttacggcccctctttatttagcggagattgccccaaaacgtattcgggggttgttggtttctttaaatcagttagccattactatcggtatcgttttttcttatatgattaattattatttttctgtttcaggtggatggccttggatgtttggtttaggagttattcccgcgattattttatttttagggacgctgtatttgcctgaaagtccacgatggatgattttaaagggttggaatcaaaaagcacgtacagttttacaatatttacggcataatgaaaacattactaaagaatttgacgaaatctgtcaaacagtggccattgaaaaagggacacatcgtcaattattggcaaaatggttacgacctattctctttattagtttaggcttaagtttttttcaacaagttacgggaattaatgccattgtgtattatgcgccaactattttacaactagcaggttttaaatacgcgagcaacgctattttagcaacactcggtattggaataattaatgtattatttacgcttgtcgcattaccgctgattgatagatgggggcgtcgtcctttgttattgtatggccttttagggatgtttataagtttagtgagtttaggattagctttttatctccctggatttacccaactacgttgggttgctgtagccagcatgattctttacattgctagttttgcaatgagcttaggccctataatgtggttaattatttcggaaatttttccattaaatattcgtggagtgggagcgagtttagcgatttcgatgagctggggttttaacctgttagtatcgttaacgtttttgacgttgatcgaatggatagggacgagttacacgttttggctctattcatttttatgtatattaggctggatttttgtttattttattgttccagaaacaaaaaattgttctttagaacaaattgaaaataatttacgtttaggacgtcctagtcgtgaattaggtgcagcgctacgcctttcttctttatttgaaaaactaaaaaaaaccgttgcttttttctaa

SEQ ID NO: 11909 - protein, 473 aa, Rickettsiella grylli
MIKISNPNGLVYTISGFAALAGLLFGYDTGIISGAILFIKKDFFLTNFQIECVVSAVLLGALIGSGVSGRVSDLFGRRKILLFTSMTFILGSLITAFSPNLTFLMIGRIVLGLAIGIGSFTAPLYLAEIAPKRIRGLLVSLNQLAITIGIVFSYMINYYFSVSGGWPWMFGLGVIPAIILFLGTLYLPESPRWMILKGWNQKARTVLQYLRHNENITKEFDEICQTVAIEKGTHRQLLAKWLRPILFISLGLSFFQQVTGINAIVYYAPTILQLAGFKYASNAILATLGIGIINVLFTLVALPLIDRWGRRPLLLYGLLGMFISLVSLGLAFYLPGFTQLRWVAVASMILYIASFAMSLGPIMWLIISEIFPLNIRGVGASLAISMSWGFNLLVSLTFLTLIEWIGTSYTFWLYSFLCILGWIFVYFIVPETKNCSLEQIENNLRLGRPSRELGAALRLSSLFEKLKKTVAFF

SEQ ID NO: 11910 - DNA, 1431 bp, Alteromonadales bacterium TW-7
  CDS (1)..(1431): transl_table=11
atgacatcacctatctcgccgagcagtaatagctcggcccacacattgggcacatgctctcttttttatgtaatttttatatcggccgtggctgctattggtggctttttatttggttttgactcgggcgttattaacggcacggtgtcggcactcggtaatgcttttaattcaagcagtgtggctacgggatttaatgttgcctcggtattattagggtgcgccgtgggggcacttgctgcggggccgctggctgataagtttggtcgccgtgcaattatgatcttcaccgcgattatttttgctattagtgcgtttggctcaggcattagcgaaagctcggccgagtttattttttaccgcttatttggtggcttaggtattggtgctgcatcggtattggcgccggcttatattgcagaggttgcaccacccgcacttcgtggtcgtttagctacacttcaacaactcgctattgtattgggcttgtttgctgcgtttttaagtaactatttaattgctgatgcagcaggtagtgcgcaaaacattttaatgcttgatatagccgcttggcgctggatgttttgggttgagcttgtgcctgcaatactgtttttagtgggtgtgttgtttattcctgagtcgcctcgttatttagtggcgcaaggtaaagtagacgatgcaaaaacggtatttagtaaaatttcgaacgacagtgctgatgcgcaaataagcgatgttaaaagctctttgcatagcgataaaaagccgagtattcgtgatttatttattgatggcagtaaaaaagtacacccaattgtttgggcgggtgttgcgctgagtgtatttcagcaatttgtaggtattaacgtggtattttattacggctctgagctttggcaagctgctgggtttgacgagtcgcaatcgctatttataaatgtattagcgggtactactaatattgtatcgacctttattgctattgcccttgttgacaaaattggtcggaaaccacttttacttgtgggcagtgtgggtatgtttattagcctaagcgcgcttacttatatatttggcagcgcaggcctagatgaagcaggcaagcttgcacttagcgataacatgggtacgtttgcgcttattatggctaacttatttgtggtgttttttggcttaagttggggcccggttgtgtgggtgttattaggcgagatgtttaataaccgtattcgcggcgcagctctcgctgttgctgcaagcgcacagtggattgctaactttgccattaccatgacctttcctattatgctggctaatattggccttgccagcgcttatggcttttatgcgttatcggcacttattagtatattttttgtggctaaatacattaatgaaacccgtggtaaaacacttgagtctatgtaa

SEQ ID NO: 11911 - protein, 476 aa, Alteromonadales bacterium TW-7
MTSPISPSSNSSAHTLGTCSLFYVIFISAVAAIGGFLFGFDSGVINGTVSALGNAFNSSSVATGFNVASVLLGCAVGALAAGPLADKFGRRAIMIFTAIIFAISAFGSGISESSAEFIFYRLFGGLGIGAASVLAPAYIAEVAPPALRGRLATLQQLAIVLGLFAAFLSNYLIADAAGSAQNILMLDIAAWRWMFWVELVPAILFLVGVLFIPESPRYLVAQGKVDDAKTVFSKISNDSADAQISDVKSSLHSDKKPSIRDLFIDGSKKVHPIVWAGVALSVFQQFVGINVVFYYGSELWQAAGFDESQSLFINVLAGTTNIVSTFIAIALVDKIGRKPLLLVGSVGMFISLSALTYIFGSAGLDEAGKLALSDNMGTFALIMANLFVVFFGLSWGPVVWVLLGEMFNNRIRGAALAVAASAQWIANFAITMTFPIMLANIGLASAYGFYALSALISIFFVAKYINETRGKTLESM

SEQ ID NO: 11912 - DNA, 1446 bp, marine gamma proteobacterium HTCC2143
  CDS (1)..(1446): transl_table=11
atgagtactgcagcatcggttcataaaagcgcgcttaaacagcagcgcaccacgctacaaattacccttgtggctgccttgggggggcttctatttggctacgacaccggcgttattgccggtagtcagctgtactttaccgaatattttaactttaccgctgccgaacaaggctgggcggttagcagtgcgctatacggctgtctgatgggtgccttggctgggggttatctggctaaccgcatcagtcggaaatataccttgattcttggcgcggtgctttttgttgtttcggcgtggggttctgggttcgctgacacgttggatcaattagtgatctaccgcattcttggcggcttaggcgtcggcttagcctcactggctgcgcctatgtatatcgctgaaatatcacccgctaaaaatcgcgggcgcatggtgtcctattaccagttggcggtggttattggtttttttgtggtttttttggcgacctactttatcggcggtggcgacacgcagaacatggcaactgagaggcttgcattgctccatgagcacaacgtgacgcagggctggcgagtgatgttctggtcagaattattgcccgctacggccttttttctgttgttgttcacggtgccgcacagtccgcgctggttgatgctgaaaggtcgtactgacgaggccgaagcggtgcttgctcgcatcacctcaagccctcaggaagccgcctcagaattatccgatatccgggcgtcgctggagaatcggtcgtcgccgaatctaacggtactgtttaccaagggcattggtttcgcgctatttcttggtgtcatgttatcgatttttcaacaggtgaccggtattaatgcgattctctactatggtgcggagatatttagtaacgccctaggctatggcccagaagatgcgcttaaacagcagttgtggctcggtgcggttaatttactcttcacctttgttgccatttataaaattgatagttggggtcgcaagccgttgtttattgccggtgctgtcggcatgtgtgtgggtttaagtattttgggtttgagcatttatgtgcaacagatgggcattatttcgctgttggcagtgttgctctttgttggctcatttgccatgtcgatggggccagtggtctgggtcatattatcggaaatgtttcccaataatgtacgcagtgtggcaatgtcgatcgccgtagcggcgcagtggttatttaacgcgttggtcgctaatagctttccgttggtgaatcaaagtgcgctaaatcaggatggttttaacggtgcactgccctattttatctttgccggattttgtgttgttgcaatgatttttgtttggaagctcgttcctgagaccaagggtaaaacgctggaggaaatggaggcgctttggtcaataaaagacaagggttga

SEQ ID NO: 11913 - protein, 481 aa, marine gamma proteobacterium HTCC2143
MSTAASVHKSALKQQRTTLQITLVAALGGLLFGYDTGVIAGSQLYFTEYFNFTAAEQGWAVSSALYGCLMGALAGGYLANRISRKYTLILGAVLFVVSAWGSGFADTLDQLVIYRILGGLGVGLASLAAPMYIAEISPAKNRGRMVSYYQLAVVIGFFVVFLATYFIGGGDTQNMATERLALLHEHNVTQGWRVMFWSELLPATAFFLLLFTVPHSPRWLMLKGRTDEAEAVLARITSSPQEAASELSDIRASLENRSSPNLTVLFTKGIGFALFLGVMLSIFQQVTGINAILYYGAEIFSNALGYGPEDALKQQLWLGAVNLLFTFVAIYKIDSWGRKPLFIAGAVGMCVGLSILGLSIYVQQMGIISLLAVLLFVGSFAMSMGPVVWVILSEMFPNNVRSVAMSIAVAAQWLFNALVANSFPLVNQSALNQDGFNGALPYFIFAGFCVVAMIFVWKLVPETKGKTLEEMEALWSIKDKG

SEQ ID NO: 11914 - DNA, 2480 bp, Ananas comosus
  CDS (567)..(2102)
gttggattttgtttcccaaatccgatccttccttccgattttgggcaatttttcgcttcaatttggtagaatttggggcgaatttgatgcgttttgggctctttggttcttaaagaggtcgaattttttggtatttttgaggtagataaaaggagaaggaaaagttggagacggagttgattataagcgcttttgaagtcgtattttcgacgaagctagaaatttttttagctcgatttcgtttcccgaatctaatactactttccaatttagggtttttggaggaggagccgtttttcggttgaaattcgtagaatttggctcgaatttgatgcgatttgagcattagggttcgtaaaagggttggatttttgaggaagagttggaaaagaagttggtcaaaccgctttcgaattcctacttttaaggaagctacaaatttttgtggttcgatttctcttcaaattggtagaatttggggcaagtttgatacgatttcggcactagggttcttaaaaagctaggattttttagctgaatttattggattgggcgaaagggagaagatgacgatcgatttctcgatgccagggagttcggggattttggattccccagcaaagagggacatgtccttcttcagtaatgggtatgtgctagggctcacagttaccgcggggatcggtgggttgctttttgggtatgatacaggtgtgatatctggagcacttctatatatccgcgatgattttaaggcagtcaatgacaattatgtcttacaagaaacaattgtaagtatggcattagttggagccatgatcggggccgcggggggtggatgggtaaatgatgcttatgggcgcaagaaggctacccttcttgctgatgtggtcttcactgttggatcgcttatcatgtgtgccgcacctgacccatatgttctcattcttgggagactcctcgtcggtttgggggtgggaatagcgtcagttacggccccagtttatatcgcagaagctgcaccgtcagaaattagaggagggttagtggctactaatgtgctcatgatcaccggcgggcagttcctctcttaccttgtaaatcttgctttcactgaggtttctgggacgtggcgttggatgcttggagtcgctgcgataccagcaatcatacaattcattctgatgctctttcttcccgaatcacctcgctggctctacaggaagaatgagaaagctagggctatcgaggtcctctcgaagatctacgaccccgaccggttagaggaggagatcgatcttcttgctgtttcctctctcgatgatcggtccaagaaatcggtcagttatctcgatgtgttccggtcaaaggaaataaggctcgcatttttcgcaggagccggccttcaggcgttccagcaattcacggggatcaacacggtcatgtactacagcccgacgatcgtccagatggcgggcttctcctccaaccagctcgccctcctcctctccctcatcgtcgcggccatgaacgctgtgggcactgtcgtcggcatacttctcatagaccgcgccggccgccgccgcctcgccctcaccagcctctccggcgtcacgctctccctcctcatcctctccgcagccttcttcctccaatcctccgatctcacgtccgccttatgtggctcggctgctctacacacctccaccgcgtgcgggaaccgcctcgggtggttcgcggtggccggcctggctttatacatcgccgccttctcgcccggcatggggcccatcccgtgggcggtgaactcagagatctaccccgaagcgtaccgcggggtgtgcggggggatgtccgcgaccgtcaactgggtctcgaacctgatcgtcgcgcagatcttcctttccgtcgtggcggtgctggggacggcggcgacgtttctaatcatcgccggggtggccgtgctcgctttcgtcttcgtgctcctcttcgtgccggagacgaagggccggacctttgagcaggttgagcggatgtggaaggagcgggcgtgggggagcccgttgggcagccgcgagagcctcctcgacggcgcggcttgagtcgccttcgtccggtttaagttctcatgcaaagaggacattgctcctgtttttttcaagaggggtggttcctccttttgcatggggatatattatatcaagttacacagagtaaacaaaaggagagaactagggtttctcaatttgttatgtgcctttttgtttgttccctttttagttatgtagctagtttatcatgttgttgatttgtgaaagaaaacattcccagaaatagtgagtgccccttttgttgtatgtatgcatgtacaaattatgcgcgattattcgatctatttattcaaatgagatgtgtagttcttgtagggtgtagggtttcatttcaaatacctgcactttgagtcaaaaaaaaaaaaaaaa

SEQ ID NO: 11915 - protein, 511 aa, Ananas comosus
MTIDFSMPGSSGILDSPAKRDMSFFSNGYVLGLTVTAGIGGLLFGYDTGVISGALLYIRDDFKAVNDNYVLQETIVSMALVGAMIGAAGGGWVNDAYGRKKATLLADVVFTVGSLIMCAAPDPYVLILGRLLVGLGVGIASVTAPVYIAEAAPSEIRGGLVATNVLMITGGQFLSYLVNLAFTEVSGTWRWMLGVAAIPAIIQFILMLFLPESPRWLYRKNEKARAIEVLSKIYDPDRLEEEIDLLAVSSLDDRSKKSVSYLDVFRSKEIRLAFFAGAGLQAFQQFTGINTVMYYSPTIVQMAGFSSNQLALLLSLIVAAMNAVGTVVGILLIDRAGRRRLALTSLSGVTLSLLILSAAFFLQSSDLTSALCGSAALHTSTACGNRLGWFAVAGLALYIAAFSPGMGPIPWAVNSEIYPEAYRGVCGGMSATVNWVSNLIVAQIFLSVVAVLGTAATFLIIAGVAVLAFVFVLLFVPETKGRTFEQVERMWKERAWGSPLGSRESLLDGAA

SEQ ID NO: 11916 - DNA, 1422 bp, Bacillus megaterium; identical to SEQ ID NO: 4618
  CDS (1)..(1422): transl_table=11

SEQ ID NO: 11917 - protein, 473 aa, Bacillus megaterium; identical to SEQ ID NO: 4619

SEQ ID NO: 11918 - DNA, 1596 bp, Aspergillus parasiticus
  CDS (1)..(1596)
atggcggtccttcattctggggttgtgtgtctcgatgggtggttttatcttcggttactccaccggtatgtcaacttccctgtggggtacctaccatgcttcgtgctgactttcacctcaggtcaaattgctggctttacgactatgaatgatttcaagatgcgctttgcggaacaacatgcggatggaacatacgctttcagcaacgtgcgcaatggtttgattgtcggtctgttgtccattggtactatgattggcgccctcgtcgccgctcctatcgccgatcgcattggtcgcaaatactctatctccttctggtctgtgattcacatggttggtatcatcattcagatcgccaccgacgacaactgggtccaagttgctatgggtcgttgggtggccggtctggttgtcggcgctctgtccagcatcgtccctatgtaccagagtgaatctgctcctcgtcaggtccgtggtgccatggtcagcgccttccagctgttcgttgcttcggtattttcatctcttatctcgtcaacttcggtaccgaatccatcaacggtaccgcttcctggcgtatcactatgggacatgtgtgcctggcccttgatcttgggtgttggcactctgttccttcccgagtctccccgttatgcctaccgtaacggtcgtgtcgaagaagcccgtgaggttatgtgcaagctttacggcgttggccccaaccaccggtgcatcgcccaggagatgaaggacatgaaggacaagctcgatgaggagaaagctgccggacaggcttggcatttcgaagtcttcactggtcctcgtatgttctaccgtgtagctggaattgctttacagtcactgcagcagctcactggcgccaacttcctcttctactatggtaacaccatcttcacttctaccggtctgaacaacagctacgtcacccagattattctgggtgccgttaacttcggcatgacccttcctggtctctatgttgttgagcacttcggtcgtcgtaatagtctgatggtcggtgcctcctggatgtttatctgcttcatgatctgggcctccatcggtcacttcgccttggacttggagaaccctcccaacacccctcaggcgggtactgccatgattgtcttcacttgcttcttcatcggtggcttcgccaccacctggggacctattgtgtgggctatctgtggtgagatgtaccctgctcgctaccgtgctgtctgcattggtcttgccactgccgccaactggagcctgaacttcctgatctctttcttcaaccccattcatctccagcgctatcgactttgctacggttacgtctttgcaggctgctgcttcgccgccgtgcttgtggtcttcttcttcgtcaacgagacccagggtcgcacccttgaggaagtcgacaccatgtacgtcctccacgtcaagccctggaagagtgccagctggacgccccggagggtatcgtccgtgatctccacggaccccccgcttcccccaagcaggagggtcgggctgagcacagcgagcccgccaccgagatccgcgagtaaatggtatcatgtctga

SEQ ID NO: 11919 - protein, 531 aa, Aspergillus parasiticus
MAVLHSGVVCLDGWFYLRLLHRYVNFPVGYLPCFVLTFTSGQIAGFTTMNDFKMRFAEQHADGTYAFSNVRNGLIVGLLSIGTMIGALVAAPIADRIGRKYSISFWSVIHMVGIIIQIATDDNWVQVAMGRWVAGLVVGALSSIVPMYQSESAPRQVRGAMVSAFQLFVASVFSSLISSTSVPNPSTVPLPGVSLWDMCAWPLILGVGTLFLPESPRYAYRNGRVEEAREVMCKLYGVGPNHRCIAQEMKDMKDKLDEEKAAGQAWHFEVFTGPRMFYRVAGIALQSLQQLTGANFLFYYGNTIFTSTGLNNSYVTQIILGAVNFGMTLPGLYVVEHFGRRNSLMVGASWMFICFMIWASIGHFALDLENPPNTPQAGTAMIVFTCFFIGGFATTWGPIVWAICGEMYPARYRAVCIGLATAANWSLNFLISFFNPIHLQRYRLCYGYVFAGCCFAAVLVVFFFVNETQGRTLEEVDTMYVLHVKPWKSASWTPRRVSSVISTDPPLPPSRRVGLSTASPPPRSASKWYHV

SEQ ID NO: 11920 - DNA, 1711 bp, Amanita muscaria; identical to SEQ ID NO: 4620
  CDS (38)..(1600)

SEQ ID NO: 11921 - protein, 520 aa, Amanita muscaria; identical to SEQ ID NO: 4621

SEQ ID NO: 11922 - DNA, 2364 bp, Kluyveromyces lactis; identical to SEQ ID NO: 11722
  CDS (214)..(2364)

SEQ ID NO: 11923 - protein, 716 aa, Kluyveromyces lactis
MESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 11924 - DNA, 2118 bp, Solanum lycopersicum; identical to SEQ ID NO: 4592
  CDS (93)..(1664)

SEQ ID NO: 11925 - protein, 523 aa, Solanum lycopersicum; identical to SEQ ID NO: 4593

SEQ ID NO: 11926 - DNA, 1620 bp, Trichoderma reesei
  CDS (1)..(1620)
atgggattcttgaacaaaaaagccgatgctcctgcgcaggagcccaagagggatccctcgcccagcagtggaggctctgagacgactccctcgcagcaggagagagtcaccctccttgcctgtgccctgggagccattgccgccattggaggcttcatctttggctatgtcagtggtcagatctcgggtttcttcttgatgaaggactatgcccgccgcttcggagagctgcagagtgatggatcatacgacttcagcgctgcccgccagggcaccatcgtcggtctcctctgcgtgggagccctcattggctccctagttgccggcaagatggcagacaccgtcggccgtcgcctgtccatctccatgttcgccttcttcgcctgtgtcggaaccattatcgagatctcctcgtcgacccactgggttcagtttgccgttggccgtctcgtcactggtctgagcatcggtgccctctccgtcgtcgtccccatgtaccagtcagagagtacccctgccgtcatccgcggtgtcatcgtctcgtcgtaccagctgctcattaccatgggtatctggacggccgagatggtcaactggggaaccgagaccaggcccaacagcgccgcatggagaatccccaacggcctcacctttgcttgggccctggtcctcggtgctggcatcctgttcctccccgaaagcccccggtttgcctacagccgcggccgcgtcgatgaggctcgccagacgattgcccgtctccatggcctctccaccgactcggacattgtcaacaaccagatcgccgacatccaggccaagattgacgaggagagcgagaacacggccgcgttcagctggaccgagatcttcaccggccctcgcatgttctaccgtacggtcctcggtgtcgttctccaggccggccagcagctcactggcgccaacttcttcttctactttggcacgaccgtcttcgctgccactggcatcagcaacagctatgtcacgcagattatcctcggatcggtcaacgtgtttgccaccatcatcggtctcttcatcattgaccgatttggccgacgtgtcattctcatggctggtgcctcctggatgatgatgtgcttccttgtctacgcctttgtcggtcactttgctctcgaccacgagaaccccatgctcacccccaaggctggatccgccctggtcaccttctcttgcctggccattgccgccttcgccgtcagttggggacccctggtctggactgtcaacgccgagctgtaccccatccgctaccgaagcttctgcatgggcattgccactgcctccaactggttctggaacttcctcatctccttcttcactcgattcatcaccgacaagatcgactacttctacggcctcattttcgccggatgctgtgccgccctcgtcgtcatcgtcttcttcttcctgatcgagtccaaggaccgcacgctcgaggagattgacaccatgtacgtccagcacgtcaaccccattacgtcgagccgatggaacgccgcccagttccgagacgagatgagggagacgcagaccaacgatgtgcgagagcacgctcacgaggatgagaaataa

SEQ ID NO: 11927 - protein, 539 aa, Trichoderma reesei
MGFLNKKADAPAQEPKRDPSPSSGGSETTPSQQERVTLLACALGAIAAIGGFIFGYVSGQISGFFLMKDYARRFGELQSDGSYDFSAARQGTIVGLLCVGALIGSLVAGKMADTVGRRLSISMFAFFACVGTIIEISSSTHWVQFAVGRLVTGLSIGALSVVVPMYQSESTPAVIRGVIVSSYQLLITMGIWTAEMVNWGTETRPNSAAWRIPNGLTFAWALVLGAGILFLPESPRFAYSRGRVDEARQTIARLHGLSTDSDIVNNQIADIQAKIDEESENTAAFSWTEIFTGPRMFYRTVLGVVLQAGQQLTGANFFFYFGTTVFAATGISNSYVTQIILGSVNVFATIIGLFIIDRFGRRVILMAGASWMMMCFLVYAFVGHFALDHENPMLTPKAGSALVTFSCLAIAAFAVSWGPLVWTVNAELYPIRYRSFCMGIATASNWFWNFLISFFTRFITDKIDYFYGLIFAGCCAALVVIVFFFLIESKDRTLEEIDTMYVQHVNPITSSRWNAAQFRDEMRETQTNDVREHAHEDEK

SEQ ID NO: 11928 - DNA, 1602 bp, Phaeosphaeria nodorum
  CDS (1)..(1602)
atgccaggcgtaaaggacaacgactccggagtgcccacctactgggggcaatccggtaggatgcttcaagttctcatcaccatggtcgcgactaccgacttcttgctctttggttacgaccaaggtgtcatgagtggtatcatctccgcccccgcctttaccgaagcatttccccaggtccacgacaccaactacgaaggtttcgttgtttccatctacgccgtcggatgcttcttgggcgccgtattcatcttcctcttcggtgacaagctcggtcgtcgcaagtccatcttccttggtgctttcgtcatggtcgtcggtgtcatcatccagatcgcaactgtgccccctaacggcggcgctaccgctcaatttgtcattggacgttgtatcactggtatcggaaacggtatcaacacatcgactattcccacctaccaagcagaatgttgtaaggccaagaaccgtggaaaggttatttgcgtcgagggcagcatggttgccattggtacgctcatcgcctactggatcgattatggatgtctctacggccccgatgacttcacctggagattccccatcgctttccagtgtgtgttcgcattcatcgtcattgctttgatggttcaactacccgaatcaccgcgatggctcctcacccatcaccgcgaggaagaagctgcgacaattcttgctggtctgaacggtctccgtcgtgacgaccccgaggtcctgcttcaaatgggtgttatcaaggtccctaccaagcttctcttcaccaacggcaagacccagtacttccgccgcatgatcctcggagcatcttcgcaattcatgcagcagttgtcgggttgcaacgctgtcatctactatttccccattctttgccagaacgcgctcggcaccgaccacaacctcgcccttcttttgggaggtgtgaacatggttgtctacgccatcttcgcgactacatcttggttcgtcgttgagcgtgtcggtcgccgcaagctctttttgatcggtaccgttggacaatgcttagccatggttcttaccttcgcttgcctaattcccccgtccgaaactggcgctgccaacggtgctgctgttggtctgttcatctacattgccttttttggcgctacctggttgccactcccctggttgtaccctgccgagatcaatcctctcaagactcgtgcgaaggcgaacgctttcagcacgatcaacaactggctctggaacttcttcattgtcatgatcacaccggttctgatcgatagcattggatggggaacttaccttttcttcgccgcactcaacgcctgcttcttcccagtcatttacttcttctacccggagacttccggccgttctctcgaggagattgatctcatcttcgccaagggtttcatcgagaacaagagctacgtgctagcagctaaggagcttcctatgctcgaggaggccgaaatcgcgcaatactctcgtgagctcggtgtcgacatgcacgacgaggaggctgtttcatccgatggctcgatcaaggagaagaaccgtcgtcaggaggacctcctgccccagcagcccgcccaggtttaa

SEQ ID NO: 11929 - protein, 533 aa, Phaeosphaeria nodorum
MPGVKDNDSGVPTYWGQSGRMLQVLITMVATTDFLLFGYDQGVMSGIISAPAFTEAFPQVHDTNYEGFVVSIYAVGCFLGAVFIFLFGDKLGRRKSIFLGAFVMVVGVIIQIATVPPNGGATAQFVIGRCITGIGNGINTSTIPTYQAECCKAKNRGKVICVEGSMVAIGTLIAYWIDYGCLYGPDDFTWRFPIAFQCVFAFIVIALMVQLPESPRWLLTHHREEEAATILAGLNGLRRDDPEVLLQMGVIKVPTKLLFTNGKTQYFRRMILGASSQFMQQLSGCNAVIYYFPILCQNALGTDHNLALLLGGVNMVVYAIFATTSWFVVERVGRRKLFLIGTVGQCLAMVLTFACLIPPSETGAANGAAVGLFIYIAFFGATWLPLPWLYPAEINPLKTRAKANAFSTINNWLWNFFIVMITPVLIDSIGWGTYLFFAALNACFFPVIYFFYPETSGRSLEEIDLIFAKGFIENKSYVLAAKELPMLEEAEIAQYSRELGVDMHDEEAVSSDGSIKEKNRRQEDLLPQQPAQV

SEQ ID NO: 11930 - DNA, 1536 bp, Phaeosphaeria nodorum
  CDS (1)..(1536)
atggtgcttactggcaagtctctgcagacggcacagctgttgctggtcgtattgccggctttcgtcctttttggatacaaccagtctggtgttggaggtctcctatccctccgcgattggaacgaccacttccctcagatcaacaccattgatgctaaaggcgctgagaagagccacaaatcgaccatccagggagctgttgtcgctaccttcaccattggcgcactcttcggtgctctctcctgcacttgggccggagacattctcggacgacgaaaagtcatcttcggtgctgcgatcttcactttcattggcgaagtcttgcaatgcactagcttccaccttgcgcagttcgtcgtcggccgcttcatcctcggattcggtgttggtgcattgagcgccacggtccctgtctggcaatctgaatgctcgtctacagccaaccgcggaaagcacgtcgtcctggatggctgcttcatcagtctgggatatctcctcgaagcatggatcaacctcggattcttcgaagtcaagaacaacaagcccgtccaatggcgtcttcccctcgctatcccaactttgatctccttggtccctctggctgccgttttctcgattcccgagagtccgcgatggctcgtgaacaagggccgcgttgaggaagctcgcgcatctttgtctgcattcaagggtcttgacctgcacgacccggagatcagcgctgaggtcagcggcatcgaactcgcccttgaagaaactggccgcagcgctgccaagctcggcgacatcttcaccatgggtaaggacaagctattctaccgcttctcgctgtgcattttcttgcagttcctgcagcaaatgtgcggaagtaacttgatctccacatactctaccatcatcttccaacaaggcctcggcctcgacgcagaaacctcccgcatcctctccggcggcgcgctcacctggaaattcctctcctgcttcgtcgccttcttcaccatcgaccggttcggtcgccgcaagctcttcatgttctctggcgtcggcatggcgtcgtgcatgctcgcgctagccgtcgcgtcctcgttcccgaagaccaactacagcgcgcaaatcgcgtctgccttcttcgtgttcatgttcaacttcttcatcccgattggcttcctgggcgccaactttttgtactgcaccgaggtcgcgccgacgaggttgcgcgtgggcatggcgggcatttcgacggcgaatcattggctctggaacttcgtagtcaacatggtaacccccgtggccatcgagaccatcggctggagatactacctcgtcttcctcatcatctcggccatcatcgtgcccgtcgtgtggttcgggtaccccgagaccatgggccgcagtctcgaggagctcgagatgatgttcaccgagcacgacaagatccgcgacattgtgagggagtcgcgcaagcctttaacgggcgggttggggcttgagcgggcgagggagaaggtcgcgattgagaaggatgagtttgcttag

SEQ ID NO: 11931 - protein, 511 aa, Phaeosphaeria nodorum
MVLTGKSLQTAQLLLVVLPAFVLFGYNQSGVGGLLSLRDWNDHFPQINTIDAKGAEKSHKSTIQGAVVATFTIGALFGALSCTWAGDILGRRKVIFGAAIFTFIGEVLQCTSFHLAQFVVGRFILGFGVGALSATVPVWQSECSSTANRGKHVVLDGCFISLGYLLEAWINLGFFEVKNNKPVQWRLPLAIPTLISLVPLAAVFSIPESPRWLVNKGRVEEARASLSAFKGLDLHDPEISAEVSGIELALEETGRSAAKLGDIFTMGKDKLFYRFSLCIFLQFLQQMCGSNLISTYSTIIFQQGLGLDAETSRILSGGALTWKFLSCFVAFFTIDRFGRRKLFMFSGVGMASCMLALAVASSFPKTNYSAQIASAFFVFMFNFFIPIGFLGANFLYCTEVAPTRLRVGMAGISTANHWLWNFVVNMVTPVAIETIGWRYYLVFLIISAIIVPVVWFGYPETMGRSLEELEMMFTEHDKIRDIVRESRKPLTGGLGLERAREKVAIEKDEFA

SEQ ID NO: 11932 - DNA, 1701 bp, Phaeosphaeria nodorum
  CDS (1)..(1701)
atggttggcggaggaggaggctcagccggcttcgatgctgcgctagagcgacgacaagccctcatgggcgccagtggccctgcggctctggtcaagaacttcaaggttttcagcatcgccttgtttgcttgcttaggaggtgtcttgtatggatacaaccagggcatgttcagtggcattctggctatgccatctttcggtaaacagaccgacggctacatcgacaacccgacacagaagggatggcttactgctattcttgaacttggagcctggttcggagcactcttttccggtttcgtggccgaagtcctgtcacgaaagtacggtatcctgtgcgcaactggcgtcttcatcgtcggtgttgtcgtccaaattacagccattgctggtggtcacaatgagattctcgcgggccgcttcatcacaggaattggtgtgggcagtctttcagtcatcgtccctatgtacaacagcgagtgtgcccctccggaagttcgtggtgctctcgtggctcttcagcagctcgctattacctttggtatcatgatcagtttctggatcaactacggaaccaactacattggcggaactactctcgagacgcagtccaacgcagcgtggcttgtgcccatctgcctccagttgctccccgctttcatcctcctcattggcatgatttggatgccgttctcgccccgttggctgatgcaccatggccgtgaagaagaggctcgttccaacctggccagtctgcgcaaccttcctgcggaccatgagcttattgagcttgaattcctcgagatcaaggcccagtcaatgtttgagaagcgcagtcttgcagaggcatttcctcacctccaagagcagaccgcatggaacagcttcaagcttcaatttgtcgcaatcggtgcactgttcaagaccaaggccatgttcaagcgtgttattgtggcaaccgttactatgttcttccagcagtggtctggaatcaatgcggttctttactacgctccccaaatcttcgcgcagcttggcttgacaggcaacaccacctcccttctcgcgaccggagtggtcggtattgtcatgttcatcgccacaatcccagccgtgctctacattgaccgcctcggtcgtaaacccgtgctcgcagtcggagctctgggtatgggtttctgtcatctggtcatcgccgtcattctcgccaagaacattggtcgcttcgccgaggagaagtccgcaggttgggcagccgtagtgatggtctggctcttcgtcatcaactttggatactcctggggtccatgcgcctggattctcatcgccgagatctggcctctctcaactcgcccatatggaacggcccttggaggatcgtccaactggatgaacaacttcatcattggtcagatcactcctgatctccttgaaaggatcacgtacggaacttacatcctgttcggtctcattatcagtctcggtgctgttttcatctggttcttcgtaccggagactaagcgtctcacattggaagagatggacactatctttggctctgaaggcactgcgctcaaggaccaggagagaatggcggagatcaatgccgaaattggccttgcccagttgaccggtgcggcgccgcctagttaccaggacaccaagattgttggagacgagaaagaggctgtgcaagtctaa

SEQ ID NO: 11933 - protein, 566 aa, Phaeosphaeria nodorum
MVGGGGGSAGFDAALERRQALMGASGPAALVKNFKVFSIALFACLGGVLYGYNQGMFSGILAMPSFGKQTDGYIDNPTQKGWLTAILELGAWFGALFSGFVAEVLSRKYGILCATGVFIVGVVVQITAIAGGHNEILAGRFITGIGVGSLSVIVPMYNSECAPPEVRGALVALQQLAITFGIMISFWINYGTNYIGGTTLETQSNAAWLVPICLQLLPAFILLIGMIWMPFSPRWLMHHGREEEARSNLASLRNLPADHELIELEFLEIKAQSMFEKRSLAEAFPHLQEQTAWNSFKLQFVAIGALFKTKAMFKRVIVATVTMFFQQWSGINAVLYYAPQIFAQLGLTGNTTSLLATGVVGIVMFIATIPAVLYIDRLGRKPVLAVGALGMGFCHLVIAVILAKNIGRFAEEKSAGWAAVVMVWLFVINFGYSWGPCAWILIAEIWPLSTRPYGTALGGSSNWMNNFIIGQITPDLLERITYGTYILFGLIISLGAVFIWFFVPETKRLTLEEMDTIFGSEGTALKDQERMAEINAEIGLAQLTGAAPPSYQDTKIVGDEKEAVQV

SEQ ID NO: 11934 - DNA, 1698 bp, Phaeosphaeria nodorum
  CDS (1)..(1698)
atgcctggtggtggtgtcgtcccaattgctggcacggctgatgtgagccgtgtcgaagcccccgttaccgttcgcgcctacctgatcattgctttcgcagcattcggtggtatcttcttcggttatgatactggttggatgggtggtgtcctcaacatggactacttcatcaagcagtacactggcttggagtaccccgacgtcaagttccctggcctcgatcccaaggacccccagatcaccaactaccgcaataccgagttctccgtctcctcttcgaaccagtctcttgtcacttctatcctgtctgctggtaccttctttggtgccatcatggccggtgaccttgctgacttcattggccgtcgattcaccatcattctcggctgcggtatcttctgcgttggtggtatccttgagactgcctccactggtctcggtgtgatggttgcaggccgtcttgttgctggtttcggtgtcggtttcatctcggccattgtcattctgtacatgtccgagattgctcctaagaaggtccgtggtgccgtcgttgccggttatcagttctgcattaccattggtatcctcatcgccaactgcgttgtgtacggcactcagaaccgccgcgacactggctcttaccgtatccccatcgccgtccagttcctctgggccatcatccttgccattggtcttgcgcttctgcccgagtctcctcgttactgggtcaagaagggcaagctcgacaaggctgctcacgctcttggccgtgtccgtggccagccccttgactctgagtacattcaggatgagcttgctgagatcattgccaaccacgagtatgagatgtccattctccccgagacgagctacctcggctcatggatggcctgcttctctggcaagatcaccagcccctcatccaacgctcgccgcacattcgtcggaatcgtaattcagatgatgcagcagcttactggtatcaacttcatcttctacttcggacccgtcttcttccagcagctcggcacgatcgacaaccccttcttgatctccatggtcaccaccctcgtcaacgtgctctccaccccagcctcgttcatcatggttgagaagctcggacgtcgttccatcttgatctacggtgccgctggtatggttatcatgcagttcatcgttggtgccattggtgccaccgctggcaaggctcatggagacactcccgctaaccctaacgctgtccgcgctatgattgctttcatctgcttgaacatctccgttttcgccaccacctggggtccctctgcctggatcgtcattggcgagatattccctctgaccatccgttcgcgtggtgttggtctctccaccgcatccaactggttctggaactgcatcatcggtgtcattaccccctacctcgtcgccgagcgccctgactccgccaagctcggatccaacgtcttcttcatgtggggcggtctttgctgcatctccttcctcttcgcatacttcttcgttcctgagaccaagggtcttaccctcgagcaggtcgacaagatgttggaggagaccacaccccgtacttcgcgcaagtggaagccccacagcacctttgccgcggacatgcacctcaacgagaagaacatcgagattccgctcgagaacattgccgctaagcacgaggccaccgtctaa

SEQ ID NO: 11935 - protein, 565 aa, Phaeosphaeria nodorum
MPGGGVVPIAGTADVSRVEAPVTVRAYLIIAFAAFGGIFFGYDTGWMGGVLNMDYFIKQYTGLEYPDVKFPGLDPKDPQITNYRNTEFSVSSSNQSLVTSILSAGTFFGAIMAGDLADFIGRRFTIILGCGIFCVGGILETASTGLGVMVAGRLVAGFGVGFISAIVILYMSEIAPKKVRGAVVAGYQFCITIGILIANCVVYGTQNRRDTGSYRIPIAVQFLWAIILAIGLALLPESPRYWVKKGKLDKAAHALGRVRGQPLDSEYIQDELAEIIANHEYEMSILPETSYLGSWMACFSGKITSPSSNARRTFVGIVIQMMQQLTGINFIFYFGPVFFQQLGTIDNPFLISMVTTLVNVLSTPASFIMVEKLGRRSILIYGAAGMVIMQFIVGAIGATAGKAHGDTPANPNAVRAMIAFICLNISVFATTWGPSAWIVIGEIFPLTIRSRGVGLSTASNWFWNCIIGVITPYLVAERPDSAKLGSNVFFMWGGLCCISFLFAYFFVPETKGLTLEQVDKMLEETTPRTSRKWKPHSTFAADMHLNEKNIEIPLENIAAKHEATV

SEQ ID NO: 11936 - DNA, 1728 bp, Phaeosphaeria nodorum
  CDS (1)..(1728)
atgaagctcaagatctcgaatccgttcaatcgctggcgtgaagacaaaccagcggcacataactcgcgatatgtgggagagcacgctggttatgataccactcctcttcctcgactgacatggaagggcttttggatgggtattctggtatcgatggagcacacactgactgggtactgcacacaggacactggtcaaatttccggattccttgaaatgaaggactttttgcgtcgcttcggtcagcaacggtctgatgggacatactacttctccaacgtccgatctggtctaattgtggctttgctgtccatcggcacgctgtttggtgcacttgttgcagctccaatcgcagaccgaattgggcgcaagtacagcatcgcttggtggtgcatgatcgtaaacgtcggcattatagtgcaaatatcatcgacagacaagtggtaccaggtcatgatgggtcgcttcgtcgctggtttgggagtcggtgcactaagtcttctcgtgccgatgtaccaggccgaaacagcacctcgccacatacgcggtgctctcatctcagcataccagctaatgatcacgtttggtatcttcctcgcagctgtattcaattatgcggctgaacgccaccaatccggcaaagccgcatcctggcagatcaccatgggtttgaccttcgtctggaccgtcattttggcaggtggcatcatgttcttttccgagacgcctcgcttcaacttccggcgtggcagggtcgaccaggctaccaaaaccatgactgacgtgtacggagtcggcgaaaatcattacagcatccagatggaactcgaagagatgaagacaaaacttgccgctgaatctacgatgggaagtccgatacaggaatggatcaacatgtggaaggccccgaagatggcatacagacttgctattggtatgggcttgcagatgtttcagcagctgactggcgccaactactttttctactacggcacgactgtgttcaaaggaacaggcatcaacaactcctatgtaactcagatgatcttggtacctcactcttccctcgcaaaaaacggcatcaatttcggcgtcacattctacgggctctacatcgtcgagcactacggacgacgcaagtctctcctcgctggctccgcgtggatgttcatctgcttcctcatcttcgcatctgtcggccacttcgcactcgaccgtgagaatccgcagaacacagaaccagcagccacagcgatgatttgcttcgcgtgctttttcatctttgggtttgcaacgacgtggggacccatgatctggacgatctgcggagaactgtatccatcgcgatatcgcgccaaggctatggcgctgacattcttcacacccttcatcaccggcgccatcgatttccgctacggctacgtcttcgccggcaccaacgttctcggcggactcatcgtgtacttcttcgtcatcgaagggcaaggccgcacacttgaggaaatcgacaccatgtacttgatgggtgtcaagccttgggaaagtgcaaagtgggtggtgccgagcttggaggaaatgagcgggaaggtaagggagaggcttgaggctaacaatccggagttggcgatcaagaaggaggttgctggtggtgaagaagggttaagggcgggagagagcggtggaagtgaagaggtgttgagggaaaagacggaggagactgctgtttga

SEQ ID NO: 11937 - protein, 575 aa, Phaeosphaeria nodorum
MKLKISNPFNRWREDKPAAHNSRYVGEHAGYDTTPLPRLTWKGFWMGILVSMEHTLTGYCTQDTGQISGFLEMKDFLRRFGQQRSDGTYYFSNVRSGLIVALLSIGTLFGALVAAPIADRIGRKYSIAWWCMIVNVGIIVQISSTDKWYQVMMGRFVAGLGVGALSLLVPMYQAETAPRHIRGALISAYQLMITFGIFLAAVFNYAAERHQSGKAASWQITMGLTFVWTVILAGGIMFFSETPRFNFRRGRVDQATKTMTDVYGVGENHYSIQMELEEMKTKLAAESTMGSPIQEWINMWKAPKMAYRLAIGMGLQMFQQLTGANYFFYYGTTVFKGTGINNSYVTQMILVPHSSLAKNGINFGVTFYGLYIVEHYGRRKSLLAGSAWMFICFLIFASVGHFALDRENPQNTEPAATAMICFACFFIFGFATTWGPMIWTICGELYPSRYRAKAMALTFFTPFITGAIDFRYGYVFAGTNVLGGLIVYFFVIEGQGRTLEEIDTMYLMGVKPWESAKWVVPSLEEMSGKVRERLEANNPELAIKKEVAGGEEGLRAGESGGSEEVLREKTEETAV

SEQ ID NO: 11938 - DNA, 1677 bp, Phaeosphaeria nodorum
  CDS (1)..(1677)
atggcttctgaccttcagatcggcactcgcttgggcggtccacagaagaagggtttgtacaaggagttgcgccagaatccgtaccttcttggtctatcagcttttgcctcgcttggcggctttctctttggctatgaccaaggtgtggtttccggagtcttgaccatggagagttttgcagcagccttcccccgcatttcatacgacagctcattcaagggatggttcgtctcatctctgctattggcagcatggttgggatctctcgtgaatggccccgttgcagatcgctttggtcggaaaggttccatcatgattgcagtcgtcatcttcaccatcggttccgcgctccaagctggtgcaattaacattgaaatggcctttgctggacgcgctattgctggctttgctgtgggaatgttaacgatgattgttccgatgtacatgagcgaagtttccaccgccggtatccgaggaacattagtcgttctacagcagctttcgatcactctcggtatccttgtgtcatactggctcgaatatggcacacaatatataggcggtccacgatgcgcaccagatattccttatactggtgggaccatggacgaaccagctttcgacccacgcacagatgtcggtccgaacggctgcactgggcagtctgatgcatcatggcgtgtcccgttcgccctgcaaatcttccccggtctcgtgcttgggattggcatgatcttctttccagagagccctaggtactactgcatgcgcgataatgacgaagccggcgttcgagctcttgccaaagttcgtcaaaccagacccgatgacgagctgctccagaaggaataccttgctatcaaggcggaggtcatttttgaacagcagtatgcacgcgaaaagttccccggcaaatctggcgtgtctctctacctggctggatactcaaccctcttctcgaattggccatcatttagacaacaggcaattatctattatgcccccaccattttcggccagctcggcttgtccggcaagacgactggtttgctagctactggagtgtatggaattgtcaatactctctccactcttccagcactgttcttgattgacaagattggtcgccgtccactcctcttgtctggtgctgcgggaaccttcatctccctctgcatagtgggtggggtcattggaggctacggcaacactctcaaggaccaccccgcagctggctggacaggaatcgcctttgtttacatctacgatgtcaacttctcgtactcttgggctcccatcggatgggtactaccgtcggagatttacaacatcggaaaccgttccaaggccatgtcgctgaccacgtcgtcgacatggatgtgcaacttcataattgggctcgtcacacctgacatgcttgagactatcggctacggaacgtaccttttctttgccgcttttgcgcttatcgcattcttctttacctggttcctgatacctgagacgaaggggaaaacactagaagagatggatgctgtgttcaaagacactacagctcacgaagaaaagacgagactttacaacattgctcaaaccctcggcctcgaggaagcagaaaacgccgctttcgacgagaagccacacaaagctctgcaaacagagatgacggggccgtag

SEQ ID NO: 11939 - protein, 558 aa, Phaeosphaeria nodorum
MASDLQIGTRLGGPQKKGLYKELRQNPYLLGLSAFASLGGFLFGYDQGVVSGVLTMESFAAAFPRISYDSSFKGWFVSSLLLAAWLGSLVNGPVADRFGRKGSIMIAVVIFTIGSALQAGAINIEMAFAGRAIAGFAVGMLTMIVPMYMSEVSTAGIRGTLVVLQQLSITLGILVSYWLEYGTQYIGGPRCAPDIPYTGGTMDEPAFDPRTDVGPNGCTGQSDASWRVPFALQIFPGLVLGIGMIFFPESPRYYCMRDNDEAGVRALAKVRQTRPDDELLQKEYLAIKAEVIFEQQYAREKFPGKSGVSLYLAGYSTLFSNWPSFRQQAIIYYAPTIFGQLGLSGKTTGLLATGVYGIVNTLSTLPALFLIDKIGRRPLLLSGAAGTFISLCIVGGVIGGYGNTLKDHPAAGWTGIAFVYIYDVNFSYSWAPIGWVLPSEIYNIGNRSKAMSLTTSSTWMCNFIIGLVTPDMLETIGYGTYLFFAAFALIAFFFTWFLIPETKGKTLEEMDAVFKDTTAHEEKTRLYNIAQTLGLEEAENAAFDEKPHKALQTEMTGP

SEQ ID NO: 11940 - DNA, 1605 bp, Phaeosphaeria nodorum
  CDS (1)..(1605)
atggtcaaggtatcgttcaagccgccgccaggcacgccgggtaaagcatggcccgcagttctggttggtctcttcatggcctttggtggtgtgttgtttggatatgacacaggtaccatctctggtatcattgccatgccctactggcagaaggagttctccacccagccagatggcagcatcacagcttctgaagactctctcattgtttcgattctatctgctggcacattctttggcgccctcggcgcggctccttgtgccgatttccttggtcgaagaatgggtcttatcgtttcagtcggactggtcttcaactttggtgttattcttcagactgcatcaaccagtcaacctttgttcattgctggtcgcttctttgctggttttggtgtcggtctcttatctgctatggttcccatgtaccagtccgagactgcgcccaagtggattcgtggtgtgattgtcggatcctaccagcttgctattacgatcggtcttctgctagccgccattgtcaacaatgctacaaaggaccacaccgattctggatcgtaccgtattccgattgcagtccaattcttgtgggccatcatcttgttgatcggacttttcattctcccagatacaccacgttggttcatcaaggaagacagatacgatgacgccgcaaaggcgctcggaaagcttcgtcgcctgccggtcgatcacccagcagttctcgaggaactgaatgaggtccaagccaaccatctctacgagatgtctcttggcaaagcatcatatatggaatgctgcaagggcactttgggcaagcgccttctcactggatgtcttctccaggctttgcagcaattgactggtgtgaacttcatcttctattatggtacccagtactttaaaagggccggcttcaaggaccccttcaccagtcaggtcatcacgaacgttgtcaacgtcgcatccacgttccctggtctgtacatggttgagaagcttggccgacgtaagctgttgcttcttggagctgttggcatgtctgtttgtcaatttattgtcgccatcaccggtacggtcgccggtaccaccgatcttgctgcgcaacgcaccgctatcgctttcgtctgcatttacatcttcttctttgccagctcctggggacctgtcgcctgggtcgtcacgggtgagatgttcccgctcaaggcccgtgcgaagtgtctttcgatgaccacagcttccaactggctgctcaactgggccattgcctactccacaccttacatggtcgacgagaaaggtgccaacctccaaagcaaggttttcttcgtttgggggtccttctgcttcgtctgcatcgcgtttgtctggttcatgatttacgagaccaagggtcttactctcgaacaggttgacgagctctacggcaccgtcaacaaggcgtggaagtccaaggactttgttcctcaaatcacattcgtcgatgttgaccacgccgcccagaagggaatggctctcaacgagatcggcgaggcgcagaccaggaagaggagtgttcagcatgaagaggccgttggcaagacagacaaccctaacagcggactttaa

SEQ ID NO: 11941 - protein, 534 aa, Phaeosphaeria nodorum
MVKVSFKPPPGTPGKAWPAVLVGLFMAFGGVLFGYDTGTISGIIAMPYWQKEFSTQPDGSITASEDSLIVSILSAGTFFGALGAAPCADFLGRRMGLIVSVGLVFNFGVILQTASTSQPLFIAGRFFAGFGVGLLSAMVPMYQSETAPKWIRGVIVGSYQLAITIGLLLAAIVNNATKDHTDSGSYRIPIAVQFLWAIILLIGLFILPDTPRWFIKEDRYDDAAKALGKLRRLPVDHPAVLEELNEVQANHLYEMSLGKASYMECCKGTLGKRLLTGCLLQALQQLTGVNFIFYYGTQYFKRAGFKDPFTSQVITNVVNVASTFPGLYMVEKLGRRKLLLLGAVGMSVCQFIVAITGTVAGTTDLAAQRTAIAFVCIYIFFFASSWGPVAWVVTGEMFPLKARAKCLSMTTASNWLLNWAIAYSTPYMVDEKGANLQSKVFFVWGSFCFVCIAFVWFMIYETKGLTLEQVDELYGTVNKAWKSKDFVPQITFVDVDHAAQKGMALNEIGEAQTRKRSVQHEEAVGKTDNPNSGL

SEQ ID NO: 11942 - DNA, 1794 bp, Phaeosphaeria nodorum
  CDS (1)..(1794)
atgtgccaatgtgaccacgcgcgtgccaaccagcaagggccatttcccgggccacaacgtgtttctagtggacagaactggagaacacgttacgcaacccagtcaccaagagaggcacagcttcatccttgtcttaccccagacacacccccggaaatcgctcgtttgccgtgggttgattctgaccccacccaactggttgagctaccgctcggcaagatgaagaccttctacaatgtctacgctatatgcggtttcgccgccattggtggtgggctgttcggtttcgacatctcatccatgtctggtgtcctaggaacggcggcttacaagaactactttggccaacccagcggctatcgtcaaggtggtattacggcttctatgcccgcaggctcactggtcggcgcgctaagctcttctttcctggctgatcacctctcgcgccgcactgctatccaaatcgccgctctggtctggatgattggcgccatactccaggcagcatccaatggtatccctctcctttgcgtcggccgtgtcgttggtggctggtctattggtgtctgctccgccattgtccctgtctaccaggcagagatcgcccccaagaacatccgcggccgtgtcgtgtcccttcaacagtgggccatcacctggggtattctgatccaatacttcattcaatatggctcatcattctatgatggcggcgcaaagaatccgacacagggcactgcagccttccgcattccttggggcattcaagctgttcctggcgccatccttcttatcggcatgttcttcttccccttttctcctcgttggctcgcttccaaggatcgctgggaggaggctctaacggtcctggcaaatctccacggtggtggcgacatcaaccaccccgctgtccttgcagagtacaaggagatcgaagaagctcttcgctttgagcgcgagcaggccgagactagcttcggcgctctcataaagcctcgtattatcaagcgtgttattctcggcatgtcgatccagatgtggtcgcagctgtgcggtatgaacatcatgatgtactatattgttttcattatgcgtggagccggtatcgccgatgaacttctcactgcatccattcagtacatcatcaacgtcgccatgactctacctgctatcctttacctcgacaaatttggtcgacgccctgcactcctcactggatctttcttgatggcagtgtggcttttcactgttggtgcacttcaggcatcctacggtaacccaaacccagacaaggccgataaagacatctcctgggtcgttcccaaggagcatagcgccgtctccaagggtatagtagcatgctcctatctgtttgtcgccacttttgccacgacctggggcccaacctcctgggcctacccatcggaaatcttccccgccaaggtccgcgcgaaggcagtttcgctcgctacagtgtggaaagcaagcaactggacctggaattgcattttagccttcgccgtaccgccgcttctgtggagcatcaactggaagatgtacatgatcttcggtaccttcaacgcagtcgcattcatccacatgttcctcaccgcacctgagacgaagggtcgcacgcttgaggaaatggatatcgtgttcgactcgggcatcccggcttggaaggctggacaggttcaagggaggtttgaccagatcaaagccgatatcgaggctggcaacctcaaggttgcaactggtcgtgcttcgagcattgaggttgagccgaaggtttag

SEQ ID NO: 11943 - protein, 597 aa, Phaeosphaeria nodorum
MCQCDHARANQQGPFPGPQRVSSGQNWRTRYATQSPREAQLHPCLTPDTPPEIARLPWVDSDPTQLVELPLGKMKTFYNVYAICGFAAIGGGLFGFDISSMSGVLGTAAYKNYFGQPSGYRQGGITASMPAGSLVGALSSSFLADHLSRRTAIQIAALVWMIGAILQAASNGIPLLCVGRVVGGWSIGVCSAIVPVYQAEIAPKNIRGRVVSLQQWAITWGILIQYFIQYGSSFYDGGAKNPTQGTAAFRIPWGIQAVPGAILLIGMFFFPFSPRWLASKDRWEEALTVLANLHGGGDINHPAVLAEYKEIEEALRFEREQAETSFGALIKPRIIKRVILGMSIQMWSQLCGMNIMMYYIVFIMRGAGIADELLTASIQYIINVAMTLPAILYLDKFGRRPALLTGSFLMAVWLFTVGALQASYGNPNPDKADKDISWVVPKEHSAVSKGIVACSYLFVATFATTWGPTSWAYPSEIFPAKVRAKAVSLATVWKASNWTWNCILAFAVPPLLWSINWKMYMIFGTFNAVAFIHMFLTAPETKGRTLEEMDIVFDSGIPAWKAGQVQGRFDQIKADIEAGNLKVATGRASSIEVEPKV

SEQ ID NO: 11944 - DNA, 1557 bp, Phaeosphaeria nodorum
  CDS (1)..(1557)
atggcaattcctcccaagtggtaccagtcgcagttcttggtcggtcttttcgcctctcttggatctctcctgtacggttatgatctcggtgtcattgcacaggtcatcgcctcacagtcatttaacaccaagtttggtcgtctcaccgatacaatagatgggccccaagtattagtacccgccgcggagaagggagcagtagtttctgtcttcaccggaggtgccttcttcggtgctgcattcggagggcccatgggtgacaggcttggacgacgatggacaattttgatcggcgctgtcatcttctgtcttggaggtgctctccaaactggcgcacagtctttggcatatctatacgcaggaagatcgattgccggtcttggtgttggtatattggtcatgatcattcccgtctaccaaggagaattggctcatcctactatccgtggtcgtatcacatcgctccagcagttcatgttgggcattggtgctctggcggcagcctggatctcctatggaacatacgttggcttcgcgcctgacaatgatggccagtggcgcacaagtcttggtatccaagtcattccagcagttttcctcggtgctctcattctcatgttccccgagtcgccgcgttggttgatcgaccatggtcgcgttgaagaaggtctccgcaacctcgccaagctccacgccaacggcgatgaaagcgatccttgggtacaagccgagttgcagcaaatccaggaccagctcacctttgagcacgaacacgaagcgcaatcgtacgtggagttgctgacagacaaatcgtgcttccgccgcctcttcctggcttgtgctctgcaggcttctgtccagatgacgggtgtttccgcaatccaatactattccgttgagatctacggaaagatgggcattaagggcgatgacaccctgaaataccaggccatctcgtccataattgctcttattgcacagtttctctgcatgtgcttcatcgaccgcttcggacgtcgctggcctctaatcctcggtaaccttggtaacatggtcacattcatcatctcgaccatcatgttggctgtctttcctccgggagctagtaacaacaaggctgctgcttggggcttcatcgttgtcacctggatttacaacttcagcttcagtgcgacttgtggacctttgtcctggatcattccagctgagatcttcgacacaaagacgcgttccaagggagtgtcgatcgcgaccacaacgtcgtttgccttcaatactatgatagggcaagttactcctattgctatggagtctgtgggatggaagttttatatcctgtttgtcgtctgtaacctgacgaatgcgatcttcttctactgcttcctccctgagaccgctaagcgtccgctggaggagatgaactacctgttcacgaacgcgccgattttcgtaccaggaatgaacaagcgcgactgggcccccggtcaagatctcgagcgtcgtgtggaagaagttgaagctaaacgcggctccgtatcccaagtggagagattttga

SEQ ID NO: 11945 - protein, 518 aa, Phaeosphaeria nodorum
MAIPPKWYQSQFLVGLFASLGSLLYGYDLGVIAQVIASQSFNTKFGRLTDTIDGPQVLVPAAEKGAVVSVFTGGAFFGAAFGGPMGDRLGRRWTILIGAVIFCLGGALQTGAQSLAYLYAGRSIAGLGVGILVMIIPVYQGELAHPTIRGRITSLQQFMLGIGALAAAWISYGTYVGFAPDNDGQWRTSLGIQVIPAVFLGALILMFPESPRWLIDHGRVEEGLRNLAKLHANGDESDPWVQAELQQIQDQLTFEHEHEAQSYVELLTDKSCFRRLFLACALQASVQMTGVSAIQYYSVEIYGKMGIKGDDTLKYQAISSIIALIAQFLCMCFIDRFGRRWPLILGNLGNMVTFIISTIMLAVFPPGASNNKAAAWGFIVVTWIYNFSFSATCGPLSWIIPAEIFDTKTRSKGVSIATTTSFAFNTMIGQVTPIAMESVGWKFYILFVVCNLTNAIFFYCFLPETAKRPLEEMNYLFTNAPIFVPGMNKRDWAPGQDLERRVEEVEAKRGSVSQVERF

SEQ ID NO: 11946 - DNA, 1710 bp, Phaeosphaeria nodorum
  CDS (1)..(1710)
atggcgatactcgatcgcttcaaggcgcagtcgcgctcgccagcttcttctgtggctgatccagagaagaagccccagattcttgaaattggcatgcgccagatctttagaccaaggattatcgccatggctatcattgtatcgatgggcggctttatcttcggatacgataccggtcaaatctcaggttttttggagatgccagacttcctagagaagtttgccgaccaaaatgagaacggcgaacggtcattcagcaactggaaatccggtttgatagttgcattgctatcaatcggtaccctgatgggtgcgctcattgctgcgcccatatccgacaagtttggtcgcaagtactccatcatcttctggaacatcatcttctgtgttggagtcatcgtccaaatcgcaaccaccaacatatggtaccaaatctcgctcggaagatgggtcgcaggtctcggggtcggtggcctctcggtccttacgcctatgtaccagtccgaaactgccccaagatatgtgcgcggcgcattggtgtcttgctaccagctctttatcacccttggtatctttgttgcatactgcatcaacttcggcacggagaagaccccaagttcagcgtcctggaagatccccatgggcattggcttcatctggtcgttcctgatgattgtcggcattctgttcatgcaagaatcccccagatgggaataccgtcagggcaaaatcgaaagcgcgcgccacaccatcgcgctcagttacggcgttccagaggaccatccccacgtccagaccgagatccgagagatcgaagagaaactcgaggctgaacgtgctggcggtgaacatcacccatggtacgagatcttcactggcccacgcatgctgtaccgtaccctactcggtatcacactccaagctctccagcagcttacaggcgccaactactacttctactatggcaccacaatcttcaactccgtcggtatccaaaattcctacgtcacctcgatgatcctcggcggcgtaaacttcggcatgaccttccccggcctctacatcgtggaaaaatacggccgccgcccttccctcatctggggcgcgctgtggatgttcatgtgcttcctcgtcttcgcctcgctcggccacttcgccctgcccaaccccgacggctccacgaaccagggcatcggctacgccatgattgtcttcgcgtgcctgttcatctccgggtttgcgatgacgtggggcccgattgtgtgggccgtcgttggcgagatatacccctcgcggtatcgagccaagtgcatggcgctggccactgcatccaactgggtcttcaactttctcatctctttcttcacgccgtacatcacatcggcgattgattaccgctacggatacgtgtttgcggggtgttgtttcgcgggcgcggtggttgtgtacttgtttgtttgcgagagccatgggaggtcgctggaggagattgataccatgtatatcctcggtgtgacgccgtggaagagcaagaattggcacccgacgccaggcgaggatctgccgaatttggatagtacgtatcttacgccgggcgcgaggggcattcgaaagaggcaggaggcgagggtgccggaacagttgaggagagaggaggtgccggttacagaggctgatatgctggcgtcgggagcgaggccggtgcaatag

SEQ ID NO: 11947 - protein, 569 aa, Phaeosphaeria nodorum
MAILDRFKAQSRSPASSVADPEKKPQILEIGMRQIFRPRIIAMAIIVSMGGFIFGYDTGQISGFLEMPDFLEKFADQNENGERSFSNWKSGLIVALLSIGTLMGALIAAPISDKFGRKYSIIFWNIIFCVGVIVQIATTNIWYQISLGRWVAGLGVGGLSVLTPMYQSETAPRYVRGALVSCYQLFITLGIFVAYCINFGTEKTPSSASWKIPMGIGFIWSFLMIVGILFMQESPRWEYRQGKIESARHTIALSYGVPEDHPHVQTEIREIEEKLEAERAGGEHHPWYEIFTGPRMLYRTLLGITLQALQQLTGANYYFYYGTTIFNSVGIQNSYVTSMILGGVNFGMTFPGLYIVEKYGRRPSLIWGALWMFMCFLVFASLGHFALPNPDGSTNQGIGYAMIVFACLFISGFAMTWGPIVWAVVGEIYPSRYRAKCMALATASNWVFNFLISFFTPYITSAIDYRYGYVFAGCCFAGAVVVYLFVCESHGRSLEEIDTMYILGVTPWKSKNWHPTPGEDLPNLDSTYLTPGARGIRKRQEARVPEQLRREEVPVTEADMLASGARPVQ

SEQ ID NO: 11948 - DNA, 1614 bp, Phaeosphaeria nodorum
  CDS (1)..(1614)
atgggtctgatgctgaagaagcccgaggggagtgccggaagcgcattccctgccattctggtcggtttgttcgtcgcctttggcggtgtccttttcggatatgatactggtaccattggtggcatcctgggcatgacctactggaaggataccttcagtaccggttatcgcaacgagaaaaacgagctcgatgttgacgcctcccaatcttctttgatcgtctccatcctctccgctggtacattcttcggtgctcttaccgctgcacctgcagctgatttccttggtcgtcgtctcggtctcgttgcttgcaacgttgtcttctgcgttggtgtcatcttgcagaccatcgctaccgacattcctgtattcgttgctggtcgcttcttcgctggatacggtgttggcatgatcagtgcaaccatccccctctaccagtctgagaccgcgcccaagtggattcgtggtgtcattgttggtgcctaccagcttgctatcactattggtatcctccttgccaacatcgtcaacaacgctactaaggaccgcagcgataccggatcataccgtattcctattgcagtacagttcgcatgggctataatcttgttcgtcggttgcatcttcctcccagagacccctcgttggtacatcaagaagggcaagccagaggccgccgccaagtcgctgtccacccttcgtcgtctcgatatcgaccacccagccgttgtcgaggagcttgccgagatcactgccaaccacgagtacgagctctcgctcggcaagtccacgtacctcgactgcttcaagggcaaccttggcaagcgtctggcgactggttgcttgctccaggccctccagcagcttactggtgtcaacttcatcttctactatggtacctccttcttccagcgtgctggtttcaagaaccccttcatcatttctatgatcacatcatccgttaacgtcgcctccaccttccctggtctttaccttgttgagaagtggggtcgtcgcaaccttctcctcttcggcgctgtcggcatggctgtctgccagttcatcgttgccattactggtaccgttgctggtgttgagaaccaggctgcacagaacgcgctcgtcgcattcgtctgcatctacatcttcttcttcgcctgctcttggggcccagtcgcctgggtcgttactggcgagatcttccccctcaaggtccgcgccaagtccctctccatgaccaccgcctccaactggcttcttaacttcgccattgggtacgccactccctacatggtcaatgacggccctggcaatgccaacctcggagccaaggtcttcttcgtgtggggcggattctgcttcatctgcggattcttcgtctgggccctgatctacgagaccaagggtctgtctcttgagcaagttgacgagctttacggcaaggtcagcaaggcctggaagtctcagggctttgttcccaccgtctctttccaggatgttcaggatatccagggtgacaaccgccgcaagagcttgaccgacgtcgaggctgaggcttcccgcaagagaagcgctcagtacaccgagggcttcaacgagaagtctactgtgtaa

SEQ ID NO: 11949 - protein, 537 aa, Phaeosphaeria nodorum
MGLMLKKPEGSAGSAFPAILVGLFVAFGGVLFGYDTGTIGGILGMTYWKDTFSTGYRNEKNELDVDASQSSLIVSILSAGTFFGALTAAPAADFLGRRLGLVACNVVFCVGVILQTIATDIPVFVAGRFFAGYGVGMISATIPLYQSETAPKWIRGVIVGAYQLAITIGILLANIVNNATKDRSDTGSYRIPIAVQFAWAIILFVGCIFLPETPRWYIKKGKPEAAAKSLSTLRRLDIDHPAVVEELAEITANHEYELSLGKSTYLDCFKGNLGKRLATGCLLQALQQLTGVNFIFYYGTSFFQRAGFKNPFIISMITSSVNVASTFPGLYLVEKWGRRNLLLFGAVGMAVCQFIVAITGTVAGVENQAAQNALVAFVCIYIFFFACSWGPVAWVVTGEIFPLKVRAKSLSMTTASNWLLNFAIGYATPYMVNDGPGNANLGAKVFFVWGGFCFICGFFVWALIYETKGLSLEQVDELYGKVSKAWKSQGFVPTVSFQDVQDIQGDNRRKSLTDVEAEASRKRSAQYTEGFNEKSTV

SEQ ID NO: 11950 - DNA, 1797 bp, Phaeosphaeria nodorum
  CDS (1)..(1797)
atgggtttgggtcaagtggctatcaaggtgcgcggtgccgaatgcggtatcgaggccatcctgttgggaagtgtgacttccattggaggatttttgtttggatatgacacaggacaaatctcatccatgttgattttcccggacttcatcaatcgctttggccaacaacaaccagatggaagtattgcttgggacagcacgatccagtccctggtcgtttccaccatgtctctcggaacccttgtcggagctcttgcaggctcatacactgctgattggtggggtcgtcgaaagagtctgagttttggcgtggccatcttcgtcattggtaacatcatccaaatcaccgccatgtactcgtgggttcatctcatgataggccgtattgtggccggtctcggtgtgggcatattgtcagtgggcgtgcccatgttccaatcagaatgctgcccacgcgagattcgtggtgcagtcgtcgcttcttaccagctcatgatcaccatcggcattctagtcagcaacggcatcaactatggcgtacgcgacagtccaggtgacgacacggacgcttcctggcggatcgtcattggcatgggtatcgctttctctttgcccttgggagctggcattcttgtcgtaccagaatcacccagatggcttgctggacgcggccgttgggaggacgcacggatggctcttgctcgactacgcggccggaaagcggaccccaatcatgagcttgtcaacgacgatttcaacgagatgaaagcaaccatcgaggaacaaaataaagctggtcgaggcacttggaaggaatgcttcactggtcagccctccggcataccgcgactcgtgtaccgtacactcctcggctgcgccctgcaattctttcagcaatggactggcgtcaactacttcttctactatggcgccacagtcttcaatgctgctggtatcgaggacccaatccagacgcaactaatccttggtgcagtcaatgtggccatgactatccctggcctctacttgatcgagcgactcggtcggcgacttccactcatcgttggtggtctttggcaagcggtatggcttcttgtatttgccgttatcgggattgtacggcctccgggtgagaatccatcttctggagtggtcatgattgtcagcgcatgcatgttcatcgcttcgtttgcctgcacgtggggaccatttgtttgggttgtcattggggaaatatttccgcttcgtgtgcgtgcgaagcaggcgtctcttgcaactgctttcaactggcttggcaacttcctcctcgctttcctcactccctacgctaatgaaggcatcggctattcgtttggctttgtgttcttcgcatgcaacttcatcgcagctggtattgtctacttcttcgtcttcgaatctagagcgttgtctctagaatccgtggacatgatgtactctgacggtagcatcaaaccgagggctagcaagaaatgggtgccgccgggctatatcaatcgcctggaacgagatgagacatattggcatcgtcccagtcaaatggagaacacgcaaccctccaacttgcctgcaaactcgatggatgagaagcactatgacaaagatgacacttcaccagaacgcggcatgtctgtgcatcgtgagcacgctgctagcgatgtgaggatatacgtccgctgggtgctgtggcccttcaagctcttcattggtgtcatgtcatccttgtacagcgtctgggatatatgtgatgattgtagctggtacatcttcggcatgtga

SEQ ID NO: 11951 - protein, 598 aa, Phaeosphaeria nodorum
MGLGQVAIKVRGAECGIEAILLGSVTSIGGFLFGYDTGQISSMLIFPDFINRFGQQQPDGSIAWDSTIQSLVVSTMSLGTLVGALAGSYTADWWGRRKSLSFGVAIFVIGNIIQITAMYSWVHLMIGRIVAGLGVGILSVGVPMFQSECCPREIRGAVVASYQLMITIGILVSNGINYGVRDSPGDDTDASWRIVIGMGIAFSLPLGAGILVVPESPRWLAGRGRWEDARMALARLRGRKADPNHELVNDDFNEMKATIEEQNKAGRGTWKECFTGQPSGIPRLVYRTLLGCALQFFQQWTGVNYFFYYGATVFNAAGIEDPIQTQLILGAVNVAMTIPGLYLIERLGRRLPLIVGGLWQAVWLLVFAVIGIVRPPGENPSSGVVMIVSACMFIASFACTWGPFVWVVIGEIFPLRVRAKQASLATAFNWLGNFLLAFLTPYANEGIGYSFGFVFFACNFIAAGIVYFFVFESRALSLESVDMMYSDGSIKPRASKKWVPPGYINRLERDETYWHRPSQMENTQPSNLPANSMDEKHYDKDDTSPERGMSVHREHAASDVRIYVRWVLWPFKLFIGVMSSLYSVWDICDDCSWYIFGM

SEQ ID NO: 11952 - DNA, 1701 bp, Phaeosphaeria nodorum
  CDS (1)..(1701)
atgcgcttcttccgcaagccgaccgaggctgttcatgagaaaggcacccctgccaactctacgccagcagacacaccaccaaggggcaactctcacacggcagagaatgtcgttcctgaaggtcgcatccctgctattgcggtcgtactaggggccgtcgccagcattggtggcttcatgttcggttatgaaagtggtcagatttcgggctttttggcaatgccagacttcatcgagcggttcggtgacaatggagaattctccgatgttcgccaaggaactattgttggtcttcttgctattggtacactcttcggatgcttgtgctcagcacctctcgccgatacctacggccgacgcctcacgatttccggttcagcattcttctacatcattggtgtgatcatcgagattaccagcaaaaaggtatgggtacaattcgcaatgggccgcttcactgccggtcttggcataggagcgctgtccactgtcgtcccaatgtaccagtcagagtcaattcccaagcgcattcgcggagcaactgtcagctcttaccaactgctcatcactcttggtatctggacagcctacatggtcaactacggtaccgtgaaagactactcgaactccgcgcagtggagaatccccaacggcctttccgcactctgggccatcattcttggcagcaccatcctgctgcttccagagtcgccccgctacgcgtaccgcaagggcagaattgatgaggcccgcacgaacatggcccgcctcaacggagtcgacccgcacagcgcctttatcgatgccgagatccgtgaaatccaggagaagctagaggccgagagcgctgggggcgaccacccatggcacgagatctttactggaccccgaatgctctaccgtactctcctcgcaatggtactacaagcgggccagcaactgactggtgcaaactacttcttctactacggcactaccatctttacggctactggtctcgaaaactcctacgtgacctccatcatccttggtaccgtcaacgttgcggctacaatcgttggcctgtggattgtcgagaatgtcggtcgtcgcaaggcgatgatggctggtgcggcatggatgggcatgtgcctcttcatctacgcctttgtcggtcactacacactcgacaagcaaaacccacagcttacgcctgggcccggcaatgtgatgattgttttcacgtgccttttcattgcggctttcgctaccacttggggtcctctcgtgtgggctatcgttggtgaaatgttccctgctcgttaccgcgctctctgcatggctctcgcaaccgccgccaactggctgttcaacttcctaatctcattcctctcgtcaatgatcacccgtcagatcgactacctttatggtctcgtgtttggaacctgctgtttcgcgctcttcttcatcgtatacttcttcatgattgagacgaagggtcgatcgctcgaggagatcgacaccatgtacgtcttgcacgtcaacccaatcaccagcgccaaattcgacgcatcttcgctgcgcaaggatggcctcatcgatacggacaggttacacatgggtgctggcggcaggactttcagcaaggcagagcaggctgggcagaacggaggttcgcgcggcattcttgagccggctgagcgccaggaactccaggtttaa

SEQ ID NO: 11953 - protein, 566 aa, Phaeosphaeria nodorum
MRFFRKPTEAVHEKGTPANSTPADTPPRGNSHTAENVVPEGRIPAIAVVLGAVASIGGFMFGYESGQISGFLAMPDFIERFGDNGEFSDVRQGTIVGLLAIGTLFGCLCSAPLADTYGRRLTISGSAFFYIIGVIIEITSKKVWVQFAMGRFTAGLGIGALSTVVPMYQSESIPKRIRGATVSSYQLLITLGIWTAYMVNYGTVKDYSNSAQWRIPNGLSALWAIILGSTILLLPESPRYAYRKGRIDEARTNMARLNGVDPHSAFIDAEIREIQEKLEAESAGGDHPWHEIFTGPRMLYRTLLAMVLQAGQQLTGANYFFYYGTTIFTATGLENSYVTSIILGTVNVAATIVGLWIVENVGRRKAMMAGAAWMGMCLFIYAFVGHYTLDKQNPQLTPGPGNVMIVFTCLFIAAFATTWGPLVWAIVGEMFPARYRALCMALATAANWLFNFLISFLSSMITRQIDYLYGLVFGTCCFALFFIVYFFMIETKGRSLEEIDTMYVLHVNPITSAKFDASSLRKDGLIDTDRLHMGAGGRTFSKAEQAGQNGGSRGILEPAERQELQV

SEQ ID NO: 11954 - DNA, 1953 bp, Phaeosphaeria nodorum
  CDS (1)..(1953)
atgcctgagcgtaagcctgatatcgaggctactgagccgggactttcgtcctcgggcaacagcagtaagaccgaccttggaactacacgccacacggaggacgcaaaccatgcctccagtgcgccacgaaaagcttctgtcgccgcaaagctacgcaaccccctgactggatttaccgaagaacaagtccttattgacgtcgaaacatggtgtgctgagaaaggactcactgaagacctcgactcgtttcgtaagggcgctttgatcgctcgtgtgggacagcgagatgatgggttcgagtacgttaatatcctcagcgaggaggagaaagaatggctgcgacacgagactacacaccgctggagtcagcctttcatgctgtacttcctggtcgtactttgtgctggatctgccatcgtgcagggtatggaccaaactgccgtcaacggtgctcagctcttctactttgaagaatttggtatcacagatgtctggctccagggtttgcttaacggtgccccatacctgtgctccgctctcatcggttgttggtcgaacgcgcccctcaacaaatactttggacgtcgtggtaccatcttcatttcctgcatcatctcgttcattactggtatatggatggctgcggccaacaactggcctaacctgctcatttcgcgattctttctcggtttcgccgtcggagcaaagtcctcgaccactcccgtctacgctgcagagtctgcgccgaagaatattcgtggtgctttgacaatgatgtggcagatgtggaccgcattcggtattatgttaggtttcatcgtatctgtgggcttccaagacaccgactttctcggcccgtactcccaatggaggtggatgttgggtagcaccagtatccctcctttcatcgtatgcattcaggtctacttctgccctgaatctccgcgatggtacatggagaagggcaagttcgacaaggcattccaatctctctgccgcctccgaaaacacaagatccaggctgcgcgtgacatgtactacgcatacaagttgatcgaagtggaagccgccgagcgagagggtcgtaacccatggaaggagtttttcggtgtgcgccgtaaccgccgtgccgcacagagtgcctttttcgtcatgttcatgcaacaattctgcggtgtcaatgtcattgcctactactcgtcgtccatcttcaagcaggccggtttcagcgactccgaggccctcctcaccagtatgggtacgggcattaccaacttcgtcttcgcaattcctgccatctataccatcgatacttttggtcgccgaaacttgcttcttacaactttcccacttatgggcatctgcttgttgtggtgcggcatgtctttctatcttcctaataatgctgatggaacccccactgctggccgtcttggatctattgcagctgcgatcttcacattcatggctgtgtactctccaggagaaggcccagtgccattcacctactccgctgaggctttcccactgcacctgcgtgacgtgggaatgtcattcgcaactgccgtctgctggggtttcaacttcattctctcacttacatggcctgcgctcgtcaaagccttctccgaacagggcgcgttcggttggtacgcagcgtggaacttcttcggctgggtgtactgctacttcctgctccctgagacgaaaaatcttactcttgaagagctagacactgtgttcgatgtgggcaataagcaatttgcaagttactacagcgcaaagctgccgtggtacttccagaagaacattctgcggcgggacgtacctcccatggagccgctgtacgaattacatgacgagactcttgcgggagaagactattctactagagctgctcccagcgacggtgcagccgcatatggcgagaaaagtgcagaggttcgcgtgtaa

SEQ ID NO: 11955 - protein, 650 aa, Phaeosphaeria nodorum
MPERKPDIEATEPGLSSSGNSSKTDLGTTRHTEDANHASSAPRKASVAAKLRNPLTGFTEEQVLIDVETWCAEKGLTEDLDSFRKGALIARVGQRDDGFEYVNILSEEEKEWLRHETTHRWSQPFMLYFLVVLCAGSAIVQGMDQTAVNGAQLFYFEEFGITDVWLQGLLNGAPYLCSALIGCWSNAPLNKYFGRRGTIFISCIISFITGIWMAAANNWPNLLISRFFLGFAVGAKSSTTPVYAAESAPKNIRGALTMMWQMWTAFGIMLGFIVSVGFQDTDFLGPYSQWRWMLGSTSIPPFIVCIQVYFCPESPRWYMEKGKFDKAFQSLCRLRKHKIQAARDMYYAYKLIEVEAAEREGRNPWKEFFGVRRNRRAAQSAFFVMFMQQFCGVNVIAYYSSSIFKQAGFSDSEALLTSMGTGITNFVFAIPAIYTIDTFGRRNLLLTTFPLMGICLLWCGMSFYLPNNADGTPTAGRLGSIAAAIFTFMAVYSPGEGPVPFTYSAEAFPLHLRDVGMSFATAVCWGFNFILSLTWPALVKAFSEQGAFGWYAAWNFFGWVYCYFLLPETKNLTLEELDTVFDVGNKQFASYYSAKLPWYFQKNILRRDVPPMEPLYELHDETLAGEDYSTRAAPSDGAAAYGEKSAEVRV

SEQ ID NO: 11956 - DNA, 1599 bp, Phaeosphaeria nodorum
  CDS (1)..(1599)
atgcctgcacgacatgcgcccgcgattgtcatgagcacgcctgctcccaaggagattttcaacaagaatgtatacttaacggcaatggtggcgtcgatgggtgcgtttatcttcggttatgatctggcgtttatcgggacgacgattacgctgaagccttttaccaaggactttggtttgatgcacgcgacacagtcgcaaaaagatgctttctcggcgaatatcgtttctttacttcaggctggatgcttcttcggctctttggctgttgcgcctttgggtgacaagttcggtcggaagccagctttgatggtcgccggtgtgctcttctgcattggttctttgatgcagactgttagttttggtcatgtttgggccatgttcttgggtcgtgccattggaggactcggtgtcggtcttgccagtggagtcgttcctctatacgtggctgagctatcgccaccatctattcgaggccgtcttgttggcatctacgaaatcagtgtgcagacaggaacatgtattggcttctggatctgttatggtgtgcaacggaacatgcgcagcaactcgaaccaatggatcacaccgtttgccgtgcaacttattccaggtgtccttctcattattggcatgctatttgttccagaatctccaagatggctggcccaacacaagtctcgcgatgcgtgcgcatctgtcctcagcaaactccgcggtcttccagaagaccatgaatattttcaggaagagctcaaccacattatggataccgtcaacgacgaattcgagaccagaccgagcggcggcatgatcggtcaatggaaagagctcgctgtaccaagcaaccgccgccgtgtcttggtcggcgtgttcatcttcatcttcatgcaaggggccggatcgaacgccatcaactacttctctccccgtatattcaagtccatcggcctcacaggacaatccaccggtctctacgccactggcatctacggcgtcgtccgactcgtctgcgtcatcatcgccatgtactacgttgtagacaagtttggccgaaggaacatgctcatgggcggtgcggcagtcatgcttgtcgcaatgtggttcatcggcgcatacattaagatcgccaagccagaagcctctggcaaaccccacttgacagctggaggctacgcagccgttaccttcatctacatcttcgccgtcggattctgtttctcgtacgctggtgtaccgtggatctactgcgcagagatctttcctcttcgcattcgtggaatcggcatggcgatttgcacggcgacgcactggttgttcaacttcgtcatcgctcgatcagtaccttatatggtaaccaatatcggatatggcacttacttcgtgtttgctacttgtctgacattgtccattgtgtttgtgtacttcttcttaccagagacaaagggtctttcgctcgaggagatcgatatactgttcggtggatcaggaccaagctcttttgatgcagctagactcgaagaggagaagctgggctcaaagtcagacgtcgtttacgttgagcgattcttccttatgtacaatagatctcatacataa

SEQ ID NO: 11957 - protein, 532 aa, Phaeosphaeria nodorum
MPARHAPAIVMSTPAPKEIFNKNVYLTAMVASMGAFIFGYDLAFIGTTITLKPFTKDFGLMHATQSQKDAFSANIVSLLQAGCFFGSLAVAPLGDKFGRKPALMVAGVLFCIGSLMQTVSFGHVWAMFLGRAIGGLGVGLASGVVPLYVAELSPPSIRGRLVGIYEISVQTGTCIGFWICYGVQRNMRSNSNQWITPFAVQLIPGVLLIIGMLFVPESPRWLAQHKSRDACASVLSKLRGLPEDHEYFQEELNHIMDTVNDEFETRPSGGMIGQWKELAVPSNRRRVLVGVFIFIFMQGAGSNAINYFSPRIFKSIGLTGQSTGLYATGIYGVVRLVCVIIAMYYVVDKFGRRNMLMGGAAVMLVAMWFIGAYIKIAKPEASGKPHLTAGGYAAVTFIYIFAVGFCFSYAGVPWIYCAEIFPLRIRGIGMAICTATHWLFNFVIARSVPYMVTNIGYGTYFVFATCLTLSIVFVYFFLPETKGLSLEEIDILFGGSGPSSFDAARLEEEKLGSKSDVVYVERFFLMYNRSHT

SEQ ID NO: 11958 - DNA, 1758 bp, Phaeosphaeria nodorum
  CDS (1)..(1758)
atggctcctgttggtggcggggctgccgagttcgaggctgccgctttggctcgccgcaaggctctctccggagccacggggcctatggccttggtcaagaacttgaaggtctttggcattgcatgctttgcgtgcttgggtggcctgctttatggttacaaccaaggtgtattctctggtgttcttaccatgacttctttcaaggagcacatgggcgactatattgaagatgccgacaagctcacatggaactcctccaagcagggttggctcgtctctattctcgagctcggagcctggctcggaactatgtactctggattcctcgctgagattttgtctcgtaaatacgccattctcgtcaacgtcgctatcttcatcatcggtgttgtgattcagacaacttcgattagcgctggacacaacgcaatcctcgcgggacgattcatcacaggtatgggggttggttcgctctccatgattgtacccatgtacaacgccgagatcgcgcctcctgaggtccgtggtgcgcttgtcggtcttcagcaactctccatcactctcggtattatgataagtttctggatcgactatggcacgaacttcatcggtggcactggtcgtagccaaaaggaagcggcatggcttctcccactctgtctgcaactcgtcccggctgtccttcttggtgtgggcatgatctttatgcctttctccccacgttggctggtccatcatgaccgcgagcctgaagctcaacgggttttggctcaactccgaagcctaccagaggagcacgagctgatcgagcttgaatttgctgagatcaaggcacaatcgctcttcgagaagaagtccctccgcgagaacttcccacatctccaggatatgagcgcgttgtcgactttcaagctgcagtttgttgctattggcagtctcttcactaccaggggtatgttcaagcgcgttatcatcgcgaccatgacgatgtttttccaacagtggacgggtatcaacgcaattttgtactacgcgcccaccatcttttcaggattgggtttgagctccaactcagtgagtttgctagccacgggtgtggtcggtattgttatgttcattgctaccattcccgccgtcatgtacgtggatagctggggtcgtaagccagtccttgtcatcggtgctatcggcatggcactctgccatttcatcattgctgccatcgttgccagcttttccgatgactggccaaaccaccagggtgccggttgggccgccgtcgttatggtctggctgttcgtcattcacttcggttactcctggggcccttgtgcctggatcgtggttgctgagatctggcccttgtctaaccgtccatatggtatcgcacttggcgcatcatccaactggatgaacaactttattgttggtcaggtcacacccgacatgctcacgcacttgaagtacggaacttacatcttcttcggtatcttcaccgctatgggagctgccttcatcgccttctacttccccgagactaaaggtctcaccctcgaggagatggacacgctctttggttccgtcggtactgctgagcgtgagaaagagcgctggagggaggtccatgctgaggtcgggctcactgagctcctccgtcgggctggtgtatacaacggaagtgatgaacacgttgctggaggtgacatggaaaagcctgtcctagagaccaagcacgaggagcacactcctgttgcatag

SEQ ID NO: 11959 - protein, 585 aa, Phaeosphaeria nodorum
MAPVGGGAAEFEAAALARRKALSGATGPMALVKNLKVFGIACFACLGGLLYGYNQGVFSGVLTMTSFKEHMGDYIEDADKLTWNSSKQGWLVSILELGAWLGTMYSGFLAEILSRKYAILVNVAIFIIGVVIQTTSISAGHNAILAGRFITGMGVGSLSMIVPMYNAEIAPPEVRGALVGLQQLSITLGIMISFWIDYGTNFIGGTGRSQKEAAWLLPLCLQLVPAVLLGVGMIFMPFSPRWLVHHDREPEAQRVLAQLRSLPEEHELIELEFAEIKAQSLFEKKSLRENFPHLQDMSALSTFKLQFVAIGSLFTTRGMFKRVIIATMTMFFQQWTGINAILYYAPTIFSGLGLSSNSVSLLATGVVGIVMFIATIPAVMYVDSWGRKPVLVIGAIGMALCHFIIAAIVASFSDDWPNHQGAGWAAVVMVWLFVIHFGYSWGPCAWIVVAEIWPLSNRPYGIALGASSNWMNNFIVGQVTPDMLTHLKYGTYIFFGIFTAMGAAFIAFYFPETKGLTLEEMDTLFGSVGTAEREKERWREVHAEVGLTELLRRAGVYNGSDEHVAGGDMEKPVLETKHEEHTPVA

SEQ ID NO: 11960 - DNA, 1644 bp, Candida intermedia
  CDS (1)..(1644)
atgtcacaagattcgcattcttctggtgccgctacaccagtcaatggttccatccttgaaaaggaaaaagaagactctccagttcttcaagttgatgccccacaaaagggtttcaaggactacattgtcatttctatcttctgttttatggttgccttcggtggtttcgtcttcggtttcgacactggtaccatttccggtttcgtgaacatgtctgactttaaagacagattcggtcaacaccacgctgatggtactccttacttgtccgacgttagagttggtttgatgatttctattttcaacgttggttgcgctgtcggtggtattttcctctgcaaggtcgctgatgtctggggtagaagaattggtcttatgttctccatggctgtctacgttgttggtattattattcagatctcttcatccaccaagtggtaccagttcttcattggtcgtcttattgctggtttggctgttggtaccgtttctgtcgtttccccacttttcatctctgaggtttctccaaagcaaattagaggtactttagtgtgctgcttccagttgtgtatcaccttgggtatcttcttgggttactgtactacttacggtactaagacctacactgactctagacagtggagaattcctttgggtttgtgtttcgcttgggctatcttgttggttgtcggtatgttgaacatgccagagtctccaagatacttggttgagaagcacagaattgatgaggccaagagatccattgccagatccaacaagatccctgaggaggacccattcgtctacactgaggttcagcttattcaggccggtattgagagagaagctttggctggtcaggcatcttggaaggagttgatcactggtaagccaaagatcttcagaagagttatcatgggtattatgcttcagtccttgcaacagttgaccggtgacaactacttcttctactacggtactaccattttccaggctgtcggtttgaaggattctttccagacttctatcattttgggtattgtcaactttgcttccaccttcgttggtatctatgtcattgagagattgggtagaagattgtgtcttttgaccggttccgctgctatgttcatctgtttcatcatctactctttgattggtactcagcacttgtacaagcaaggttactccaacgagacctccaacacttacaaggcttctggtaacgctatgatcttcatcacttgtctttacattttcttctttgcttctacctgggctggtggtgtttactgtatcatttccgagtcctacccattgagaattagatccaaggccatgtctattgctaccgctgctaactggttgtggggtttcttgatttccttcttcactccattcatcaccagtgccatccacttctactacggtttcgttttcactggttgtttggctttctctttcttctacgtctacttcttcgtctacgaaaccaagggtctttctttggaggaggttgatgagatgtacgcttccggtgttcttccactcaagtctgccagctgggttccaccaaatcttgagcacatggctcactctgccggttacgctggtgctgacaaggccaccgacgaacaggtttaa

SEQ ID NO: 11961 - protein, 547 aa, Candida intermedia
MSQDSHSSGAATPVNGSILEKEKEDSPVLQVDAPQKGFKDYIVISIFCFMVAFGGFVFGFDTGTISGFVNMSDFKDRFGQHHADGTPYLSDVRVGLMISIFNVGCAVGGIFLCKVADVWGRRIGLMFSMAVYVVGIIIQISSSTKWYQFFIGRLIAGLAVGTVSVVSPLFISEVSPKQIRGTLVCCFQLCITLGIFLGYCTTYGTKTYTDSRQWRIPLGLCFAWAILLVVGMLNMPESPRYLVEKHRIDEAKRSIARSNKIPEEDPFVYTEVQLIQAGIEREALAGQASWKELITGKPKIFRRVIMGIMLQSLQQLTGDNYFFYYGTTIFQAVGLKDSFQTSIILGIVNFASTFVGIYVIERLGRRLCLLTGSAAMFICFIIYSLIGTQHLYKQGYSNETSNTYKASGNAMIFITCLYIFFFASTWAGGVYCIISESYPLRIRSKAMSIATAANWLWGFLISFFTPFITSAIHFYYGFVFTGCLAFSFFYVYFFVYETKGLSLEEVDEMYASGVLPLKSASWVPPNLEHMAHSAGYAGADKATDEQV

SEQ ID NO: 11962 - DNA, 1569 bp, Candida intermedia
  CDS (1)..(1569)
atgggtttggaggacaatagaatggttaagcgtttcgtcaacgttggcgagaagaaggctggctctactgccatggccatcatcgtcggtctttttgctgcttctggtggtgtccttttcggatacgatactggtactatttctggtgtgatgaccatggactacgttcttgctcgttacccttccaacaagcactcttttactgctgatgaatcttctttgattgtttctatcttgtctgttggtactttctttggtgcactttgtgctccattccttaacgacaccctcggtagacgttggtgtcttattctttctgctcttattgtcttcaacattggtgctatcttgcaggtcatctctactgccattccattgctttgtgctggtagagttattgcaggttttggtgtcggtttgatttctgctactattccattgtaccaatctgagactgctccaaagtggatcagaggtgccattgtctcttgttaccagtgggctattaccattggtcttttcttggcctcttgtgtcaacaagggtactgagcacatgactaactctggatcttacagaattccacttgctattcaatgtctttggggtcttatcttgggtatcggtatgatcttcttgccagagactccaagattctggatctccaagggtaaccaggagaaggctgctgagtctttggccagattgagaaagcttccaattgaccacccagactctctcgaggaattaagagacatcactgctgcttacgagttcgagactgtgtacggtaagtcctcttggagccaggtgttctctcacaagaaccaccagttgaagagattgttcactggtgtggctatccaggctttccagcaattgaccggtgttaacttcattttctactacggtactaccttcttcaagagagctggtgttaacggtttcactatctccttggccactaacattgtcaatgtcggttctactattccaggtattcttttgatggaagtcctcggtagaagaaacatgttgatgggtggtgctactggtatgtctctttctcaattgatcgttgccattgttggtgttgctacctcggaaaacaacaagtcttcccagtccgtccttgttgctttctcctgtattttcattgccttcttcgctgccacctggggtccatgtgcttgggttgttgttggtgagttgttcccattgagaaccagagctaagtctgtctccttgtgtactgcttccaactggttgtggaactggggtattgcttacgctactccatacatggtggatgaagacaagggtaacttgggttccaatgtgttcttcatctggggtggtttcaacttggcttgtgttttcttcgcttggtacttcatctacgagaccaagggtctttctttggagcaggtcgacgagttgtacgagcatgtcagcaaggcttggaagtctaagggcttcgttccatctaagcactctttcagagagcaggtggaccagcaaatggactccaaaactgaagctattatgtctgaagaagcttctgtttaa

SEQ ID NO: 11963 - protein, 522 aa, Candida intermedia
MGLEDNRMVKRFVNVGEKKAGSTAMAIIVGLFAASGGVLFGYDTGTISGVMTMDYVLARYPSNKHSFTADESSLIVSILSVGTFFGALCAPFLNDTLGRRWCLILSALIVFNIGAILQVISTAIPLLCAGRVIAGFGVGLISATIPLYQSETAPKWIRGAIVSCYQWAITIGLFLASCVNKGTEHMTNSGSYRIPLAIQCLWGLILGIGMIFLPETPRFWISKGNQEKAAESLARLRKLPIDHPDSLEELRDITAAYEFETVYGKSSWSQVFSHKNHQLKRLFTGVAIQAFQQLTGVNFIFYYGTTFFKRAGVNGFTISLATNIVNVGSTIPGILLMEVLGRRNMLMGGATGMSLSQLIVAIVGVATSENNKSSQSVLVAFSCIFIAFFAATWGPCAWVVVGELFPLRTRAKSVSLCTASNWLWNWGIAYATPYMVDEDKGNLGSNVFFIWGGFNLACVFFAWYFIYETKGLSLEQVDELYEHVSKAWKSKGFVPSKHSFREQVDQQMDSKTEAIMSEEASV

SEQ ID NO: 11964 - DNA, 1641 bp, Aspergillus oryzae
  CDS (1)..(1641)
atgggtgttgagacttctgccgagcatggggagatgatcagcccagctggcgctccccaatactccagccaagaatccgtggctgctaacaagcctatggaaattggtgttgacactcccgttccccgcattaccctgcgggcgtttgttatgggtgccttcgtttctatgggtggtcttcttttcggatacgacaccggtcagatctccggtttccaagagatggataactatcttgaacgctatggtcaactgaacgatgagggtaaatattatttcagccatgtccgctccggtcttattgtcagtctgttatccatcggtaccttgattggtgctctggttgccgctcctatagccgataagcttggtcgtaaatggtctatcactttctggtgtatcatcctcaatgtcggcttgattattcagatctcttcccctgccggtaaatgggttcagatggtcatgggccgttgggtgactggtcttggcgttggtggttgctccctgctcgttcccatgtaccagggtgagagtgctcctcgccaggtccgtggtgccatgatcagttgctaccagctgttcgtcactcttggtatcttcctttcctactgcattaacttgggaaccgagcatctcgaaggcactgagcagtggcggattaccttgggtcttaccttcctctttgctctcattctcggtggtggcatggcttgcttccctgagagcccacgtttcgagttccgtcacggccgtgtcgatagtgctcgtaacaccatgtccaagctctatggtgtccccgagaaccaccgcgtcatcctccaggaaatcgaggagatccagcaacaactcgacgccgaatcccaagagcaggtgtggcacgagttcatcaccgctcctcgcatgttgtaccgtatcgccctgggtatggttctgcagtctttgcaacagctgactggtgccaactacttcttctattatggtaccactatcttccaaggtgccggtatctccaacagcttcatcacccaagttattcttggtgctgttaacttcggtaccactttcggtggtctctacattgttgagaacttcggtcgtcgcaagtctctcatcgctggtgctgctttcatgtttgtttgcttcatgatcttcgcttctattggccacttcatgttggacgttcagaaccccgaaaacactcccggacctggtaagggcatggttgttgtcgcctgtttcttcatcaccgcctacgccatgacctggggtcccatgatctgggctatctgcgccgaactgttcccttccaagtaccgtgccaagggtatggctctggccaccgcatccaactggctctggaacttcctcatcggttttttcaccccattcatcaccggtgcaattgactttgcctacggatacgtcttcgctggatgcttggctgtcgctgctctcgtcgtctacttcttcgtcatcgagggtaagggccgcactctcgaggagctcgactggatgtacgtcaacaaggtcgctccctggaagagcagcaactttgagatgccttctcttcacgaccagcagtatggcaaccagcatggtcgcaaggaatctcgctcttatcacgccgagaacgcataa

SEQ ID NO: 11965 - protein, 546 aa, Aspergillus oryzae
MGVETSAEHGEMISPAGAPQYSSQESVAANKPMEIGVDTPVPRITLRAFVMGAFVSMGGLLFGYDTGQISGFQEMDNYLERYGQLNDEGKYYFSHVRSGLIVSLLSIGTLIGALVAAPIADKLGRKWSITFWCIILNVGLIIQISSPAGKWVQMVMGRWVTGLGVGGCSLLVPMYQGESAPRQVRGAMISCYQLFVTLGIFLSYCINLGTEHLEGTEQWRITLGLTFLFALILGGGMACFPESPRFEFRHGRVDSARNTMSKLYGVPENHRVILQEIEEIQQQLDAESQEQVWHEFITAPRMLYRIALGMVLQSLQQLTGANYFFYYGTTIFQGAGISNSFITQVILGAVNFGTTFGGLYIVENFGRRKSLIAGAAFMFVCFMIFASIGHFMLDVQNPENTPGPGKGMVVVACFFITAYAMTWGPMIWAICAELFPSKYRAKGMALATASNWLWNFLIGFFTPFITGAIDFAYGYVFAGCLAVAALVVYFFVIEGKGRTLEELDWMYVNKVAPWKSSNFEMPSLHDQQYGNQHGRKESRSYHAENA

SEQ ID NO: 11966 - DNA, 1557 bp, Aspergillus oryzae
  CDS (1)..(1557)
atgacgccgttgatttgtcgaatccccatgttctccatagtactcctgctcgccgcatttggcaccattggcggtgcccttttcggttttgatgttagttctatgagtgcctggattggcacgaagcagtatctcgactattttaacagccccgactccaacttacaaggtggtatcactgcttccatgtccgcgggttctttcgctggcgccatcgctgctggttgggtctctgatatcgtgggtcgtcggatgtcccttatgatcgcgagtgtgatctggattattggtgccgtccttcagcttagcgcacagaacgtcgcgcatctggttgtcggacgtgtcgtcagcggtctttctgtcggtatcacttcctcccaggtctgtgtgtatcttgcagaattggctcccgctcgcatccgtggtcgcatcgtcggtatccagcaatgggctatcgaatggggtattctgatcatgtatctgatttcctacggctgtggaaagggtatcgagggcccagcctcattccgcgtcgcttggggcatccaagccgtccccggtctcattttgctgttggccctcccgtttttcccggagtcgccccgttggctggctagcaaggaaaggtgggaagagagtctggacacgctagcgttgctgcacggtaaaggcgatcgtaacgaccccgtcgtgcaggtcgaatgggaggaagtgcaggaggctgtgcgtatcgcccgtgaggcaaaggacgtgactttcctggctctgtttggacccaagatttggatgcgcaccatgtgtggcgtcagtgtgcaggtgtggcagcaactgctcggtggtaatgttgctatgtactatgtcgtctacattttcaccatggccggcatggacaacaacgccactttgtattcctctgcgatccagtacgtgatcttccttgtcaccaccggtgtcgttctgccatatatcgaccgcatcggccgccgcttcctgttgctatcgggtgccatcacctgcatgatacttcattatgcaattgctggtgtcatggcgagctatggtaatccggtcgaccagatcgatggtaacgagaatttgcgatgggagatcaagggagctccaggcaaggctgtcattgctctctcgtacatcttcgtcggtgtttacggtctcacctgggcccctgccgcctggatttacgcctctgaagtgttccccctgaagtaccgtgctaagggtgtcggtctttctgccgcgggtaactggatcttcaacttcgccctggcctacttcgtcgctcccgccttcaccaacatcaagtggaagacctacatcatcttcggcgtgttctgcacggtgatgaccttccatgtgttcttcatgtatcccgagacggcgcgtcggtcgcttgaagaaattgatataatgttcgagtcgaacgtgaagccgtggcagtcgagcaaactccaagataaatttggagaggagatcgcacggcgccagcagagtgtttcggaagagaaggcagcagatgcctcccacaaggaagttgcctag

SEQ ID NO: 11967 - protein, 518 aa, Aspergillus oryzae
MTPLICRIPMFSIVLLLAAFGTIGGALFGFDVSSMSAWIGTKQYLDYFNSPDSNLQGGITASMSAGSFAGAIAAGWVSDIVGRRMSLMIASVIWIIGAVLQLSAQNVAHLVVGRVVSGLSVGITSSQVCVYLAELAPARIRGRIVGIQQWAIEWGILIMYLISYGCGKGIEGPASFRVAWGIQAVPGLILLLALPFFPESPRWLASKERWEESLDTLALLHGKGDRNDPVVQVEWEEVQEAVRIAREAKDVTFLALFGPKIWMRTMCGVSVQVWQQLLGGNVAMYYVVYIFTMAGMDNNATLYSSAIQYVIFLVTTGVVLPYIDRIGRRFLLLSGAITCMILHYAIAGVMASYGNPVDQIDGNENLRWEIKGAPGKAVIALSYIFVGVYGLTWAPAAWIYASEVFPLKYRAKGVGLSAAGNWIFNFALAYFVAPAFTNIKWKTYIIFGVFCTVMTFHVFFMYPETARRSLEEIDIMFESNVKPWQSSKLQDKFGEEIARRQQSVSEEKAADASHKEVA

SEQ ID NO: 11968 - DNA, 1629 bp, Aspergillus oryzae
  CDS (1)..(1629)
atgtggacgaccactagcggcctgagtggtcggtcgctccgattgagcatcacctttgccgctgtcgtgggtttctcgctttttggctacaaccagggcatgatggctggcctcctcaacggcgacgagttcgtggactcttttccaatcctcaaaatgcctgacaatccgactgcgggcgaaaagcactacatcgacgtcatccgtggtgctgtcacatcctgttacgagcttggctgtttcttcggcgcgttattctccatgttcttgggcgacaaactcggccgtactcgcctgatctttatgggtgccagtatcctgatcattggggccttgttgacaacggtctgcttcactggtcattgggaagttggtcagtttgtcatcggccgtgttgtatcgggtattggaaatggtatgaacaccgctacaatcccagtttggcaatcagagtgctccggcgctcacaatcgtggttttctggtgtgctttgagggcgccatgatcgctggtggtactttcattgcctactgggtggtcttcggtatgtcgcacgccgccgattctgtccaatggcgattcccggtggcgctgcagatctttttcgcgttggttgtggctgctggtgccatgatgctcccggattctccgtcttggtttgtcatgagagggctcgacaaggaggcctgtgaagttcttggcaagctgaagggtacctctcctgattctgatcaagtccttcatgacttcaacttcttaaaacaagacatggaatcctcaaagaacacacagtcaaactggaagacggttttcacatttggcaaaacccaggaattccagcgccttctcattggctgttccggtcagtttttccagcagtttactggctgtaacgctgcaatctactactcaacattacttttccaagagaacctaggtatggagaaatacctatctctaattatgggaggtgtattcgcgactgtttacgttttggcaactatcccgtcattttttatgattgaaaaagtcggccgtcgtaacctctatctggtgggtttcctaggccaagggctgagctttgttatcacatttgcttgcttgattaaggaaactgaggagaactcgaagggtgctgctgttggcatctttttgttcattaccttctttgcatttactctgttgccactgccctggatctacccccctgagatcaacccacttcggacacgtactgtcggcgcgtcggcatcgacctgtactaattggatctgcaactttgccgtggttatgttcacaccccttttcgctggtcagagcccatggggtgtgtatctcttcttcgcgctcttcaacttcctcggtctgatcttcggcttcttcttctatgttgaaacagccggccgtgagcttgaagaggtcgacatcatctacgccaaagcccatgtcgaagggaagatggcatggagggtcgccaacaccatgcccaagctcagcttcgaagaaatcacccagcagtctcgcgagctgggcctggacaccaacgaccatggcgtgcacgagaagactgagcttggcctcagcagtgacagtggccaggagactgaagaggtccacgagaagcattaa

SEQ ID NO: 11969 - protein, 542 aa, Aspergillus oryzae
MWTTTSGLSGRSLRLSITFAAVVGFSLFGYNQGMMAGLLNGDEFVDSFPILKMPDNPTAGEKHYIDVIRGAVTSCYELGCFFGALFSMFLGDKLGRTRLIFMGASILIIGALLTTVCFTGHWEVGQFVIGRVVSGIGNGMNTATIPVWQSECSGAHNRGFLVCFEGAMIAGGTFIAYWVVFGMSHAADSVQWRFPVALQIFFALVVAAGAMMLPDSPSWFVMRGLDKEACEVLGKLKGTSPDSDQVLHDFNFLKQDMESSKNTQSNWKTVFTFGKTQEFQRLLIGCSGQFFQQFTGCNAAIYYSTLLFQENLGMEKYLSLIMGGVFATVYVLATIPSFFMIEKVGRRNLYLVGFLGQGLSFVITFACLIKETEENSKGAAVGIFLFITFFAFTLLPLPWIYPPEINPLRTRTVGASASTCTNWICNFAVVMFTPLFAGQSPWGVYLFFALFNFLGLIFGFFFYVETAGRELEEVDIIYAKAHVEGKMAWRVANTMPKLSFEEITQQSRELGLDTNDHGVHEKTELGLSSDSGQETEEVHEKH

SEQ ID NO: 11970 - DNA, 1629 bp, Aspergillus oryzae
  CDS (1)..(1629)
atgtggacaaccacctgtggctttcggggccgaaagctccgtctagccatcaccatcaccgccgtcctcggtttctcgctcttcggttacgatcagggtctgatgtccggtattatcgccggtactgagtttacgaaagagttcaaaccgctatacatccccggcgacgccacagaggcgtacaagtcgcatgtctcggttctccaaggtgcggtcacagcttgctatgaattgggctgtttcttcggtgccattttcaccatgatgttcggtgagcggattggtcgtacacctttgctagtggctggtggtattattatggctgtcggtgccttgatctccaccgtttctttcggtcctcactggggtctgggccaattcgttattggtcgtgtgatttcaggtcttggaaacggtatggatactgctacgattccagtttggcagtcggaatgttctaaggcccataaccgtggtttccttgtctgtttcgaaggtgccattatcgccgttggcacgtttgtcgcctactggattgatttcggtctctcatatgtggattcctcggttcagtggcggttccccgtggccttccagattctctttgccgtcttcgtgactgccggcgctcttatgctgcccgagtctcctcgatggtttgttatgcggggatatgataaggaagcttgcgaggtgcttggtgctcttagcgatcttcctgccgattcggaggaggtgctcgccgatttcaacctgatgaaggctgaccttgctgctaccgaggatagcaaggccagttggaaaacactctttacctttggcaagacccaagagttccagcgtatgatgattggttgctctggccagttcttccaacaattcaccggatgcaacgccgctatctactactctaccctgttgttcgagaacaacctgcacttggagaaacgtctctcgttgattatgggtggtgtctttgctaccgtctacgcccttgctactattccttctttctttatgattgagaaggtcggtcgtcgcaagctgttcttgattggttttgcgggtcagggtctcagtttcattattactatgggctgcctgattaaggacacttcggagaacgctaagggtgctgccgtcggtatcttcctctttattgtctttttcgccttcacgactctccccttgccctggatctaccctcccgagatcaacccgctccgtacccgtactatggctgcctctgcctccacttgcaccaactggatctgcaactttgccgtcgtcatgttcactcctgtcttctcctctgccagtccctggggtatttacctcttctttgccctggtcaacttcaccgctattcctttcgcctggtttttctactgtgagactgctggccgtgcgctggaggagattgacattatctttgcgaaggcccacgtggaaggcaaatgggcttaccagatcgccaacaccctgcccaagctcacccccgaacagatgtctcagatggcgaccgagctgggcttggatgtgtcgacgcagcccgtcgcctatggcgctgagaaggctgagcttgctcttagcagtggcgagagccaggaaaaacagactgctaattag

SEQ ID NO: 11971 - protein, 542 aa, Aspergillus oryzae
MWTTTCGFRGRKLRLAITITAVLGFSLFGYDQGLMSGIIAGTEFTKEFKPLYIPGDATEAYKSHVSVLQGAVTACYELGCFFGAIFTMMFGERIGRTPLLVAGGIIMAVGALISTVSFGPHWGLGQFVIGRVISGLGNGMDTATIPVWQSECSKAHNRGFLVCFEGAIIAVGTFVAYWIDFGLSYVDSSVQWRFPVAFQILFAVFVTAGALMLPESPRWFVMRGYDKEACEVLGALSDLPADSEEVLADFNLMKADLAATEDSKASWKTLFTFGKTQEFQRMMIGCSGQFFQQFTGCNAAIYYSTLLFENNLHLEKRLSLIMGGVFATVYALATIPSFFMIEKVGRRKLFLIGFAGQGLSFIITMGCLIKDTSENAKGAAVGIFLFIVFFAFTTLPLPWIYPPEINPLRTRTMAASASTCTNWICNFAVVMFTPVFSSASPWGIYLFFALVNFTAIPFAWFFYCETAGRALEEIDIIFAKAHVEGKWAYQIANTLPKLTPEQMSQMATELGLDVSTQPVAYGAEKAELALSSGESQEKQTAN

SEQ ID NO: 11972 - DNA, 1698 bp, Aspergillus oryzae
  CDS (1)..(1698)
atggaatcaacagttatagatcactcctctcgagggggctttgccctcatctaccagaatccctatttactgggcgttgcttcgttctcaactcttggaggtctcctcttcggatatgatcagggcgtggtatcgggggtcattacaatggaatcctttggagctcgattccctcgaatatacacagacagtagcttcaagggatggtttgtgtcgacactgctcctcgctgcatggttcggatctctaatcaacggcccaatcgcagatcgattgggccggaaactgtctatgaatgtcgccgtcgttatcttcgtgataggatcagctatccaatgcggtgccgtgaacatcccaatgctcttcgtcggacgtgcaattgccggtctagccgttggccaattaaccatgatcgtgccactctacatttcagaggtctccatccccgagatccgtggtggcctcgtcgtcctccaacaactctcaataacaatcggcatcctaattagctactggatcgactacggcacaaattacataggcggcacacgctgcgcccccaacaccccctacacaggccatacaaagaccacacccaccttcaacccctacacagacgtcccgcccaacggctgcacaggacaatccgaagcctcctggcgtctccccctcgccatccaaatcctcccagccctcatcctaggcctcggcattatcttcttccccgactctccccgctggctggcaatgaaagaacgcgacgacgaagccctaacagccctctccaagctgcgccgccagaccagagacagtcctgcgctggtaaatgagttcctcgagatcaaggcgtcgattatgctagaaaacactttcgcccgggaccatttcccgggcctatctggcctccggctgcatgctgcgcagtatgtgtcgtttttgacgacgtgggcgcggttcaagaggctggctatcgggtgctgtgtgatgttttttcagcagtttatgggctgcaatgctatgatatactacgccccgacgatctttgcgcagttgggtttggatgggaatacgacttctcttcttgcgacgggtgtgtacggcattgttaactgtctcagcaccttgccggcgcttttcttgattgataagattggtcgtcgggttctactcatgtctggtgctgtagggacctgtatctcgctggtgattgtgggtgcgcttatcggggcgtatggatccgatttggtcaaccataaatccgctgggtgggcaggtattgccttcatttatatttacgatattaacttttcctactcttttgctcccattggatgggtcctgccctcagaaatcttcaacctttctatccgttctaaggccatttcaatcacaacttcggcgacctggatgtgcaattttatcattggattgatcacccctgatatgctcgagtcaatcacttggggtacctatatcttctttgcggcattctgtctccttgcactggcattcacgttcttctgtattccggagacccgtggaaagactttggaagatatggaccttattttcggagacacagcagcccacgaagagaaacaacgcattgttcagattgaggccgagctccgtggtacgcagggccctaataaggacaccttagtaaagccctccgtacagcaggaagagtacgtttga

SEQ ID NO: 11973 - protein, 565 aa, Aspergillus oryzae
MESTVIDHSSRGGFALIYQNPYLLGVASFSTLGGLLFGYDQGVVSGVITMESFGARFPRIYTDSSFKGWFVSTLLLAAWFGSLINGPIADRLGRKLSMNVAVVIFVIGSAIQCGAVNIPMLFVGRAIAGLAVGQLTMIVPLYISEVSIPEIRGGLVVLQQLSITIGILISYWIDYGTNYIGGTRCAPNTPYTGHTKTTPTFNPYTDVPPNGCTGQSEASWRLPLAIQILPALILGLGIIFFPDSPRWLAMKERDDEALTALSKLRRQTRDSPALVNEFLEIKASIMLENTFARDHFPGLSGLRLHAAQYVSFLTTWARFKRLAIGCCVMFFQQFMGCNAMIYYAPTIFAQLGLDGNTTSLLATGVYGIVNCLSTLPALFLIDKIGRRVLLMSGAVGTCISLVIVGALIGAYGSDLVNHKSAGWAGIAFIYIYDINFSYSFAPIGWVLPSEIFNLSIRSKAISITTSATWMCNFIIGLITPDMLESITWGTYIFFAAFCLLALAFTFFCIPETRGKTLEDMDLIFGDTAAHEEKQRIVQIEAELRGTQGPNKDTLVKPSVQQEEYV

SEQ ID NO: 11974 - DNA, 1788 bp, Aspergillus oryzae
  CDS (1)..(1788)
atggggcttcctaagctgaaattacctcgcgcaaatgcagatcgagcttacaaagatgagccggacccaagaccatcggatgccgtcctccgccaaagcgcgaacggagatgatggtctggtagacacaaaaatcccttttctgacatttcggtcatttagcatgtgtgtagtcatctcaatgggtgggtttcttttcggttatgataccggtcaaatctccggatttctagagatggaggatttcctccagcgatacggtgagcaaagggcagatggtacttattatttctcgaacgttcggtcgggcctgattgttgctctgctgtcaattggcaccttaatgggcgcattggtggccgcgccgattgcggatcgggttggtcgcaaatggtgtgtcagcgggtggtgtgtgattctctgcgccgggatcacggtccagatctcttctccgacaggcaagtggtatcaagttgcgttgggtcgatgggttgctggtcttggtgtgggagccttatccctcctggtccccatgtatcaagccgagactggccccagacatattcgaggatccttagtcagtacgtaccagttgtttatcactctgggcatcttcgttgccaactgtatcaacttcggtaccgagaagaaaaccagcacggcctcctggcgaattccaatgggagtaacgtatatctgggctatcattcttgggttcggtatatcgatgtttccagaaagtccgcgtcatgactatcgaaagggcaaggtggacaaggctatttcgacgctggcaaagatgtatggtgtacccaagaaccatcgcgcgctggcgattgagttcgacgagatcaagcaaaagtatgaagaagaggtggcacgcggtcaagtctcatggatccagctattcaaggccccacgaatggcgtaccgcgttgctgtcggggtagccctgcaagccttgcagcagttgacaggtgcgaactacttcttctactacggcacgaccatcttccagggcgccggaatcgaaaacagctacgtgacgcagatgatccttggtgcggtcaattttggttccacattcctgggactctatctcatcgagaactacggccgtcgtcgctcattgatcgctggcgcgctctggatgttttgctgcttcatcgtcttcgcttctgtgggccatttctccctgaatcgggatgacccgccgtctacgaagaccgcgggtgtggtcatggtcgtgttcgcctgtctgtttattctggcattcgcaagtacctggggccccatggtgtggacgattattgctgaactatacccgtcggaataccgagctcgtgcgatgtctcttgcgacggcgtccaattggctctggaacttcctgctggcattcttcacgccgttcatcacgagtgcgatcgactttcggtacggatacgtctttgcgggttgtctcttccttgctgcaggtctggtttatttcgcagtcatggaagggaaaggtcgtaccctcgaggagatcgatacgatgtatgtgtggaaggtgaagccatggcacagctccaaatatgtctttccagaaacagagccgagcatcatggagaaacggagggcgtctcacgcttcaaaccccagtaccaacccaacgactattgacgacaatcatgagactacggtcctttcggggaaaaatataaactgtcgatcatccctcaatcttcggccgaaatctcgggggttaatcaggagagaggaaaaaacatggtcgaagctccttgcataa

SEQ ID NO: 11975 - protein, 595 aa, Aspergillus oryzae
MGLPKLKLPRANADRAYKDEPDPRPSDAVLRQSANGDDGLVDTKIPFLTFRSFSMCVVISMGGFLFGYDTGQISGFLEMEDFLQRYGEQRADGTYYFSNVRSGLIVALLSIGTLMGALVAAPIADRVGRKWCVSGWCVILCAGITVQISSPTGKWYQVALGRWVAGLGVGALSLLVPMYQAETGPRHIRGSLVSTYQLFITLGIFVANCINFGTEKKTSTASWRIPMGVTYIWAIILGFGISMFPESPRHDYRKGKVDKAISTLAKMYGVPKNHRALAIEFDEIKQKYEEEVARGQVSWIQLFKAPRMAYRVAVGVALQALQQLTGANYFFYYGTTIFQGAGIENSYVTQMILGAVNFGSTFLGLYLIENYGRRRSLIAGALWMFCCFIVFASVGHFSLNRDDPPSTKTAGVVMVVFACLFILAFASTWGPMVWTIIAELYPSEYRARAMSLATASNWLWNFLLAFFTPFITSAIDFRYGYVFAGCLFLAAGLVYFAVMEGKGRTLEEIDTMYVWKVKPWHSSKYVFPETEPSIMEKRRASHASNPSTNPTTIDDNHETTVLSGKNINCRSSLNLRPKSRGLIRREEKTWSKLLA

SEQ ID NO: 11976 - DNA, 1638 bp, Aspergillus oryzae; identical to SEQ ID NO: 4630
  CDS (1)..(1638)

SEQ ID NO: 11977 - protein, 545 aa, Aspergillus oryzae; identical to SEQ ID NO: 4631

SEQ ID NO: 11978 - DNA, 1542 bp, Aspergillus oryzae
  CDS (1)..(1542)
atggatatggaactccaacagctagagaatcaactgcgtgaattgaagaagtcgcgcttcgagctcgcgctgcccaacccggcctactttacttatatcctagtcgcatttgcctccctgggaggtttgctctccggcctggaccagtccttgatcagtggtgccaacctctacatgcccgatgacctgcacttgtctgactcgcgcgccagcttggttaatgccggtatgccgctgggtgccgtgggtggtgcgctaattctttctccggccaacgagtacttgggccgtcgtatggctattatcgtatcgtgcatcctctacaccattggtgctgctttggaggccggcgcggtcaactttggcatgatgtttgcgggccgtttcattctaggtatgggtgttggtttggagggtggtaccgttccggtttatgttgctgaatgtgttacagtcccatcacggattcgtggtaacctggtctcgctgtatcagctaaacattgctctgggcgaggtccttggctatgcggttgcggccatcttcctggatgtcaagggcaactggcgctatattcttggctcatccctggtcttctcaaccatccttcttgtcggaatgcttttcctgcctgaaagtcctcgtttcttgatgcacaagaacaagccggtggaagcatatggtgtttggaaaaagatccgtggcttcgaggatatcgatgccaagagtgagttcttaggtatgcgccagtcggtggagtcggaaaacgaggagcagcagcacaccaagaagtacgcctggatggacttctttaccaatccacgtgctcgccgcgccatggtctacgccaacatcatgattgtcctcggccagctaacgggtgtcaacgccgtaatgtactacatgggtactcttatggaaaatatcgggttcgacaagcgcaacagtgtcttcatgtcgcttgtgggtggtggttctttgctgatcggcacaatcccggcggtcatgtacatggagaaattcggtcggcgttactgggccaataccatgctgccgtgtttctttattggtcttgttttggttggcgtgggttatcaaatcaatcccgaacgaaacccagtggccgcccagggcgtctacctcaccggcatcattctctacatgggtttctttggctcatacgcttgtctgacctgggttatcccatccgaggtgttccccacctaccttcgtagttatggtatgactactgccgacgccaaccttttcctatgctcgttcatcgtcacatacaacttcaccgctatgatgaaatctatgacccgtatcggtctcacattgggcttctacggtggcatcgccgcaatcggctgggtctaccaggtcatcttcatgccagaaacgaagaacaagtctctggaagagatcgacgagctgttctccaagcccacgtcatatatcgtcaaggagaacatgaagagcactgcgcagatcatccgggatctctcccatttccggttcaagaaagtgttcagcccctag

SEQ ID NO: 11979 - protein, 513 aa, Aspergillus oryzae
MDMELQQLENQLRELKKSRFELALPNPAYFTYILVAFASLGGLLSGLDQSLISGANLYMPDDLHLSDSRASLVNAGMPLGAVGGALILSPANEYLGRRMAIIVSCILYTIGAALEAGAVNFGMMFAGRFILGMGVGLEGGTVPVYVAECVTVPSRIRGNLVSLYQLNIALGEVLGYAVAAIFLDVKGNWRYILGSSLVFSTILLVGMLFLPESPRFLMHKNKPVEAYGVWKKIRGFEDIDAKSEFLGMRQSVESENEEQQHTKKYAWMDFFTNPRARRAMVYANIMIVLGQLTGVNAVMYYMGTLMENIGFDKRNSVFMSLVGGGSLLIGTIPAVMYMEKFGRRYWANTMLPCFFIGLVLVGVGYQINPERNPVAAQGVYLTGIILYMGFFGSYACLTWVIPSEVFPTYLRSYGMTTADANLFLCSFIVTYNFTAMMKSMTRIGLTLGFYGGIAAIGWVYQVIFMPETKNKSLEEIDELFSKPTSYIVKENMKSTAQIIRDLSHFRFKKVFSP

SEQ ID NO: 11980 - DNA, 1530 bp, Aspergillus oryzae
  CDS (1)..(1530)
atggggaagaatctaggcttcgtaagggcctactatacagtcgccctcgcttgtactggctcgtttctcttcgcttatgacactggaattatcgggggtgtcctcacccttaaatcgtttcagaactcgtttaggtacaccgagaagcaaaagtcgacgatcaattccaattccaacagtcttttacaggccggtgcctttttcgcctgcttcttcgtctggcccttcacagccaaatatggccgtcgatggtctatcgctcttgcctctttcatattctgtattggagccatcattcaagttattcccacgcattcagtcgctgcattttacgtcgcacgcgtgataagtggtatcggtgtcggaatggcgaccgtcattgtccccatgtatacctcggagatggctcctaagtccatccgtggtaagctgggaagtttcttccagggtttctttgtcctaggagtgttcttctcgtattggattgactatgcagtggagaaacatatcccagagactagtgacagccagtggcagattcccatcgggttgcagttagtgccaggtggggtcctaggacttgggatgctatttttgaaggaaagtgtgcgttggctggccaagaagggacggcacgatgaggctatgcgatcattggtgtggattcgaggaggggaggagactgaagaagtccgggcagagatggcagaaatcttagacggtatagaagctgaaaacctggcgacagagggcgtgacatggaaagaaatactgcgagtgccgggaaacctacatcgaatgtgtattgcggtcaccattcagataggagttcagataacgggaaatacttccctggcatactatgctcctcaaattttccaggcggtcggcgctggcgacaatagtttatttataagcggtttcttcggagttgcaaaagtaatctcctgctggttcttccttttgtttctcgtcgagcgcattggccgacggtggtcacttatcatcggcgccttcctcatgggctcactgatgctgatcgtggggatcctggcgaagttatttcccccagacccagatgccaccaccatcagctctgctggcattgcatctatcctgatggtatacttcgaggccatgtgttataatatgtcctggggtccggtaccttggctatatatgagcgagatcttccctactaggatccgtgaggtcggtattgcggtcggtaccgcaactcaatggttgttcaattttgtgttttcacaagcaacgccacatgccctcgatagtatgggttggggcatgtttttgatgttttgcatcttcaactggatcctcgtggtatatgcctggctgttcatcaaagaaacaacaggtaaatccttggaggaaatggaagaagtgttcaactcgagggttggattatatcataaagagagaccactagatgaacaggttcagaataaacattctacagaaaggcctacaagtacgatgcgattcgccgtcatttacgtagaaggataa

SEQ ID NO: 11981 - protein, 509 aa, Aspergillus oryzae
MGKNLGFVRAYYTVALACTGSFLFAYDTGIIGGVLTLKSFQNSFRYTEKQKSTINSNSNSLLQAGAFFACFFVWPFTAKYGRRWSIALASFIFCIGAIIQVIPTHSVAAFYVARVISGIGVGMATVIVPMYTSEMAPKSIRGKLGSFFQGFFVLGVFFSYWIDYAVEKHIPETSDSQWQIPIGLQLVPGGVLGLGMLFLKESVRWLAKKGRHDEAMRSLVWIRGGEETEEVRAEMAEILDGIEAENLATEGVTWKEILRVPGNLHRMCIAVTIQIGVQITGNTSLAYYAPQIFQAVGAGDNSLFISGFFGVAKVISCWFFLLFLVERIGRRWSLIIGAFLMGSLMLIVGILAKLFPPDPDATTISSAGIASILMVYFEAMCYNMSWGPVPWLYMSEIFPTRIREVGIAVGTATQWLFNFVFSQATPHALDSMGWGMFLMFCIFNWILVVYAWLFIKETTGKSLEEMEEVFNSRVGLYHKERPLDEQVQNKHSTERPTSTMRFAVIYVEG

SEQ ID NO: 11982 - DNA, 1587 bp, Aspergillus oryzae
  CDS (1)..(1587)
atgactgttgaggtcaagtacgacaacggacaactgcgagatcttctacactctccttatgtttttggagcagcgctactcgcctcgtttggcgggttctcttttggttatgatcagggtgtcatttcccttatcttggttatgccgcagttccgcgaacagttccccgagacctctcccgaaaacccaaaatacggattccataccggctttatgacggggatgctcgagctgggcgctttcatcgggtgtctatttttcccagccgttgcggatcgcatctcccggaaatgggggttgaccgtggcgaccgtattctttgttattggcgctataattcagacggcatcgatgaactatgggacattggtggctggaagattcattgggggtgtcggcgtggacacactggccatgggggcacctttatatatctcggagatcgctcctccggcgtggagaggatcattgctcgtgctggaatctattagcatcgttattggggcaattgtggcatattggatcacttatggcacgagggccatacccggcgagtggtcattccggcttccattccttctacagatgtttcctgcattgatagtgggttgtgcgattcatttcttcccattctcgcctcgatggctcgcaatgcgcgggagggaggaagatagtctcttcgctcttgcgaagctgcgccgacgccctgtgcacgatgagcaggtacaattggaatggaagggtatcctctccgaagtgcgatttcagcgacaaatgctcgaaaaagaatatccagaccaccagtctcgtccacttctggtcggcctgaagcagtgggtttctctcgtccgcccgaagtattttcgacgaacacttgtggcattggctattccgttttttcaacagttctcgggaatcaacgcattcgtctactacgccccgacattctttgaagctctcggtcaaagcagcgaaacatctctcatcctctccggaatggtcaatatctgccagctggtcgggggtataccaatcctcatgtatctggaccgcgtcggtcgtcggaccatggccataatcggaggagttatcatggccataccacatctaatcatggccggactgatgaaccgatacagcaatgactggccttcccacaaagcaattgggtggttctgcgtagccctcatttatgcctacgcactcgcatacgcggtatcctacggccccctcgcctgggtcctaccagcagaggtattcccgaattccaaacgtgcaaagggtgtcggcgccgcgactgcgatgaactggctcgccaactttatcatcggggttgttgttccggagatgctcattaagcttggttggggtacttttcttttctttgggttgttctgtgtggcggcggctattttctcgtttctctttgttccggagacgtctgggaagtctcttgagcagattgcggttgtgtttggggataatttggatggggatgagagggggttgcaggagaagattgcgagggagacgtttgagaatgcgacggctagggtgttgcatgtggagaaggctgggtcggcgtag

SEQ ID NO: 11983 - protein, 528 aa, Aspergillus oryzae
MTVEVKYDNGQLRDLLHSPYVFGAALLASFGGFSFGYDQGVISLILVMPQFREQFPETSPENPKYGFHTGFMTGMLELGAFIGCLFFPAVADRISRKWGLTVATVFFVIGAIIQTASMNYGTLVAGRFIGGVGVDTLAMGAPLYISEIAPPAWRGSLLVLESISIVIGAIVAYWITYGTRAIPGEWSFRLPFLLQMFPALIVGCAIHFFPFSPRWLAMRGREEDSLFALAKLRRRPVHDEQVQLEWKGILSEVRFQRQMLEKEYPDHQSRPLLVGLKQWVSLVRPKYFRRTLVALAIPFFQQFSGINAFVYYAPTFFEALGQSSETSLILSGMVNICQLVGGIPILMYLDRVGRRTMAIIGGVIMAIPHLIMAGLMNRYSNDWPSHKAIGWFCVALIYAYALAYAVSYGPLAWVLPAEVFPNSKRAKGVGAATAMNWLANFIIGVVVPEMLIKLGWGTFLFFGLFCVAAAIFSFLFVPETSGKSLEQIAVVFGDNLDGDERGLQEKIARETFENATARVLHVEKAGSA

SEQ ID NO: 11984 - DNA, 1617 bp, Aspergillus oryzae
  CDS (1)..(1617)
atgggtgacgctgtagctccaaacgccctcgccgataccacgcgagtggaggcacccgtcaccttcaagacgtatatgatgtgtgcctttgcagcctttggtggtatcttcttcggttatgattccggttatatcaacggtgtcatgggcatgagttatttcatccaagaatttgaaggcttggatcctgccaccaccgactcggatcatttcgttgtctcatcgtggaagaaatccttgatcacatccatcttgtcggcaggtacattcttcggtgctttgattgctggtgatcttgcggactggtttggacgtcgcatcaccatcgtctccggttgtgctatcttcatcgttggtgtcgttttgcagaccgcatcaaccaccgtagctcttctcgtagtgggacgtttgattgcgggattcggtgtcggttttgtgtcggccatcattatcctgtacatgtcagagattgctcctcgcaaggtccgcggtgccattgtgtcgggttaccagttctgtatcaccattggtctgatgctggcttcttgtgtcgactatgccactcagaatcgcactgactccggttcctatcgcattccaattggcattcagattgcttgggccctcatcctcggtggggggttgctcatgctacctgaatcgccccgttatttcgtcagaaagggccagctcgacaaggcgtcccatgtcctcgctcgtgtccgtggccagcccgaggattcggagtatatcaagcaggagctagcagagatcgttgccaacaacgaatacgagatgcaagcgatgccccagggtggctacttcaccacctggctgaactgcttccgtggaagtctgttccaccccaacagcaacctccgccgtaccgtcctaggtacttctcttcagatgatgcagcaatggaccggtgtcaacttcgtgttctacttcggtaccacgttcttcacctccctcggaacaatttcgaatcccttcctgattagcatgatcaccaccatcgtcaatgtttgctcgactcccgtctcattctacaccatggagaaggttggacgtcgtcccctgctgttgtggggtgctctgggcatggttatctgccagtttattgtcgccattaccggtaccgtcgtcggtgacaagggcggcaacaacgctgcggtcagcgcggagatctctttcatctgcatttacatcttcttcttcgccagcacctggggtcctggcgcctgggttgtcatcggcgagatcttccctctgcccattcgttcgcgcggtgtggctctgtccactgcgtctaactggctttggaactgcatcatcgccgtcatcactccatacatggttgaccaggacaagggcgatctcaagtccaaggtgttcttcatctggggatccctctgcgcctgcgccttcctctacacctacttcctcatccccgagaccaagggactcaccctcgagcaggtcgacaagatgatggaggagaccacgccacggacctctgccaagtggaagcctcacaccaccttcgccgccgacatgggactcaccgagaaggacatcaccgacaaagtccacgtcgcccaccgggaagtctaa

SEQ ID NO: 11985 - protein, 538 aa, Aspergillus oryzae
MGDAVAPNALADTTRVEAPVTFKTYMMCAFAAFGGIFFGYDSGYINGVMGMSYFIQEFEGLDPATTDSDHFVVSSWKKSLITSILSAGTFFGALIAGDLADWFGRRITIVSGCAIFIVGVVLQTASTTVALLVVGRLIAGFGVGFVSAIIILYMSEIAPRKVRGAIVSGYQFCITIGLMLASCVDYATQNRTDSGSYRIPIGIQIAWALILGGGLLMLPESPRYFVRKGQLDKASHVLARVRGQPEDSEYIKQELAEIVANNEYEMQAMPQGGYFTTWLNCFRGSLFHPNSNLRRTVLGTSLQMMQQWTGVNFVFYFGTTFFTSLGTISNPFLISMITTIVNVCSTPVSFYTMEKVGRRPLLLWGALGMVICQFIVAITGTVVGDKGGNNAAVSAEISFICIYIFFFASTWGPGAWVVIGEIFPLPIRSRGVALSTASNWLWNCIIAVITPYMVDQDKGDLKSKVFFIWGSLCACAFLYTYFLIPETKGLTLEQVDKMMEETTPRTSAKWKPHTTFAADMGLTEKDITDKVHVAHREV

SEQ ID NO: 11986 - DNA, 1680 bp, Aspergillus oryzae
  CDS (1)..(1680)
atgggtgtctctaatctgatggcccggctcaagcctcaggccgaccatgaacaccaggagcactccgatactcctaccccagtcagagccgactcaaacttggagaaggataatgccatgattgacgacagccccgtcaagtatctgacatggcggtccttcatcctgggtttgtgtgtctcgatgggtggttttatcttcggttactccaccggtcaaattgctggctttacgactatgaatgatttcaagatgcgctttgcggaacaacatgcggatggaacatatgctttcagcaacgtgcgcaatggtttgattgtcggtctgttgtccattggtactatgattggcgcccttgtcgccgctcctatcgccgaccgcattggtcgcaaatactctatctccttctggtcggtgattcacatggttggtatcatcatccagatcgccaccgatgacaactgggtccaagttgctatgggtcgttgggtggccggtttgggtgtcggcgctctgtccagcatcgttcctatgtaccagagtgaatctgctcctcgtcaggtccgtggtgccatggtcagcgccttccagctgttcgttgccttcggtattttcatctcttatctcgtcaacttcggtaccgaatccatcaacggtaccgcttcctggcgtatcactatgggcattggcttcgcctggcccttgatcttgggtgttggcactctgttccttcccgagtctccccgttatgcctaccgtaacggtcgtatcgaagaagcccgtgaggttatgtgcaagctttacggcgtcggccccaaccaccggtgcatcgcccaggagatgaaggacatgaaggacaagctcgatgaggagaaggctgccggacaggctggcatcttcgaagtcttcactggtccccgtatgttctaccgtgttatgctgggaattgctttgcagtcactgcagcagctcactggcgccaatttcctcttctactatggtaacaccatcttcacttctaccggtctgaacaacagctacgtcacccagattattctgggtgccgttaacttcggcatgacccttcctggtctctatgttgttgagcacttcggccgtcgtaatagtctgatggtcggtgcctcctggatgtttatctgctttatgatctgggcctccattggtcacttcgccttggacttggagaaccctcccaacacccctcaggctggtactgccatgattgtcttcacttgcttcttcatcgtcggcttcgccaccacctggggacctattgtgtgggctatctgtggtgagatgtaccctgctcgctaccgtgctgtctgcattggtcttgccactgccgccaattggacctggaacttcctgatctctttcttcacccccttcatctccagcgctatcgactttgcctacggttacgtctttgcaggctgctgcttcgccgccgtgcttgtggtcttcttcttcgtcaacgagacccagggtcgcacccttgaggaagtcgacaccatgtacgtcctccacgtcaagccctggaagagtgccaactggacgcccccggagggtatcgtccgcgatctccacgggccccccgcttcccccaagcaggagggtcgggctgagcacagcgagcccgccaccgagatccgcgagtaa

SEQ ID NO: 11987 - protein, 559 aa, Aspergillus oryzae
MGVSNLMARLKPQADHEHQEHSDTPTPVRADSNLEKDNAMIDDSPVKYLTWRSFILGLCVSMGGFIFGYSTGQIAGFTTMNDFKMRFAEQHADGTYAFSNVRNGLIVGLLSIGTMIGALVAAPIADRIGRKYSISFWSVIHMVGIIIQIATDDNWVQVAMGRWVAGLGVGALSSIVPMYQSESAPRQVRGAMVSAFQLFVAFGIFISYLVNFGTESINGTASWRITMGIGFAWPLILGVGTLFLPESPRYAYRNGRIEEAREVMCKLYGVGPNHRCIAQEMKDMKDKLDEEKAAGQAGIFEVFTGPRMFYRVMLGIALQSLQQLTGANFLFYYGNTIFTSTGLNNSYVTQIILGAVNFGMTLPGLYVVEHFGRRNSLMVGASWMFICFMIWASIGHFALDLENPPNTPQAGTAMIVFTCFFIVGFATTWGPIVWAICGEMYPARYRAVCIGLATAANWTWNFLISFFTPFISSAIDFAYGYVFAGCCFAAVLVVFFFVNETQGRTLEEVDTMYVLHVKPWKSANWTPPEGIVRDLHGPPASPKQEGRAEHSEPATEIRE

SEQ ID NO: 11988 - DNA, 1680 bp, Aspergillus oryzae
  CDS (1)..(1680)
atgcagggagatgcccactacagcgaactttcaaggaatgacaacgactacatgcctgtcgagctcgaagccgctccggcctttctagtgcaggagacgatgagtccgggttttgaaaggagcacgcgaactgaaatacccagcatgagacgcccacagttcctcgcgtacttcaacaccaggctagccctagcctgctctctcatagccgtctcctctttcaactatggtttcgataaccagggctttgctaccactcaggctatggacgcctttgacaaacggttcggtgactataaccctggaacgaaggcgtatgcactggacccagcctggctatcactattcaacagtctaaactacatcgggtttgctgctggcgtgctcatcggcagtcaaatatccgcccggttcggtcgacggtggtgcatgttttcgatgagttgctacgctctcatcacggccacgatcacagttacttctgggaaccgggaccagatcctcgctgcccgaattctgaactacgtctatgttgggatggagttggctgttgtcccaacgttccaatctgaaatagtcccggctcaagtccgaggcctcgccgtcggcacttaccaattcagtatcatcctgggcggtctaatcatcaactccatctgccgcggcacaagcaagatccaagatgaccgagcctggcgcattcctcttggtttattctacatcgtcccagcaatagtcttgtcattgatatggttcgtccctgagagtccacgctggcttctccaaaaaggccgcgtggaagaatcccaagctagtcttcggcaactacgccagggatgtttcactcccgaacagattcacaatgagttccgtgaacttcagaccgtgctcgaacaggaggttgagaacggccactgggtcgacctagtcaagggagtcaatctgaagagaacggcgctcgtgttcatggtcaatttctttcagcaaggtactgggcaggccttttcgtctcagtatggagcggtctatgttaagcagttggggaccattaacgcgttcgatatgacaattgtgctttcgcttctgaatttggtgtcgatcattggctcgttggcatatgctgatcgggttgggaggagacccatgctcttagccagctccgcagtaatggcagcaggcctattgacgatgggaggtctaggaactccaagccccatgacaacggacttgaagaaaggtgtagtgggtatgtacgtggtcatggcactagggttctctctcggttggggacctcagacgtacgtagtagccaccgagctacctgcgctacggctgagagacatgacactgcagttggggttctttgtcaatgtcatttccaactttgtcgtcaacttcaccatcccctaccttgtagatgcggaatatgcgggcctaaactccaaggttggattaatattcggcgccattgcggttatcgcgtttgtttgcactttccttttcgtaccagagtgccgcggcaagactcttgagcagattgatctcatgtttcattcgggagtcaagttgcgggactttggatcttatgatgctagtacgttgattgctgaaccggagctcaaagaaggtgaagtgcatagtgatactggtaaagttgaagagaatggcgtcaaacagtag

SEQ ID NO: 11989 - protein, 559 aa, Aspergillus oryzae
MQGDAHYSELSRNDNDYMPVELEAAPAFLVQETMSPGFERSTRTEIPSMRRPQFLAYFNTRLALACSLIAVSSFNYGFDNQGFATTQAMDAFDKRFGDYNPGTKAYALDPAWLSLFNSLNYIGFAAGVLIGSQISARFGRRWCMFSMSCYALITATITVTSGNRDQILAARILNYVYVGMELAVVPTFQSEIVPAQVRGLAVGTYQFSIILGGLIINSICRGTSKIQDDRAWRIPLGLFYIVPAIVLSLIWFVPESPRWLLQKGRVEESQASLRQLRQGCFTPEQIHNEFRELQTVLEQEVENGHWVDLVKGVNLKRTALVFMVNFFQQGTGQAFSSQYGAVYVKQLGTINAFDMTIVLSLLNLVSIIGSLAYADRVGRRPMLLASSAVMAAGLLTMGGLGTPSPMTTDLKKGVVGMYVVMALGFSLGWGPQTYVVATELPALRLRDMTLQLGFFVNVISNFVVNFTIPYLVDAEYAGLNSKVGLIFGAIAVIAFVCTFLFVPECRGKTLEQIDLMFHSGVKLRDFGSYDASTLIAEPELKEGEVHSDTGKVEENGVKQ

SEQ ID NO: 11990 - DNA, 1602 bp, Aspergillus oryzae
  CDS (1)..(1602)
atggccattggcaacatttatgtcattgcggccatcgccgtcatcggcggtggtcttttcggtttcgatatctcgtccatgtctgcgattatcggtacaaacacctataagtgttatttcaacaacggaggaagtgtgacgatcaatgagaatggtgaaaaggaatgtggaggtcccgatacaatgactcagggtggtatcactgcagccatggctggtggctcctggttaggtgctctggtctctggatacctgtctgatatgctcggtcgtaagcagtcgatcatggttggttccgtgatttggtgcattggatgtattcttgtctgcgccgcccagaacattcccatgttgattgttggtcgtatcatcaacggtttcagtgtcggtatctgctccgctcaggtcccggtctacatctctgagatcgcccctcctactaagcgtggtcgccttgttggtcttcagcaatgggccatcacgtggggtatcctgatcatgttctacatttcctatggatgcagctttatcaagggcaccgccgcgttccggattccctggggtctgcagatgattcctgctatccttcttttccttggaatgatgttgcttcctgagtctccccgttggctcgcccgcaaggaccgttgggaggagtgccatgctgtccttaccttggttcatggtcacggtgacccggactctccttttgtccagagcgaattcgaggagatcaagggcatgtgcgaatttgaacgtcagaatgccgacgtgagcttcatggaactcctcaagccgaacatgatcaaccgcactcacgtcggtgtcttcacgcaaatctggtcccagcttacgggcatgaacgtgatgatgtactacattacgtatgtgtttgcgatggccggtttgaatggtaacaaccttctggtgtcgtccagtatccaatatgtgatcaatgtgttcatgaccatccctgctatcttgtggctggatcgctggggtcgccgtcccactctccttattggtgccgccctcatggcggcctggctgtacgccaatgctggtctgatggccgcacacggtcatgccgctcccccaggcggtctcaatggaacacccgcagagtcctgggaaatcaccggccctccttccaaggctgtcattgcgtgtacctacctgttcgtcgcctcctacgccatcacctggggtcctgcctcgtgggtgtaccctcccgagctcttccccctgcgtgtccgtggcaaggccaacgctctgtgcacctccttcaactgggccttcaacttcgctctgggttggttcgtcccccctgccttcgagaacatcaagtggcaggtctacatcgtcttcggtgtcttctgtactgccatgttcattcatgtatttttcatgttccccgagaccgccggtaagaccctcgaggacgtcgaggccatcttcaccgacccaactggtattccgtacatcggtattcccgcctggaagaccagaaacgaattctcgcgcggcgccaccctggagcaggttggcttcgacgaggagaagaagattggcggtactgtccagcattccgagaccgcataa

SEQ ID NO: 11991 - protein, 533 aa, Aspergillus oryzae
MAIGNIYVIAAIAVIGGGLFGFDISSMSAIIGTNTYKCYFNNGGSVTINENGEKECGGPDTMTQGGITAAMAGGSWLGALVSGYLSDMLGRKQSIMVGSVIWCIGCILVCAAQNIPMLIVGRIINGFSVGICSAQVPVYISEIAPPTKRGRLVGLQQWAITWGILIMFYISYGCSFIKGTAAFRIPWGLQMIPAILLFLGMMLLPESPRWLARKDRWEECHAVLTLVHGHGDPDSPFVQSEFEEIKGMCEFERQNADVSFMELLKPNMINRTHVGVFTQIWSQLTGMNVMMYYITYVFAMAGLNGNNLLVSSSIQYVINVFMTIPAILWLDRWGRRPTLLIGAALMAAWLYANAGLMAAHGHAAPPGGLNGTPAESWEITGPPSKAVIACTYLFVASYAITWGPASWVYPPELFPLRVRGKANALCTSFNWAFNFALGWFVPPAFENIKWQVYIVFGVFCTAMFIHVFFMFPETAGKTLEDVEAIFTDPTGIPYIGIPAWKTRNEFSRGATLEQVGFDEEKKIGGTVQHSETA

SEQ ID NO: 11992 - DNA, 1650 bp, Aspergillus oryzae
  CDS (1)..(1650)
atgttggttggcaacatctatgtcattgcgggcatcgccgtcgtcggcggtgccctctttggctttgatatctcttccatgtcagctcagctgaatgaaaactcttacaaatgttactttaaccaaggccctcagggtcctccattcaccgatgatgcagactgttccggccccgaatcactggttcaaggaggtatcaccgcatccatgtccgctggctcttggctgggcgccttgatttccggtccattgtctgatcgcattggccgaaagacttccatcatggccggttgctctctttggataattgggtccacgatcatgtgcgcctcccagaacattggcatgctcattgtgggccgtatcttcaacggtctctgtgtcggtatcgaatctgcccaggtccccgtgtacatcagtgaaatctcgccgccgtcgaaacgaggtcggtttgttggtgtccaacaatgggctatcacatggggtattcttatcatgttctatatttcgtatggatgttcctacatcggcgatcggtccgcctttggatatagcacggcagcgtggagaatcccttggggtctgcagatgattcccgccgtcttcctcttcctgggtatgatgattctcccagaatcaccgcgatggctggcccgaaaggaccgctgggaggaatgccagaccatcctggcgaaagtccactgtaagggagacatgagccacccatttgtagcgctcgaaatgcaggacatccgggagatgtgtgactttgaacgccagttcaagaatgtcacgtacttcgacctcttcaaaccgagaatgttgaaccgcaccatcattggccttttcatgcagatctggtctcagttgactggcatgaacgtcatgatgtattatattacatatgtcttctcaatggctggttattccggagattcaaacctccttgcctcttccattcaatacataattaacgtcctcatgaccctaccagctctgatctggttggatcgctggggccgtcggccgaccttgctcattggcgcggtacttatgggtaccttcatgtatgccaatggtgccatcatggccgtccatggcgaggtcgtaccaggaggtatcgacggagtcgcccagcagtcgatgagattacacggcgcggcggctaaagggttgatcgcgtgtacctacctcttcgtggcctcctatgccccaacctggggccccgtcagctggacctacccaccagagctgtaccccatgcgtctcagaggtaaaggtgtcgccttatcaacgtccggaaactgggcgttcaacaccgcgttgggtttgttcaccccccctgcatttgccaacattcgctggcagacgtatatcatctttggagtgttcaacaccgctatgttcattcatgtctacttcttcttccctgagacggccggtaagacgttggaggagactgaggctatgttcgaggatcccaatggcatcaaatatatcggcacaccggcatggaagacacgggtaacgacggggcgtatcgagcaattggagagaggtgatgtcgagggtctcgagtcgaaggcgcagcaagaaccggcggctcgggaggtcgaagtgactcagccggagcagaagactgcatcgtag

SEQ ID NO: 11993 - protein, 549 aa, Aspergillus oryzae
MLVGNIYVIAGIAVVGGALFGFDISSMSAQLNENSYKCYFNQGPQGPPFTDDADCSGPESLVQGGITASMSAGSWLGALISGPLSDRIGRKTSIMAGCSLWIIGSTIMCASQNIGMLIVGRIFNGLCVGIESAQVPVYISEISPPSKRGRFVGVQQWAITWGILIMFYISYGCSYIGDRSAFGYSTAAWRIPWGLQMIPAVFLFLGMMILPESPRWLARKDRWEECQTILAKVHCKGDMSHPFVALEMQDIREMCDFERQFKNVTYFDLFKPRMLNRTIIGLFMQIWSQLTGMNVMMYYITYVFSMAGYSGDSNLLASSIQYIINVLMTLPALIWLDRWGRRPTLLIGAVLMGTFMYANGAIMAVHGEVVPGGIDGVAQQSMRLHGAAAKGLIACTYLFVASYAPTWGPVSWTYPPELYPMRLRGKGVALSTSGNWAFNTALGLFTPPAFANIRWQTYIIFGVFNTAMFIHVYFFFPETAGKTLEETEAMFEDPNGIKYIGTPAWKTRVTTGRIEQLERGDVEGLESKAQQEPAAREVEVTQPEQKTAS

SEQ ID NO: 11994 - DNA, 1545 bp, Aspergillus oryzae
  CDS (1)..(1545)
atgttattcacacgcccctccaacgagaaaggagctgcctggccagccatcttggtcggactgttcgccgcgttcggtggtatcctctatggctacgacactgggaccatctcaggcatccagactatgccctactggatcgaggagttcgacaacccgaacgcaggccgcatcgccctaatcgtttccatcttgtcagttggcaccttcgttggtgccctcgcagcgggtatcatggcagacattactgggcgacgatggggaatcatcctgtcggccatgttgcctttcaatctcggtgtcgccctccaaactgccgctacatcgcagcctctgttcattgctggtcgcttttttgcaggtcttggagttggcctgatttctgcccagatcccgatgtaccagtccgagactctacccaaatggatcagaggcgcagttgttggatcttaccagctttgtatcacaatcggcctgttcctggctgccattgtgaattgggcaacgcagcaccggccggacagtggaagctaccgtatccctcttgcaattcaattcgcatgggctctcattcttgccggcggcctcttcttcctccccgagacccctcgttttcttatcaaaaagggcaacgacacccaagctcttcgatcattggtttttcttcgccgcttgagtgctgatgatcctgaccttcttgccgagatggaagagttgaagaacaattgggagtatgagaagtccattggctctgcttcgtaccttgaatgcttcaagggaactgctggtaaacgtaccatcacgggaatcatacttcagtcacttcagcagctggtgggtatcaatttcatcatctattatgggacaagctactttgccgagaatgtgcaaggtctgcccgactccttcatcctgcaggtgattgtcaactccattaacgtggtcatgacgcttcctgggctgtgggcaattgaccgcttcgggcgacgacctgttctactgacgggagcactcggtatgggtgtctcgcaatatattgttgcggcttgtggcgccgccaccccgacttcgaattttacgtcgcagtgcgcccagttcgcttttatttgcatatatatctctttcttcgcatctaccttcggtccctgcgcctgggttgtcacaggagagatcttctccctccagactcgtgccaaaggtctttccatgaccactgcagcaaactggttcttcaattggctactctcttacattacgccatacctcactggagcgcttaacccaacccaatcgaacgtgttctggatttggggtagcttctgctggattgcgttcgtcttcacatttaccatgatctatgagaccaagggcctgtcccttgaacaggtcaatgagctttatgaaagtgtgtcaaaggcctggaggagcgctaattaccgttctgagctccgtaggatgtctgtttctgaagcctatcgcaaggagtcggtggatgaagagacgaagccttcggaaatggcttgtgaagattctagcaaagtctga

SEQ ID NO: 11995 - protein, 514 aa, Aspergillus oryzae
MLFTRPSNEKGAAWPAILVGLFAAFGGILYGYDTGTISGIQTMPYWIEEFDNPNAGRIALIVSILSVGTFVGALAAGIMADITGRRWGIILSAMLPFNLGVALQTAATSQPLFIAGRFFAGLGVGLISAQIPMYQSETLPKWIRGAVVGSYQLCITIGLFLAAIVNWATQHRPDSGSYRIPLAIQFAWALILAGGLFFLPETPRFLIKKGNDTQALRSLVFLRRLSADDPDLLAEMEELKNNWEYEKSIGSASYLECFKGTAGKRTITGIILQSLQQLVGINFIIYYGTSYFAENVQGLPDSFILQVIVNSINVVMTLPGLWAIDRFGRRPVLLTGALGMGVSQYIVAACGAATPTSNFTSQCAQFAFICIYISFFASTFGPCAWVVTGEIFSLQTRAKGLSMTTAANWFFNWLLSYITPYLTGALNPTQSNVFWIWGSFCWIAFVFTFTMIYETKGLSLEQVNELYESVSKAWRSANYRSELRRMSVSEAYRKESVDEETKPSEMACEDSSKV

SEQ ID NO: 11996 - DNA, 1605 bp, Aspergillus oryzae
  CDS (1)..(1605)
atgtcagttatactccgaagactcgtccacaatgaggcgatgcgagaggaccccaaggagatttatggatggagggtgtacatgctcgcgtgttcggcctgctttggcggcatgcttttcggaatggagaccggtatcataggaggtgtccttacgatggatcctttccaagtgaaatatgggttaaagaaccttggcgatataggagaggccaatctctccgctaatattgtatccacattacaggcagggtgcttctttggcgccctcatcgcctccccagtagcagacaaatggggtcgaaagaccgggttgatatccgcatcgttaattgctatcgttggcgttatcatgcaagtggcagcaagcgggcacctggaagctatgtacatcggacgtctaatcaacggtttcggtgtcggcttcgcttcgatgatcaatcctctctatgtctctgaaaacgccccaagagccatccgtggtggtctaacaggcctctaccaactgttcatcacaatgggaattatgctcgccttctggatcaactacggctcttccctccacatcaagggcacggcacaatacatggttccacttgccatgcaggccctccccgcccttcttatgcttgtgggtatgctcctatgcaacgaatccccccgttggctcgcaaaacaagaccgctgggaagacgctcggaagacgctctcccgcgtgcgcaacctcccctcaacacatcagtacattgagaacgagttccaagatatcgtcaatcaacttgagcatgagcgccaactcatcggtggttccggcttctgggaccttatgaaagagatgtggctcatcccaggcaaccgcaaacgagccatgatcagcatcttcctcatggtctgccagcaaatgaccggcacgaacgccattaattactacgcaccacagatctttgaaaatctgggcatcaccggtactacgacaggcctcttcgccacgggagtgtacgggatcgtgaaggtggtggcatgtgccgtcttcctagtcttcgtcgccgattctttgggccgtcgacgctctctgctctggacctctgtcgcccagggcctagctatgctctacatcgggttatatatccgcattgcgccaccggtagaaggccagcccgtgatccccgctggctatgtcgctctcgtctgtatcttcctctttgccgcgtgcttccagtttggctgggggcccgtctgctggatctatgtctccgagatcccgactgcccgactgagaagtctgaacgtcgccatggctgccgcgacccagtggctgttcaactttgtcgtttctcgggctgttcccaatatgctggcgaccgttggtgccaacggttacgggacatacatcattttcgcctgtttttgtttctcaatgggcgtgtgggtttggttctttattcccgaaaccaaaggtctctcactggagaaaatggatgagctcttcggtgctactagcagtgatactcatttgaagactgaagatgtagagagaagtgcatcccaagtggaaggtgaccataaagatgaagttgctacagaaactagggtagaaagggtgtaa

SEQ ID NO: 11997 - protein, 534 aa, Aspergillus oryzae
MSVILRRLVHNEAMREDPKEIYGWRVYMLACSACFGGMLFGMETGIIGGVLTMDPFQVKYGLKNLGDIGEANLSANIVSTLQAGCFFGALIASPVADKWGRKTGLISASLIAIVGVIMQVAASGHLEAMYIGRLINGFGVGFASMINPLYVSENAPRAIRGGLTGLYQLFITMGIMLAFWINYGSSLHIKGTAQYMVPLAMQALPALLMLVGMLLCNESPRWLAKQDRWEDARKTLSRVRNLPSTHQYIENEFQDIVNQLEHERQLIGGSGFWDLMKEMWLIPGNRKRAMISIFLMVCQQMTGTNAINYYAPQIFENLGITGTTTGLFATGVYGIVKVVACAVFLVFVADSLGRRRSLLWTSVAQGLAMLYIGLYIRIAPPVEGQPVIPAGYVALVCIFLFAACFQFGWGPVCWIYVSEIPTARLRSLNVAMAAATQWLFNFVVSRAVPNMLATVGANGYGTYIIFACFCFSMGVWVWFFIPETKGLSLEKMDELFGATSSDTHLKTEDVERSASQVEGDHKDEVATETRVERV

SEQ ID NO: 11998 - DNA, 1719 bp, Aspergillus oryzae
  CDS (1)..(1719)
atggcgggtggaatggcctctcaaggcatctctgccaagcgcgcagagcttgctggaggcagagtcggatggcgcgggctggtcagcagcaagaaagcgtttggtattgcgctgttcgcctcgctgggtggtttggtctacggatataaccagggaatgtttgcccaaattcttaccatgcggtccttcattgatgcgacccaaggatatgcagaacacacaggtaccgctcagggtatgctcacctccattcttgagctaggtgcctggttgggaacactcgcaaatggatatttggccgacgcgttgggtcgccgtgtgaccgtggttgtggccgtggtcgtgttctgtgtgggagtcattgttcaggcgtgcactacgaacccagacttcgtttatgctggtcggttcgtcaccggtctgggagtcggtaacctgagtatgattgtcccgctttacaacgccgagctggctcctcccgaaatccgaggatctctagtcgccgttcagcaattggctattacgttcggtatcatggtcagtttctggattggatatggcacaaacttcatcggcggaacgggagagggtcaatctattgccgcctgggagattccggtgtgcatccaaattcttcccgcgctcgttctggcggttggcatgatgctgttcatgcctcagtcgccgcgtcatttaatgaatcagggccgtgaagaggagtgtctacagaccgtagcgcgtctgcgcgacgcctctgtcgatgatatgctcgtgcgcatcgaattcttggagatgaaggcgctccgcatgtttgaggaagagacagcgcggaagaagtatccgcagtatcaggatgggtcattcaagagccgtttcatgattggggtacatgattacatgtccctcattacggataaatccctgttcaagaggaccactgttgcctgtttgattatggtctttcagcagtggaatggtatcaatgccccacaaatctttaaggatctggagctcggcggtaccactacttcattgctggccactggagtagctggtatcttcgagttcgtcttcactattccagccgttctctgggtcgacaatattggtcgcaagaagatcctcattgcgggtggcattggtatggctgtttgccactttattgtggctggtattattggatcataccaacatacctttgccgagcacaaggctcctggatgggttgctgtagtatttgtgtggattttcattatcaactttgcctattcatggggtcctgttgcctggatcgtggtttctgaagtctaccccctgagtatgcgtgccaagggtgttagtatcggtggaagcagcaactggctcaacaacttcgccgtgggtctttctacctcccccttcctgagtgcatcgaactacggtacatttatcttcttcggatgtatcaccaccatcggtgtattctgggtgtggttcctggtccccgaaaccaagggccgtaccttggaagagatggacgaactctttggctctgggggtatggccgccgaagatgaggcccggaagcgacggattgagcgtgagattgggctcttggctctgttagcgggtggcggttggtccgcaggcggaaacctggggaaagcgcttcctggaacatcaatcggagtgacagcctccgagggaccgggtgctggtcacgaaatccggtgggtttga

SEQ ID NO: 11999 - protein, 572 aa, Aspergillus oryzae
MAGGMASQGISAKRAELAGGRVGWRGLVSSKKAFGIALFASLGGLVYGYNQGMFAQILTMRSFIDATQGYAEHTGTAQGMLTSILELGAWLGTLANGYLADALGRRVTVVVAVVVFCVGVIVQACTTNPDFVYAGRFVTGLGVGNLSMIVPLYNAELAPPEIRGSLVAVQQLAITFGIMVSFWIGYGTNFIGGTGEGQSIAAWEIPVCIQILPALVLAVGMMLFMPQSPRHLMNQGREEECLQTVARLRDASVDDMLVRIEFLEMKALRMFEEETARKKYPQYQDGSFKSRFMIGVHDYMSLITDKSLFKRTTVACLIMVFQQWNGINAPQIFKDLELGGTTTSLLATGVAGIFEFVFTIPAVLWVDNIGRKKILIAGGIGMAVCHFIVAGIIGSYQHTFAEHKAPGWVAVVFVWIFIINFAYSWGPVAWIVVSEVYPLSMRAKGVSIGGSSNWLNNFAVGLSTSPFLSASNYGTFIFFGCITTIGVFWVWFLVPETKGRTLEEMDELFGSGGMAAEDEARKRRIEREIGLLALLAGGGWSAGGNLGKALPGTSIGVTASEGPGAGHEIRWV

SEQ ID NO: 12000 - DNA, 1593 bp, Aspergillus oryzae
  CDS (1)..(1593)
atgggcttcatgttgaagaagccggatgatgctacgggctctgctgcccctgccatcgttattggcttgtttgttgcctttggtggtgttttgttcggttatgataccggcaccatcagtggcatccttgccatgccttactggcgcaagctgttctccacgggctatatcaacccgtcagacaactatcccgatgtgacctcctctcaatcctccatgatcgtgtctctcctgtctgcaggaactttcttcggtgcccttggtgcagcacccattgctgattacttcggtcgtcggcttgctatgatcatcaacacatttgttttctgctttggtgtcatccttcagaccgctgctactgctatcccgttatttgttgcgggaagattctttgcaggcctaggtgttggattgctctctgcaacaatcccgctgtaccagtccgaaaccgctcctaagtggatccgtggtaccatcgttggtgcctaccagctggctatcaccattggattgctccttgctgccatcgtgaacaattccactaagggccgtgacgatactggttcctaccgtatccctgtcgctgttcagtttgcctgggctattatcctggttgttggcatgatcgtactccctgagacgcctcgcttcttgatcaagaagggcaagcatgaagctgctgccaaggctctctcacgccttcgccgcatcgatgtcaatgatcccgccattgtggaggagctggctgagatccaggccaaccatgaatatgaactcagtgtgggcaatgccagctacctctccattcttcgtgggagtatcggcaagcgactggccactggctgtgccgttcagggtctgcagcagctggctggagtcaacttcatcttctactacggaactactttcttcgaacactccggtatcaaggacggatttattattactttgatcaccaacattgttaatgtcgtctcaaccttccctggtctctatatggtcgagaaatggggtcgtcgtcctcttctcttgttcggtgctgtcggcatgtgtgtctctcaactcatcgttgccattgttggcaccgccaccacttccgacgtcgcaaacaaggtgctgatcgccttcgtctgtgtctacatcttcttcttcgcttgctcatggggttgcaccgcgtgggtggtgaccggtgagctcttccctctcaaggctcgtgccaagtgtctctcaatcacgaccgccaccaactggctcctcaactgggccatcgcatatgctaccccttatatggttaactccggcccgggcaacgccaacctgcagtccaaggtgttcttcatctggggtggattctgcttcattgccggtattttcgtctacacctgcatctacgagaccaagggtcttaccttggagcaggttgatgagctttacgctaagattcctgtggcctggcgctcccatgaatttgttccatccgtcagctatgctgacgttcgtgacgttgccgccggcaaagtgtctggcaacctcgctgatctagaggccgacgcccagatgaagcgtgatatggagcatgttgagaaggcctag

SEQ ID NO: 12001 - protein, 530 aa, Aspergillus oryzae
MGFMLKKPDDATGSAAPAIVIGLFVAFGGVLFGYDTGTISGILAMPYWRKLFSTGYINPSDNYPDVTSSQSSMIVSLLSAGTFFGALGAAPIADYFGRRLAMIINTFVFCFGVILQTAATAIPLFVAGRFFAGLGVGLLSATIPLYQSETAPKWIRGTIVGAYQLAITIGLLLAAIVNNSTKGRDDTGSYRIPVAVQFAWAIILVVGMIVLPETPRFLIKKGKHEAAAKALSRLRRIDVNDPAIVEELAEIQANHEYELSVGNASYLSILRGSIGKRLATGCAVQGLQQLAGVNFIFYYGTTFFEHSGIKDGFIITLITNIVNVVSTFPGLYMVEKWGRRPLLLFGAVGMCVSQLIVAIVGTATTSDVANKVLIAFVCVYIFFFACSWGCTAWVVTGELFPLKARAKCLSITTATNWLLNWAIAYATPYMVNSGPGNANLQSKVFFIWGGFCFIAGIFVYTCIYETKGLTLEQVDELYAKIPVAWRSHEFVPSVSYADVRDVAAGKVSGNLADLEADAQMKRDMEHVEKA

SEQ ID NO: 12002 - DNA, 1596 bp, Aspergillus oryzae
  CDS (1)..(1596)
atgtggtcactccggcaaacgaaattgatacgcccacccgcaggaactgatccctctgcacctcggcaaagggatccatggtatgtatacaaactggctgcatttgtgtccctaggtgctctgctgtttggctacgaccaaggagtcatgggtgtcattgtcgccgatcaacggttcaaggatttgatgcgtcctaagaattcatctgattgcaactcaggggtgactggtgctattgtttcaatgtacgatgtaggttgcttcattggcgccatgtccaccggtagtctttcggatcggtatggccgtgagagaatgttggctattgcgagcgtcgtcttcgttattggtgcagtcctacaagctgcctcgtacacagttgtccaaataccagcctttcaccatatataccattttctgacaaacacatggatcattggccgtatagtcttgggctatggtgttgggggatgtgcggcaggggtacccctgtatcaatctgagatcgctcctccaaccctccgagggagattgattggaatagagcaaatggttctgtgcactggtgagctgtgtgcattctggatgaactatgggttcaattacctctcgactaaacactggtggcgcattcccttggcaattcaaattcttccggccattgttctggggataggttgctggttctgggtcttgccaagtccacggtggcttgtcactcaggaccgacacgactgtgctcgcgaggtattgattagattacacggtccagaggctgcagtggtagaactcgagcagatccaggaaacaatgcgcctagagaagcacaccaaagcatcttggacaggaatgtttaaaatccctatcctgcggctaaccctccttggttgtgggattcaaggcttccagcaagtcacgggcacgaattcaatcctttactacacgccgacactctttgaaaagggtggtattaccgatcctcgcaccgcaaacctggcgacaggaggcgttgggatcgcactgttcgtcagtgcatggatacccatcttcttctttgaccgtctggggcgcaaagtatggctccagattgggaccgtaggaatgatgctagccatggtcggaatcgcagtattgcaatggcatgcgggtgagagccccgggtcaaagggtaactatgcgattgtggtctttccctatctgttctatatcttcttcaacattagctggggtgtcgcggcctggacctatccgtcagaaatattcccgctgtccatgcgtgcaaagggcaacgcacttgcaacttccgctaattggaccatgtgctatatcgttgcccaggcttcgccaccagttgcagatgcaatcgggtggggcctttacgttgtttatgccgctatatgtgtcatcgctttcattttcgtccgctttgcgctagttgagacgaggaatcggtcgctagaggatatgaaccggcttttcgggctgcaaggctatttcgcagaaggtgaagctgccactgcagaggaaatttttgtagccaaaaatgcttcggcggagcacattgaagagagcactaattttgcaggtccgtcatag

SEQ ID NO: 12003 - protein, 531 aa, Aspergillus oryzae
MWSLRQTKLIRPPAGTDPSAPRQRDPWYVYKLAAFVSLGALLFGYDQGVMGVIVADQRFKDLMRPKNSSDCNSGVTGAIVSMYDVGCFIGAMSTGSLSDRYGRERMLAIASVVFVIGAVLQAASYTVVQIPAFHHIYHFLTNTWIIGRIVLGYGVGGCAAGVPLYQSEIAPPTLRGRLIGIEQMVLCTGELCAFWMNYGFNYLSTKHWWRIPLAIQILPAIVLGIGCWFWVLPSPRWLVTQDRHDCAREVLIRLHGPEAAVVELEQIQETMRLEKHTKASWTGMFKIPILRLTLLGCGIQGFQQVTGTNSILYYTPTLFEKGGITDPRTANLATGGVGIALFVSAWIPIFFFDRLGRKVWLQIGTVGMMLAMVGIAVLQWHAGESPGSKGNYAIVVFPYLFYIFFNISWGVAAWTYPSEIFPLSMRAKGNALATSANWTMCYIVAQASPPVADAIGWGLYVVYAAICVIAFIFVRFALVETRNRSLEDMNRLFGLQGYFAEGEAATAEEIFVAKNASAEHIEESTNFAGPS

SEQ ID NO: 12004 - DNA, 1629 bp, Emericella nidulans
  CDS (1)..(1629)
atgggcattctcttcaaaaagcccgaagggaccgagggcaaggcatggcctgccattttgatcagcggcttcgtcgcattcgggggaattctattcggctatgacactggcacgatcagtggaatccttgccatgccgtactgggctcaaaccttttctacaggctaccgagacagcaccggccagttgaacgtaacctctagccagtcctctgccatcgtctcaatcctctcggccggaacattcttcggtgccctgggtgccgcgcctgtgggcgacatcatcggacgtcgttggggcctcattgcgtcaaacggtgtctttgtgctgggtgttgtcctacagacgattgccacctccatcccgccgttcctcgcaggtcgcttctttgccggattgggggttggtcttatatctgcgttggttcccctctaccaatccgagaccgcaccgaaatggatccgcggattcatcgtgggctcctaccagttctccataaccatcggcctccttcttgcctcagttctcaacaacgcaacccaccaccgcaacgactcgggctcctaccgcatcccaatcgccgtacaatttgcctggtccatcatcctcgtcggaggcatgcttatcctccccgaaacccctcggtacctgatcaagcgcgacgacaccaaagccgctgctctttccctctcgaagctccgccgtctcccgcaagaccacgagtccatccgccaggaactgtcggagatccaagctaaccaccagttcgaagtcagcctgggcaagtccgggtacgccgagtgtttccgggggagcctcctgaagcgtttgctcacggggtgtggcctgcaagcgctgcagcagctgaccggtatcaatttcatcttctactacgggacgcagttcttcaagaactccggattcaagaacgagtttgtcatcacgcttatcacgaactgtgtgaatgtgggctcgacgatccccggtctgtacgccatcgataaatggggtaggaggcctgtgcttcttacgggggcgattgggatggctgtgtctcagttgcttgttgccgtcctgggaacgacgacgactggccaggatgctcaggggaatattattgtgcacaatgctgcggcgcaaaaggccgcgattgcgtttatctgtctctacatcttcttctttgcggcttcgtgggggccaattgcttgggtcgtaacaggcgaaatcttccccctcaaaacccgcgcaaagtctctctccatgacgaccgccacaaactggctcctaaactgggcactgagcttcgcaaccccgtacttggtaaactacggtgacggaaacgcaaacctacagtccaagatcttcttcatctggttcggctgctgcttcctctgtattgggtttgtgtactttatgatctatgagacgaaggggcttacccttgaagaggtggatgagctttatcttgaggttaagagcgcgagggaaagcgtcagctggagtccgaaggggacttttgcgagagttgcggagaaggggaatggtagtgcaggtattctagagcgcaccgagaagggggatgttggggggcatagggagattggcgcgcctgatggggtgtcggtctag

SEQ ID NO: 12005 - protein, 542 aa, Emericella nidulans
MGILFKKPEGTEGKAWPAILISGFVAFGGILFGYDTGTISGILAMPYWAQTFSTGYRDSTGQLNVTSSQSSAIVSILSAGTFFGALGAAPVGDIIGRRWGLIASNGVFVLGVVLQTIATSIPPFLAGRFFAGLGVGLISALVPLYQSETAPKWIRGFIVGSYQFSITIGLLLASVLNNATHHRNDSGSYRIPIAVQFAWSIILVGGMLILPETPRYLIKRDDTKAAALSLSKLRRLPQDHESIRQELSEIQANHQFEVSLGKSGYAECFRGSLLKRLLTGCGLQALQQLTGINFIFYYGTQFFKNSGFKNEFVITLITNCVNVGSTIPGLYAIDKWGRRPVLLTGAIGMAVSQLLVAVLGTTTTGQDAQGNIIVHNAAAQKAAIAFICLYIFFFAASWGPIAWVVTGEIFPLKTRAKSLSMTTATNWLLNWALSFATPYLVNYGDGNANLQSKIFFIWFGCCFLCIGFVYFMIYETKGLTLEEVDELYLEVKSARESVSWSPKGTFARVAEKGNGSAGILERTEKGDVGGHREIGAPDGVSV

SEQ ID NO: 12006 - DNA, 1563 bp, Tuber borchii
  CDS (1)..(1563)
atgggtttcatcatcaagagaccagagggtgagtctggcaaagctttgccggctattctcataggtctcttcgtcgcctttggtggtatcctttttggatatgatactggtaccatcaatggtatccttgccatggacttcttccagagtgagttcgctacagatggaaggaaagaattgacctcgagtcaaacctcgttaattgtccctatcttatctgctggtaccttctttggagctctctgtgcctctcccttcggtgatatcttgggtcgtcgtatgggtcttattgcctcttgcctggttttctccatcggtgttgccctccaggttgctgctaccgctattcctcttatggctgctggtcgtgtaattgctggtcttggtgtcggtctagtctccgcactggtacctctctaccaatccgagtcagctccaaagtggatccgaggatccatcgttggttgttaccaattggctatcaccattggtctcctcctcgcagcttgcgccaaccagggaacccacgcccgaaataatcacggttcctatcgtatccccctggccattcagttcgtctgggctgccatcttggccggtggtatgttcatcctcccggagaccccccgttactatatcaagaaggacaacatggaggctgccgcaaagagtatgagccgtctccgctctctcccagccgaccaccccgctatcattgaggagttgaacgagatcaaggctatccacgacttggagatgcaagcgaccggggaggctacttatttagactgcgtcaagcccgacatgatcaagagattgttgaccggatgcggaattcaggccctccagcaacttactggtatcaacttcatcttctattacggaactcaattcttcaagaacgctggtatcaagaacgctttcctcatcggcctcatcactaacttggtcaatgtcatctctactttccccggtctttggatggttgagaagatgggtcgtcgcaatctcctcctcttcggtgccatcggtatgtgcgcctgtcaattcattgtcgcaattgtgggtattactactgtcagcgccatcgcaaacaatgtcctcattgcgttcgtctgcttctacatcttcttcttcgcctgctcttggggtccctgctcatgggtcgttaccggtgagatctaccctcttaaggtccgtgccaagtgcctctccatttccaccgcaaccaactggcttctcaattgggctatcggtttctcaactccttacctcgtcgccgagggtccgggcaaacctaacctcggaactaaaatcttcttcgtctggggttcatgctgcttcctctgtattgctttcgtttacctcttcatctacgagaccaaggggctctccctcgagaatgttgaccaactctacatgaccgtgggtcatgcatgggagtccaagaaattcactccatcagtttcctacaatagcgacaaaatgctttccaacggacacggggctgacggaaagtcctctgagctcgcccacattgagggcgggcacggcgaggtttag

SEQ ID NO: 12007 - protein, 520 aa, Tuber borchii
MGFIIKRPEGESGKALPAILIGLFVAFGGILFGYDTGTINGILAMDFFQSEFATDGRKELTSSQTSLIVPILSAGTFFGALCASPFGDILGRRMGLIASCLVFSIGVALQVAATAIPLMAAGRVIAGLGVGLVSALVPLYQSESAPKWIRGSIVGCYQLAITIGLLLAACANQGTHARNNHGSYRIPLAIQFVWAAILAGGMFILPETPRYYIKKDNMEAAAKSMSRLRSLPADHPAIIEELNEIKAIHDLEMQATGEATYLDCVKPDMIKRLLTGCGIQALQQLTGINFIFYYGTQFFKNAGIKNAFLIGLITNLVNVISTFPGLWMVEKMGRRNLLLFGAIGMCACQFIVAIVGITTVSAIANNVLIAFVCFYIFFFACSWGPCSWVVTGEIYPLKVRAKCLSISTATNWLLNWAIGFSTPYLVAEGPGKPNLGTKIFFVWGSCCFLCIAFVYLFIYETKGLSLENVDQLYMTVGHAWESKKFTPSVSYNSDKMLSNGHGADGKSSELAHIEGGHGEV

SEQ ID NO: 12008 - DNA, 1587 bp, Sclerotinia sclerotiorum
  CDS (1)..(1587)
atgcttggtgctatcgcatctatcggtggtttcatgttcggttatgaatctggtcaaatttctttcgtccaaatgtccgacttcttagatcgattcggtgaaaatggtgaactttctgctgtccgtcaaggaaccatcgtcgccattctctgcgccggtactcttgttggatgccttggatctagttacctctgcgatacaatcggtcgtcgttacactatctccagttctgcattcttctacatcatcggtgttatcatcgaaatcacttcttctactcactgggttcaattcgctatggggagattcactgctggtttgggtattggtgctttgagtactagtgttcctatgtaccaatctgagtctgtgccaaagaacatccgtggtgctgtcgtttccagttatcagttgttgattactcttggtatctggactgcttatatgatcaactacggaactcattctgcctataccaacagtgcacagtggcgtattcctaacggtctctccgcactctgggccatcatcctcggtaccgctgtcctcttcatgcccgaatcccctcgctttgcataccgtatcggacgtgaagatgaagctcgcaaaaacatggctctcctcaacggtgttgacccttactccccacttatcgattccgagatccaagaaatcgaacaaaagctcgcagccgaaagagaaggtggtgatcacccctggtacgaaatctttactggccctagaatgttgtaccgaacacttctcggaatggttcttcaagctggtcaacaattgactggtgccaatttcttcttctactatggtactaccatcttcaagtctggtggtatctccgattcttatgttacctctatcattctcggtaccgtcaatgtcgtcgctaccattggtggtctctggattgttaagaactgcggtcgtaggaaggctctcatggttggtgctgccgagatgtttgtttgcatgttgatctactctttcgtcggacacttcaagatccaaggacaagccaatgctcaagcccctggtgctgttttgatttgtttcacctgtatctacattgttggattcgctactacatggggacctttggtttgggccattgtcggagaattatacccagcacgttacagagcttcttgcatggctctcgccaccgcatcgaactggctcttcaacttccttatctctttcttcaccacatttatcaccaacgatatcgattactactatggtcttgtctttgccggatcccttttcgctctcttctggattgtatacttcttcgttatcgagaccaaggatcgctcccttgaggaaattgacaccatgtacgtcctccacgtcaacccacgaacatcctccacttgggaccccaagtccctcggtgccgaaggtgtcaaaggtgttgataccgatggaatgttcttgaccactggagggaaagatattaagaagagtgagatggctggacgaccaatgttggaacatgacgagagaaggttccctgagaccgctggaggagctgcttctcaggagcacaaacctgagattatgaatgcttaa

SEQ ID NO: 12009 - protein, 528 aa, Sclerotinia sclerotiorum
MLGAIASIGGFMFGYESGQISFVQMSDFLDRFGENGELSAVRQGTIVAILCAGTLVGCLGSSYLCDTIGRRYTISSSAFFYIIGVIIEITSSTHWVQFAMGRFTAGLGIGALSTSVPMYQSESVPKNIRGAVVSSYQLLITLGIWTAYMINYGTHSAYTNSAQWRIPNGLSALWAIILGTAVLFMPESPRFAYRIGREDEARKNMALLNGVDPYSPLIDSEIQEIEQKLAAEREGGDHPWYEIFTGPRMLYRTLLGMVLQAGQQLTGANFFFYYGTTIFKSGGISDSYVTSIILGTVNVVATIGGLWIVKNCGRRKALMVGAAEMFVCMLIYSFVGHFKIQGQANAQAPGAVLICFTCIYIVGFATTWGPLVWAIVGELYPARYRASCMALATASNWLFNFLISFFTTFITNDIDYYYGLVFAGSLFALFWIVYFFVIETKDRSLEEIDTMYVLHVNPRTSSTWDPKSLGAEGVKGVDTDGMFLTTGGKDIKKSEMAGRPMLEHDERRFPETAGGAASQEHKPEIMNA

SEQ ID NO: 12010 - DNA, 1689 bp, Emericella nidulans
  CDS (1)..(1689)
atgggtgtggacatcaagggcctcttcaagcccaaagctgaacaacaagaacactcccaagccacaacgccttcaaggaccgactcaattgcggagaaggacaatggcatcatcgacgacagccctgtcaagtacctaacatggcggtcattcatcctgggtatcgttgtgtccatgggtggtttcatcttcggttactctactggtcaaatttccggcttcacaacaatggcagatttcaagaagcgcttcgccgagcgccaagcaaacggcgagtacgtcttcagcaacgtccgcaacggtctaatcgtcggtcttctctgcattggaaccatgatcggagccctcgtcgccgcccccatcgccgaccgcattggccgcaaactctccatgtccttctggtcgatcatccacatcgtcggtatcattatccagatcgccactgactccaactgggtccagattgccatgggccgttgggttgccggtctcggtgtcggtgccctctccagcgtcgtccccatgtaccaatccgaagctgcaccccgccaggtccgtggtgccatgatctcggccttccagcttttcgtcgcctttggtatcttcatctcttatatcatcaactacggtaccgagtcgatccaatccactgcctcgtggagaatcaccatgggcatcggtttcgcttggccactgatcttaggtctcggagctcttttcctgcccgagtccccccgttacgcttaccgtcttggccgtattgacgaggcccgcaaggtcatgaccaagctctatggtgttgaggttaaccaccgcgttgtcgtccaagaaatgaaggacatgaaggataagctcgaggaggagcgcgctgctggtgttgctccctggcacgaggttgtgactggcccccgtatgctctatcgtactcttcttggtattgctctgcagtccctgcagcagctctctggcgcaaacttcatcttctactacggtaactccattttcacctccaccggtctcaacaacagttacgtcacccagatcattcttggtgccgttaacttcggtatgaccctgcctggtctgtacattgtcgagcactttggtcgccgtgctagtctgatggtcggtggtgcctggatggccatctgcttctacatctgggcttctgtgggcaactccgttcttgatcttgacaacccgcagaacacccccaaggccggagccgccatgatcgtgttcacctgcttcttcatcgccggtttcgccaccacatggggtcccatcgtctggtccatctgctctgagatgtaccccaaccgcagccgcgccacaagcattggcattgccacttgtgccaactggacatggaacttcctgatctccttcttcaccccatttatctcaggctccatccactttgcctacggctacgtgtttgcctcctgctgtgttgttggtgtccttatcgtcttcttcttcgtcaacgagacccagggccgtaccctcgaggaagtcgacaccatgtatgtcttgcatgttgtcccctggaagagtgcttcctgggttcccgatgagagcatcgtccgtgatctccaccctggttccgatgctaacaagactgagggccttgggcaggcggagcatggtgaggagagcaggccggagcctgtggagattcgggagtga

SEQ ID NO: 12011 - protein, 562 aa, Emericella nidulans
MGVDIKGLFKPKAEQQEHSQATTPSRTDSIAEKDNGIIDDSPVKYLTWRSFILGIVVSMGGFIFGYSTGQISGFTTMADFKKRFAERQANGEYVFSNVRNGLIVGLLCIGTMIGALVAAPIADRIGRKLSMSFWSIIHIVGIIIQIATDSNWVQIAMGRWVAGLGVGALSSVVPMYQSEAAPRQVRGAMISAFQLFVAFGIFISYIINYGTESIQSTASWRITMGIGFAWPLILGLGALFLPESPRYAYRLGRIDEARKVMTKLYGVEVNHRVVVQEMKDMKDKLEEERAAGVAPWHEVVTGPRMLYRTLLGIALQSLQQLSGANFIFYYGNSIFTSTGLNNSYVTQIILGAVNFGMTLPGLYIVEHFGRRASLMVGGAWMAICFYIWASVGNSVLDLDNPQNTPKAGAAMIVFTCFFIAGFATTWGPIVWSICSEMYPNRSRATSIGIATCANWTWNFLISFFTPFISGSIHFAYGYVFASCCVVGVLIVFFFVNETQGRTLEEVDTMYVLHVVPWKSASWVPDESIVRDLHPGSDANKTEGLGQAEHGEESRPEPVEIRE

SEQ ID NO: 12012 - DNA, 1563 bp, Cryptococcus neoformans var
  CDS (1)..(1563)
atggcccccaggagttccaagaaggctttgaccctctgtcttttccagagtttggcgggtgtcattttcggatggagtaattctgaaggttctggtctgttctccatgtcaaagtaccaagaacgattcggtgaatgtgtcgacggcgtttgcaccctttcaactactcgacaatctgccattaccggtcttttgtcagtcggcgctgtcattggtgctgttggttccggttctattgctgaccgattcggtttgcgattgacctgtatggttttcatcttcatctacctttgtggtgctgccatcgagacttctgcctttaacacctatggtcaactctgcgttgctcgtcttctcaccggtctcggtgtcggtgctacctctggtcttgttcccgttttccaggctgaggcttctcctcctcgataccgaggtctcgtcactggttctttccagctttgtgttactcttggtatctggggtgttgccatgaccaactggggtatgagctcttatgccggtgatgtctcatggcgaatccccgtatctcttcaaatggtctgggctgctttgttgctagttggtttcctcttttcccccgagtctccccgattccttgccaagaagggcagatgggaacattgccgaaagaaccttgccaatctccgtggtcttcctgtcgatcaccctgacatcgataccgagatggaggaagtccgtgaggctaccatcaaggaccaggagcgcggtcaggccagctatgttgaatgcttctccactaaggaccgaattctctggcgaactatgattggtatctgtgtccagatcgggcagcaaatcaccggtgtcaactttttcttctcttacggtgtccagttcgcccagactgccggtcttgacgatacctatgtcttccagatcattctcgcttccgtcaacgtcctcttctctttccccggtattctcgctgtcgaccgagctggtcgacgacctatccttcttatcggtggcattctcatgtttattggtcaaatcgttgtcggtgctgtctccaaagcctaccctgatgacaagattgccggtgatgtcctcattgcctttacctgtcttttcattgcgtcctttgcgtcatcttggggtcctatcgcctgggttgtttgcggtgagactttccccatcaggttgtcttctctgtgtgtcactctcggtaccggtgccaactggctcttcaacctcatcatcgcctttgctgctcctcagatccaggcccgaattggtactggtatcacttttgtttgggccggctgtctcgcgatttctgtttcttttgccttcttctgcattcctgagacgagatcgatgtccatcgaacaggtagatgcgctctatctctctcacactcccgcttggcgatctcacaaatttgtggatgagcagctggctagggctcaaaatgcgcaagagaagcactactctcgatctatccacgctgagaacgagcaggtcaaatctagccaacagactagcgctcgaaccagcgctgaggacgacaggattgtctaa

SEQ ID NO: 12013 - protein, 520 aa, Cryptococcus neoformans var
MAPRSSKKALTLCLFQSLAGVIFGWSNSEGSGLFSMSKYQERFGECVDGVCTLSTTRQSAITGLLSVGAVIGAVGSGSIADRFGLRLTCMVFIFIYLCGAAIETSAFNTYGQLCVARLLTGLGVGATSGLVPVFQAEASPPRYRGLVTGSFQLCVTLGIWGVAMTNWGMSSYAGDVSWRIPVSLQMVWAALLLVGFLFSPESPRFLAKKGRWEHCRKNLANLRGLPVDHPDIDTEMEEVREATIKDQERGQASYVECFSTKDRILWRTMIGICVQIGQQITGVNFFFSYGVQFAQTAGLDDTYVFQIILASVNVLFSFPGILAVDRAGRRPILLIGGILMFIGQIVVGAVSKAYPDDKIAGDVLIAFTCLFIASFASSWGPIAWVVCGETFPIRLSSLCVTLGTGANWLFNLIIAFAAPQIQARIGTGITFVWAGCLAISVSFAFFCIPETRSMSIEQVDALYLSHTPAWRSHKFVDEQLARAQNAQEKHYSRSIHAENEQVKSSQQTSARTSAEDDRIV

SEQ ID NO: 12014 - DNA, 3229 bp, Torulaspora delbrueckii
  CDS (986)..(2689)
accaacctaccacatttggttatgacactgtggccagtctacaagatagcgtgatagatcccaacctggtaattgtacattctgggatggttgttggatattattcacgcaaattgtggtgctattcgtggttagcagccttgagccgatcttgtttacctttcgggaagctcatcgacaaggcttggcggaagatggaagaaaaaaacggaaaaactttttgtaggatcgcacgaattcttccgtgaatgttcacccagtttttccgtagatggtaagtttttccggagggcgagggacccccacctaaattaatgagaacgcgctggcagctgaccagcagccaacaatttctgagcgagtgtgtgtgtgtgtgtgtgtgtgactaacgaggtagtttcactttttcgtatagccagaattttatggtatgtttgagagcacaacagctcgaaatacactggttcaatatgccagcttagcagcaataatagctactccttgattactatctcatttactatgggttgactacaagttgaggaatttagtggtccggggctagcggggccccacaggctatggtataccatggagaatttacaaggagaatcctggattaaatctcgctgcgtcgctccactatcataggaacattgtttttccgccacgacgttttctacgccctaccgcgtttgcggtttttccgtatttttccggctatactaaaaacgcgtggcggattaatatggaaaatcttctgattcctccacagcagtacggaaaatagttgttccaagcgcccatctccatgtttttccgaagataatatcccgctgtcatctaatagtgagggaagatcgaaatgtataagaataacgaggttttgggtaggattgttcaggttctctcgaatattattctgtgctttttgattatctccacagatcaaaaataaattcaatcagcattgaataaaaataaaatgtctactacagagcatacaccagttgaccatttgtcgccagctgtgtctgcatcaggttctgggttatctaccccatctaataaagccgaaagagatgatataaaagatttcgacgctgccgctgatagagaagctgccgttgatataccaaagagaccagcttcttcttacatcggtgtctccattttgtgtttaatggttgcttttggtggtttcgtcttcggttgggatactggtactatttctggttttgtgaacttgtctgatttcctccaaagattcggtcaaagaagcaaggacggtgtttactacctgtccaaggttagaatgggtttaattgtttctatcttcaacattggttgcgctatcggtggtattattctatccaagattggtgatatatatggtcgccgtatcggtctagttgctgttactgtcatttatgtcgttggtatcttgattcaaatctgttctttcaacaaatggtaccaatactttatcggtagaattatctctggtctaggtgttggtggtatcgctgttttgtctccaatgttgatttccgaagtttctccaaagcaaattagaggtactctagtcgcttgttaccaactgatgatcactctaggtatcttcttgggttactgtactaactacggtaccaagacatacaatgactccactcaatggagagtcggtctaggtctatgtttcgcttgggctatctttatgattggtggtatgcttttcgttcctgaatctccacgttacctggtcgagcatggtaatattgaagaggccaagcgctctctatccaggtccaacaaactttctgttgatgatccagctgtgctagctgaattggatgccatttccgctggtgtggaagccgaaaaattggcaggtagcgcttcctggggtgaattgttctccactaagaccaaggttttccaacgtttgattatgggtgtcatgcttcaatctctacaacaattgactggtgataactacttcttctactacggtaccactgtcttcaagtctgtcggtttgaaagattctttccaaacttctatcattattggtgttgtcaacttcttctccactttcgtcggtatcttctgtatcgaaagatttggtcgtcgtacttgtttgctatggggtgccgcttccatggtctgttgtttcgtcgtgtttgcatctgtcggtgttacgaagctatggccagaaggtcctagccatcaagatatctcttccaagggtgctggtaactgtatgatcgtctttaccatgtttttcatcttctgtttcgctacctcttgggctggtggttgttacgttatcgtctctgaatctttcccattgagagttaagtctaagggtatggctattgctaccgctgctaactggctatggggtttcttaattgctttcttcactccattcattactggtgccattaacttctactacggttacgtcttcatgggatgtctagttttcggttacttctacgttttcttctttgttccagaaactaaaggtttgaccttggaagaagtggagaccatgtggctcgaaggtgtcctaccatggaagtctgctgcttgggttccaccagacagaagaggtgctgactacaacgctgaagaaatggctcacgatgataagccaatgtacaagagatttttctccaaataagtctctgagctttaatccatacatttcactgatcttttaatgacttttttttacgaccatcttttatgatacatttaagtaaatcagataaatatcgaataacacaactacattctacatttaaaaaatgaggctaaagactactccaataggtgttttatgcatcaatagctttatgcatttgatttaactctattatttaattttattataatttattttatttattttgacgctgacgccgacggaaaaaatttcgcctaatactcatcgcttgtcgattgaaatttcaagcgcacttatcagttctagtgaacagtcaattttgatattgatacttgtttatgttcaagagagtttcaagtactcttgtatcattacagaactgtcttttttcacagtttcgtggacaattgccgaagaacgctagaatctcgttgcacatatcgagagctactagtacactaatgagcgctccagctaccaataccatctctgcgcaattgcagaacctctccattcaagagcccacaaaagtgg

SEQ ID NO: 12015 - protein, 567 aa, Torulaspora delbrueckii
MSTTEHTPVDHLSPAVSASGSGLSTPSNKAERDDIKDFDAAADREAAVDIPKRPASSYIGVSILCLMVAFGGFVFGWDTGTISGFVNLSDFLQRFGQRSKDGVYYLSKVRMGLIVSIFNIGCAIGGIILSKIGDIYGRRIGLVAVTVIYVVGILIQICSFNKWYQYFIGRIISGLGVGGIAVLSPMLISEVSPKQIRGTLVACYQLMITLGIFLGYCTNYGTKTYNDSTQWRVGLGLCFAWAIFMIGGMLFVPESPRYLVEHGNIEEAKRSLSRSNKLSVDDPAVLAELDAISAGVEAEKLAGSASWGELFSTKTKVFQRLIMGVMLQSLQQLTGDNYFFYYGTTVFKSVGLKDSFQTSIIIGVVNFFSTFVGIFCIERFGRRTCLLWGAASMVCCFVVFASVGVTKLWPEGPSHQDISSKGAGNCMIVFTMFFIFCFATSWAGGCYVIVSESFPLRVKSKGMAIATAANWLWGFLIAFFTPFITGAINFYYGYVFMGCLVFGYFYVFFFVPETKGLTLEEVETMWLEGVLPWKSAAWVPPDRRGADYNAEEMAHDDKPMYKRFFSK

SEQ ID NO: 12016 - DNA, 1608 bp, Magnaporthe grisea
  CDS (1)..(1608)
atggttcgcggattcaagcggccagagaatgaggccggtgccgcctggcccgccattctcgtcggcgccttcgtctccttcggtggtgtccttttcggctatgacaccggtaccatcagtggtatcttggccatgaaatactggaaggagctcttctccacaggttacaccgatgccacaggccagcttggtatctctccctctgaggaggccgccgtcgtctccatcctctctgccggtaccttcttcggagctctcgcctcagtcttcctcgccgactccatcggtcgtcgctgggccctcatcgcctcctgctgggtcttcaacctgggtgtcatcttccagactgccgctgtcgccctgcccctgttcctcgctggtcgcttctttgctggtttcggtgtcggtctcatctccgccatgatccctctgtaccagtccgagacggctcccaagtggattcgtggtgccatcgttggtgcttaccagttgtctatcaccatcggtcttctccttgccgccatcgtcaataactccacccacgaacgcgacgacacgggctcctaccgtatcccaattgccgtccagttcgcctggtctatcattctcattgttggcatgttgatccttcccgagactcctcgattcctcgtcaagaagggaaagatggaccaggccgcccggtctctcggcaagctccgccgtctccctgccgaccacgaggccatcgtcgccgaggttgccgagatcaaggccaacaacgactacgagatgtcccagggcactgccggctacatcgactgcttccgcggccccatgctcaagcgccagctcaccggcatgggtctccaggctctccagcaactcactggtgtcaacttcatcttctactatggcaccaagtactttgagaactcgggtatcagccaacccttcgtcatccaaatgatcacctccgtcatcaacgtcgtctccaccatccctggtcttatcgccgtcgaccgctggggtcgtcgccccatgcttctctggggtgccatcggaatgactatcagccagttcctggttgccatgctcggtaccctcaccacaggtcagcgcgcggacggttccatcatcgtttacaacgtcgaggctcagaaggctggtgttgctttcgtctgcatctacatcttcttctttgccagcacctggggtcccctagcctgggttgttaccggcgagatcttccctctgaagcagcgtgcccgtggcctgtccctcaccaccgccactaactggctcctcaactgggctatcgcctacatgactccttacctcgtcaactttggtcccggctacgccaacctccagtccaagatcttcttcgtctggttcggagcctgcttcctgtgcattgcctttgtctacttcttcatctacgagaccaagggtctgtcacttgaggaggtcgatgagttgtatgctcaggtcagctccgcccgccacagcagcgcgtggcagccttctgtctctttcacccagcgcactggcgtcgactccgccactgtcgagaagatcgagggcgacgccagcgaccacgctgtcgatcaggccaacagggtctaa

SEQ ID NO: 12017 - protein, 535 aa, Magnaporthe grisea
MVRGFKRPENEAGAAWPAILVGAFVSFGGVLFGYDTGTISGILAMKYWKELFSTGYTDATGQLGISPSEEAAVVSILSAGTFFGALASVFLADSIGRRWALIASCWVFNLGVIFQTAAVALPLFLAGRFFAGFGVGLISAMIPLYQSETAPKWIRGAIVGAYQLSITIGLLLAAIVNNSTHERDDTGSYRIPIAVQFAWSIILIVGMLILPETPRFLVKKGKMDQAARSLGKLRRLPADHEAIVAEVAEIKANNDYEMSQGTAGYIDCFRGPMLKRQLTGMGLQALQQLTGVNFIFYYGTKYFENSGISQPFVIQMITSVINVVSTIPGLIAVDRWGRRPMLLWGAIGMTISQFLVAMLGTLTTGQRADGSIIVYNVEAQKAGVAFVCIYIFFFASTWGPLAWVVTGEIFPLKQRARGLSLTTATNWLLNWAIAYMTPYLVNFGPGYANLQSKIFFVWFGACFLCIAFVYFFIYETKGLSLEEVDELYAQVSSARHSSAWQPSVSFTQRTGVDSATVEKIEGDASDHAVDQANRV

SEQ ID NO: 12018 - DNA, 1722 bp, Saccharomyces mikatae IFO 1815
  CDS (1)..(1722)
atggcttttgaagagaacaataagcctgttgcttcagagcaaccccaagctgctgaagatttagtgtcttcattcagtaaagattcacacttaagtgcacaatctcaaaaatattccaatgatgaattgaaagctggcgaggcaaaccctgaagggtctgaaagtgtgcccatggagatacccaagaagcctatgtctgagtatgtaactgtttctctgctatgcttgtgtgtcgccttcggcggcttcatgtttggctgggataccggcaccatatctggttttgttgctcaaacagacttcttgagaagatttggtatgaaacacaaggatggaacccattatttgtcaaatgtcagaactggtttaattgtcgccattttcaacattggttgtgcctttggtggtattattctttccaaagctggcgatatgtatggccgtaaaaagggtctttcaattgttgtttccgtttatatagtcggaattatcattcaaattgcctccatcaacaaatggtaccaatattttatcggaagaattatctctggtctaggtgtcggtggtattgccgtcttatctcctatgttgatctctgaaattgccccaaaacatttgagaggtacactagtttcctgttaccagctgatgattactgcaggtattttcctaggctattgtactaactatggtacaaagaactattcgaactcagtccaatggagagtaccattggggctatgtttcgcttggtcattattcatgattggcgctttaacgctggtccctgaatccccacgttacttatgtgaaatgaatagggtcgaagatgcaaagcattctattgccaagtctaacaaagtgtcaccagaagatccagctgttcaagccgagttggatctgatcatggcgggtgtagaagctgaaaaactggctggcaatgcgtcatggggtgaattattttctacaaagaccaaagtcttccaacgtttgttaatgggtgtacttgtccaaatgttccaacaattgactggtaataactacttcttctactacggtaccattgtcttcaagtcagttggtcttaatgattcatttcaaacttccattgtcattggtgtggtcaactttgcttccactttcttcagtttgtggactgttgagaacttgggtcgtcgtaagtgtttgcttttaggcgccgccaccatgatggcctgtatggttatcttcgcttctgttggtgtaaccagattatatcctcatggtaagagccaaccttcttccaagggcgctggtaactgtatgattgtcttcacctgtttttatattttctgttatgccacgacttgggcaccagttgcctgggttattactgcagaatcattccccttgagagtcaagtcgaaatgtatggccatggcctcagcttccaattgggtatggggcttcttgattgcattcttcactccatttatcacctctgccattaatttctactacggttatgtctttatgggctgtttagttgctatgttcttttatgtttttttctttgttccagaaaccaagggcctgtcgttggaggaaatacaagagttatgggaagaaggtgttctcccatggaaatccgaaggctggatcccctcctctagaagaggtaatgattataatttggaagatttacaacatgacaacaaaccatggtacaaagccatgctataa

SEQ ID NO: 12019 - protein, 573 aa, Saccharomyces mikatae IFO 1815
MAFEENNKPVASEQPQAAEDLVSSFSKDSHLSAQSQKYSNDELKAGEANPEGSESVPMEIPKKPMSEYVTVSLLCLCVAFGGFMFGWDTGTISGFVAQTDFLRRFGMKHKDGTHYLSNVRTGLIVAIFNIGCAFGGIILSKAGDMYGRKKGLSIVVSVYIVGIIIQIASINKWYQYFIGRIISGLGVGGIAVLSPMLISEIAPKHLRGTLVSCYQLMITAGIFLGYCTNYGTKNYSNSVQWRVPLGLCFAWSLFMIGALTLVPESPRYLCEMNRVEDAKHSIAKSNKVSPEDPAVQAELDLIMAGVEAEKLAGNASWGELFSTKTKVFQRLLMGVLVQMFQQLTGNNYFFYYGTIVFKSVGLNDSFQTSIVIGVVNFASTFFSLWTVENLGRRKCLLLGAATMMACMVIFASVGVTRLYPHGKSQPSSKGAGNCMIVFTCFYIFCYATTWAPVAWVITAESFPLRVKSKCMAMASASNWVWGFLIAFFTPFITSAINFYYGYVFMGCLVAMFFYVFFFVPETKGLSLEEIQELWEEGVLPWKSEGWIPSSRRGNDYNLEDLQHDNKPWYKAML

SEQ ID NO: 12020 - DNA, 1590 bp, Sclerotinia sclerotiorum
  CDS (1)..(1590)
atgcttggtgctatcgcatctatcggtggtttcatgttcggttatgaatctggtcaaatttctggtttcgtccaaatgtccgacttcttagatcgattcggtgaaaatggtgaactttctgctgtccgtcaaggaaccatcgtcgccattctctgcgccggtactcttgttggatgccttggatctagttacctctgcgatacaatcggtcgtcgttacactatctccagttctgcattcttctacatcatcggtgttatcatcgaaatcacttcttctactcactgggttcaattcgctatggggagattcactgctggtttgggtattggtgctttgagtactagtgttcctatgtaccaatctgagtctgtgccaaagaacattcgtggtgctgtcgtttccagttatcagttgttgattactcttggtatctggactgcttatatgatcaactacggaactcattctgcctataccaacagtgcacagtggcggattcctaacggtctctccgcactctgggccatcatcctcggtaccgctgtcctcttcatgcccgaatccctcgctttgcataccgtatcggacgtgaagatgaaagctcgcaaaaacatggctctcctcaacggtgttgacccttactccccacttatcgattccgagatccaagaaatcgaacaaaagctcgcagccgaaagagaaggtggtgatcacccctggtacgaaatctttactggccctagaatgttgtaccgaacacttctcggaatggttcttcaagctggtcaacaattgactggtgccaatttcttcttctactatggtactaccatcttcaagtctggtggtatctccgattcttatgttacctctatcattctcggtaccgtcaatgtcgtcgctaccattggtggtctctggattgttaagaactgcggtcgtaggaaggctctcatggttggtgctgccgagatgtttgtttgcatgttgatctactctttcgtcggacacttcaagatccaaagacaagcccaatgctcaagcccctgggctgttttgatttgtttcacctgtatctacattgttggatctgctactacatggggacctttggtttgggccattgtcggagaattatacccagcacgttacagagcttcttgcatggctctcgccaccgcatcgaactggctcttcaacttccttatctctttcttcaccacatttatcaccaacgatatcgattactactatggtcttgtctttgccggatcccttttcgctctcttctggattgtatacttcttcgttatcgagaccaaggatcgctcccttgaggaaatcgacaccatgtacgtcctccacgtcaacccacgaacatcctccacttgggaccccaagtccctcggtgccgaaggtgtcaaaggtgttgataccgatggaatgttcttgaccactggagggaaagatattaagaagagtgagatggctggacgaccaatgttggaacatgacgagagaaggttccctgagaccgctggaggagctgcttctcaggagcacaaacctgagattatgaatgcttaa

SEQ ID NO: 12021 - protein, 529 aa, Sclerotinia sclerotiorum
MLGAIASIGGFMFGYESGQISGFVQMSDFLDRFGENGELSAVRQGTIVAILCAGTLVGCLGSSYLCDTIGRRYTISSSAFFYIIGVIIEITSSTHWVQFAMGRFTAGLGIGALSTSVPMYQSESVPKNIRGAVVSSYQLLITLGIWTAYMINYGTHSAYTNSAQWRIPNGLSALWAIILGTAVLFMPESLALHTVSDVKMKARKNMALLNGVDPYSPLIDSEIQEIEQKLAAEREGGDHPWYEIFTGPRMLYRTLLGMVLQAGQQLTGANFFFYYGTTIFKSGGISDSYVTSIILGTVNVVATIGGLWIVKNCGRRKALMVGAAEMFVCMLIYSFVGHFKIQRQAQCSSPWAVLICFTCIYIVGSATTWGPLVWAIVGELYPARYRASCMALATASNWLFNFLISFFTTFITNDIDYYYGLVFAGSLFALFWIVYFFVIETKDRSLEEIDTMYVLHVNPRTSSTWDPKSLGAEGVKGVDTDGMFLTTGGKDIKKSEMAGRPMLEHDERRFPETAGGAASQEHKPEIMNA

SEQ ID NO: 12022 - DNA, 1647 bp, Trichoderma reesei
  CDS (1)..(1647)
atgcccattggcaacatctacgtgatcgccggcgtgtccgtcgtcggcggcgcgttgttcggcttcgacatctcgtctgtgtcggcccagctggccgagcagtcgtacctctgctacttcaaccaagatgagaatccgcccaccaccgtcgatggcacctgtggtggcccgcggtccctcgtccagggcggcatcacggcctccatggctgctgggtcctggctgggcgccctgatctcgggtcccctgtctgatcgcctgggccgcaagtactccatcatggtcggatgtatcatttgggttattggctccaccctctcgtgcgcttctcaaaacattggcatgctcattgtcgcccgtatcatcaacggtctctccgtcggtatcgaatctgctcaggtccccgtctacattgccgagatttcgcctccctccaagcgcggccgcttcatcggcatgcagcagtgggccatcacctggggcatcctcatcatgtactacatctcctacggctgctccttcatcggcaagcagaaccctctcgagtacaacactgcctcgtggcgtattccatggggtctgcagatgattcccgccttcttcctcttcttcatgatgatgccgcttcccgagtctccccgttggctcgcccgcaaggaccgctgggaggactgccgcgccgtgctcaccctcgtccacggcaagggcgatcccaaccacccctttgttgcctacgaactgcaggacatcaaggacatgtgcgagtttgagcgtcgccatgctgatgtcacctacctcgacctgttcaagcccaacatgctcaaccgcacattcattggtctctttacccagatctggtcccagctgacgggcatgaacgtcatgatgtactacattgccaacatcttctccatggctggctacagcggcaacgccaacctgctcgcctcgtccatccagtacatcatcaacgtgctgatgaccattcccgccctgctttgggtcgacaaatggggtcgccgtcccacgctgctcgtcggttccgtcctcatggccctgtggatgtacgccaacgcgggtatcctcgccacctacggtgaagtcgtccccggcggcattgatcacgtcgctgcccagtcgatgcgtgtctcgggcgcccctgccaagggtctcattgcctgcacgtacctgtttgtggcctcgttcgcgcccacctggggtcccgtctcgtggacctaccctccggagctgttccccctccgcctccgaggcaagggcgtggctctggcgacttccggaaactgggccttcaacacggcgctgggtctcttcaccccggtggcctttgccaacatcaagtggaagtcgtacctcatctttgccatcttcaacactgtcgccttcttccacgtcttcttcgtcttccccgagacggccggcaagacgctcgaggagacggaggccatgttcgaggatcccaacggcatcaagtacctgggcacgcccgcgtggaagacgagggtggccacgagcctcacggagcgtgccgagcacggcgacattgaggccaagattggccatgacacggagaagcctccggtccacactcacgaggaggagaaggccagcactccccctccccagtag

SEQ ID NO: 12023 - protein, 548 aa, Trichoderma reesei
MPIGNIYVIAGVSVVGGALFGFDISSVSAQLAEQSYLCYFNQDENPPTTVDGTCGGPRSLVQGGITASMAAGSWLGALISGPLSDRLGRKYSIMVGCIIWVIGSTLSCASQNIGMLIVARIINGLSVGIESAQVPVYIAEISPPSKRGRFIGMQQWAITWGILIMYYISYGCSFIGKQNPLEYNTASWRIPWGLQMIPAFFLFFMMMPLPESPRWLARKDRWEDCRAVLTLVHGKGDPNHPFVAYELQDIKDMCEFERRHADVTYLDLFKPNMLNRTFIGLFTQIWSQLTGMNVMMYYIANIFSMAGYSGNANLLASSIQYIINVLMTIPALLWVDKWGRRPTLLVGSVLMALWMYANAGILATYGEVVPGGIDHVAAQSMRVSGAPAKGLIACTYLFVASFAPTWGPVSWTYPPELFPLRLRGKGVALATSGNWAFNTALGLFTPVAFANIKWKSYLIFAIFNTVAFFHVFFVFPETAGKTLEETEAMFEDPNGIKYLGTPAWKTRVATSLTERAEHGDIEAKIGHDTEKPPVHTHEEEKASTPPPQ

SEQ ID NO: 12024 - DNA, 2536 bp, Pichia angusta; identical to SEQ ID NO: 4664
  CDS (578)..(2203)

SEQ ID NO: 12025 - protein, 541 aa, Pichia angusta; identical to SEQ ID NO: 4665

SEQ ID NO: 12026 - DNA, 1752 bp, Aspergillus niger
  CDS (1)..(1752)
atgggtgtctctaatatgatgtcccggttcaagcctcaggcggaccactctgagtcctccactgaggctcctactcctgctcgctccaactccgccgtcgagaaggacaatgtcttgctcgatgacagtcccgtcaagtacttgacctggcgctccttcatcctgggtatcgtcgtgtccatgggtggtttcatcttcggttactctactggtcaaatctctggtttcgagactatggatgacttcctccaacgtttcggtcaggaacaggcggatggatcctatgctttcagcaacgtccgtagtggtctcattgtcggtctgctgtgtatcggtactatgatcggtgccctggttgctgctcctatcgcagaccgcatgggccgcaagctctccatctgtctctggtctgtcatccacatcgtcggtatcatcattcagattgccaccgactccaactgggtccaggtcgctatgggtcgttgggttgccggtctgggtgttggtgccctctccagcattgtccccatgtaccagagtgaatctgctccccgtcaggtccgtggtgccatggtcagtgccttccagctgttcgttgccttcggtatcttcatctcctacatcatcaacttcggtaccgagagaatccagtcgactgcttcctggcgtatcaccatgggcattggcttcgcctggcccttgattctggctgttggctctctcttcctgcccgagtctcctcgtttcgcctaccgtcagggtcgtatcgatgaggcccgtgaggttatgtgcaagctgtacggtgtcagcccgaaccaccgcgtcatcgcccaggagatgaaggacatgaaggacaagctcgacgaggagaaggccgccggtcaggctgcctggcacgagctgttcaccggccctcgcatgctctaccgtaccctgctcggtattgctctgcagtccctccagcagctgaccggtgccaactttatcttctactacggaaacagtatcttcacctccactggtctgagcaacagctacgtcactcagatcattctgggtgctgtcaacttcggtatgaccctgcccggtctgtacgtcgtcgagcacttcggtcgtcgtaacagtctgatggttggtgctgcctggatgttcatttgcttcatgatctgggcttccgttggtcacttcgctctggatcttgccgaccctcaggccactcctgccgctggtaaggccatgatcatcttcacttgcttcttcattgtcggtttcgccaccacctggggtcctatcgtctgggccatctgtggtgagatgtaccccgcccgctaccgtgctctctgcattggtattgccaccgctgccaactggacctggaacttcctcatctccttcttcacccccttcatctctagctccattgacttcgcctacggctacgtctttgctggatgctgtttcgccgccatcttcgttgtcttcttcttcgtcaatgagacccagggtcgcactcttgaggaggttgacaccatgtacgtgctccacgtcaagccctggcagagtgccagctgggttcccccggagggcattgtccaggacatgcccgccccccttcctcttccaagcaggagggtcaggctgagatggctgagcacaccgagcccactgagctccgcgagtaagccactcgcactcgcgcgaactcattttgctagttgctcttgtacattgaacctgcatcttaagctttga

SEQ ID NO: 12027 - protein, 583 aa, Aspergillus niger
MGVSNMMSRFKPQADHSESSTEAPTPARSNSAVEKDNVLLDDSPVKYLTWRSFILGIVVSMGGFIFGYSTGQISGFETMDDFLQRFGQEQADGSYAFSNVRSGLIVGLLCIGTMIGALVAAPIADRMGRKLSICLWSVIHIVGIIIQIATDSNWVQVAMGRWVAGLGVGALSSIVPMYQSESAPRQVRGAMVSAFQLFVAFGIFISYIINFGTERIQSTASWRITMGIGFAWPLILAVGSLFLPESPRFAYRQGRIDEAREVMCKLYGVSPNHRVIAQEMKDMKDKLDEEKAAGQAAWHELFTGPRMLYRTLLGIALQSLQQLTGANFIFYYGNSIFTSTGLSNSYVTQIILGAVNFGMTLPGLYVVEHFGRRNSLMVGAAWMFICFMIWASVGHFALDLADPQATPAAGKAMIIFTCFFIVGFATTWGPIVWAICGEMYPARYRALCIGIATAANWTWNFLISFFTPFISSSIDFAYGYVFAGCCFAAIFVVFFFVNETQGRTLEEVDTMYVLHVKPWQSASWVPPEGIVQDMPAPLPLPSRRVRLRWLSTPSPLSSASKPLALARTHFASCSCTLNLHLKL

SEQ ID NO: 12028 - DNA, 1593 bp, Aspergillus niger
  CDS (1)..(1593)
atggctgaaggcttcgttgacgcctcgcgcgtcgaggccccagtcaccctcaagacctacttgatgtgtgcctttgcggcttttggtggtatcttcttcggttatgactctggttatatcagcggtgtcatgggaatgagatacttcatcgaggagtttgagggcttggactataacactacccccaccgattccttcgtcctcccgtcctggaaaaaatcgttgatcacgtcgatcctctcggctggaaccttctttggtgccctcattgctggtgacttggcagactggttcggtcgtcgcactaccattgtcagtggttgtgttgtcttcatcgttggtgttatcctgcagaccgcttcgacctccttgggtctgcttgttgccggccgtctggtcgcgggatttggtgtgggcttcgtctccgccatcattatcctgtacatgtctgagattgcacctcgcaaggttcgcggtgctattgtctcagggtaccagttctgcatcaccatcgggctcatgttggcctcgtgcgtcgactacggcactgagaaccgtctcgactctggctcctaccgtatcccaatcggcctccagctcgcctgggccttgatcctgggaggtggtctgctctgcctgcccgagtcccctcgttactttgttaaaaagggcgacctggctaaggctgcggaggttcttgcccgcgttcgtggtcaaccccaagactcggattatatcaaggatgagctggcggagattgtggcaaatcatgagtacgagatgcaggtgattccggaaggtggatatttcgtcagctggatgaactgcttccgtggcagtatattctcgcccaacagcaatctccgtcggactgtcctaggtacttctctgcagatgatgcaacagtggaccggtgtcaactttgtcttctactttggaacgacctttttccagtcgctgggaaccatcgatgaccccttcctcatcagcatgattaccactatcgtcaacgtctgctcgacccccgtctcgttctacacaattgagaagtttggccgccgttcgctccttttgtggggagcacttggtatggtcatctgccagttcattgtcgctatcgtcggcaccgtggacggtagcaataagcacgctgtcagtgcagagatttctttcatctgcatttacatcttcttctttgctagcacgtggggcccgggcgcctgggttgtgattggcgagattttccccctacctattcggtcgcgtggtgtggctctgtcgacggcatcgaactggctgtggaattgcatcatcgctgtcatcaccccttacatggtcgacaaggacaagggtgacttgaaggccaaggtgttcttcatctggggctcgctgtgtgcctgcgcttttgtctacacgtacttcctaattccggagaccaagggtcttactcttgagcaggtggacaagatgatggaagagaccacgcctcgcacctcagccaagtggactccacatggcaccttcacggccgagatgggtcttactgcgaatgccgtggccgaaaaggctactgcggttcaccaggaggtgtga

SEQ ID NO: 12029 - protein, 530 aa, Aspergillus niger
MAEGFVDASRVEAPVTLKTYLMCAFAAFGGIFFGYDSGYISGVMGMRYFIEEFEGLDYNTTPTDSFVLPSWKKSLITSILSAGTFFGALIAGDLADWFGRRTTIVSGCVVFIVGVILQTASTSLGLLVAGRLVAGFGVGFVSAIIILYMSEIAPRKVRGAIVSGYQFCITIGLMLASCVDYGTENRLDSGSYRIPIGLQLAWALILGGGLLCLPESPRYFVKKGDLAKAAEVLARVRGQPQDSDYIKDELAEIVANHEYEMQVIPEGGYFVSWMNCFRGSIFSPNSNLRRTVLGTSLQMMQQWTGVNFVFYFGTTFFQSLGTIDDPFLISMITTIVNVCSTPVSFYTIEKFGRRSLLLWGALGMVICQFIVAIVGTVDGSNKHAVSAEISFICIYIFFFASTWGPGAWVVIGEIFPLPIRSRGVALSTASNWLWNCIIAVITPYMVDKDKGDLKAKVFFIWGSLCACAFVYTYFLIPETKGLTLEQVDKMMEETTPRTSAKWTPHGTFTAEMGLTANAVAEKATAVHQEV

SEQ ID NO: 12030 - DNA, 1584 bp, Emericella nidulans
  CDS (1)..(1584)
atggcagacgcggtgattgctggtcagcgcgtggaggccccggtcacatggaaggcgtaccttatgtgcgtgttcgcggcctttggtggtatattcttcggctacgactctggctatattaatggagttatgggcatggattatttcatccaagaatttacaggaaaggtcaaaagcgaaactcccgccgcgcagtttgtgatttcatcgtcgaataaatcccttatcacctctatcctgtctgcggggacgttctttggcgctattattgccggtgacctggcagagtggtacggccgtcgcatcacgattatcaatggctgcggagtctttatggctggtgtggcttttcagattgcctctaccaccgtgcccatgcttgtcgtcggccgattgatcgcaggcgttggtgtcggttttgtctctgcgatcatcattctgtacatgtctgagatttctcctcgaaggttccgtggtgctatcgtatcgggctatcagttttgcatcaccattggtttgatgctggcctcctgcgtgaactatgggacggagaaccggaatgattcgggctcataccgtatcccgattgccctccaactcctctgggcgatcattcttgggataggtctgttcgtccttccagagtctccccgttattatgttcggaaaaacaatctggctgaagcagccaaaaccctcgctcgcgtgcgaggccagcccccggagtcagagtatatcacgcaagagctggcagaaatcgtggccaacaatgaatacgagatgcaggttattccccagggcggctattttgctacgtggttgaactgcttccgtggaggtctccggtctcctaacagcaaccttcgtcgtgttatccttgggacctctcttcagatgatgcaacaatggactggagtgaacttcgtcttctattttggtactacgtttttccagaacctcggtaccattgacgaccctttcctcatcagcatgatcaccacgattgtcaatgtcttttctactccgatctccttttacacgatggagaagctcggtcgtcgccctctactgctttggggcgctctgggcatggtcgtctgccaatttattgtggcgatcgctggaaccgtggatggagacaacagtaaaaccgtctcggcgcaaatctcgtttatctgcatttatatctttttctttgcttccacttggggccctggcgcttgggtcgttattggcgagattttcccgctgcccattcgttctcgtggcgttgcgctatcaacagcctccaactggctttggaactgcattattgcagttatcacaccgtacatggttgatatcgacaaggggaacctcaagtcccgagtgttctttatctggggatccctgtgtgcctgcgcatttgtctatgtctacttcctgattcccgagacaaaaggcctcaccctcgaacaagtcgacaagatgatggaggagactactcctcgcacatctgccaaatggaagcctcactctacctttgcgaccgagatgggtatgactgagaaaaatgcgagtacaaccgtggaaagcgctgcctaa

SEQ ID NO: 12031 - protein, 527 aa, Emericella nidulans
MADAVIAGQRVEAPVTWKAYLMCVFAAFGGIFFGYDSGYINGVMGMDYFIQEFTGKVKSETPAAQFVISSSNKSLITSILSAGTFFGAIIAGDLAEWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 12032 - DNA, 1428 bp, Xanthomonas axonopodis pv
  CDS (1)..(1428)
atgtccagtgtttccattgacggcgcccccgatgccggcgagaacacccgtttcatcatcctgattagttgcgtggccacgatcggtggcttcctgttcggcttcgacagcggcgtgatcaatggcaccgtcgacggcctgaaacagaccttccagtccactgccgcagagacgggcttcgaggtcgcctcgatgctgctgggctgcgccatcggcgccttctttgccggccgcctggccgaccgctggggccgccgcgcggtcctgatcatttccgcggcgctgttcctgctctcggccatcggggccggcgcctcgcacagctctgcctttttcatctttgcgcgcgtgatgggcggctttgcggtgggcgcggccagcgtcatttcgccggcctacatcgccgaggtcgcctccgcgcgctaccgcggccggctcgccacgatgcagcagatcgccatcatcagcgggctgttctgcgcattcctgagcaactacctgctggccaacgccgccggtgcctccaccgagccgctctgggccgggcaggccgcctggcgctggatgttctggatgcaggcggttccctccatcctgttcctgttgctgctgctggtcatcccggaaagcccgcgctatctggtggtcaagggtcgccgcgagcaggcgctggtggtgctcaagcgcctgtacggcaacgccgccgcgcagaccaagctgggcgagatttccgcctcgatggcggccgaccagcacaagcccaagttctccgacctgatcaacaaggccaccggcaagatccgccccatcgtctggatcggcattggcctggcggtgttccagcaactggtcggcatcaacgtggtgttctactacggcgcggtgttgtggcaggcagtgggcttctccgagcaggatgcgctgttgatcaacgtgctttccggcggcctcagcatcggtgcctgcctggtcacggtgatgctggtggacaagatcggccgcaagccgctgctgtggatcggctcggccggcatggccgtctcgctggccttggtgacctacgcgtttgccactgcctcgctggatcccaacggcaagcttgcgatgtccgatgccatgggcatgctcgccctggtggccgccaacgtctatgtggtgttcttcaacgcctcgtggggcccggtgatgtgggtgatgctgggcgaaatgttccccaaccagatccgcggctcgggcctggccattgccggtgccgcgcagtggacgtccaacttcgccatcaccgtcagcttcccgatcctgctcggcagtatcggtctggccggtgcctacggcatctacaccgtcgccgccttcatctcggtgttcttcgtactcaagtacgtctacgagaccaagggcaaggagctggagcagatggagggctga

SEQ ID NO: 12033 - protein, 475 aa, Xanthomonas axonopodis pv
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 12034 - DNA, 1972 bp, Trichoderma harzianum
  CDS (123)..(1754)
tggagctccaccgcggtggcggccgctctagaactagtggatcccccgggctgcaggaattcggcacgaggtcaccacgattcatggtcaaggtcctctacacaaagcatcaagagtgagccatggctatcggcaacatctacgtgattgccggcgtgtccgtcgtcggcggcgcgctcttcggcttcgacatctcgtctgtgtcggcccagctggccgagcagtcgtatctctgctacttcaaccaggatgagaaccctccaaccacggccgatggcaaatgtggtggtccgcggtctctcgtccaaggtggtatcaccgcctccatggctgctggctcctggctgggagctctgatctctggtcccctgtctgatagactgggccgaaagtactccatcatggtcggatgtatcatctgggtcattggttccactctctcctgtgcctcccaaaacattggtatgctcattgtcgcccgtatcatcaacggtatctccgtcggtatcgaatctgctcaggtccccgtctacattgccgaaatctctcctccctccaaacgtggtcgcttcattggtatgcagcaatgggccatcacttggggcattctcatcatgtactacatctcctacggctgctccttcattggcgaagacaaccccgtcagctacaacaccgctgcctggcgtatcccatggggtcttcagatgatccccgccttcttcctcttcttcatgatgatgccccttcccgagtctcctcgttggcttgcccgcaaggaccgctgggaggactgccgagctgtccttactctcgtccacggcaagggtgaccctaaccacccctttgtcgcctacgaactgcaggacatcaaggatatgtgcgagtttgagcgccagcatgccgatgttacttacctcgatctgttcaagcctcgcatgatcaaccgtaccttcattggtctcttcactcagatctggtcgcagttgactggcatgaacgtcatgatgtactacattgccaacatcttctccatggctggttacagtggcaacgccaacctgcttgcctcgtccattcagtacatcatcaacgtcctcatgactattcctgccctactctgggtcgacaaatggggtcgccgtcccacgcttcttatcggttccgtactcatggccctgtggatgtacgccaacgccggtattctcgccacctacggtgaagtcgttcccggcggtatcgaccacgttgctgcccagtcgatgcgtgtcaccggtgcccctgccaagggtctcatcgcctgcacatatcggtttgtggcttcctttgcgcccacctggggtcccgtctcctggacctaccctccggagctgttccctctccgtctccgaggcaagggtgtcgccatggccacctctggaaattgggccttcaacactgctctgggtctctttacccccgtggcctttgccaacatcaagtggaagtcgtacctcatcttcgccgtcttcaacactgttgccttcttccacgtcttcttcgtcttccccgagactgccggaaagactttggaagagactgaggccatgtttgaggaccccaacggcattccctacatgggaactcccgcctggaagaccaaggtcgcaaccagcctcactgtccgtgccgaacagggcgacctcgaggccaagattgcccacgataccgagaagcctccgatccacactcacgaggaagagactacccagtaaatgggaaatttaataacatcttgacgatgataatcttgtgcagggcggtaggctttagttgataccctgggggaagtgtggcctcgtcccacaaggaaccttatgatgcaaatgtttaatagtcgtactataccaataccatcacatgttgcattttgaaaaaaaaaaaaaaaaaaaactcgagggggggcccggtacccaattcgccctatagtgaa

SEQ ID NO: 12035 - protein, 543 aa, Trichoderma harzianum
MAIGNIYVIAGVSVVGGALFGFDISSVSAQLAEQSYLCYFNQDENPPTTADGKCGGPRSLVQGGITASMAAGSWLGALISGPLSDRLGRKYSIMVGCIIWVIGSTLSCASQNIGMLIVARIINGISVGIESAQVPVYIAEISPPSKRGRFIGMQQWAITWGILIMYYISYGCSFIGEDNPVSYNTAAWRIPWGLQMIPAFFLFFMMMPLPESPRWLARKDRWEDCRAVLTLVHGKGDPNHPFVAYELQDIKDMCEFERQHADVTYLDLFKPRMINRTFIGLFTQIWSQLTGMNVMMYYIANIFSMAGYSGNANLLASSIQYIINVLMTIPALLWVDKWGRRPTLLIGSVLMALWMYANAGILATYGEVVPGGIDHVAAQSMRVTGAPAKGLIACTYRFVASFAPTWGPVSWTYPPELFPLRLRGKGVAMATSGNWAFNTALGLFTPVAFANIKWKSYLIFAVFNTVAFFHVFFVFPETAGKTLEETEAMFEDPNGIPYMGTPAWKTKVATSLTVRAEQGDLEAKIAHDTEKPPIHTHEEETTQ

SEQ ID NO: 12036 - DNA, 1569 bp, Uromyces fabae; identical to SEQ ID NO: 4712
  CDS (1)..(1569)

SEQ ID NO: 12037 - protein, 522 aa, Uromyces fabae; identical to SEQ ID NO: 4713

SEQ ID NO: 12038 - DNA, 1725 bp, Oryza sativa subsp
  CDS (1)..(1725)
atggtgaaaggagctcacaaaatgggagaaatgtctgacctttggagagaggctcagtgtttggagactgtcatttgcactgttttatccaatttggagatagtgctaatcgaaatcgacaatggtgtgcaacctagtgcctaccattacatagtctcaaagaaagttacacaaggagaagaaggagaagacgacgcagctgccatgggagaagagaagcagaatgacgagaggaagaacaagtacgccgtcgggtgctccatcatcggctccatcatctcggtcctcatgggctatgacactggtgtgatgagtggggcgatgctgttcatcaaggaggacctgaagacgaacgacacgcaggtgcaggtcctcgccgggatcctcaacgtgtgcgcgctcgtcggctccctcaccgccggccgcgtctccgactgcgtcggccgccgcctcaccatctccctcgccgcctgcatcttcctcgtgggctccgtcctcatgggcctcgcgcccaacttcgccacgctcctcgccggccgctgcgtcgccggcgtcggcgtcggctacgcgctcatgattgcgccggtgtacgccgccgagatcgcctccgccgacatccgcggctcgctcacctcgctcccggagatctgcatcagcttcgggatactcatcggctacgtggccaactacctgctcgccaagctgccgctggtgtacgggtggcgcgccatgctcggcctcggcgcgctcccgagcgccgcgctcgcgctcggcgtgctcgccatgcccgagtccccgcggtggctcgtcgtccagggccgcgccgaggaggcgctctccgtgctccgccgcgtgtgcgacaggcccagcgaggccgacgcgcggctcgcggagatcaaggccgcggcggggctcgccgacgacgacggcgccgccgccaacgcgggcagcggcggcaagggcgtgtggagggagctgttcctgcacccgacgccgccggtgcggcgcatcgtcatcgccgccctggggatccacttcttccagcacctcaccggcatcgaggccgtggtgctctacagcccgcgcatcttcaaggcggccggcatcgccagccgcaactcggtgctcgctgcgaccatcggcgtgggcgtcaccaagacggcgttcatcctcaccgccatcctcctcgtcgaccgcataggccggcggccgctctacctgtcaagcctcgccggcatcatcgcctcgctcgcctgcctcggcatgggcctcaccgtcatcgagcggtcgccgccgcaccactcgccggcgtgggccgtcgtgctcgccatcgccaccgtgttcaccttcgtcgcctccttctccatcggcgtcgggccgatcacctgggcctacagctcggaggtgtacccgctccgcctccgcgcgcagggcgccagcgtcggcgtcgccatcaaccgcgtgatgaacgccggcgtgtccatgacgttcgtgtcgctctacaaggccatcaccatcggcggcgccttcttcctcttcgccgggctcgccgtcgccgccgccacgttcttctacctcctgtgcccggagacgcagggcaagccgctggaggagatcgaggaggtgttcagccaggggtggcgcgcgcggcgccgggcgtcggcggcggccgtcgagatgccggcctccggcggcggcggcggcggcggcgccccgatggcgtag

SEQ ID NO: 12039 - protein, 574 aa, Oryza sativa subsp
MVKGAHKMGEMSDLWREAQCLETVICTVLSNLEIVLIEIDNGVQPSAYHYIVSKKVTQGEEGEDDAAAMGEEKQNDERKNKYAVGCSIIGSIISVLMGYDTGVMSGAMLFIKEDLKTNDTQVQVLAGILNVCALVGSLTAGRVSDCVGRRLTISLAACIFLVGSVLMGLAPNFATLLAGRCVAGVGVGYALMIAPVYAAEIASADIRGSLTSLPEICISFGILIGYVANYLLAKLPLVYGWRAMLGLGALPSAALALGVLAMPESPRWLVVQGRAEEALSVLRRVCDRPSEADARLAEIKAAAGLADDDGAAANAGSGGKGVWRELFLHPTPPVRRIVIAALGIHFFQHLTGIEAVVLYSPRIFKAAGIASRNSVLAATIGVGVTKTAFILTAILLVDRIGRRPLYLSSLAGIIASLACLGMGLTVIERSPPHHSPAWAVVLAIATVFTFVASFSIGVGPITWAYSSEVYPLRLRAQGASVGVAINRVMNAGVSMTFVSLYKAITIGGAFFLFAGLAVAAATFFYLLCPETQGKPLEEIEEVFSQGWRARRRASAAAVEMPASGGGGGGGAPMA

SEQ ID NO: 12040 - DNA, 1440 bp, Zymomonas mobilis; identical to SEQ ID NO: 4714
  CDS (1)..(1440): transl_table=11

SEQ ID NO: 12041 - protein, 479 aa, Zymomonas mobilis; identical to SEQ ID NO: 4715

SEQ ID NO: 12042 - DNA, 1413 bp, Lactobacillus casei; identical to SEQ ID NO: 4722
  CDS (1)..(1413): transl_table=11

SEQ ID NO: 12043 - protein, 470 aa, Lactobacillus casei; identical to SEQ ID NO: 4723

SEQ ID NO: 12044 - DNA, 1956 bp, Solanum lycopersicum
  CDS (61)..(1632)
tatcatcttcttattgttattttaactaccacatttgaagccggaaaacttagtaacacgatggccggtggaggatttacgacctccggtaacggaggcacgcatttcgaggctaaaatcacaccaattgttatcatatcttgtattatggctgctaccggaggtctcatgtttggttatgatgttggagtttctggtggtgttacatcaatggatccatttttaaaaaaattctttccaacagtttataagagaacaaaggagccaggattagacagtaattactgtaaatacgataatcaagggttacaattatttacttcatcgttatacctagctggtttaacggcgacgttttttgcttcttacactacaagaaaacttggccggagattaactatgttaatcgccggttgttttttcattattggagttgtactaaatgctgctgctcaagatttagctatgcttattattggaagaattctccttggttgtggcgttggtttcgccaatcaggctgttccattatttttatcagaaatagcacctacaagaattcgtggaggacttaacattttgttccaacttaacgtaactattggtattctttttgccaatctcgtcaactacggaacagccaagattagtggaggatggggatggagattatcattagggttagctggatttccagcagtattgttgactttgggcgcattatttgttgttgaaaccccaaacagtttgattgaaagaggttacttagaagaaggcaaagaagtacttcgaaaaatcagaggtaccgacaacattgaacctgaattcttggaacttgttgaggctagtcgtgttgctaaacaagtcaaacaccctttcagaaatttactccaacgtaaaaatagacctcaattaatcatctctgttgccctccagatattccaacaatttacaggaatcaacgctattatgttctacgcacctgttttattttcaacactagggtttggaaacagcgcagctctttactcagctgtcatcaccggagcagtcaacgttctctccaccgttgtctcagtctactccgttgacaagctcggacgacgagtcctcctcctggaagctggggtccaaatgttactatctcaaataataatcgctataatcctaggtatcaaagttactgatcattcagacaaccttagccatggttggggaatcttcgtagtagttctgatctgtacatatgtatcggctttcgcatggtcatggggcccacttggatggttaattcctagcgagacgttccctttggaaactcgttcagctggtcaaagtgtaacagtgtgtgttaacttgcttttcacgtttgttatggcacaagcatttctctcaatgctttgtcatttcaagtatgggatattcttgttcttctcggggtggatttttgtgatgtcgttgttcgttttcttcttgttgcctgagacgaagaatgttcctattgaggagatgacggagagggtgtggaagcaacattggctgtggaagaggtttatggtggatgaagatgatgttgatatgattaaaaagaatggacatgctaacggatatgatcccacttctcggttgtaaaataaaaaataaaagaatattagcggtgttttacgttgattttatcatagtaaagatgcgtagaaataaatcaaacatgcaagagagagatcagagtctactgtctagtctagtgatatcgataagtgtttctcacaaaataggtgtgcatttggattttttttactgcttgttttcctcctttatatcgttcaatgtagtagaaattgtttagccaaagtgtaagagatgcaatatggtgataatttatgtaaccatatagcctatgtatattagagatttggtataatacattttgggaaagcactttgataaaaaaaaaaa

SEQ ID NO: 12045 - protein, 523 aa, Solanum lycopersicum; identical to SEQ ID NO: 4729

SEQ ID NO: 12046 - DNA, 1395 bp, Bacillus subtilis
  CDS (1)..(1395): transl_table=11
atgaagaatactccaactcaattagaaccaaatgttcctgtaacaagaagccattcaatgggatttgtcattttgatctcatgtgcggcggggcttggcggcttattgtatggctatgacacggcagtgatttctggcgccatcggttttctgaaagatttatacagcctgagtccgtttatggagggacttgtcatttcaagcattatgattggaggagttgtgggcgtcgggatatccggatttttaagtgacagattcggccggagaaaaattttaatgacagccgctttgttatttgcgatatcagcaatcgtttcagcgctttctcaagacgtgtccaccttaatcattgcaaggattatcggggggctgggaatcgggatgggctcatcgctctctgttacgtatattacagaagcggcaccgcccgctatacgcggaagtttatcttcgttatatcagctctttacgatactgggtatttccgcaacatactttattaatctagctgtgcagcggtccggaacatacgaatggggcgtgcacaccggctggagatggatgcttgcttatggaatggtgccatccgtcatttttttccttgtcctgctcgtcgtcccggaaagtccgagatggctggcgaaagcgggcaaaacaaatgaagctttaaagatcctgacacgtattaatggagaaactgttgcaaaagaagaattaaagaacattgagaactctttaaaaatagaacaaatggggtcgctctcccagctgtttaagccgggtctcagaaaggcgcttgtcattggaatcctgctggcgctgtttaaccaagtcatcggcatgaacgcgattacttactacgggccggaaatctttaaaatgatgggattcgggcaaaacgccggatttgtgacgacttgtatcgtcggggttgtagaagttatttttaccgttattgcggtgttgctgattgataaagtcggacgaaaaaaactgatgtccatcggttctgcttttatggctatttttatgattttaatcgggacgtcgttttattttgagttaacaagcgggatcatgatgatcgtccttatattaggttttgtcgctgctttctgtgtctcggtcggaccgatcacatggattatgatttctgaaatcttcccgaaccatctgcgtgcgcgggccgcgggcattgcgaccatctttttatggggagcaaactgggcgatcggacagtttgtgccaatgatgatcgattctttcgggctcgcctatacattttggatctttgcggtgattaacatcctttgtttcctgtttgtcgttacgatctgtccagaaacgaagaacaaatcgctcgaggaaattgaaaagctttggataaaatga

SEQ ID NO: 12047 - protein, 464 aa, Bacillus subtilis
MKNTPTQLEPNVPVTRSHSMGFVILISCAAGLGGLLYGYDTAVISGAIGFLKDLYSLSPFMEGLVISSIMIGGVVGVGISGFLSDRFGRRKILMTAALLFAISAIVSALSQDVSTLIIARIIGGLGIGMGSSLSVTYITEAAPPAIRGSLSSLYQLFTILGISATYFINLAVQRSGTYEWGVHTGWRWMLAYGMVPSVIFFLVLLVVPESPRWLAKAGKTNEALKILTRINGETVAKEELKNIENSLKIEQMGSLSQLFKPGLRKALVIGILLALFNQVIGMNAITYYGPEIFKMMGFGQNAGFVTTCIVGVVEVIFTVIAVLLIDKVGRKKLMSIGSAFMAIFMILIGTSFYFELTSGIMMIVLILGFVAAFCVSVGPITWIMISEIFPNHLRARAAGIATIFLWGANWAIGQFVPMMIDSFGLAYTFWIFAVINILCFLFVVTICPETKNKSLEEIEKLWIK

SEQ ID NO: 12048 - DNA, 3143 bp, Saccharomyces cerevisiae; identical to SEQ ID NO: 4588
  CDS (962)..(2686)

SEQ ID NO: 12049 - protein, 574 aa, Saccharomyces cerevisiae; identical to SEQ ID NO: 4589

SEQ ID NO: 12050 - DNA, 1674 bp, Schizosaccharomyces pombe
  CDS (1)..(1674)
atgagtaagacattgaccattacgatgctgttgtttgtgtccatggccggatggatgttcggtgctgacacgggttccattggtggtatcaccaatatgcgagactttcaatctcgtttcgcagatcggtataatccggtgactgacacgtattcgtattcttcagcgcggcaaggtttaattactggtatggtcaacgttggttctttcttcggctgtttaatttcttctcccactactgatcgaattggtaagcgtaattccattattgggttctgtgttatttacctcatcggcgttatcattcaagtcaccgctgttccatcctgggtccaaatcatggttgctaagatttggaccggtctaggaatcggtgccttgtctgtgcttgctcccggttaccaatctgaagtggctcctccccatattcgtggtaccattgtcgttacctatcaattgtgtgttacagctggtattttcattgccgcttgtatcaacatgggtacccacaaactttataaaactgctcaatggcgtgtatccatcggtattaacttgctctggggtatcatcacccttgtcggtgtctcattcttgtcggaatctcctcgttatcttgtgtccattggtaaggatgatgaggcaatccaggttatgtgtaagaacgctgagcttcctcccgattcggacatcattcaaacggaatacaagcaaatcaagtcggactgtgaagccgccgtcgagggtggtccatgcacatggccagagatttttggtaaggaaatcagatacagaacatttttgggaatggctattatgtcctttaaccaattgaccggttgcaactattatttctactacggtacccaagtgttcaagggaaccggtatggaatctccttacttggcctcattgattcttgatgccgttaactttggatgtacgtttggtggtcttttcgtacttgaatattgcggacgtcgtgttccattgatcatcggtggtgtttggcaatccatttgtttcttcatctatgcagctgttggtaatcgtgctcttactcgtaagaatggtacctcaaaccatcgtgccggtgccgttatgattgtgttctcatgtcttttcattttcagttttgctcaaacttggggtcctgccgcatacgttatcgttggtgaatcgtatcccattcgttatcgttccaagtgtgctgccgttgcgacaactagtaattggctttggaatttcttgatttccttcttcactccatttatcaccaactccattggattcaagtatggttacatctttgcatcgtgcaacctttgtgcctccatcgtaacgttcttgtttgctcacgagtccaagggtcttaccttggaagaaattaacgaactctatctctctgacgccaaaccctggatgtcacgtcccaagaatttgtcggaaatggcagaagccaaagaagtggagcgcgaggagactcgtccaaagggcgaatcagccagatatttggagcacgctgattccaattccgattctgaagacctctcttccagtgcgaacaacgacgttcatgagcctgttgcccgccaagatccatttaatgaaaatgaagtggaaaagtctcgtacccgaccaagccaagaatcatacacaacctcctccaactaa

SEQ ID NO: 12051 - protein, 557 aa, Schizosaccharomyces pombe
MSKTLTITMLLFVSMAGWMFGADTGSIGGITNMRDFQSRFADRYNPVTDTYSYSSARQGLITGMVNVGSFFGCLISSPTTDRIGKRNSIIGFCVIYLIGVIIQVTAVPSWVQIMVAKIWTGLGIGALSVLAPGYQSEVAPPHIRGTIVVTYQLCVTAGIFIAACINMGTHKLYKTAQWRVSIGINLLWGIITLVGVSFLSESPRYLVSIGKDDEAIQVMCKNAELPPDSDIIQTEYKQIKSDCEAAVEGGPCTWPEIFGKEIRYRTFLGMAIMSFNQLTGCNYYFYYGTQVFKGTGMESPYLASLILDAVNFGCTFGGLFVLEYCGRRVPLIIGGVWQSICFFIYAAVGNRALTRKNGTSNHRAGAVMIVFSCLFIFSFAQTWGPAAYVIVGESYPIRYRSKCAAVATTSNWLWNFLISFFTPFITNSIGFKYGYIFASCNLCASIVTFLFAHESKGLTLEEINELYLSDAKPWMSRPKNLSEMAEAKEVEREETRPKGESARYLEHADSNSDSEDLSSSANNDVHEPVARQDPFNENEVEKSRTRPSQESYTTSSN

SEQ ID NO: 12052 - DNA, 1596 bp, Schizosaccharomyces pombe
  CDS (1)..(1596)
atggggttcaagcgtggaaagaattttacccttgttatgttaattttcgtctccatggccggttggatgtttggtgctgataccggttccattggtggtgttactagtatgcgcgattttcgtgagcgttatgctgatagatatgacccgatcaccgaccagtattctttgtcttcggctcgtcaaggtcttttaactggtatggttaacgttggttccttgtttggatgtatcatttcttctcccattgccgatcgttttggtaagagactttctatcattggtttttgtgctgtttatatcattggtatcatcgttcaagttaccgctgttccctcttgggtacaaatcatggttgccaagatttggactggtattggtattggcgctctttctgtcttggctcctggatatcaatcagagactgctcctcccagtattcgtggtaccgtcgtcgtcacttatcagttgtttgtcactggtggaattttcattgccgcttgtatcaatatgggtactcacaaacttcataaaactgcccagtggcgtgtttcaattggtattaatctcctttggggtatcattaccatgattggaattctcttccttcccgaatcccctcgttatcttattcaagttggcaaggatgaagaggctgttagagttctttctgaaagtgctgagctttttcctgatagtgaggaagttcaaaatgaatatcaccgtctcaaatcatctattgacgaagaatttgctggtggcccttgcagctgggcaagcattttcggtaaagacattcgttatcgtactttccttggtatgtttgttatgtcgcttcaacaattgaccggtaacaactatttcttctactatggtttctcagttatgcaaggagctggtattaattctccttacctatctgctatgattcttgatgcagttaattttggctgcacttttggtggtatgtatgtattggaaaggtttggtcgtcgtaaccctcttatcattggtggtatttggcagtcaatttgctttttcatttattcagctgtcggttctcgtgctttatatcataagaacggtacttcaaatacccgtgctggtgccgttatgattgtcatggcatgtcttttcatttttggatttgctcaaacttgggctcctgccgcatacgttattgttggtgagtcataccctgttcgttaccgctctaagtgtgctgccgtcgctactgctagcaactggctctggaatttcctaatttcattctttactccattcattcaagcttctattggattcaagtacggttacgtttttgcttcttgtaatttgaccggtgcaattgttattttcttgtttgctaaagagactaaaggtcttactttggaagaaattaatgagttgtatatgtctgtcatcaagccctgggaatctggtaactttaagcttaactattctgagcaaaagaaagttgagaaagagaaatccagaaagggcggtgcccgtggtgagtctgttgagtatgttgagcgtgcttcaaacactgactcatctccacaatactcttcccatgaggaagattacgcataa

SEQ ID NO: 12053 - protein, 531 aa, Schizosaccharomyces pombe
MGFKRGKNFTLVMLIFVSMAGWMFGADTGSIGGVTSMRDFRERYADRYDPITDQYSLSSARQGLLTGMVNVGSLFGCIISSPIADRFGKRLSIIGFCAVYIIGIIVQVTAVPSWVQIMVAKIWTGIGIGALSVLAPGYQSETAPPSIRGTVVVTYQLFVTGGIFIAACINMGTHKLHKTAQWRVSIGINLLWGIITMIGILFLPESPRYLIQVGKDEEAVRVLSESAELFPDSEEVQNEYHRLKSSIDEEFAGGPCSWASIFGKDIRYRTFLGMFVMSLQQLTGNNYFFYYGFSVMQGAGINSPYLSAMILDAVNFGCTFGGMYVLERFGRRNPLIIGGIWQSICFFIYSAVGSRALYHKNGTSNTRAGAVMIVMACLFIFGFAQTWAPAAYVIVGESYPVRYRSKCAAVATASNWLWNFLISFFTPFIQASIGFKYGYVFASCNLTGAIVIFLFAKETKGLTLEEINELYMSVIKPWESGNFKLNYSEQKKVEKEKSRKGGARGESVEYVERASNTDSSPQYSSHEEDYA

SEQ ID NO: 12054 - DNA, 1668 bp, Schizosaccharomyces pombe
  CDS (1)..(1668)
atgaataggtttattacatcaattctcgtggtgtttatctcaatgtccggatggttgcaaggcgccgatactggttccattagcggcatcttgggcatgcgagattttcaatctcgttttgctgatcgttacaatcccatttcaaattcctacagttactcagcatggagacaagctttgttgactggtacaatcaatgctggctgtttatttggtgctatgctttcttcgccgtttaccgaaagaattggtaagaaatactctatttgctttttcagcggggtatatattattgcagagcttcttttagtcacagcagtcccttcttggattcaagtattggttggtaaaatccttgctggtgttggtatcggagctttgtcagtcttgagtcctggataccaatctgaagtagcaccaccacaaattcgtggtgcagttgttgcaacctatcaaattttctcgacaggtgctgctttagttgcagcctgtatcaatatgggaactcataaactgcgtaagactgcatcatggagaacttcttttggcataaatatgctttggggaatcctgttaatggttggtgtactctttttgcctgaatcaccgcgttatcttatttacaaaggacgagatgaagaagctcttcgaattatgtgcaatatggcggaactaagtcctgaaagtgaaattattcaaactaattttaataccattaagagtgatattgaaatagaaatggctggaggtaaagcaagatggatagaaattttcggtaaggatattcgataccgtacctgcttaggatttcttgtcatgttgttcagagagttgattggtaacaattattatttctattatgctacacaagttttcaagggaactggtatgacggatatattcttaccagccgttattttaggtgctattaattttggtacaacgtttggtgctttatacacaattgataacttaggacgtcgtaacccactaatttttggagctgctttccaatcgatatgcttctttatatatgccgctgtaggcgatcgaaagctcatatataagaatggtactagtgatcacagagcaggatctgtaatgattgtgttttcttgtttgtttcttttctcttactgctgttcttggggcccaatgggctgggtaattgtgggtgaaacttttcccattcgttatcgcagtaaatgcgcttctgtagccacatcgggaaactggctgggtaatttcatgatttctttttttactcctttcattaacaatgcgatcggattcaagcttggttacatttacgcctgcattaatttgtttagttcatttatgattttctttttggctaaagaaactaaaggtcttactttggaggaagtcaatgacttatacatgtccaacattaagccatgggaatcttacaaatatgtaagagaaattgaatctcatcgtatacactttagtaaagaagaagaaaagcgtgaaagagagaaatcgaaaggtattcgcggccaagaagaagaattcattgaaaatgctgatgaagacaataacgatagtagttcttcttcaggatctgtcgtgtctgctgtcaagccacggagatccgctgtttccaacgatcgcttttcagaggattcacaccctacgtatatctaa

SEQ ID NO: 12055 - protein, 555 aa, Schizosaccharomyces pombe
MNRFITSILVVFISMSGWLQGADTGSISGILGMRDFQSRFADRYNPISNSYSYSAWRQALLTGTINAGCLFGAMLSSPFTERIGKKYSICFFSGVYIIAELLLVTAVPSWIQVLVGKILAGVGIGALSVLSPGYQSEVAPPQIRGAVVATYQIFSTGAALVAACINMGTHKLRKTASWRTSFGINMLWGILLMVGVLFLPESPRYLIYKGRDEEALRIMCNMAELSPESEIIQTNFNTIKSDIEIEMAGGKARWIEIFGKDIRYRTCLGFLVMLFRELIGNNYYFYYATQVFKGTGMTDIFLPAVILGAINFGTTFGALYTIDNLGRRNPLIFGAAFQSICFFIYAAVGDRKLIYKNGTSDHRAGSVMIVFSCLFLFSYCCSWGPMGWVIVGETFPIRYRSKCASVATSGNWLGNFMISFFTPFINNAIGFKLGYIYACINLFSSFMIFFLAKETKGLTLEEVNDLYMSNIKPWESYKYVREIESHRIHFSKEEEKREREKSKGIRGQEEEFIENADEDNNDSSSSSGSVVSAVKPRRSAVSNDRFSEDSHPTYI

SEQ ID NO: 12056 - DNA, 1674 bp, Schizosaccharomyces pombe
  CDS (1)..(1674)
atgggaagaacacttacatctgtcctcgtggtcttcatttctatggccggatggctaggaggtgctgataccggttccattagtggtatcttgggaatgcgtgattttcaatctcgttttgctgaccggtataatcctatcacgaactcttatagttactcagcctggcgacaagcactgttgacaggaaccgttaacgctggttgcttatttggtgctatgctttcctctccatttactgaagccattggcaaaaaatactccattgccttctttagcggttgttacattattggtcaaattcttttggtaactgctgttccttcttgggttcagattatggttggtaagttatttacaggtttaactattggtgctttgtcggtgttgagtcctggataccaatctgaagttgctcctccgcaaattcgtggtgcagttgtttcgacctatcaactatttcaaacttgcggtactttaatcgctgcttgtatcaatatgggaactcataaacttcgtaaaacagcgtcctggagaacttcctttggcattaacatactttggggtatctttttgatggtgggtgtactgtttttacctgaatcaccgcgttacctcatctataagggaagagatgaagaggctcttcgaatcatgtgtcaaactgctgaactagatcctgagagtgaaatcattcaaaccaattttaataccattaagagtgatattgaaatggaaatggctggaggtaaggcaagatggcctgaggtttttggaaaagaagttcgctatcgtactgtcttgggattccttactatgttactgagagaattgattggtaataactattacttttattatgctacacaagttttcaagggaactggtatgacggatatattcttaccagccgttattttaggtgctattaattttggtacaacgtttggtgctttatacacaattgataacttaggacgtcgtaacccactaatttttggagctgctttccaatcgatatgcttctttatatatgccgctgtaggcgatcgaaagctcatatataagaatggtactagtgatcacagagcaggagctgtaatgattgtgttttcttgtttgtttcttttctcttactgctgttcttggggcccaatgggctgggttattgtcggcgaaacctttccaatacggtatcgtagcaaatgtgctgctgtagccacatcgggtaattggctgggcaactttatggtttcattcttcactcctttcatctcaaattctattgggttcaaacttggatatatttatgcttgtatcaatatgacttctgcgtttcaaatatttttgatggccaaagaaactaaaggccttaccttggaagaagttaatgaattatacgagtctgacattaagccatgggattcctataagtacgtgagacaaattgaatctcgtcgtatacacttcagtaaagaagaagaaaagcgagaaagagagaagtcaaaaggataccgcggtcaagaagaacgttttatcgaaaatgcagatggtgcggataatgacgatagcagcgcttcttcagaatcctttgcatctgctggcgcacactccagatcggtttttcctaggaggtcaaacgtgtcagaagaatcacacccgacttgggtataa

SEQ ID NO: 12057 - protein, 557 aa, Schizosaccharomyces pombe
MGRTLTSVLVVFISMAGWLGGADTGSISGILGMRDFQSRFADRYNPITNSYSYSAWRQALLTGTVNAGCLFGAMLSSPFTEAIGKKYSIAFFSGCYIIGQILLVTAVPSWVQIMVGKLFTGLTIGALSVLSPGYQSEVAPPQIRGAVVSTYQLFQTCGTLIAACINMGTHKLRKTASWRTSFGINILWGIFLMVGVLFLPESPRYLIYKGRDEEALRIMCQTAELDPESEIIQTNFNTIKSDIEMEMAGGKARWPEVFGKEVRYRTVLGFLTMLLRELIGNNYYFYYATQVFKGTGMTDIFLPAVILGAINFGTTFGALYTIDNLGRRNPLIFGAAFQSICFFIYAAVGDRKLIYKNGTSDHRAGAVMIVFSCLFLFSYCCSWGPMGWVIVGETFPIRYRSKCAAVATSGNWLGNFMVSFFTPFISNSIGFKLGYIYACINMTSAFQIFLMAKETKGLTLEEVNELYESDIKPWDSYKYVRQIESRRIHFSKEEEKREREKSKGYRGQEERFIENADGADNDDSSASSESFASAGAHSRSVFPRRSNVSEESHPTWV

SEQ ID NO: 12058 - DNA, 1641 bp, Schizosaccharomyces pombe
  CDS (1)..(1641)
atgggaaaaaatttgaccattgtcatgttggtcttcgtgtccatggccggatggatgtttggcgccgataccggttccattggtggtatcaccaacatgagagatttccaatctcgtttcgcagatcggtataatccggtaacagattcgtattcgtattcttcggcgcggcaaggtctaattactggtatggttaacgttggttctttctttggttgtttcctttcttcccctcttatggatcgcattggtaagcgtacctctattatgttttggactattgtttatttgattggtattattcttcaagttaccgctgtcccatcttgggtccaaatcatggttgctaagatttggactggtctttccattggcgccttgtctgtgcttgcccccggtttccaatctgaggttgctcccgccgatcttcgtggtaccattgtcaccacctatcaattggctgtcactggtggtattttcattgccgcttgtatcaacatgggtactcacaagttgcacaagactgctcaatggcgtgtatccatgggtattaacttgctttggggtatcatcaccttcatcggtatttctttccttcctgaatcccctcgttatttgatctctgttggtagagatgaagaggctcttcaaattatggccaagaacaacgatcttcctatcgaacacgaagttatccaaacggaataccatgttattaagtctgattgtgaagctgaattggctggtggtcccgctacttggcccgaaatttttggtcccgacattcgttatcgtaccttccttggtcttggtgtcatgtctcttcaacaacttaccggtgataactactacttctactatggtttcgaggtgtttgagggtactggtatgaactctccttatctttctgctttgattcttgatgccgttaactttggatgtacgtttggtggtcttttcgtcctagagttctttggtcgtcgtatgccattgattattggtgctctttggcaatccattactttcttcatttacgcagctgttggtaatcgtgctcttactcgtaagaatggtacctcaaaccatcgtgccggtgccgttatgattgtgttctcatgtcttttcattttcagttttgctcaaacttggggtcctgccgcatacgttatcgttggtgaatcgtatcccattcgttatcgttccaagtgtgctgccgtcgctaccactggtaactggttgtggggtttccttatttcctttttcactcccttcattaccaactccattggattcaagtatggttacattttcgctgcttgtaacttgtgtgctgcttgtattattttcttgtttgctcatgaaaccaaaggtcttaccttggaagagattaacgaactatatatctctggtgctaagccctggatgcctagacctaagaaccttggtaacttcaccaagcaacaagaagaggttcgtgaaaaatcccgtggtgttcaaggcgaaagtgccgctcatcttgaaaacgttgacggtgaggaaggtattgaggactctagcaatgacattagttccacaacatcttcggatggccgtgccaagcccgaatctagctaccacgatcaggaagaacaattcgcatag

SEQ ID NO: 12059 - protein, 546 aa, Schizosaccharomyces pombe
MGKNLTIVMLVFVSMAGWMFGADTGSIGGITNMRDFQSRFADRYNPVTDSYSYSSARQGLITGMVNVGSFFGCFLSSPLMDRIGKRTSIMFWTIVYLIGIILQVTAVPSWVQIMVAKIWTGLSIGALSVLAPGFQSEVAPADLRGTIVTTYQLAVTGGIFIAACINMGTHKLHKTAQWRVSMGINLLWGIITFIGISFLPESPRYLISVGRDEEALQIMAKNNDLPIEHEVIQTEYHVIKSDCEAELAGGPATWPEIFGPDIRYRTFLGLGVMSLQQLTGDNYYFYYGFEVFEGTGMNSPYLSALILDAVNFGCTFGGLFVLEFFGRRMPLIIGALWQSITFFIYAAVGNRALTRKNGTSNHRAGAVMIVFSCLFIFSFAQTWGPAAYVIVGESYPIRYRSKCAAVATTGNWLWGFLISFFTPFITNSIGFKYGYIFAACNLCAACIIFLFAHETKGLTLEEINELYISGAKPWMPRPKNLGNFTKQQEEVREKSRGVQGESAAHLENVDGEEGIEDSSNDISSTTSSDGRAKPESSYHDQEEQFA

SEQ ID NO: 12060 - DNA, 1608 bp, Schizosaccharomyces pombe
  CDS (1)..(1608)
atggcgaaaatcttaaccattgtcatgttggtcttcgtgtccatggccggatggatgttcggtgctgacacgggttccattggtggtatcactaatatgcgggactttcaatctcgatacgcagacaggtatgatcctgtcacagatacgtattcgtattcttctgctcgccaaggtcttttggttggtatggttaacactggaactactgttggatgtttactttcttcacctcttggagatcgattcggtaaacgtaagtgtatcatgggatggacattggtttacattaccggtgttatcgttcaactcaccacaattccatcttgggttcaaatgatggtagctaaaatttggactggtcttggcattggtgctttgtcagtcattgctcctggttaccaatccgaatcttctcccccccatattcgtggtgccattgtaactacttatcaattgttcattactcttggtatttttattgccgcctgtatcaacatgggtactcacaaatacaccactcatcctgaagctcaatggcgtgttcccatcggtattaacttactttggggtattctcatgttctttggaatgcttttcctccctgaatccccacgttaccttgcagttaaaggaagaaatgaagaatgtatgaaaattcttactcgtaatgctggcctcccagccgatcatcccatcatgcaaaaagaatacaatgccattcaagctgacgttgaggcagaattggctggtggtccttgctcctggcctcagatctttagcaacgaaattcgttacagaacacttttgggaatgggtgtcatggcattccaacaattgaccggtaacaattacttcttctactatggtactcaggtattccgcggtactggcttgaactcccccttcctcgcagctttgattcttgatgctgtcaactttggatgtacgtttggtgctatctttgttcttgaatactttggtcgtcgtggtcccctcatcgttggtggtgtttggcaatctatttgtttctttatttatgcttctgtaggtgatcgtgcacttacccgccccaatggtacttcgaatcatcgtgctggtgccgttatgattgtgttctcatgtcttttcattttcagttttgctcaaacttgggctcctgccgcatacgttatcgttggtgaatcgtatcccattcgttatcgttccaagtgtgctgccgtcgctactgctagcaactggttctggaactttatgatttccttcttcactccctttattagcaactcaattggtttcaagtatggttatgtgtttgcagcttgcaacttgtgtgccgctattattattttcctattcgccaaggaaaccaaaggtcttaccttggaagagattaaccaactttatttgtcgaatattaagccctggaacactggtgcttaccagcgtgatcgggaagatattaagcaaagcgactcagaaaaggagcgtggacctacttctaagttacatgaatacgttgagcatgctcccaactcgtatgcttcaacacactctacagagagtgagaattatcctcaacaagtcaccaatccggttggcttatga

SEQ ID NO: 12061 - protein, 535 aa, Schizosaccharomyces pombe
MAKILTIVMLVFVSMAGWMFGADTGSIGGITNMRDFQSRYADRYDPVTDTYSYSSARQGLLVGMVNTGTTVGCLLSSPLGDRFGKRKCIMGWTLVYITGVIVQLTTIPSWVQMMVAKIWTGLGIGALSVIAPGYQSESSPPHIRGAIVTTYQLFITLGIFIAACINMGTHKYTTHPEAQWRVPIGINLLWGILMFFGMLFLPESPRYLAVKGRNEECMKILTRNAGLPADHPIMQKEYNAIQADVEAELAGGPCSWPQIFSNEIRYRTLLGMGVMAFQQLTGNNYFFYYGTQVFRGTGLNSPFLAALILDAVNFGCTFGAIFVLEYFGRRGPLIVGGVWQSICFFIYASVGDRALTRPNGTSNHRAGAVMIVFSCLFIFSFAQTWAPAAYVIVGESYPIRYRSKCAAVATASNWFWNFMISFFTPFISNSIGFKYGYVFAACNLCAAIIIFLFAKETKGLTLEEINQLYLSNIKPWNTGAYQRDREDIKQSDSEKERGPTSKLHEYVEHAPNSYASTHSTESENYPQQVTNPVGL

SEQ ID NO: 12062 - DNA, 1422 bp, Zymomonas mobilis
  CDS (1)..(1422): transl_table=11
atgagttctgaaagtagtcagggtctagtcacgcgactagccctaatcgctgctataggcggcttgcttttcggttacgattcagcggttatcgctgcaatcggtacaccggttgatatccattttattgcccctcgtcacctgtctgctacggctgcggcttccctttctgggatggtcgttgttgctgttttggtcggttgtgttaccggttctttgctgtctggctggattggtattcgcttcggtcgtcgcggcggattgttgatgagttccatttgtttcgtcgccgccggttttggtgctgcgttaaccgaaaaattatttggaaccggtggttcggctttacaaattttttgctttttccggtttcttgccggtttaggtatcggtgtcgtttcaaccttgaccccaacctatattgctgaaattgctccgccagacaaacgtggtcagatggtttctggtcagcagatggccattgtgacgggtgctttaaccggttatatctttacctggttactggctcatttcggttctatcgattgggttaatgccagtggttggtgctggtctccggcttcagaaggcctgatcggtattgccttcttattgctgctgttaaccgcaccggatacgccgcattggttggtgatgaagggacgtcattccgaggctagtaaaatccttgctcgtctggaaccgcaagccgatcctaatctgacgattcaaaagattaaagctggctttgataaagccatggacaaaagcagcgcaggtttgtttgcttttggtatcaccgttgtttttgccggtgtatccgttgctgccttccagcagttagtcggtattaacgccgtgctgtattatgcaccgcagatgttccagaatttaggttttggagctgatacggcattattgcagaccatctctatcggtgttgtgaacttcatcttcaccatgattgcttcccgtgttgttgaccgcttcggccgtaaacctctgcttatttggggtgctctcggtatggctgcaatgatggctgttttaggctgctgtttctggttcaaagtcggtggtgttttgcctttggcttctgtgcttctttatattgcagtctttggtatgtcatggggccctgtctgctgggttgttctgtcagaaatgttcccgagttccatcaagggcgcagctatgcctatcgctgttaccggacaatggttagctaatatcttggttaacttcctgtttaaggttgccgatggttctccagcattgaatcagactttcaaccacggtttctcctatctcgttttcgcagcattaagtatcttaggtggcttgattgttgctcgcttcgtgccggaaaccaaaggtcggagcctggatgaaatcgaggagatgtggcgctcccagaagtag

SEQ ID NO: 12063 - protein, 473 aa, Zymomonas mobilis
MSSESSQGLVTRLALIAAIGGLLFGYDSAVIAAIGTPVDIHFIAPRHLSATAAASLSGMVVVAVLVGCVTGSLLSGWIGIRFGRRGGLLMSSICFVAAGFGAALTEKLFGTGGSALQIFCFFRFLAGLGIGVVSTLTPTYIAEIAPPDKRGQMVSGQQMAIVTGALTGYIFTWLLAHFGSIDWVNASGWCWSPASEGLIGIAFLLLLLTAPDTPHWLVMKGRHSEASKILARLEPQADPNLTIQKIKAGFDKAMDKSSAGLFAFGITVVFAGVSVAAFQQLVGINAVLYYAPQMFQNLGFGADTALLQTISIGVVNFIFTMIASRVVDRFGRKPLLIWGALGMAAMMAVLGCCFWFKVGGVLPLASVLLYIAVFGMSWGPVCWVVLSEMFPSSIKGAAMPIAVTGQWLANILVNFLFKVADGSPALNQTFNHGFSYLVFAALSILGGLIVARFVPETKGRSLDEIEEMWRSQK

SEQ ID NO: 12064 - DNA, 1638 bp, Candida albicans
  CDS (1)..(1638): transl_table=12
atgtcgtccaagatcgaaagaatcttttctggacctgctttaaaaatcaatacttatttggacaagcttccaaaaatttacaatgttttcttcatcgctagtatatccaccattgctggtatgatgtttggttttgatatttcttcaatgtctgcctttattggtgctgaacattatatgaggtatttcaattccccaggatcggatatccaagggttcattacttcatccatggctttgggttctttctttggttctattgcctcctcatttgtttctgaaccctttggtagaagattatcattattgacttgtgctttcttctggatggtcggtgctgctattcaatcatcagttcaaaatcgtgctcaattgattattggtagaatcatttctggtattggtgttggtttcggttctgctgttgctccagtttatggtgctgaattggctccaagaaaaattagaggtcttatcggtggtatgttccaattctttgtcaccttgggtatcatgatcatgttttacttatccttcggattgggccacattaatggtgttgcttcattcagaattgcttggggacttcaaattgtccctggtctttgtttgttcttgggttgtttctttattccagaatctcctcgttggttggctaaacaaggtcaatgggaagctgctgaagaaattgttgccaagatccaagctcatggtgatcgtgaaaatcctgatgttttgattgaaatttctgaaatcaaagatcaattattattggaggagtccagtaaacaaattggatatgctactttattcaccaaaaaatacattcaaagaaccttcactgctattttcgctcaaatttggcaacaattgactggtatgaacgttatgatgtactatatcgtttatattttccaaatggctggttattctggtaacagtaacttggttgcttcatccattcaatatgttatcaacacttgtgtcaccgtgcctgcattatattttattgataaagtaggtagaagaccattattgattggtggtgccactatgatgatggctttccaattcggtcttgctggtattttgggtcaatactcaattccttggccagatagtggtaacgactcagtcaacattagaattccagaagacaataagtctgcctccaaaggtgccattgcttgttgctacttgttcgttgcttcctttgcctttacttggggggtcggtatttgggtctactgtgctgaaatatggggtgataacagagttgctcaacgtggtaatgccatctccacttctgccaattggattttgaatttcgctattgccatgtataccccaactggtttcaagaatattagctggaaaacatatatcatttatggtgtcttctgtttcgctatggctacccatgtctactttggattcccagaaaccaagggtaaaagattggaagaaattggtcaaatgtgggaagaacgtgttcctgcttggagatcaagatcttggcaaccaaccgttcctattgcttccgatgccgaattggcaagaaagatggaagttgaacacgaagaagataaattgatgaatgaagactctaactccgaatccagagaaaatcaagcctaa

SEQ ID NO: 12065 - protein, 545 aa, Candida albicans
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 12066 - DNA, 1641 bp, Saccharomyces cerevisiae
  CDS (1)..(1641)
atggttagttcaagtgtttccattttggggactagcgccaaggcatccacttctctaagtagaaaggatgaaattaaactaacccctgaaacaagggaagctagcttggacattccatacaaacccattattgcatactggacggtgatgggtctctgtctgatgattgcctttggtggattcatttttggttgggatacaggaaccatttcagggtttattaaccaaacagatttcaagagaaggtttggtgagttacaaagggacggcagttttcaactatcagatgtcaggacagggctaattgtcggtatcttcaacataggttgtgctttaggtggcctaacgctgggacgcctgggcgatatttatgggcgtaaaatcggcttaatgtgtgttatactggtgtatgttgttggtatcgtgatccagattgcttcctctgacaaatggtatcaatattttattggtagaattgtttctggaatgggtgttggaggtgttgctgtgctgtcgccaactttgatctcagaaatttccccaaagcacctaagaggcacttgtgtctctttttaccagctaatgattacccttggaattttcttgggctactgtaccaattatggtacaaagaaatattcaaattcaatacagtggcgggttcccttgggtttgtgttttgcgtgggcaatctttatggtgattggaatggttatggttccggaatcgcccagatatttagtagaaaaaggtaagtatgaagaagctagaaggtctttggccaaatcaaacaaggtcacagttactgatccaggcgttgtttttgagtttgatactatagttgcaaatatggaattagaaagggctgttggaaatgccagttggcacgaactcttctcaaataaaggagcaattctaccaagggtaataatgggaatcgttatccagtcactgcaacagcttactggctgtaattattttttctactacggcacgaccattttcaatgctgttggaatgcaagactctttcgagacttccattgtccttggggctgttaattttgcttctacatttgttgcactatacattgtggataaatttgggcgtcgaaaatgtttattgtgggggtctgcctcgatggcaatttgtttcgtcatattcgccaccgttggcgtcactagattatggccacaagggaaagaccaaccttcttcgcaaagtgctggtaatgttatgatcgtttttacttgtttcttcattttctcttttgccattacttgggctcctatcgcctatgtcattgtggcagaaacttatccattaagagttaaaaatcgtgccatggccattgcggttggtgcgaactggatgtggggtttcttgattggatttttcacaccctttatcactagatccataggattttcttatggctatgttttcatgggttgcttaatcttttcgtacttctacgttttcttctttgtttgcgaaacaaagggattaactctggaggaagttaatgaaatgtacgaagaaagaataaagccatggaagtccggaggttggattcccagttctagaagaacaccacaaccaacaagcagtacaccattagttattgttgatagtaaataa

SEQ ID NO: 12067 - protein, 546 aa, Saccharomyces cerevisiae
MVSSSVSILGTSAKASTSLSRKDEIKLTPETREASLDIPYKPIIAYWTVMGLCLMIAFGGFIFGWDTGTISGFINQTDFKRRFGELQRDGSFQLSDVRTGLIVGIFNIGCALGGLTLGRLGDIYGRKIGLMCVILVYVVGIVIQIASSDKWYQYFIGRIVSGMGVGGVAVLSPTLISEISPKHLRGTCVSFYQLMITLGIFLGYCTNYGTKKYSNSIQWRVPLGLCFAWAIFMVIGMVMVPESPRYLVEKGKYEEARRSLAKSNKVTVTDPGVVFEFDTIVANMELERAVGNASWHELFSNKGAILPRVIMGIVIQSLQQLTGCNYFFYYGTTIFNAVGMQDSFETSIVLGAVNFASTFVALYIVDKFGRRKCLLWGSASMAICFVIFATVGVTRLWPQGKDQPSSQSAGNVMIVFTCFFIFSFAITWAPIAYVIVAETYPLRVKNRAMAIAVGANWMWGFLIGFFTPFITRSIGFSYGYVFMGCLIFSYFYVFFFVCETKGLTLEEVNEMYEERIKPWKSGGWIPSSRRTPQPTSSTPLVIVDSK

SEQ ID NO: 12068 - DNA, 2617 bp, Saccharomyces cerevisiae
  CDS (840)..(2543)
gcctatggacgtcttacgaatgatcgaaaataagaaaagaacaaagtaaatttaggatctggaaggagtgctgtatgtaaacgaagctttcagttttaggtaatgtttgcacaacctacatgatataacatggtatgttctgcaagagcgtgcctgcccttggcccgttatagcagatcataccatctgcaagcagaccccattattgcacgcctccgcaatcttgcgtatacgtagtcccacgacaaagtacgaagggtaaactgaccttgttcagttccccacaaaaattacataaccatttctccgcggaattacataatcatttctccgcgaaaattacataatcatttctccgtgcgagttataagtgcttttctcgtgcatcccttggcacttcacaaaaccttctttttcttttttttctttatttcaggggaaatcagtgcaaaactaaaaaagaaagaaattttgtgaaatgtaaactccaggtgtcaaaaaataaattatatccgtggaaaatcaggcgtcggaaattgtacatgaaaccgcctcctccacaataaatgctgaccacacgaacaatgcatacactcggacaccttcgttcaaagtatcagtagcagttcgacacaccgtatactacttagctcttaaggtctaggctcatctttctcagttcctctttttcgctaattaaaggtatataatgtcacagttgtgtaactagagaagagcacacttgttcctatctttttcttcttctttttttggtatgagttgaaaaaaataatcattgcacaatttagttctaaacgcttttgttattactcaatatcatgtcaggtgttaataatacatccgcaaatgagttatctactaccatgtctaactctaactcagcagtaggcgctccctctgttaagactgaacacggtgactctaaaaattcccttaacctagatgccaatgagccacctattgacttacctcaaaaacccctctctgcgtataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacatatcagaggaactctggtccaattgtaccagctgatgggtacgatgggtatttttctaggatactgtaccaattacggtaccaagaactatcacaacgccactcaatggagagtcggccttggtctttgctttgcctgggctacattcatggttagtggaatgatgtttgtaccagaatcaccacgttacctgattgaggttggtaaagatgaggaagcgaaacgttcactatcgaaatccaacaaagtctcagttgacgatccagccttgctagttgaatatgacactataaaggcaggaattgaacttgaaaagctggcaggtaacgcatcatggtctgaactactctccactaaaacaaaggtctttcagcgtgttctcatgggagtgatgatccaatcgctgcagcaattaaccggtgacaactacttcttttactacggtaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttacgtattcttaggctgtctggtttttgcatacttttatgtctttttctttgtcccagaaacaaaaggcctgacactggaggaggtgaatactatgtggctggaaggtgtgccagcatggaaatcggcctcatgggtgccaccggagagaagaaccgcagattacgatgctgatgcaatagatcatgacaatagaccaatttacaagaggttcttttccagctgatcttctagttttcggtaaattggtaaaaaagcaaaaaaaaaaattacgaaactaattctctattatacataatg

SEQ ID NO: 12069 - protein, 567 aa, Saccharomyces cerevisiae
MSGVNNTSANELSTTMSNSNSAVGAPSVKTEHGDSKNSLNLDANEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKRSLSKSNKVSVDDPALLVEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 12070 - DNA, 1695 bp, Saccharomyces cerevisiae; identical to SEQ ID NO: 4578
  CDS (1)..(1695)

SEQ ID NO: 12071 - protein, 564 aa, Saccharomyces cerevisiae; identical to SEQ ID NO: 4579

SEQ ID NO: 12072 - DNA, 2064 bp, Saccharomyces cerevisiae
  CDS (290)..(1912)
aacgtgtctatgttgagcttcttaatatctacccagcaacctgtatatcagtgctttctttaattatacttcccttgacaaatcgatacgtcggccctcaaaagaagaggaaaaaaaatagaaaaaaaaatagaaaataaaaatgtcagtaattctaatgatgacacaaattcaaatagcaacattgaatactgtttaacagaacaattaaccacttttaattagaaatactaacaaagaatttgttaacgtattcttaggaagtaaagtacttcaattattgctagaaatgactgctcagattccgtatcaacatagctcgggatacatctctcattttcacaataatgagcttgatgcaggcaggggaagggattataatgtaaccattaagtatctagatgataaagaagaaaatatagaaggccaagcagcaaagattagtcacaatgcgagtctgcatattcccgttttattgtgcttggtaatctcgcttggtggctttatttttggatgggacattggaaccatcggtggaatgacaaatatggttagctttcaagaaaaatttggcacaactaatattatccatgacgatgaaacaatttttgtatctactaagaaacttactgatctgcaaataggcctaattatcagtatttttaacatcagttgtggcgtaggggctttaactctgtcaaaaatcggtgattggattggtaggaaaggtggtatatggtttgccttagtagtgtactgcatcggtataaccattcaaattctctcctatggaaggtggtattttttgacattgggaagagccgtaacgggaatcggtgtgggagtaaccactgtcttggtgccaatgtttctctccgagaattctccactaaaaatcagaggctccatggtatctacgtatcaattgattgtaacatttggcatactaatgggaaacattttaaatttcatatgcgaaagatgttataaagatcctacacaaaatatagcctggcaattgccattgttcttgggatacatttgggcaattataattggaatgtcacttgtttacgttcctgaatctccacagtacttggcaaaaatcaaaaatgatgtgccctctgctaaatactcttttgcgaggatgaatggcatccctgcgacggatagcatggtaattgaattcatcgatgatttgctggaaaataactataataatgaggaaactaacaacgaatcaaaaaagcaaagcttagttaaaagaaacacatttgaatttattatgggaaagccaaagttatggttgagactgattattggtatgatgataatggcatttcaacagctgtccggaataaattatttcttttattacggaacgtctgttttcaaaggtgtcgggattaaggatccttatattacttcaatcatactgtcaagtgttaacttcctttctacgatattaggcatatattacgtggagaaatggggccacaagacatgtttattatatggttcaacaaatttattattttatatgatgacatatgctactgtggggacatttggaagagaaacggacttctcaaatattgttttaattatcgtgacttgttgttttattttttggtttgcaataacattgggcccagttacatttgtactagtgtccgaattgttccctctaagaacgagggccatatcaatggctatttgcacatttatcaattggatgttcaatttcttaatatcacttttaacaccaatgattgtatccaaaattgatttcaaactaggatacatatttgctgcttgcctattagcgttgataatattcagttggatactagttcctgaaacgaggaaaaagaatgagcaagagatcaataaaatatttgaaccggagtagatattacataatataaatagaagaagtagcaaagtgcagtttttttttccataataaataaccatcagtaactaagtggccgtgaggactgaccacattttctttacatacagtaaagtaaataaatctatcaaatattttgattattactt

SEQ ID NO: 12073 - protein, 540 aa, Saccharomyces cerevisiae
MTAQIPYQHSSGYISHFHNNELDAGRGRDYNVTIKYLDDKEENIEGQAAKISHNASLHIPVLLCLVISLGGFIFGWDIGTIGGMTNMVSFQEKFGTTNIIHDDETIFVSTKKLTDLQIGLIISIFNISCGVGALTLSKIGDWIGRKGGIWFALVVYCIGITIQILSYGRWYFLTLGRAVTGIGVGVTTVLVPMFLSENSPLKIRGSMVSTYQLIVTFGILMGNILNFICERCYKDPTQNIAWQLPLFLGYIWAIIIGMSLVYVPESPQYLAKIKNDVPSAKYSFARMNGIPATDSMVIEFIDDLLENNYNNEETNNESKKQSLVKRNTFEFIMGKPKLWLRLIIGMMIMAFQQLSGINYFFYYGTSVFKGVGIKDPYITSIILSSVNFLSTILGIYYVEKWGHKTCLLYGSTNLLFYMMTYATVGTFGRETDFSNIVLIIVTCCFIFWFAITLGPVTFVLVSELFPLRTRAISMAICTFINWMFNFLISLLTPMIVSKIDFKLGYIFAACLLALIIFSWILVPETRKKNEQEINKIFEPE

SEQ ID NO: 12074 - DNA, 1704 bp, Saccharomyces cerevisiae
  CDS (1)..(1704)
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcaacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaatccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 12075 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 12076 - DNA, 1704 bp, Saccharomyces cerevisiae; identical to SEQ ID NO: 4584
  CDS (1)..(1704)

SEQ ID NO: 12077 - protein, 567 aa, Saccharomyces cerevisiae; identical to SEQ ID NO: 4585

SEQ ID NO: 12078 - DNA, 3323 bp, Saccharomyces cerevisiae; identical to SEQ ID NO: 4586
  CDS (1189)..(2883)

SEQ ID NO: 12079 - protein, 564 aa, Saccharomyces cerevisiae; identical to SEQ ID NO: 4587

SEQ ID NO: 12080 - DNA, 2160 bp, Saccharomyces cerevisiae; identical to SEQ ID NO: 4570
  CDS (216)..(1928)

SEQ ID NO: 12081 - protein, 570 aa, Saccharomyces cerevisiae; identical to SEQ ID NO: 4571

SEQ ID NO: 12082 - DNA, 1704 bp, Saccharomyces cerevisiae
  CDS (1)..(1704)
atgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataa

SEQ ID NO: 12083 - protein, 567 aa, Saccharomyces cerevisiae; identical to SEQ ID NO: 4569

SEQ ID NO: 12084 - DNA, 1731 bp, Saccharomyces cerevisiae
  CDS (1)..(1731)
atgtctgaagaagctgcctatcaagaggatacagcagtccaaaatactccagctgatgctttgtcgccagttgaatccgattctaattccgctttgtctactccatccaacaaagctgaaagagatgacatgaaagatttcgacgagaatcacgaagaatctaataactacgttgaaattccaaagaagcccgcctccgcctacgttacagtttccatctgttgtttaatggttgctttcggtggttttgttttcggttgggatactggtaccatttctggttttgttgctcaaactgattttatcagaagatttggtatgaagcaccacgatggtacttattatttgtctaaggttagaactggtttaattgtctccattttcaacattggttgtgccattggtggtattattttagcaaaattaggtgatatgtatggtcgtaaaatgggtttgattgtcgttgttgtcatctacattatcggtatcattatccaaattgcctcaatcaacaagtggtaccaatatttcattggtagaattatctctggtttaggtgtcggtggtattgccgttttatctcctatgttgatttctgaagtctctccaaagcatattagaggtactttggtttcatgttaccaacttatgattactttgggtattttcttgggttactgtacaaactacggtaccaagacctacaccaattctgtccaatggagagttccattaggtctaggtttcgcttgggctttgtttatgattggtggtatgacattcgttccagaatctccacgttatttagttgaagtcggtaaaattgaagaagctaagcgttctattgctctttcaaataaggtcagcgcagacgatccagctgttatggctgaagtcgaagttgttcaagctacagttgaagctgaaaaattagctggtaatgcctcctggggtgaaatatttagcactaagactaaggttttccaacgtttgatcatgggtgctatgattcaatcattgcaacaattgacaggtgataactatttcttctattacggtactaccgttttcactgctgtcggtttggaagattcttttgaaacttctattgtcttgggtattgtcaactttgcttccacctttgttggtattttcttagtcgaaagatatggtcgtcgtagatgtttattatggggtgctgcttccatgacagcttgtatggttgttttcgcttctgttggtgttacaagattgtggccaaatggtaagaagaacgggtcttctaagggtgctggtaactgtatgattgtcttcacatgtttctacttattctgttttgccactacctgggctccaattccatttgttgttaactctgaaactttcccattgagagttaagtccaagtgtatggctattgctcaagcttgtaactggatctggggtttcttgattggtttctttactccatttatttcaggtgctattgatttctactacggttatgttttcatgggctgtttggtcttttcttacttctacgtcttcttcttcgttccagaaactaaaggtttgactttagaagaagttaacaccttatgggaagaaggtgttttgccatggaaatcaccttcttgggttccaccaaacaagagaggtactgactacaacgctgatgatctaatgcatgatgatcaaccattttacaagaagatgttcggaaaaaagtag

SEQ ID NO: 12085 - protein, 576 aa, Saccharomyces cerevisiae
MSEEAAYQEDTAVQNTPADALSPVESDSNSALSTPSNKAERDDMKDFDENHEESNNYVEIPKKPASAYVTVSICCLMVAFGGFVFGWDTGTISGFVAQTDFIRRFGMKHHDGTYYLSKVRTGLIVSIFNIGCAIGGIILAKLGDMYGRKMGLIVVVVIYIIGIIIQIASINKWYQYFIGRIISGLGVGGIAVLSPMLISEVSPKHIRGTLVSCYQLMITLGIFLGYCTNYGTKTYTNSVQWRVPLGLGFAWALFMIGGMTFVPESPRYLVEVGKIEEAKRSIALSNKVSADDPAVMAEVEVVQATVEAEKLAGNASWGEIFSTKTKVFQRLIMGAMIQSLQQLTGDNYFFYYGTTVFTAVGLEDSFETSIVLGIVNFASTFVGIFLVERYGRRRCLLWGAASMTACMVVFASVGVTRLWPNGKKNGSSKGAGNCMIVFTCFYLFCFATTWAPIPFVVNSETFPLRVKSKCMAIAQACNWIWGFLIGFFTPFISGAIDFYYGYVFMGCLVFSYFYVFFFVPETKGLTLEEVNTLWEEGVLPWKSPSWVPPNKRGTDYNADDLMHDDQPFYKKMFGKK

SEQ ID NO: 12086 - DNA, 3025 bp, Saccharomyces cerevisiae; identical to SEQ ID NO: 4574
  CDS (510)..(2288)

SEQ ID NO: 12087 - protein, 592 aa, Saccharomyces cerevisiae; identical to SEQ ID NO: 4575

SEQ ID NO: 12088 - DNA, 2213 bp, Saccharomyces cerevisiae
  CDS (501)..(2213)
aaaaaaatgttttttaggcaacggagattcgttttatccacgtttaccccacaaaaagtgcaggtacattgtggggccccggcatcgaaaaccagtttttttcctttaaacgctggaaaaaaaggagaaattattggaactttgcagagaatagtccgtaggcaaattgaaaatgttccttaaaaaatttcgtttcttactcattgagattattcagatgccctccgtgccttcattgaaaaaaatccaagagatgtctcggatctgtatgcagattttggcttgcagacaatggagagcaaatgggtatacaatatagaaagcacagaaacatataaaaagagctcgagaaaagacatatggtttgtaactatcttcttcttttttccaatttttctgttttaataataaaaaaacaagaacaaacaagctcaacttgtcttttctaagaacaaagaataaacacaaaaacaaaaagtttttttaattttaatcaaaaaatgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatctagaagaggtgccaactacgacgctgaagaaatggctcacgatgataagccattgtacaagagaatgttcagcaccaaataa

SEQ ID NO: 12089 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMAHDDKPLYKRMFSTK

SEQ ID NO: 12090 - DNA, 2209 bp, Saccharomyces cerevisiae; identical to SEQ ID NO: 4572
  CDS (213)..(1925)

SEQ ID NO: 12091 - protein, 570 aa, Saccharomyces cerevisiae; identical to SEQ ID NO: 4573

SEQ ID NO: 12092 - DNA, 1710 bp, Saccharomyces cerevisiae
  CDS (1)..(1710)
atgactgatcgtaaaaccaacttgccagaagaaccgattttcgaagaggcagaagatgatggctgcccttcgatagaaaattcttcacatctgtcagtacctacagtggaggaaaacaaggacttttccgagtataatggggaagaggcagaggaagttgttgttccagaaaagcctgcttcagcctatgctactgtttctatcatgtgtttatgtatggctttcggtggatttatgtccggttgggacacaggtacgatttctggtttcgtcaatcagactgattttttaagaagatttggtaattatagccattccaagaacacttactacttatctaatgtgagaactgggttgattgtgtccatcttcaatgtgggaagcgccattggctgtcttttcttgtctaaattgggtgatatttacggccgctgcatgggtttgattatagttattgtcgtttatatggttggtattgtcattcaaattgcctctatagataagtggtatcagtattttattggaagaattatcgctggtataggtgctggttccattagtgttcttgccccgatgcttatttcggaaactgcgccaaagcatatcagaggtacgttgctagcttgttggcaattgatggtgactttcgcaattttcttgggttattgtaccaattatggtaccaagacttactcgaattctgtccagtggcgtgttccgcttggtctatgttttgcatgggctattattatgattggtggtatgacgtttgttccggaatctcctcggtttttggtgcaagtcggtaagattgagcaagctaaagcttcttttgccaagtcgaacaagcttagtgttgacgatcctgctgtggttgcagagattgatcttcttgttgctggtgtggaggcagaagaagcaatgggaactgcttcatggaaggaattattttcgagaaagactaaagtttttcaacgtttaacgatgacagtcatgattaactctctgcagcaactaaccggtgacaactatttcttctactacggtactactatcttcaaatctgtcggtatgaatgactcttttgagacttcaattgtcttgggtattgtgaattttgcttcttgcttcttttcactttattctgttgataagttgggccgtcgtagatgtcttttacttggagcagccaccatgacggcgtgcatggttatttacgcctccgttggcgtcacaagactatatccgaacggtaaaagtgaaccatcatctaaaggtgctggtaattgtacgattgttttcacgtgtttttacattttctgcttttcctgcacctggggacctgtatgttatgtgattatttctgaaacatttccattaagggtgagatccaagtgtatgtccgttgcaacagcggccaacttattgtgggggttcctaatcgggtttttcactccttttattacttcggcaattaatttctactacggttacgttttcatgggttgcttagcgttttcatatttttacgtctttttctttgttccagaaacaaaaggtctaactttagaagaagttgatgagatgtggatggacggtgtattaccttggaaatctgaatcctgggtaccagcttctagaagggatggtgattatgataacgaaaaattacagcatgacgagaaacccttctacaaaagaatgttttag

SEQ ID NO: 12093 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 12094 - DNA, 3277 bp, Saccharomyces cerevisiae; identical to SEQ ID NO: 4580
  CDS (802)..(2505)

SEQ ID NO: 12095 - protein, 567 aa, Saccharomyces cerevisiae; identical to SEQ ID NO: 4581

SEQ ID NO: 12096 - DNA, 1422 bp, Bacillus subtilis
  CDS (1)..(1422): transl_table=11
atgaataaacaaggaaatcaaatgtcatttttacgtacaattattttagtctccactttcggcgggcttctttttggctatgataccggtgtgctcaatggagctttgccgtatatgggagagccggatcagcttaatctcaatgccttcacagaaggccttgtcaccagttcacttctttttggagcggcactgggtgctgtgtttggcggcaggatgtctgattttaacggccgccgcaaaaatattttgttcctcgctgttatattttttatttcaacgattgggtgtacgtttgcaccaaatgttacggtcatgattatttcccgttttgtgctcggtattgcggttgggggtgcatccgtaacggtgcctgcctatttagcagagatgtctcctgtggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgttggcttgtttctaaaggaagaaaagaagatgctttgcgtgtattgaaaaaaatcagggacgaaaaacgggcagcagctgagctgcaagaaattgaattcgctttcaaaaaagaagaccagcttgaaaaagcgacatttaaagatctttcagtcccatgggtgcgccgtattgtgtttattggattagggattgcgattgtacagcaaattacaggtgtgaattcgattatgtattatgggactgaaattctaagaaattccggtttccaaacggaagccgctttaatcggaaatattgcgaatggcgtgatttcggtattggcaacattcgtcggaatctggctgctgggaagagtggggcgccggccgatgctgatgacaggcttgatcggtacgacaacagcattattgctaatcgggatattctcacttgtacttgaaggatcaccggcacttccgtatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccgatattgctggcagctatcgggctgtccacaacgttctttatcttcgttggattaggaatttgctctgtcttgtttgtgaagaggtttttgccggaaacgaaagggctttcgcttgagcagctggaggaaaacttccgcgcttatgatcacagcggggcaaagaaggattctggggctgaagtgattggataa

SEQ ID NO: 12097 - protein, 473 aa, Bacillus subtilis
MNKQGNQMSFLRTIILVSTFGGLLFGYDTGVLNGALPYMGEPDQLNLNAFTEGLVTSSLLFGAALGAVFGGRMSDFNGRRKNILFLAVIFFISTIGCTFAPNVTVMIISRFVLGIAVGGASVTVPAYLAEMSPVESRGRMVTQNELMIVSGQLLAFVFNAILGTTMGDNSHVWRFMLVIASLPALFLFFGMIRMPESPRWLVSKGRKEDALRVLKKIRDEKRAAAELQEIEFAFKKEDQLEKATFKDLSVPWVRRIVFIGLGIAIVQQITGVNSIMYYGTEILRNSGFQTEAALIGNIANGVISVLATFVGIWLLGRVGRRPMLMTGLIGTTTALLLIGIFSLVLEGSPALPYVVLSLTVTFLAFQQGAISPVTWLMLSEIFPLRLRGLGMGVTVFCLWMVNFAVSFTFPILLAAIGLSTTFFIFVGLGICSVLFVKRFLPETKGLSLEQLEENFRAYDHSGAKKDSGAEVIG

SEQ ID NO: 12098 - DNA, 1701 bp, Kluyveromyces lactis; identical to SEQ ID NO: 4582
  CDS (1)..(1701)

SEQ ID NO: 12099 - protein, 566 aa, Kluyveromyces lactis; identical to SEQ ID NO: 4583

SEQ ID NO: 12100 - DNA, 1704 bp, Kluyveromyces lactis; identical to SEQ ID NO: 4564
  CDS (1)..(1704)

SEQ ID NO: 12101 - protein, 567 aa, Kluyveromyces lactis; identical to SEQ ID NO: 4565

SEQ ID NO: 12102 - DNA, 4409 bp, Saccharomyces cerevisiae
  CDS (1233)..(3524)
tagctgaaaaatcgcggtactgaagcttttttcatggcgcccttgaaactttctccttccgcctgcgcattatataaaatacgttacaataggaaaagatgacagttacttaaagtaaagcttcacagcttcagacaaaaaaagtatgaaacttgtgaagatgtttttatgctgatccggcagacggccattccattatttagttctgattttagtggaaaaactttcgaaacttaaaataataatagcccattcttggactgaggtacattttcttcttattggatttcgtttattagctgtttaacatatttctgtagggtttttttttttttttttgtacagattagaaaccatacagtgtaaaccattatataggtcaattaatatatttatagatcatcctgtcaatttttttttatttttttttgcaaagctccctttttcctgaaaccaacaacaaaatataaaaaaaaaatgataagcaggattttttcttttaataattccttaaaattaactaacaagctgaagcccttacaacaaagtaagtcaaacccaattcacaaaaaaaaaatctgttttatttcagatatgcagggtatatacatggcacagataaccttttaatgaaaagtagcaattgtgatactagcgcctttttccttgcaagaaaagggttccctgttcctgcatcgtccatcggcatagagatgtcgccgctaccctatccaattctaccgcatgcctaacaaaatgatttccgattttttcaatctaactccgtcatttcttatctgagttttcctccccgagataaattgaacaaagaatttaatcggctcatatgtgaaaaagtgtgatacttaccgcaatgggcaaaaattattaaaaaaaatctaattccgcgcttggctattatctcattaccgactcaacggtgactacctgccgtacacgcttcccctttgcttcttcctccacctcgaaagtagaacatatacatggaacagacataagctcttcagcgtatctatttcataagtggagagcatcgaacaataaacctttgcctaatttcatataacatccagtattcattttttttagttgacgctaaggcattcgcttgtgaaattaaagagcagatcaggaatagtatcaatagtctaaaccatcaagttgcacagaaaccactatatatatatggaaatatctcgaatattgcttgtatgaacgatagccaaaactgcctacgacagagggaagaaaatagtcatctgaatcctggaaatgacttcggccaccaccagggtgcagaatgtacgataaatcataacaacatgccacaccgcaatgcatacacagaatctacgaatgacacggaagcaaagtccatagtgatgtgcgacgatcctaacgcataccaaatttcctacacaaataatgagccggcgggagatggagctatagaaaccacgtccattctactatcgcaaccgctgccgctgcgatcgaatgtgatgtctgtcttggtaggcatatttgttgccgtggggggcttcttgtttgggtatgacactggacttataaacagtatcacggatatgccgtatgttaaaacctacattgctccgaaccattcatatttcaccactagccaaatagccatactcgtatcattcctctccctaggaacatttttcggtgcgttaatcgctccctatatttcagattcatatggtaggaagccaacaattatgtttagtaccgctgttatcttttccatcggaaactcattacaggtggcatccggtggcttggtgctattaatcgtcggaagagtgatctcaggtatcgggatcgggataatctctgctgtggttcctctttatcaagctgaagctgcgcagaagaaccttagaggtgccatcatttccagttatcagtgggctatcactattgggttactcgtgtccagtgcagtatcgcaaggaactcattccaaaaatggcccgtcttcatatagaataccaattggtttgcagtacgtttggtcaagtattttagctgtgggcatgatattccttccagagagtccaagatattacgtcttgaaggatgaactcaataaagctgcaaaatcgttatcctttttaagaggcctcccgatcgaagatccaagactcttagaggagcttgttgaaataaaagccacttacgattatgaagcatcgttcggcccgtcaacacttttagattgtttcaaaacaagtgaaaatagacccaaacagattttacgaatatttactggtatcgccatacaagcttttcaacaggcatctggtatcaattttatattctactatggagttaattttttcaacaacacaggggtggacaactcttacttggtttcttttatcagctatgccgtcaacgtcgccttcagtataccgggtatgtatttagtggatcgaattggtagaagaccagtccttcttgctggaggtgtcataatggcaatagcaaatttagtcattgccatcgttggtgtttccgagggaaaaactgttgttgctagtaaaattatgattgcttttatatgccttttcattgctgcattttcggcgacatggggtggtgtcgtgtgggtggtatctgctgaactgtacccacttggtgtcagatcgaaatgtaccgccatatgcgctgccgcaaattggctagttaatttcacctgtgccctgattacaccttacattgttgatgtcggatcacacacttcttcaatggggcccaaaatattcttcatttggggcggcttaaatgtcgtggccgttatcgttgtttatttcgctgtttatgaaacgaggggattgactttggaagagattgacgagttatttagaaaggccccaaatagcgtcatttctagcaaatggaacaaaaaaataaggaaaaggtgcttagcctttcccatttcacaacaaatagagatgaaaactaatatcaagaacgctggaaagttggacaacaacaacagtccaattgtacaggatgacagccacaacataatcgatgtggatggattcttggagaaccaaatacagtccaatgatcatatgattgcggcggataaaggaagtggctcgttagtaaacatcatcgatactgcccccctaacatctacagagtttaaacccgtggaacatccgccagtaaattacgtcgacttggggaatggtttgggtctgaatacatacaatagaggtcctccttctatcatttctgactctactgatgagttctatgaggaaaatgactcttcttattacaataacaacactgaacgaaatggagctaacagcgtcaatacatatatggctcaactaatcaatagctcatctactacaagcaacgacacatcgttctctccatcacacaatagcaatgcaagaacgtcctctaattggacgagtgacctcgctagtaagcacagccaatacacttccccccaataaaaaccaatagcatcttacgatcgttcgaggtcttataaaccgttttatataaattattcttatacacgcactcttgagtttcttttaacattccaacatgatagacatagaaaagaattatagataacacataacattactcacaagtagcccatgagtttgatttttcctcgttaattcggtgtcaagtggaatacaaaatgggtcaactgatcataactattacccggataatctacatcatgtggtacgttaacgatgtatggtttcctaaatcaccgggttccagatgcgggttgttgttgttcgatcttgcacctccacgtactccttttgaatagtacacatataccttacaggagatcggacgtgtgcgattattgttacctcgtcacctgttatcggttgaactgttttagctctttccattccctttgttaatagtagtttaattcttcggaaactttctacgcagactcaagttgcaataggctaaagataaggcagacactttgtatgtaacgagtttcattaggagggatagacgcacgacactatctggtactacgtgttatatcatacccagaaggaaggactctctccactgaacggtgggatgagttcctaaaggcgcccctttatttgatcaggaagccgtattgattatctaatagggcctagttatcctaattgtggggagtcgagcagtacggctctgatgtttttcgaacgaagataaggagttgacatacaaagtcaacagaagttcttcttgttagcgtctctgtgctcaatatctctctttttttctttaagtagtaattactaacatcagccaaccaatagagataaaaaaaaaaggaattaagatttcatagagaaaag

SEQ ID NO: 12103 - protein, 763 aa, Saccharomyces cerevisiae
MNDSQNCLRQREENSHLNPGNDFGHHQGAECTINHNNMPHRNAYTESTNDTEAKSIVMCDDPNAYQISYTNNEPAGDGAIETTSILLSQPLPLRSNVMSVLVGIFVAVGGFLFGYDTGLINSITDMPYVKTYIAPNHSYFTTSQIAILVSFLSLGTFFGALIAPYISDSYGRKPTIMFSTAVIFSIGNSLQVASGGLVLLIVGRVISGIGIGIISAVVPLYQAEAAQKNLRGAIISSYQWAITIGLLVSSAVSQGTHSKNGPSSYRIPIGLQYVWSSILAVGMIFLPESPRYYVLKDELNKAAKSLSFLRGLPIEDPRLLEELVEIKATYDYEASFGPSTLLDCFKTSENRPKQILRIFTGIAIQAFQQASGINFIFYYGVNFFNNTGVDNSYLVSFISYAVNVAFSIPGMYLVDRIGRRPVLLAGGVIMAIANLVIAIVGVSEGKTVVASKIMIAFICLFIAAFSATWGGVVWVVSAELYPLGVRSKCTAICAAANWLVNFTCALITPYIVDVGSHTSSMGPKIFFIWGGLNVVAVIVVYFAVYETRGLTLEEIDELFRKAPNSVISSKWNKKIRKRCLAFPISQQIEMKTNIKNAGKLDNNNSPIVQDDSHNIIDVDGFLENQIQSNDHMIAADKGSGSLVNIIDTAPLTSTEFKPVEHPPVNYVDLGNGLGLNTYNRGPPSIISDSTDEFYEENDSSYYNNNTERNGANSVNTYMAQLINSSSTTSNDTSFSPSHNSNARTSSNWTSDLASKHSQYTSPQ

SEQ ID NO: 12104 - DNA, 3642 bp, Saccharomyces cerevisiae
  CDS (551)..(3205)
ttcagtctcaaaactttcagtacaaaaagtggcgtattggccttgtttttttcttattatgtcttatagtattatatttatatatttatgtacttatccttttatgtttaaacctaatcaagatcacaattagaactagcttaacattacttctcaaaaccaaccaatacctcttatatcttttttacagcctttcccttatgtttttaccatgtacacctcgagcggcaaatctccggggaaattttaaacttgccgcatcgcacattctaaagaacaaaaggaggaggaactgtcaattattctataatctggggaaattcagtcatactgagaaaaactagacaatagtcctatcctcggcaaattgcattgatagtacttacacatcgagagatcataggacagataagaagcattttattgaagaaaaacagagagagtcactataagttgacctcactatagaaattaaaacagaaaagttttactgaggacctttttaaacagaaggatatgcctttgttggcatagaaagaagaatttataaatggatcctaatagtaacagttctagcgaaacattacgccaagagaaacagggtttcctagacaaagctcttcagagggtgaagggcatagcactgcgacgaaacaatagtaacaaagatcatacaacagatgatacgacaggtagcatacgaacccctacgagcttgcagcggcaaaattctgacaggcaatctaatatgacatccgtgtttacggatgacatttctaccatagacgacaactcaattttattttcagagcctcctcagaaacaatctatgatgatgtctatatgcgtaggtgtttttgttgcagttggcggatttttatttggttatgatacaggtctgatcaacagtattacatctatgaactatgtgaagtcacacgtagcacctaatcacgattcatttaccgcccaacaaatgtccattttggtgtcatttttgtcattgggaactttttttggggctttaactgcaccatttatatctgattcgtatggcaggaagcctactatcattttcagtacaattttcatcttctctatcggaaattctttacaggtaggtgctggaggaatcacattattgattgtgggaagggtcatttcaggtatcggtataggcgcaatttcagcggttgttccattataccaagcagaagctacacataaatcattaagaggtgctattatttctacttaccaatgggccattacctggggcttgctcgtgtcaagtgcagtgtcgcaagggacacacgcaagaaacgacgcatcttcgtatcggattcccatagggttgcaatatgtctggtcgtcatttctcgctatcgggatgttctttctccctgagagtccacgctattacgttttgaaagacaagctagatgaagcagctaaatctttatcgtttttaagaggtgtaccagtccatgattctgggttactggaagaactagttgaaataaaggcaacatatgattacgaggcatcttttggttcttcgaacttcattgattgttttatttcaagtaaaagtagaccaaagcaaactctaaggatgtttacgggaattgcccttcaagcatttcaacaattttcaggtatcaactttatattttactacggtgtcaatttcttcaataagacaggagtcagtaatagttatctggtttcatttataacctatgctgttaatgttgtctttaatgttcctggtttgttttttgtggaattttttggtagacgtaaggtgctggttgttgggggtgttatcatgactatagccaactttattgtggccattgttgggtgttccttaaagactgtagcggccgcaaaagttatgatagcatttatatgtctattcatagctgccttttctgctacatggggtggtgttgtttgggttatttcagcagaactgtacccattgggtgtgagatctaaatgtacggctatatgcgctgctgctaactggcttgtaaactttatttgtgctttaattaccccttatattgtagatactgggtcgcatacatcatcattaggtgcaaaaatattcttcatttggggctccttaaatgcgatgggggtgatagttgtttacttgaccgtttatgaaacgaagggtttgacattagaagagattgatgaattatatattaagtcatccactggtgtcgtgtcaccaaaatttaataaagatattagggaacgcgcacttaaattccaatacgatcctttgcaaagattagaagacggaaagaacacttttgttgctaaaagaaataattttgacgatgaaacaccaagaaatgattttcgaaatacgatatcgggcgaaatagatcatagtcccaatcaaaaagaagttcattctatcccagaacgtgttgatattcctactagtacagaaattcttgaaagcccgaacaaaagtagtggtatgacagtccctgtgtcaccttctctgcaagacgttccaatcccgcaaacaacagagcctgctgaaattcgaaccaaatatgtggacctaggaaatgggcttggtcttaatacgtataatagagggcctccctcactctcaagcgactcaagcgaagattacacagaagatgaaataggcgggccctcatctcaaggcgaccaaagtaatagaagtactatgaatgatattaatgattatatggcacgtctcattcacagtacttctactgcaagtaacacgacagataagttctccggtaaccaaagtacccttcgttaccacacggcttcctcacattcggatacaactgaagaggacagcaatttgatggacctgggaaacgggcttgccttgaatgcttataacagaggtccaccttcaattttaatgaattccagtgatgaagaggcaaatggtggtgagacgtctgataatttgaacacagctcaagacttggctggtatgaaggaacgaatggcgcagtttgcgcagagctatattgacaagagaggcggtctggaacctgaaactcaatctaatattttgagcacttctctctccgtgatggctgacactaatgaacataataatgaaatcctccactcaagcgaagaaaacgccactaatcaacctgtaaatgaaaataatgatttgaaataattaatttaatgttattcgatgtattaattaagcggacgtgcattataattttaatcatgtgaaagaaataattgtaacttgagatactactcaacttttatagatacacaatgtttatcttgacacacattcaattacattacttgatttaatgcctttccaaaattatgatcttttcttctataacacttttggatacttagccgccgacggataccatcttcggtcaacgtcggaagtcattataaacgaaaaggtttcccaatagaaaagtcctgcaggagccacgtataacactggcttgaattatcaacaactctcgaaggcgctggaagagaatttttacgcaagttagtattcgcataacattagttggcaaattacacaattttttgatacaatatatatacatatattttccccattgtttttcttag

SEQ ID NO: 12105 - protein, 884 aa, Saccharomyces cerevisiae
MDPNSNSSSETLRQEKQGFLDKALQRVKGIALRRNNSNKDHTTDDTTGSIRTPTSLQRQNSDRQSNMTSVFTDDISTIDDNSILFSEPPQKQSMMMSICVGVFVAVGGFLFGYDTGLINSITSMNYVKSHVAPNHDSFTAQQMSILVSFLSLGTFFGALTAPFISDSYGRKPTIIFSTIFIFSIGNSLQVGAGGITLLIVGRVISGIGIGAISAVVPLYQAEATHKSLRGAIISTYQWAITWGLLVSSAVSQGTHARNDASSYRIPIGLQYVWSSFLAIGMFFLPESPRYYVLKDKLDEAAKSLSFLRGVPVHDSGLLEELVEIKATYDYEASFGSSNFIDCFISSKSRPKQTLRMFTGIALQAFQQFSGINFIFYYGVNFFNKTGVSNSYLVSFITYAVNVVFNVPGLFFVEFFGRRKVLVVGGVIMTIANFIVAIVGCSLKTVAAAKVMIAFICLFIAAFSATWGGVVWVISAELYPLGVRSKCTAICAAANWLVNFICALITPYIVDTGSHTSSLGAKIFFIWGSLNAMGVIVVYLTVYETKGLTLEEIDELYIKSSTGVVSPKFNKDIRERALKFQYDPLQRLEDGKNTFVAKRNNFDDETPRNDFRNTISGEIDHSPNQKEVHSIPERVDIPTSTEILESPNKSSGMTVPVSPSLQDVPIPQTTEPAEIRTKYVDLGNGLGLNTYNRGPPSLSSDSSEDYTEDEIGGPSSQGDQSNRSTMNDINDYMARLIHSTSTASNTTDKFSGNQSTLRYHTASSHSDTTEEDSNLMDLGNGLALNAYNRGPPSILMNSSDEEANGGETSDNLNTAQDLAGMKERMAQFAQSYIDKRGGLEPETQSNILSTSLSVMADTNEHNNEILHSSEENATNQPVNENNDLK

SEQ ID NO: 12106 - DNA, 1515 bp, Arabidopsis thaliana
  CDS (1)..(1515)
atggccggtggagctcttaccgatgaaggaggcctaaagagagctcatctctatgaacatcggatcacttcttacttcatcttcgcttgcatcgtcggatccatgggaggctctcttttcggctatgatcttggagtctctggtggtgttacatcaatggacgatttcttgaaagagttcttcccagggatctacaaaagaaagcaaatgcatctaaacgaaacagattactgcaaatacgacaatcaaatcctcacactcttcacttcttctctctacttcgccggtttaatctcaactttcggagcttcttacgtcaccagaatctacggtaggagaggaagcatcctcgttggctctgtcagcttcttcctcggaggagtgattaacgctgcagccaaaaacatcctcatgttaatccttggtcgaatcttcctcggcataggcattggattcggaaaccaggcggttccgctatacctctcggagatggctccagcgaagattagaggaactgtgaatcagcttttccagctaacaacttgcattggaattctagttgctaatttgataaactacaaaacagagcaaatccatccatggggatggagactctctctcggtctcgccaccgtcccagctatactcatgttcctcggtggactcgttttgcctgaaacacccaatagtcttgtcgagcaagggaagctcgagaaggctaaagccgtgctgatcaaagtacgtggcacaaacaatatagaagctgagtttcaggatcttgtcgaagccagtgacgctgctagagccgtgaagaatccgtttcgcaatcttcttgctagaagaaacagaccgcagctagtgattggagccattgggcttcctgcgtttcagcaactaaccggaatgaattcgatcctgttttatgctccggttatgtttcagagcttagggtttggtggatctgcgtcgcttatctcgtctaccattacaaatgctgcgcttgttgtcgcggcgatcatgtctatgtattcagctgataaatttggaagaaggtttcttcttcttgaagctagcgtggagatgttctgttacatggttgtagtaggagtaacactagccttgaagtttggggaaggtaaggagctaccaaaatcgctcggtctgattcttgtggtccttatctgtctatttgtattggcgtatggtcgatcttggggtccaatgggatggttagttccgagcgagcttttccctctagagactcgatcagccggtcagagcgttgtggtgtgcgtgaaccttttcttcacggctctaatcgcgcagtgtttcctggtgtcgctgtgccatctcaagtacggaatattccttttattcgccggacttatattggggatgggaagcttcgtttactttctgttgccggagacgaaacaggttccgattgaagaggtttatcttctttggagacagcattggttatggaagaaatatgtcgaagatgttgatgaataa

SEQ ID NO: 12107 - protein, 504 aa, Arabidopsis thaliana
MAGGALTDEGGLKRAHLYEHRITSYFIFACIVGSMGGSLFGYDLGVSGGVTSMDDFLKEFFPGIYKRKQMHLNETDYCKYDNQILTLFTSSLYFAGLISTFGASYVTRIYGRRGSILVGSVSFFLGGVINAAAKNILMLILGRIFLGIGIGFGNQAVPLYLSEMAPAKIRGTVNQLFQLTTCIGILVANLINYKTEQIHPWGWRLSLGLATVPAILMFLGGLVLPETPNSLVEQGKLEKAKAVLIKVRGTNNIEAEFQDLVEASDAARAVKNPFRNLLARRNRPQLVIGAIGLPAFQQLTGMNSILFYAPVMFQSLGFGGSASLISSTITNAALVVAAIMSMYSADKFGRRFLLLEASVEMFCYMVVVGVTLALKFGEGKELPKSLGLILVVLICLFVLAYGRSWGPMGWLVPSELFPLETRSAGQSVVVCVNLFFTALIAQCFLVSLCHLKYGIFLLFAGLILGMGSFVYFLLPETKQVPIEEVYLLWRQHWLWKKYVEDVDE

SEQ ID NO: 12108 - DNA, 1374 bp, Lactobacillus brevis
  CDS (1)..(1374): transl_table=11
atgcgaaaagtttcgaccggatttgtttacttcttcggagcgctgggtgggttactttttgggtatgacactggggttatttccggagctattctctttattcagaaacagatgaacttaggatcttggcaacaaggctgggtcgttagtgcggttttgttaggggccattttaggggctgccatcattgggccttcgtctgaccgatttggtcggcggaaattattactgctttctgctattattttcttcgttggggcgttaggttccgccttttcaccagagttttggacgttaattatctcccgaattatcctggggatggccgttggggctgcttcagcattgattccgacgtatttggctgaattggcaccgtctgataagcgaggaacggtttccagtctatttcagttaatggttatgactgggattctcttggcctacatcacgaactacagtttctcaggtttctataccggctggcggtggatgttaggtttcgcggcaattcctgctgctttgctgttcttgggtgggctaattctccccgagagtccccggttcttggttaagagtgggcatctggatgaagctcggcacgtgctagacaccatgaacaagcatgaccaagtggcggtcaataaagaaattaatgatattcaagaatccgctaaaattgtgagcggtggttggtcagagttatttggtaagatggttcggccttcattgatcatcgggattggtttagccattttccaacaggtgatgggctgtaacacggtactgtactacgcaccaacaatcttcacggatgttggcttcggagtttcagccgcactgttagcgcatattggaattgggatctttaacgtgattgtgaccgcgattgcggtagccatcatggataagatcgaccggaaaaagatcgtaaatattggtgctgttgggatgggaatctccctgttcgttatgagcatcgggatgaagttctcaggtgggtcacagaccgcggcaatcatctctgtgattgctttgacagtttacatcgccttcttctccgcaacttggggtcctgtaatgtgggtcatgattggggaagtcttcccattgaacattcggggcttaggtaactcctttgctagtgtgatcaactggacagcaaacatgattgtttccttgacgttcccatctctgttggacttctttggaaccgggagcttgttcattggttacgggattctctgctttgcttccatctggttcgtccaaaagaaagtgttcgaaacacggaatcggtctttggaagatatcgaagccaccttacgtgctaagacaggcgaagatgctgctgaactaagcacgaccaaataa

SEQ ID NO: 12109 - protein, 457 aa, Lactobacillus brevis
MRKVSTGFVYFFGALGGLLFGYDTGVISGAILFIQKQMNLGSWQQGWVVSAVLLGAILGAAIIGPSSDRFGRRKLLLLSAIIFFVGALGSAFSPEFWTLIISRIILGMAVGAASALIPTYLAELAPSDKRGTVSSLFQLMVMTGILLAYITNYSFSGFYTGWRWMLGFAAIPAALLFLGGLILPESPRFLVKSGHLDEARHVLDTMNKHDQVAVNKEINDIQESAKIVSGGWSELFGKMVRPSLIIGIGLAIFQQVMGCNTVLYYAPTIFTDVGFGVSAALLAHIGIGIFNVIVTAIAVAIMDKIDRKKIVNIGAVGMGISLFVMSIGMKFSGGSQTAAIISVIALTVYIAFFSATWGPVMWVMIGEVFPLNIRGLGNSFASVINWTANMIVSLTFPSLLDFFGTGSLFIGYGILCFASIWFVQKKVFETRNRSLEDIEATLRAKTGEDAAELSTTK

SEQ ID NO: 12110 - DNA, 1542 bp, Oryza sativa
  CDS (1)..(1542)
atggccggcggcgccatgaccgacaccgatggcgctcacaagaactacccggggaagatgaccatcttcgtcttcctcgcctgcctcgtcgcctcctccggcggcctcatcttcggctacgacatcggcatctccggcggcgtgacgtcgatggactcgttcctgatcaagttcttcccgtcggtgtacgccaaggagaaggagatggtggagacgaaccagtactgcaagttcgacagcgagctgctcaccctcttcacctcgtcgctctacctcgccgcgctcatcgcctcgctcttcgcttccgtcatcacccgcaagttcggccgcaggatcaccatgctcggcggcggcgtcatcttcctcgtcggcgccatcctcaacggagccgccgccgacgtcgccatgctcatcatcggccgcatcctcctcggcatcggcgtcggcttcagcaaccaggctgtgccactgtacctgtcggagatggcgccggcgaggatgcggggcatgctgaacatcagcttccagctcatgatcaccgtcggcatcctcgccgccaacctcatcaactacttcaccgacaagatcgccggagggtgggggtggcgcgtcagcctcggcctcgccgccgtcccggccgtcatcatggccggcggctccctcttcctccccgacacccccaactcgctcctctcccgcggcaaggagaacgaggcgcgcgccatgctccgccgcatccgtggcaccgacgacgtcggcccggagtacgacgacctcgtcgccgccagcgaggcgtccaaggccatcgagaacccgtggcgcacgctcctcgagcgccggtacaggccgcagctggtgatgtcggtgctgatcccgacgctgcagcagctcaccggcatcaacgtcgtcatgttctacgcgccggtcctcttcaagaccatcggattcggcggcacggcctcgctcatgtccgccgtcatcaccggcctcgtcaacatgttcgccaccttcgtctccatcgccaccgtcgaccgcctcggccgccgcaagctcctccttcagggcggcgtccaaatgatctttgcgcagttcattcttgggacgctgatcgccgtcaagttcgggacggcgggcgtggcgaacatctcgcggggttacgccatcgtggtggtgctgtgcatctgcgtgttcgtgtcggcgttcgcgtggtcgtggggacccctcgggtggctggttcccagcgagatcttcccgctggagatcaggtcggcggcgcagagcgtggtggtggtgttcaacatggccttcaccttcatcatcgcgcagatcttcctgatgatgctgtgccacctcaagttcggcctcttctacttcttcggcgccatggagctcatcatgacggggttcgtcttcttcttcctgccggagacgaaggggattcccatcgaggagatggacaggatctggggtaagcactggtactggagacggttcgtcggcgctggggccggcggcaaggtcgagattacctccacagtatga

SEQ ID NO: 12111 - protein, 513 aa, Oryza sativa; identical to SEQ ID NO: 4711

SEQ ID NO: 12112 - DNA, 1563 bp, Oryza sativa
  CDS (1)..(1563)
atgccgggggccgtgatcgtgcaccaccacacgcggtacaagacgtaccccggcgaggtcaccggcttcgtcttcttctgctgcctcatcgcctccgtcggcggctgcatcttcggctacgacatcggcctcaccgccgggttgacgtcgacggagtcgttcttggcgatgttcttcccggtgatcttcgagcagcagcaggagcgggtgatcacgaaccagtactgcaagttcgacagccaggtgctgacgctgttcggctcgtcgctcttcctctccgccatggtcgccggcatcttcgcctccccgatgtcccgcgccttcggccgcaagtggaccctcttcgtcgccgccgtcgcctacctcatcggcgccatcctcggcgccatctccttcaacttcatcgttctcctcaccggccgcctcctcctcggcgtcggcgtcggcgtctgcatccacgcgtcaccgctgtacatatcggagatggcgccggcgcagcagcgggggatgctgaacatactgttccagctgatgatcacggtggggatcctgtcggcgagcctgacaacgtactggacgtcgaagatcgccggcgggtgggggtggcgcgtggggctggcgttcgggacggtgccggcggcggtgatcgcgctggggtcgctggccatcccggacacgccggtgtcgctcatcgcgcgcggcgagggcgaggcggcgcgcgcgacgctggccaagatccgcggcgtcgacgacgtgcgcgccgagttcgaggacctgacgacggcgagcgaggagagcaaggcggtggcgcacccgtggcgggagctcttcttcggcggcaggtacaagccgcagctcgcgttcgcggtgctcatccccttcttccagcagctcaccggcatcaacgtcatcatgttctacgcccccgtcctcttcaagaccgtcggcttccgccaggacgcctccctcgtctcctccgtcatcaccggcctcgtcaacgtcttctccaccttcgtcgccgtcatgaccgccgacaaggtcggccgccgcgccctcttcctccaaggtggcacccaaatgatcatctcccagatcttggtgggaacattcatcggattacagttcggggtgagcgggacgggggcgatgtcggagcagtacgcgatgtgcatcgttctgttcgtgtgcgtgtacgtggccgggttcgcgtggtcgtgggggccgatggggtggctgatcccgagcgaggtgtacccgctggcggtgaggtcggcggcgcagagcgtgacggtggcggtgaacatgttcttcacggcgttcatcagccagatcttcctcaccctcctctgccacctccgcttcggcctcttctacttcttcggcgcctgggtcctcctcatgaccgtcttcatcgccaccctcctcccggagaccaagtgcgtgccgctcgaagaggtggcgcacgtctggaggaagcactggttctggcgcaagttcatcgtcgactcccccgaccgcggcggcgccgagatgaggaagaggatagccctagagatgagctag

SEQ ID NO: 12113 - protein, 520 aa, Oryza sativa; identical to SEQ ID NO: 4659

SEQ ID NO: 12114 - DNA, 1569 bp, Oryza sativa
  CDS (1)..(1569)
atggcagctgcaaccgcagctgatgttgccgaggatacggccagtgtgtactccggcaagcttaccctctacgtcttcctcacctgcggcgtcgcggcgaccggcggcctcatcatcggctatgacatcggcatctctggtggtgtgacatcgatggacacgttcctggggaagttcttcccgtcggttctccaccaagaacagacggcgcagggcacaagccagtactgcaagttcaacagccagccgctgaccgcgttcacctcgtcgctgtacctcgcggcgctcgtggcctccttcttcgtcgcgtccttcacgcgcgcgctgggcaggaagtggtccatgttcggcggcggcgtctccttcctcgccggtgccaccctcaacggcgccgcgcggaacgtcgccatgctcatcgtcggccgcatcctcctcggcatcggcgtcgccttctgtggtctgtccactccgatatacttgtctgagatggcgccaccgcggctgcgtggcatgctcaacatcggcctccagctgatgatcaccgtgggcatcttctccgccaatctcgtcaactacggtgcggccaagatcaggggtggctgggggtggcgtgtcagcctcggcctcgctgccgccccggcatgcgtcatcgccgtgggctcgctcttcctcccggactcaccgagctccctcatcaaccgtggccgccacgagcaggcgcggcgggtgctgcggcgcatccgtggcaccgacgaggtggacgacgagtacggcgacctcgtcgcagcagccagcgagatcgaggtgtattccggctgctccgcgagacgacggccgtggcgcgacgtcctgcagcgcaggtaccggccgcagctcgccatggccgtcctcatccccttcttccagcagctcaccggcatcaacgtcatcatgttctacgcgcccgtgctgttcaagaccatcggcctcggaggagacgcgtcgctcatgtcggcggtcatcaccgggctggtcaatatcgttgccacgttcgtgtccatcgccaccgtcgacagccttggccgacgcaagctcttgttccagggaggctgccagatgcttgtgagccaggttatcattggaacgctgatcggtgtggtgtttggtacgagtggcgatggcaacatctcgagggcgttggcggtctgcatcgtggtgttcatctgcgtctacgtcgccggcttcgcttggtcgtggggcccgcttggcgtcctcctgccgagcgagatcttcccgctggaggtccggccggcggggcagagcatcagcgtggccgtgaacatgctctgcacgttcgccgtcgcggaggccttcctcccgatgctctgccacatgaggttcggcctcttctacttctttagcggatgggtgctcgtgatgacgctcttcgtctcggccttcctgcctgagaccaagggcgtgccgatcgagaagatgaccgtcgtgtggagaacgcactggttttggggtagattttactgtaaccaggatgcagatgcacacgttcaagtggcaaacagcaaagtttga

SEQ ID NO: 12115 - protein, 522 aa, Oryza sativa
MAAATAADVAEDTASVYSGKLTLYVFLTCGVAATGGLIIGYDIGISGGVTSMDTFLGKFFPSVLHQEQTAQGTSQYCKFNSQPLTAFTSSLYLAALVASFFVASFTRALGRKWSMFGGGVSFLAGATLNGAARNVAMLIVGRILLGIGVAFCGLSTPIYLSEMAPPRLRGMLNIGLQLMITVGIFSANLVNYGAAKIRGGWGWRVSLGLAAAPACVIAVGSLFLPDSPSSLINRGRHEQARRVLRRIRGTDEVDDEYGDLVAAASEIEVYSGCSARRRPWRDVLQRRYRPQLAMAVLIPFFQQLTGINVIMFYAPVLFKTIGLGGDASLMSAVITGLVNIVATFVSIATVDSLGRRKLLFQGGCQMLVSQVIIGTLIGVVFGTSGDGNISRALAVCIVVFICVYVAGFAWSWGPLGVLLPSEIFPLEVRPAGQSISVAVNMLCTFAVAEAFLPMLCHMRFGLFYFFSGWVLVMTLFVSAFLPETKGVPIEKMTVVWRTHWFWGRFYCNQDADAHVQVANSKV

SEQ ID NO: 12116 - DNA, 1521 bp, Oryza sativa
  CDS (1)..(1521)
atgacgatcgatttgtccatgcccgggagctccgggctcctggacgacgtaggggggaagaagcacatgaatttcttcagcaaccgctacgtgctcgcgctcacgggcgccgcaggaatcggcgggttcctctttggctacgacacaggtgtcatatctggagcccttttgtatattcgggatgactttccagcagtcagagacaattatttcttacaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggttcctggaacatggcgctggatgctcggagttgctgctgtgcctgcaattctacagtttgttctgatgctttttttgccagaatctccccgttggcttttctggaaggatgagaaagcaaaagctatttctgtcctagagaagatttatgactctgaccgtctagaggaagaggtagagcttcttgcttcttcttcaatgcatgaatttcagtctgatggtactgggagctatttggacattttcaagtcaaaggaactaaggctagcattttttgctggagctggtcttcaggcgttccagcaatttactggcatcaacactgtcatgtactacagcccaacaattgtccagatggctgggtttacctccaacaagttggcattgctcctttccctcatagtcgctggtatgaatgccgctgggaccattgttggaatctacctgattgaccgctgtggccggcgtcgcctggcccttacaagcttggctggtgtggtggtctccctcgccatcctagcaatggccttcatactgcagtcatcatcagatatctgttcgaatgcactcaatggtgcctgccaaggtgcactgggatggttcgcggtggcgggactcgctctatacatcgccttcttctccccaggcatggggccagttccatgggcagtgaactccgagatctaccccgaggcataccgtggaatgtgtggtggcatgtcagccactgtcaactgggtatctaacctgattgtggcacaaacattcctctcgatcgtcgggttggttgggaccggcctgaccttcctgatcatcgccggaatagcggtgctggccttcatcttcgtggctctctacgtgccggagactaaaggcctcagctttgagcaggttgagctcctgtggaaggagagagcatggggaaaccagggcaatcgccagagccttttgggcgctgcaccgtag

SEQ ID NO: 12117 - protein, 506 aa, Oryza sativa; identical to SEQ ID NO: 4687

SEQ ID NO: 12118 - DNA, 1557 bp, Oryza sativa; identical to SEQ ID NO: 4676
  CDS (1)..(1557)

SEQ ID NO: 12119 - protein, 518 aa, Oryza sativa; identical to SEQ ID NO: 4677

SEQ ID NO: 12120 - DNA, 1593 bp, Oryza sativa
  CDS (1)..(1593)
atggccggcggcgtggtggtgaacaacggaggggggaaggactaccccgggaagctcaccatgttcgtcctcttcgcctgcatcgtcgcagccaccggcggcctcatcttcggatatgacatcggcatctccgggggtgtgacgtcgatgaacccgttcctgatcaagttcttcccgtcggtgtaccggaaggagcaggcggcggagaagaaccagagcaaccagtactgcaagttcgacagcccgctgctgaccatgttcacctcgtcgctctacctcgccgcgctcgtcgcctccttcttcgcgtccaccgtcacccgcgtcgcggggcgcaagtggtccatgttcggcggcggcgtcaccttcctcgtcggcgccgcgctcaacggcgccgccaagaacgtgctcatgctcatcctcggccgcgtcctcctcggtgtcggcgtcggcttcgccaaccagtctgtgccgctgtacctgtcggagatggcgccggcgaggctgcgcgggatgctcaacatcgggttccagctgatgatcaccattggcatcctgtgcgccaacctgatcaactacgggactgccaagatcaagggcgggtgggggtggcgcgtgagcctggcgctggcggcggtgccggcggcgatcatcgccgtgggcgcgctcttcctccctgacacgcccaactccctcatcgaccgcggccacaccgacgccgccaagcgcatgctccggcgcgtgcgcggcaccgacgacatcgaggaggagtacaacgacctggtggccgccagcgaggagtccaagctcgtggcgcacccgtggcggaacatcctccagcgccggtacaggccgcagctgaccatggccatcgccatcccgctgttccagcagctgacggggatcaacgtcatcatgttctacgcgccggtgctgttcaagacgctgggattcgccgacgacgcgtccctcatgtccgccgtgatcaccggcctcgtgaacgtcttcgccaccttcgtgtccatcgtgaccgtcgaccgcctcggccgccggaagctgttcctccagggcgggacgcagatgctggcgtgccagatcgtcgtcggaagcctcatcggcgccaagttcgggttctccggcgtggccgacatccccaaggcgtacgcggcgttcgtggtgctcttcatctgcgcctacgtcgccgggttcgcgtggtcgtgggggcccctgggctggctcgtccccagcgagatcttcccgctggagatcaggtcggcggggcagagcatcaacgtgtcggtgaacatgctcttcaccttcatcatcgcgcaggcgttcctccccatgctctgccgcttcaagttcatcctcttcttcttcttcggcgcgtgggtggtgatcatgacgctgttcgtcgccttcttcctgccggagaccaagaacgtgcccatcgaggagatggtgctcgtctggaagtcgcactggtactggggcaggttcatccgcgacgaggacgtgcacgtcggcgccgacgtcgagatgcccgccgccggcaaccgcaacggcaaggtcgacccggccaagctcgccaactga

SEQ ID NO: 12121 - protein, 530 aa, Oryza sativa
MAGGVVVNNGGGKDYPGKLTMFVLFACIVAATGGLIFGYDIGISGGVTSMNPFLIKFFPSVYRKEQAAEKNQSNQYCKFDSPLLTMFTSSLYLAALVASFFASTVTRVAGRKWSMFGGGVTFLVGAALNGAAKNVLMLILGRVLLGVGVGFANQSVPLYLSEMAPARLRGMLNIGFQLMITIGILCANLINYGTAKIKGGWGWRVSLALAAVPAAIIAVGALFLPDTPNSLIDRGHTDAAKRMLRRVRGTDDIEEEYNDLVAASEESKLVAHPWRNILQRRYRPQLTMAIAIPLFQQLTGINVIMFYAPVLFKTLGFADDASLMSAVITGLVNVFATFVSIVTVDRLGRRKLFLQGGTQMLACQIVVGSLIGAKFGFSGVADIPKAYAAFVVLFICAYVAGFAWSWGPLGWLVPSEIFPLEIRSAGQSINVSVNMLFTFIIAQAFLPMLCRFKFILFFFFGAWVVIMTLFVAFFLPETKNVPIEEMVLVWKSHWYWGRFIRDEDVHVGADVEMPAAGNRNGKVDPAKLAN

SEQ ID NO: 12122 - DNA, 1536 bp, Oryza sativa
  CDS (1)..(1536)
atggcgggaggcggcgtggcggcgctgggggtgaagaaggagcgggcggcggagtacaagggccgcatgacgctcgccgtcggcatggcctgcctcgtcgccgccgtcggcggcgccatcttcggctacgacatcggcatctccgggggagtgacgtccatggatccgttcctcaagaagttcttcccggtggtgttccggaagaagaacgacgacggccagaacaactactgcaagtacgacaaccagggcctctcggcgttcacctcctccctctacctcgccggcctcgtctcctcccttgccgcctcgccggtgacgaggaactacggccgccgcgccagcatcgtctgcggcggcctcagcttcctcgccggcgccacgctcaacgccgccgccgttaacctcgtcatgctcatcctcggccgcatcctgctcggcgtcggcatcggcttcggcaaccaggccgtgccgctgtacctgtcggaaatggcgccggcgcacctccgcggcgcgctgaacatgatgttccagctggcgacgacgctgggcatcttcacggcgaacatgatcaactacgggacgcagcacatcaggccgtgggggtggcggctctcgctggggctcgcggcggcgccggcgctgctgatgaccgtcggcgggctgctcctgccggagacgcccaacagcctgatcgagcgcgggcgcgtcgaggagggccgccgcgtgctggagcgcatccggggcaccgccgacgtggacgccgagttcacggacatggcggaggcgagcgagctcgccaactccatcgagcacccgttccgcaacatcctggagccgcgcaaccggccgcagctggtgatggcggtgtgcatgccggcgttccagatcctgacgggcatcaactccatcctcttctacgcgcccgtgctgttccagagcatgggcttcggcggcagcgcgtcgctctactcctcagtcctcaccggcgccgtcctcttctcctccaccatcatctccatctccaccgtcgaccgcctcggccgccgcaagctcctcatcagcggcggcatccaaatgatcatctgccaggtgatagtggcggtgatcttgggggtgaagttcgggacggacaaggagctgacgaggagctactcgatcgcggtggtggtggtgatctgcctgttcgtgctggcgttcgggtggtcgtgggggccgctggggtggacggtgccgagcgagatcttcccgctggagacgaggtcggcggggcagagcatcacggtggcggtgaacctcttcttcaccttcgtcatcgcgcaggcgttcctgtccctgctctgcgcgctcaagttcggcatcttcctcttcttcgccgggtggatcaccgtcatgaccgtcttcgtccacgtcttcctgccggagaccaagggcgtgcccatcgaggagatggtgctcctatggaggaagcactggttctggaagaaggtcatgcccgacctgccgctcgaggacggcgacagtcatcacaagtga

SEQ ID NO: 12123 - protein, 511 aa, Oryza sativa
MAGGGVAALGVKKERAAEYKGRMTLAVGMACLVAAVGGAIFGYDIGISGGVTSMDPFLKKFFPVVFRKKNDDGQNNYCKYDNQGLSAFTSSLYLAGLVSSLAASPVTRNYGRRASIVCGGLSFLAGATLNAAAVNLVMLILGRILLGVGIGFGNQAVPLYLSEMAPAHLRGALNMMFQLATTLGIFTANMINYGTQHIRPWGWRLSLGLAAAPALLMTVGGLLLPETPNSLIERGRVEEGRRVLERIRGTADVDAEFTDMAEASELANSIEHPFRNILEPRNRPQLVMAVCMPAFQILTGINSILFYAPVLFQSMGFGGSASLYSSVLTGAVLFSSTIISISTVDRLGRRKLLISGGIQMIICQVIVAVILGVKFGTDKELTRSYSIAVVVVICLFVLAFGWSWGPLGWTVPSEIFPLETRSAGQSITVAVNLFFTFVIAQAFLSLLCALKFGIFLFFAGWITVMTVFVHVFLPETKGVPIEEMVLLWRKHWFWKKVMPDLPLEDGDSHHK

SEQ ID NO: 12124 - DNA, 1413 bp, Brassica napus; identical to SEQ ID NO: 4738
  CDS (1)..(1413)

SEQ ID NO: 12125 - protein, 470 aa, Brassica napus; identical to SEQ ID NO: 4739

SEQ ID NO: 12126 - DNA, 1599 bp, Brassica napus; identical to SEQ ID NO: 4740
  CDS (1)..(1599)

SEQ ID NO: 12127 - protein, 532 aa, Brassica napus; identical to SEQ ID NO: 4741

SEQ ID NO: 12128 - DNA, 1551 bp, Brassica napus; identical to SEQ ID NO: 4742
  CDS (1)..(1551)

SEQ ID NO: 12129 - protein, 516 aa, Brassica napus; identical to SEQ ID NO: 4743

SEQ ID NO: 12130 - DNA, 1527 bp, Brassica napus; identical to SEQ ID NO: 98
  CDS (1)..(1527)

SEQ ID NO: 12131 - protein, 508 aa, Brassica napus; identical to SEQ ID NO: 99

SEQ ID NO: 12132 - DNA, 1524 bp, Brassica napus; identical to SEQ ID NO: 4746
  CDS (1)..(1524)

SEQ ID NO: 12133 - protein, 507 aa, Brassica napus; identical to SEQ ID NO: 4747

SEQ ID NO: 12134 - DNA, 1569 bp, Brassica napus; identical to SEQ ID NO: 4748
  CDS (1)..(1569)

SEQ ID NO: 12135 - protein, 522 aa, Brassica napus; identical to SEQ ID NO: 4749

SEQ ID NO: 12136 - DNA, 1596 bp, Brassica napus; identical to SEQ ID NO: 100
  CDS (1)..(1596)

SEQ ID NO: 12137 - protein, 531 aa, Brassica napus; identical to SEQ ID NO: 101

SEQ ID NO: 12138 - DNA, 1635 bp, Brassica napus; identical to SEQ ID NO: 102
  CDS (1)..(1635)

SEQ ID NO: 12139 - protein, 544 aa, Brassica napus; identical to SEQ ID NO: 103

SEQ ID NO: 12140 - DNA, 1494 bp, Brassica napus; identical to SEQ ID NO: 4754
  CDS (1)..(1494)

SEQ ID NO: 12141 - protein, 497 aa, Brassica napus; identical to SEQ ID NO: 4755

SEQ ID NO: 12142 - DNA, 1428 bp, Brassica napus; identical to SEQ ID NO: 104
  CDS (1)..(1428)

SEQ ID NO: 12143 - protein, 475 aa, Brassica napus; identical to SEQ ID NO: 105

SEQ ID NO: 12144 - DNA, 1428 bp, Brassica napus; identical to SEQ ID NO: 4758
  CDS (1)..(1428)

SEQ ID NO: 12145 - protein, 475 aa, Brassica napus; identical to SEQ ID NO: 4759

SEQ ID NO: 12146 - DNA, 1488 bp, Triticum aestivum
  CDS (1)..(1488)
atggcgtccaagggcgagagggatgtggagatccacgtctcctccccgccgcccgacgaccgcgacgccgctaggcccttgctgcccgccgcctgcgagccctactccgtctccgccgcaatcctccccttctttttcccagctctgggtgggcttctctatggctatgacatcggggcaacatctggtgccaccatatcgctcaagtcccccacatccagtggtacagcatggtacgacctgtcatcagtgcaaaccggcctcgtggtcagcggctcactctatggtgctttgatcggatccgccacggcattcaccattgcggattttctaggaaggcgcagagagcttgttgtttcttctatcatgtatttgattggagctcttctcaccgcagtggctcctaacttccttatcatggtggttggtcgctttttatatggcataggaattggattggctatgcacgctgctccaatgtatattgctgagactgctccaagtcagattagaggcatgctcatctctctcaaggagttctttattgttcttgggatgcttcttggttatatagtaggcaatctatttgttgaagtgatttctggttggcgctacatgtatgccaccagtgctccgatatgtgtcattatgggcatcggaatgtgctggttaccttgttcacctaggtggcttctgttatgtgccacacaaggaaaaggagatctgcgggagacaaaagaaaatgctacacgttgcttatgtcgattgaggggtcaagcgtcacctgatttggtttcggagcaggtcaatttgattctggaagaactctcatacgttggtgaagagaaaaaagcaggcttcagtgagatctttcaaggaaagtgtctcaaagcaatgataattggatgtggtttggtgttctttcagcaggtcactggtcaaccaagtgtgctatattatgctgcgacaatttttcagagtgctggattctctggagcatctgatgccactcgtgtatcaattcttcttggcttgctgaagctgattatgactggagttgccgttcttgtggttgacaaacttggcagaagaccattactaattggtggtgttagtggaattgctgtctccctattcttattgtcttcatactataccttgtttacgggtgctccttatgtggctgtaatagcacttctactgtatgttggctgctaccagttatcatttggcccgattggctggcttatgatttcggaggttttcccgctgaaactgcgtggccgtggattgagtgttgctgttcttgtgaacttcgcctccaacgcgcttgtcacttttgctttctccccactagaggacttgattggcaccggggttctctttgcttcgttcggggtgattgcggtggcgtctctcgcattcatattctgcattgtgcctgaaacaaaagggctcaccctggaagaaatcgaagccaaactgtag

SEQ ID NO: 12147 - protein, 495 aa, Triticum aestivum; identical to SEQ ID NO: 4763

SEQ ID NO: 12148 - DNA, 1530 bp, Triticum aestivum; identical to SEQ ID NO: 106
  CDS (1)..(1530)

SEQ ID NO: 12149 - protein, 509 aa, Triticum aestivum; identical to SEQ ID NO: 107

SEQ ID NO: 12150 - DNA, 1458 bp, Zea mays; identical to SEQ ID NO: 108
  CDS (1)..(1458)

SEQ ID NO: 12151 - protein, 485 aa, Zea mays; identical to SEQ ID NO: 109

SEQ ID NO: 12152 - DNA, 1524 bp, Glycine max; identical to SEQ ID NO: 4768
  CDS (1)..(1524)

SEQ ID NO: 12153 - protein, 507 aa, Glycine max; identical to SEQ ID NO: 4769

SEQ ID NO: 12154 - DNA, 1620 bp, Glycine max; identical to SEQ ID NO: 4770
  CDS (1)..(1620)

SEQ ID NO: 12155 - protein, 539 aa, Glycine max; identical to SEQ ID NO: 4771

SEQ ID NO: 12156 - DNA, 1524 bp, Glycine max; identical to SEQ ID NO: 110
  CDS (1)..(1524)

SEQ ID NO: 12157 - protein, 507 aa, Glycine max; identical to SEQ ID NO: 111

SEQ ID NO: 12158 - DNA, 1659 bp, Glycine max; identical to SEQ ID NO: 112
  CDS (1)..(1659)

SEQ ID NO: 12159 - protein, 552 aa, Glycine max; identical to SEQ ID NO: 113

SEQ ID NO: 12160 - DNA, 1452 bp, Glycine max; identical to SEQ ID NO: 114
  CDS (1)..(1452)

SEQ ID NO: 12161 - protein, 483 aa, Glycine max; identical to SEQ ID NO: 115

SEQ ID NO: 12162 - DNA, 1524 bp, Triticum aestivum
  CDS (1)..(1524)
atggccggcggcgttttcctcctcaacggcgccggcgcgccggactacggcggcgcgctgaccgttcccgtcgtggtgacctgtctcatggcggcctccggcggccttatcttcggctacgacattggcatctcagggggcgtctcggagatggagtctttcctgaagaagttcttcccgggcttactcaagacgacgaggcacgcgagcaaggacgtctactgcatgtacaacgaccaggcgctcacggccttcacctcctcgctctacgccttcggcatggtgggcacgctggtggcgagccgggtcacccggcgggtcggccgcaaggccatcatggtcatcggggggagcatgttcctcgtcggctcgctcgtcaacgccgccgcggccaacctcgccatgctcatcgtcgggcggatgctgctcggcctgggcctcgggttctccggccaggccacgccggtctaccttgccgagatgtcgccaccgcggtggcgcggcgggttcatctccgcgttccctctgttcatcagcgtggggtacctcgtcgccaacctgatcaactacggcacgtcgcggattcccgaatggggctggcgcctgtccctcggcctcgcggccgtccccgccgccgtcatggtgctgggcgccgtgctcatcacggacacaccgagcagcctcgtcctgcgcgggaagcacgaccatgcccgcgccgcgctccagcgcgtccgcggcaagggcgtggacgttgacgcggagttcggcgacatactggccgccgtggagcacgaccggcggaaccaggagggcgcgttccggcggatcctgcggcgggagtaccggccgtacctggtgatggccgtggcgttccccgtgttcctgaacctcaccggcgtgaccgtgtcggccttcttctcgccgatactcttccggaccatagggttcggtagcgacgcggcgctgatgggcgccatcatcctcggcctgatgaacatcggcggcatcatcgcctcggacgtcgccatggaccgctacggccggaagctgctcttcgcgatcggcggcgcgctcatgttcacctgccaggtggcaatggcgagcatcgcggggacgcacctggggcacggcagcaagatgcccaaggggtacgcggtggcggtgctggtgctgacgtgcgtcttctcggccagcttcagctggtcgtggggtgcgctgtactggaccatccccggcgagatatacccggtggaggtgcggtcggcggggcagggcacggcggtggcgctcaacctgggcctcaacttcgtgcaggcgcagtgcttcctggcgatgctgtgcagcctcaagtacggcgtcttcgtcttctacgcgtgctggctcgtcgtcatgaccgccttcgccatggcgttggtgccggagaccaagggcgtgccgcttgactccatgggccacgtcttcgcgcgccactggtactggggcaggttcgtcaaggaccacaagttcggaaatgagtccacctga

SEQ ID NO: 12163 - protein, 507 aa, Triticum aestivum
MAGGVFLLNGAGAPDYGGALTVPVVVTCLMAASGGLIFGYDIGISGGVSEMESFLKKFFPGLLKTTRHASKDVYCMYNDQALTAFTSSLYAFGMVGTLVASRVTRRVGRKAIMVIGGSMFLVGSLVNAAAANLAMLIVGRMLLGLGLGFSGQATPVYLAEMSPPRWRGGFISAFPLFISVGYLVANLINYGTSRIPEWGWRLSLGLAAVPAAVMVLGAVLITDTPSSLVLRGKHDHARAALQRVRGKGVDVDAEFGDILAAVEHDRRNQEGAFRRILRREYRPYLVMAVAFPVFLNLTGVTVSAFFSPILFRTIGFGSDAALMGAIILGLMNIGGIIASDVAMDRYGRKLLFAIGGALMFTCQVAMASIAGTHLGHGSKMPKGYAVAVLVLTCVFSASFSWSWGALYWTIPGEIYPVEVRSAGQGTAVALNLGLNFVQAQCFLAMLCSLKYGVFVFYACWLVVMTAFAMALVPETKGVPLDSMGHVFARHWYWGRFVKDHKFGNEST

SEQ ID NO: 12164 - DNA, 1509 bp, Zea mays; identical to SEQ ID NO: 4776
  CDS (1)..(1509)

SEQ ID NO: 12165 - protein, 502 aa, Zea mays; identical to SEQ ID NO: 4777

SEQ ID NO: 12166 - DNA, 1620 bp, Zea mays; identical to SEQ ID NO: 116
  CDS (1)..(1620)

SEQ ID NO: 12167 - protein, 539 aa, Zea mays; identical to SEQ ID NO: 117

SEQ ID NO: 12168 - DNA, 1521 bp, Zea mays
  CDS (1)..(1521)
atgagcttccgggaccaggagagtggcggggaggatgggggcaggacgtcctccgcctccgacctgcggaagccgctcatcaacaccgggagctggtaccgcatgccgccggcgggtggcgtgatgggctcgcggcaatccagcctcatggagcgcttgggctcctctgcgttctctctccgcgacgtcgctatctcggccacgctctgcacgcttattgtcgcgctaggtcccatccagttcggtttcacatgcggctactcctcgcccacgcaggacgccatcattgctgatctcggcctctccctctctgagttctccctcttcggttcattatctaatgtaggggcgatggtaggcgccatctccagtgggcaacttgcagagtatatcggccgcaaggggtctctcatgatcgctgcgattccaaacataattgggtggctcgcgatatcattcgcaaaagattcctctttcttgtttatgggtcggctgctagaaggatttggagtcggtgtaatatcgtatacagtaccggtttatattgcagaaatcgctcctcaggatcagaggggagctcttggttctgtcaatcagctctccgtcacgattggtatattgcttgcctacttgtttggcatgtttgttccctggagaattcttgctgttctaggcattttaccttgttcaatcctgattcctggactgttctttgtgcctgaatccccaaggtggttggcaaaaatggggaagatggaggattttgaatattcattgcaagttctgagaggatttcagacagatatcacagcagaagtaaatgaaataaagagatcattagcatcatcgaggaggaggacaaccataaggttcgctgatatcaaacagaagagatacagtgttccccttgtgataggaatcggtctccttgtcctgcagcagctaagtggtgtcaatggcattctattttatgctgcgagcatcttcaaagctgctggtattacaaacagtaatctagcaacatttggtttaggggctgttcaggtgattgctactggagtgacaacctggttgactgacaaagctggtcgaaggcttcttctcattatttccaccacaggaatggtcattactcttgttattgtttctgtgtcattttttgtgaaggacaacatagctgctggttcgcacttatactctgtaatgagtatgctttcactggctggacttgtggcatttgtgattgcattttctcttggcttgggagcgattccgtggatcattatgtctgagatccttcctgttaacatcaagagccttgctggaagtgttgcgaccctggcgaactggctgacagcatgggccattacaatgacggcaagcctgatgttgaactggagcagtggaggaacatttgctatctacgccgtcgtgtctaccatggccctcattttcgtgtgcttgtgggtgcctgagaccaagggaagaacgctagaggaaatcgccttctcattccgctga

SEQ ID NO: 12169 - protein, 506 aa, Zea mays; identical to SEQ ID NO: 4785

SEQ ID NO: 12170 - DNA, 1488 bp, Hordeum vulgare
  CDS (1)..(1488)
atggcgtccaagggcgagagggatgtggagatccacgtctcctccccggcgcccgacgaccgcgacgccgccaggcccttgctgcccgccgcctgcgaggcctactccgtctccgccgcaatcctacccttcttcttcccagctctgggtgggcttctctatggctatgacatcggggcaacatctggtgccaccatatcgctcaagtcctccacatccagtggtacaacatggtacgacctgtcatcagtgcaaactggcctcgtggtcagcggctcactctacggtgctttgatcggatccgccacggcattcaccgttgcggattttctaggaaggcgcagagagcttgttgtttcttctatcatgtatttggttggggctcttctcacagcagtggcccctaacttccttatcatggtggttggtcgctttttatatggcataggaattggattggcaatgcatgctgctccaatgtatattgctgagactgctccaagtcagattagaggcatgctcatttctctcaaggagttctttattgttcttgggatgcttcttggttatatagtgggcaatctctttgttgaagtgatttctggttggcgctacatgtatgccgccagtgctccgatatgcgtcattatgggcatcggaatgtgctggttaccttgttcacctaggtggcttctgttatgtgccacacaaggaaaaggagatctgcgggagacaaaagaaaatgctacacgttgcttatgtcgattgaggggtcaagcgtcacctgatttggtttcggagcaggttaatttgattctggaagaactctcatacgttggtgaagagaaaaaagcaggcttcagtgagatctttcaaggaaagtgtctcaaagcaatgataattggatgtggcttggtgttctttcagcaggtcactggccaaccaagtgtgctatattatgctgcgacaatttttcagagtgctggattctctggagcatctgatgccactcgtgtatcaattcttcttggcttgctgaagctgattatgactggagttgcggttcttgtggttgacaaacttggtagaagaccattactaattggtggtgttagtggaattgctgtctccctattcttattgtcttcatactataccttgtttacgggtgctccttatgtggctgtaatagcacttctactgtatgttggctgctaccagttatcatttggtcctattggctggcttatgatttcggaggttttcccgctgaaactgcgtggccgtggattgagtgttgctgtccttgtgaacttcgcctccaatgcgcttgtcacttttgctttctcccctctagaggacttgattggcactggggttctctttgcttcgttcggggtgattgcggtggcgtctctcgcattcatattttgcattgtgcccgaaacaaaagggctcaccctggaagaaatcgaagccaaactgtag

SEQ ID NO: 12171 - protein, 495 aa, Hordeum vulgare; identical to SEQ ID NO: 4781

SEQ ID NO: 12172 - DNA, 1512 bp, Brassica napus
  CDS (1)..(1512)
atggggtttgatgccgagaaacaatcgatcgcttctcttggacagattggtgattcatcttcaggtgagattagctcagacaaacaacctctgatcaaagagaaccaccacagcccagaaaactactctgttcttgcagccatccccccgtttctctttccagctcttggagcgttgctttttggttacgagattggtgccacttcttgtgcaaccatctctattaagtcgcctaagctaagtggaatctcatggtacaacttgtctccagtggatgttggtatcattactagtggctcactgtacggtgccttaattggatccattgtggcatttagtattgctgacactataggaagaagaaaggagctgatcttggctgcactcttatatcttgttggagccattgtgactgcactagcacctgtcttctatgccctgataattggacgccttatgtatggcatcgggattggactgacaatgcacgcagctccaatgtacattgcagagactgcaccaagtcagatacgtggaaggatgatatcactaaaagagttctcaaccgtcattgggatggttggaggttatggaataggtagcctctgggttacggttacatctgggtggcgttacatgtacgcaacgatcatccctgtgccagttatcatgggaattggaatgtgttggctaccagcatcccctaggtggcttttactgcgctctctccaaggtaaagggaacgtggagagacttcaacaggcggcaatcaagtctcttcgccgccttagagggtctgtggtagttgactcagccgctgaacaagtgaacgagatcttggctgaactttcctctgtgggcgaggataaagaagctacacttggtgaaatgtttcaagggaaatgcttgaaggctctcactatagcaggaggtttagtcttgttgcaacagataactgggcaaccaagtgtactttattatgcaccatcaatactgcagactgctggcttctctgctgcagctgatgcaacacggatctcaattctactcggtctattgaagttgattatgacaggagtagctgttgcagttatcgacagacttggaaggagacctttgcttcttggtggtgttggtggcatggttgtctcattattcctactggggtcatactacatctttttcagcgccgcaccagttgtcgctgtggttgcgctgctgctctatgtgggctgttaccagctatcctttggtccgattggttggctgatgatttcagagatatttcccctaaaattaagaggtagaggaatcagcatagcagtgcttgtgaatttcggcacaaacgccctcgtgacattcgctttctcacccctaaaggagctgtttggagctggagtattgttctgtggatttggagtgatatgtgtactgtctctcttcttcatatacttcattgtgcctgagacaaagggtctcactcttgaagagattgaagccaaatgtctctaa

SEQ ID NO: 12173 - protein, 503 aa, Brassica napus
MGFDAEKQSIASLGQIGDSSSGEISSDKQPLIKENHHSPENYSVLAAIPPFLFPALGALLFGYEIGATSCATISIKSPKLSGISWYNLSPVDVGIITSGSLYGALIGSIVAFSIADTIGRRKELILAALLYLVGAIVTALAPVFYALIIGRLMYGIGIGLTMHAAPMYIAETAPSQIRGRMISLKEFSTVIGMVGGYGIGSLWVTVTSGWRYMYATIIPVPVIMGIGMCWLPASPRWLLLRSLQGKGNVERLQQAAIKSLRRLRGSVVVDSAAEQVNEILAELSSVGEDKEATLGEMFQGKCLKALTIAGGLVLLQQITGQPSVLYYAPSILQTAGFSAAADATRISILLGLLKLIMTGVAVAVIDRLGRRPLLLGGVGGMVVSLFLLGSYYIFFSAAPVVAVVALLLYVGCYQLSFGPIGWLMISEIFPLKLRGRGISIAVLVNFGTNALVTFAFSPLKELFGAGVLFCGFGVICVLSLFFIYFIVPETKGLTLEEIEAKCL

SEQ ID NO: 12174 - DNA, 1389 bp, Brassica napus
  CDS (1)..(1389)
atggcgggagataataatatggagaaaggattactactggcaaataaggaagagacggcaagaacaactctgcttcttgtcttctccaccttcatcattgtctgcgcctctttcacctttggcgtttccgcgggatatactgcagatacaatgtcctccattatgacagacttggacctttctctagcacaattttcactgtttggttcactcatgacatttggaggaatgatcggtgccatattcagcgccaaagctgcatctgccttgggtaataaaatgacgttgtggcttgccgatttattctgcataactggttggcttgcaattgcactagccaaggaaatcgttttgctcgatttaggaagattttttgttggaattggagttggtctcattagctatgtggttcctgtatatgttgcagagataacacccaagcatattagagacgcttttacatttagcaatcagttgttgcaaaactgtggagtagcaatcgcatattactttggaaatttcttgtcatggagaagtctagccttaatcggtattattccatgtgggatacaagttattggtttgttcttcatacctgagtctccaagatggctggcgaaaaaaggtcgcgatgaagaagttgaagttgttcttcaaaaattaagagggaaaggacacgatattatgttagaagctcgcgcaatcaagatttccgtagaagtttcaaaacaaaattcgaataccagcattcgtagtcttttcagaaagagatatgctcatcaacttacaatcggcataggtttgatgcttctgcaacaattatgtggaatgtcaggaataggctcttatggaagcactctttttgaacttggcggatttcctgctcggattgggatgacggtgttgtctcttatcgtcgtaccaaaatctttactgggtttaatcctcgtggatcgctgggggagacgaccacttcttatggcttcagcatttggattatgcttaagctggattacattggcggtagcttttggagttaaagatgttcccgagattcaaaacattactccagttttcactttcatcggaatattgtcattcacgatgatgtttgcatttggaatgggagcgttgccatgggttataatgtctgagatatttccaatggatataaaggtgttagcagggagtttagtgaccatagccaattggttcactggttggattgccaactattgtttcaattttatgttggtttggagcccagccggaacttttattatatcagcaatagtttgtggagtaacaattgtattcacgtggtgtttggtgccagagactcaaggattaactttagaagaaatccaactatcatttgctagtacttaa

SEQ ID NO: 12175 - protein, 462 aa, Brassica napus
MAGDNNMEKGLLLANKEETARTTLLLVFSTFIIVCASFTFGVSAGYTADTMSSIMTDLDLSLAQFSLFGSLMTFGGMIGAIFSAKAASALGNKMTLWLADLFCITGWLAIALAKEIVLLDLGRFFVGIGVGLISYVVPVYVAEITPKHIRDAFTFSNQLLQNCGVAIAYYFGNFLSWRSLALIGIIPCGIQVIGLFFIPESPRWLAKKGRDEEVEVVLQKLRGKGHDIMLEARAIKISVEVSKQNSNTSIRSLFRKRYAHQLTIGIGLMLLQQLCGMSGIGSYGSTLFELGGFPARIGMTVLSLIVVPKSLLGLILVDRWGRRPLLMASAFGLCLSWITLAVAFGVKDVPEIQNITPVFTFIGILSFTMMFAFGMGALPWVIMSEIFPMDIKVLAGSLVTIANWFTGWIANYCFNFMLVWSPAGTFIISAIVCGVTIVFTWCLVPETQGLTLEEIQLSFAST

SEQ ID NO: 12176 - DNA, 1644 bp, Brassica napus
  CDS (1)..(1644)
atgcagtcgtcaacgtatacggttaaagcaaacgccgcgtttgcgtttcagcgacggaccttctctaacctcctcaacagatccgccactaccactaccggaagccgcttctcgccgctcaacctccacctccactgctctgcttcgaaagccatgggagcgaagctcgctcgcgccgagaacgggatccaaaccgttatgaatctctcttccgtcaaagctcgatccgtcagagcacaggcctcctctgttggtggtggtggtgatgaggaagaagctgtacctctgagatccgaatcaaatagctccggcaccgttttgccgttcgttgctgttgcttgccttggtgctatattgtttggctatcaccttggggttgttaacggtgctcttgagtatcttgctaaggatcttggtattgctgataatactgttcttcaaggatggatcgttagcgcgctgcttgctggtgcaacggttggttcattcaccggaggtacattagctgacaagtttggacgaacaagaacgtttcaattggatgctatcccgcttgccattggagctttcttatgtgcaacagctcagagtgtgcaaaccatgattgtgggacgtctgcttgcaggaattggaattgggatctcatcagcgattgtgccactttacatatccgagatatccccaactgaaatccgtggagcacttggatctgtgaaccagttgttcatatgtataggaatactcgcagccttgatagctggattaccccttgcagcaaatcctctatggtggaggacgatgttgggtgttgctgtcatcccttccgttctattagccataggaatgggtttttctccagaaagcccaaggtggcttgttcagcaaggaaaagtctctgaagctgaaaaggcgatcaaaactctgtatggtaaagaaaaagtcgtcgagctagtgcgtgacttatcaacctctggccaaggtgtttctgagccagaggcaggatggtttgatctattcaacagccgctattggaaagttgtgagcgtaggtgcggctctctttttgtttcaacagttagctgggataaacgcagtggtgtactactctacatcagtgttccgtagcgccggtatccaatctgacgttgcagccagtgctctcgttggagcatcaaacgtctttggcactgctgttgcttcgtccttgatggacaaaatgggaaggaaaagtcttttactcataagcttcggtggaatggctttgtcgatgcttttgctctctttatccttcacatggaaggctcttgctgcatattctggcacccttgccgttgtaggaactgttttatatgtgctgtcattctcacttggtgctggcccggttccggctcttctccttccagagatattcgcatcccggatcagagcaaaagccgttgctctttccctcggaatgcactggatatcaaactttgtgattggtctctacttcctaagcgttgtgactaaattcggaatcagcagtgtctacttgggtttcgcggcagtatgtgtccttgcagtcatctacattgcaggaaacgtggtcgagactaaaggacggtcacttgaggaaatagagcttgctcttaactccggagcttga

SEQ ID NO: 12177 - protein, 547 aa, Brassica napus
MQSSTYTVKANAAFAFQRRTFSNLLNRSATTTTGSRFSPLNLHLHCSASKAMGAKLARAENGIQTVMNLSSVKARSVRAQASSVGGGGDEEEAVPLRSESNSSGTVLPFVAVACLGAILFGYHLGVVNGALEYLAKDLGIADNTVLQGWIVSALLAGATVGSFTGGTLADKFGRTRTFQLDAIPLAIGAFLCATAQSVQTMIVGRLLAGIGIGISSAIVPLYISEISPTEIRGALGSVNQLFICIGILAALIAGLPLAANPLWWRTMLGVAVIPSVLLAIGMGFSPESPRWLVQQGKVSEAEKAIKTLYGKEKVVELVRDLSTSGQGVSEPEAGWFDLFNSRYWKVVSVGAALFLFQQLAGINAVVYYSTSVFRSAGIQSDVAASALVGASNVFGTAVASSLMDKMGRKSLLLISFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAAVCVLAVIYIAGNVVETKGRSLEEIELALNSGA

SEQ ID NO: 12178 - DNA, 1524 bp, Brassica napus
  CDS (1)..(1524)
atggaagatcaggtcatctccagcaagaatccggatcccgtcgatcagaagccgaccaatgaaaagccacccggagttaatagatacgctcttcagtgtgctattgtcgcctccatcgtctccatcatctttggttacgatactggtgttatgagtggagcaatggtgtttatagaagaagagctaaagacaaacgaagttcagatcgaagttctcaccggaatcctcaacctttgtgcccttgtcggatcactactcgccggaagaacgtcggacataatcggacgtcgttacacaatcgtcttggcctcaatactcttcatgttaggctcaatactaatgggctggggtccaaattatcccgttctcctaaccggtagatgcacagccggtctaggagtcggttttgctctaatggttgctccggtttactcagccgagatagcaaccgcttcacacagaggactcttagcttctctacctcatctttgcatcagtatagggattttactaggttacctagtcaattacttcttctccaagctaccaatgcatatcggttggagactgatgctcggcatagctgcgatcccgtcgctagtgctagcgttagggatcttgaaaatgccggaatctccacggtggttgatcctacaaggccgtctcggagagggcaagaggatactggacttggtgtcgaactcgcctgaagaggcggagatacggtttcaagacatcaaaaccgctgccggaatcgacccaaagtgcgaagatgaagtggtgaagatggagaacaagaagactcacggtgaaggagtttggaaagagctaatcctaagaccaacacctgccgtaagacgagttcttttgactgcgttagggattcatttcttccagcacgccacgggtatcgaagccgtgcttttatacggtccgaagatctttaagagggcagggatcacggctaaagacaagcttttcttggtcacaatcggtgtcggaatcatgaagacgacgtttattttcacagcgactttcttgcttgacaaggtaggtcggaggaagcttttgttgaccagcgttggaggaatggtttgtgcgttgacgatgttagggtttgggctcacgatggcacagaactctggcgggaaactagcttgggctttggtattaagcatagtttctgcttatagttttgtagcggttttctctattgggcttgggccgataacttgggtgtacagctctgaggtgttcccgttgaagcttagggcgcaaggagcgagtctcggcgttgcggtgaatagagtgatgaatgctacggtgtccatgtcgtttttgtcgctgactagggcgataacaaccggaggagctttctttatgtttgctggagttgcggcggtggcgtggaacttcttcttcttcctaatgcccgagacgaaaggtaagtcgcttgaagagatcgaagcgctttttcaaagagatggtgacaataaaacaaaaggagagaacgtcaccgtttaa

SEQ ID NO: 12179 - protein, 507 aa, Brassica napus
MEDQVISSKNPDPVDQKPTNEKPPGVNRYALQCAIVASIVSIIFGYDTGVMSGAMVFIEEELKTNEVQIEVLTGILNLCALVGSLLAGRTSDIIGRRYTIVLASILFMLGSILMGWGPNYPVLLTGRCTAGLGVGFALMVAPVYSAEIATASHRGLLASLPHLCISIGILLGYLVNYFFSKLPMHIGWRLMLGIAAIPSLVLALGILKMPESPRWLILQGRLGEGKRILDLVSNSPEEAEIRFQDIKTAAGIDPKCEDEVVKMENKKTHGEGVWKELILRPTPAVRRVLLTALGIHFFQHATGIEAVLLYGPKIFKRAGITAKDKLFLVTIGVGIMKTTFIFTATFLLDKVGRRKLLLTSVGGMVCALTMLGFGLTMAQNSGGKLAWALVLSIVSAYSFVAVFSIGLGPITWVYSSEVFPLKLRAQGASLGVAVNRVMNATVSMSFLSLTRAITTGGAFFMFAGVAAVAWNFFFFLMPETKGKSLEEIEALFQRDGDNKTKGENVTV

SEQ ID NO: 12180 - DNA, 1569 bp, Brassica napus
  CDS (1)..(1569)
atggctggcggtggattcgtagtcggagatggccaaaaggcttatcccggcaaactcactccctttgttctcttcacttgcgtcgtcgctgccatgggtggtctcatcttcggatacgatatcggaatctctggtggtgtgacgtcgatgccgtcttttctccgtcgatttttcccgtcggtttaccgtaaacagcaagaagacgcgacaacgaatcagtactgtcaatacgatagtcctaagcttacgctgttcacttcgtcgttgtatttggcagcgctaatttcgtcgctggtggcttccaccgtgacgaggaagttcggacgacggctctcgatgctcttcggtggtatactcttctgcgccggagctctcatcaatggttttgctaaacacgtttggatgctcatcgttggtcgtatcttgctcggttttggtatcggtttcgctaatcagtctgtgccactatacctatctgaaatggctccatacaaatacagaggagcgctaaacatcggcttccagctttcaatcacaatcggaatcctcgtagccgaagtgctcaactacttctttgccaagatcaaaggaggctggggatggcgtctcagtctcggcggtgctgtggtccctgccctgatcatcacactcggctccctagtccttcctgacactcccaactcaatgatcgagcgaggccagcacgaggaggccaaaaccaagctcagacgtatccgtggcgtcgatgacgttagccaagagttcgacgatttagtcgcagctagtaaagagtctcagtcgatagagcacccgtggacgaacctcctccgccgtaaataccggccgcatctcaccatggccattatgattccattctttcagcagctcaccggaatcaatgtgattatgttttacgctcctgttttgttcaacaccattggtttcacgaccgacgcttctctcatgtccgccgtggtcactggctcggtcaacgtcgctgccacgcttgtgtcgatctacggtgttgacaagtggggacgtaggtttctctttcttgaaggcggtacacaaatgcttatatgccaggctgtggttgctgcatgcatcggggccaagttcggggtagacgggacccctggtgagataccaaagtggtatgctatagtggttgtaacgtttatatgcatctatgtggcgggtttcgcatggtcatggggtccgctagggtggttagtacctagtgagatcttccccttggagataaggtcagccgctcagagtatcacggtgtcagtgaacatgatcttcacgttcataatcgcgcagatcttcctgacgatgctttgccatttgaagtttgggctgttccttgtattcgccttcttcgtgatagtgatgtcgattttcgtctacatattcttgccggagacgaaagggattccgattgaggaaatgggacaagtgtggaggtcacattggtattggtcaaggtttgtggaggatggtgagtatgggaatggagttgagatgggcaagagcagcagcaaccaaggaactaaacatgtttag

SEQ ID NO: 12181 - protein, 522 aa, Brassica napus
MAGGGFVVGDGQKAYPGKLTPFVLFTCVVAAMGGLIFGYDIGISGGVTSMPSFLRRFFPSVYRKQQEDATTNQYCQYDSPKLTLFTSSLYLAALISSLVASTVTRKFGRRLSMLFGGILFCAGALINGFAKHVWMLIVGRILLGFGIGFANQSVPLYLSEMAPYKYRGALNIGFQLSITIGILVAEVLNYFFAKIKGGWGWRLSLGGAVVPALIITLGSLVLPDTPNSMIERGQHEEAKTKLRRIRGVDDVSQEFDDLVAASKESQSIEHPWTNLLRRKYRPHLTMAIMIPFFQQLTGINVIMFYAPVLFNTIGFTTDASLMSAVVTGSVNVAATLVSIYGVDKWGRRFLFLEGGTQMLICQAVVAACIGAKFGVDGTPGEIPKWYAIVVVTFICIYVAGFAWSWGPLGWLVPSEIFPLEIRSAAQSITVSVNMIFTFIIAQIFLTMLCHLKFGLFLVFAFFVIVMSIFVYIFLPETKGIPIEEMGQVWRSHWYWSRFVEDGEYGNGVEMGKSSSNQGTKHV

SEQ ID NO: 12182 - DNA, 1428 bp, Brassica napus
  CDS (1)..(1428)
atggtggcggtgaaagaagaaagaagcatagaagaagggcttctaaagctcaagaaccaaaacgacacttcacaatgtcgtattactgcctgtgttatcctcagcactttcgtagccatatgcggctccttctcctttggagttgctgttggttatacttcaggtgctgagataggaatgataaaagacatgggcctctctatcgcagaattttcagcatttggctcattctccacgttgggagcaacagtcggtgcgctgttcagcggtaaaatggcgatcatgctaggaagaaaaggaacaatgtgggtctccaatatactctgcatcactggttggctatccatcgctttcgctaaggatgtgttgtggctgaacatcggaagaatatcatcagggataggaatcggcttgattagctacgtggtaccggtctacatagcagaaattacgccaaaacatgttcgcggcacatttaccttttcaaatcagcttcttcaaaacgctggactcgccatggtttatttttgcgggaatttcatcaactggaggatgatggctttactaggtgctttaccatgcgtcattcaagcaatcggtttattcttcgtaccagaatccccaagatggctggcaaaagttggtacggaaaaagaactagaaaattcactgcttcggcttagagggagagatgctgatatctcaaacgaagcctcagagattcaacttatgaccaaaatgctagaaagtgattcaaagtcaagcttcactgatttgttccagagaaagtatagacacactctcgtggtaggaatcgggctaatgttaatacaacaattctcaggaagtactgctgtaatatcttatgcaaacaccatttttagaaaagctggtttttcggtggccattggatcgacaatgttaggcatattcatgataccaaaagccatgattggtctaattcttgtagataaatggggcagacggcccctcttgttgacttcagcctctgggatgaccataactagcatgcttattggactcgccttcacattacagaaaatgcaattacttccagaactaactccagtattcacgtttatatgcgttacgctgtatattgcaacttatgcaataggcgtgggaggcctcccttgggtaataatgtcagagatatttccaataaatataaaagtaacagcagggagtttagttacgttagcctcatggtcaagtagttccatcgtcacttacgctttcaactttctattcgaatggagcactcaaggaacattttacatattcggggctatcggaggaggagcgttgctttttatttggctgctcgttccggaaacgaaaggattatcacttgaagaaatacaaatttcgcttacaggtcagcccgatgagataagccatatgtag

SEQ ID NO: 12183 - protein, 475 aa, Brassica napus
MVAVKEERSIEEGLLKLKNQNDTSQCRITACVILSTFVAICGSFSFGVAVGYTSGAEIGMIKDMGLSIAEFSAFGSFSTLGATVGALFSGKMAIMLGRKGTMWVSNILCITGWLSIAFAKDVLWLNIGRISSGIGIGLISYVVPVYIAEITPKHVRGTFTFSNQLLQNAGLAMVYFCGNFINWRMMALLGALPCVIQAIGLFFVPESPRWLAKVGTEKELENSLLRLRGRDADISNEASEIQLMTKMLESDSKSSFTDLFQRKYRHTLVVGIGLMLIQQFSGSTAVISYANTIFRKAGFSVAIGSTMLGIFMIPKAMIGLILVDKWGRRPLLLTSASGMTITSMLIGLAFTLQKMQLLPELTPVFTFICVTLYIATYAIGVGGLPWVIMSEIFPINIKVTAGSLVTLASWSSSSIVTYAFNFLFEWSTQGTFYIFGAIGGGALLFIWLLVPETKGLSLEEIQISLTGQPDEISHM

SEQ ID NO: 12184 - DNA, 1527 bp, Brassica napus
  CDS (1)..(1527)
atggccgttgttgtatctgctaacgggaatggtccggcttttgaagccaagatgactgtatatgtctttgtctgcgttctgattgcagctgtcggcggtttgatcttcggttacgacatcggaatttccggtggagtgacggcgatggatgatttcttgaagaagtttttccctacggtgtgggagaggaagcagcacgctcatgagaacaattactgcaagtatgataaccagcacttgcagctattcacatcgtctctttacctagccgcactcgtggccagcttcttggcttcggccgtctgttccaaacttggaaggaagcccactatgcagtttgcttctgtctttttcttgatcggtgtcgggctagccgcaggagctgataacatcgtcatgttgatcattggaagaatcttacttggcttcggtgtaggctttggcaatcaggcagtgccgcttttcttatccgagattgctcctgcacagctcaggggaggtctcaatattgtattccaactcatggtaacaattggaatactaatagccaaccttgtcaactacttcactgccaccgttcaccctaacggatggcgaatcgccctcggtggagccgcaatccccgcggttatcctcctcttgggttcactgatcatctgtgagacccccacgagcctcatagagcgcaacaaaaacgaagaaggcagagaaactctaaggaaaatcagaggagttgaagatataaatgatgagtatgaatctatcgtccatgcgtgcgagattgcgagtcaagttaaagacccttacaggaaactgttgaaaccagcgagtcgtccacctttaatcattggaatgcttctacagcttttccagcagtttagtggaatcaatgccattatgttctatgcaccggtcttgttccagaccgttggatttggaagtaacgcagctcttctctctgcggttatcacgggaagcatcaacgttcttagtacgtttgtagggatctatcttgtcgatagaactggccggaggttccttcttttacaatcttccgttcacatgctcatttcccagatgatcattggaatcatcctagcaaaagacttgggtatcacgggaacgctcgggaaggcacaagccatggtggttgtggtctttgtgtgcgcttacgtgatgggattcgcgtggtcatggggaccattaggatggctaattcctagcgagacgtttcctctagaaactcgaagtgcagggttcgctgttgcagtctcgtgcaacatgttattcaccttcgtgatcgcgcaggctttcttgtcgatgctttgtgggatgagatcgggaatattcttcttcttcagcgcttggatcattgtgatgggactgtttgctttgttctttataccggagactaaaggtgtggccattgatgatgtgagggagagagtgtggaagccacactggttctggaaaaggtatatgcttgctgaggatgatcatcaagatgtggagaagagaactgaatga

SEQ ID NO: 12185 - protein, 508 aa, Brassica napus
MAVVVSANGNGPAFEAKMTVYVFVCVLIAAVGGLIFGYDIGISGGVTAMDDFLKKFFPTVWERKQHAHENNYCKYDNQHLQLFTSSLYLAALVASFLASAVCSKLGRKPTMQFASVFFLIGVGLAAGADNIVMLIIGRILLGFGVGFGNQAVPLFLSEIAPAQLRGGLNIVFQLMVTIGILIANLVNYFTATVHPNGWRIALGGAAIPAVILLLGSLIICETPTSLIERNKNEEGRETLRKIRGVEDINDEYESIVHACEIASQVKDPYRKLLKPASRPPLIIGMLLQLFQQFSGINAIMFYAPVLFQTVGFGSNAALLSAVITGSINVLSTFVGIYLVDRTGRRFLLLQSSVHMLISQMIIGIILAKDLGITGTLGKAQAMVVVVFVCAYVMGFAWSWGPLGWLIPSETFPLETRSAGFAVAVSCNMLFTFVIAQAFLSMLCGMRSGIFFFFSAWIIVMGLFALFFIPETKGVAIDDVRERVWKPHWFWKRYMLAEDDHQDVEKRTE

SEQ ID NO: 12186 - DNA, 1524 bp, Brassica napus
  CDS (1)..(1524)
atggaagatcaggtcatctccagcaagaatccggatcccgtcgatcagaagccgaccaatgaaaagccacccggagttaatagatacgctcttcagtgttctattgtcgcctccatcgtctccatcatctttggttacgatactggtgttatgagtggagcaatggtgtttattgaagaagatctaaagactaacgaagttcagatcgaagttctcaccggaatcctcaacctttgtgcccttttcggatcattactcgctggaagaacatcggacataatcggacgtcgttacacaatcgtcttagcttcaatactgttcatgttaggttcagtattaatgggctggggtccaaattatcccgttctcctaaccggtagatgcacagccggtctaggcgtcggttttgctctaatggttgctccggtttactcagccgagatagcaaccgcttcacatagaggactcttagcttctcttcctcatctttgcatcagtatagggattttactaggttacctagtcaattacttcttctccaagttaccaatgcatatcggttggagactgatgctcggcatagctgcgatcccctcgctagtgctagcgttagggatcttgaaaatgccggagtctccacgctggttggtcttacaaggccgtctcggagaagccaagaagatactgaagttagtatcgaactcgcctgaagaagctgagatacggtttaaagacatcaaaaccgctgctggaatcgacgcaaattgtgaagatgaagttgtgaagatggagaacaagaagactcacggtgaaggagtgtggaaagagctaatcttaagaccaacacctgccgtacgacgagttcttttgactgcgttagggattcatttcttccagcacgccacgggtatcgaagccgtgcttttatacggtccgaagatctttaagagggcagggatcacggctaaagacaagcttttcttggtcacaatcggtgtcggaatcatgaagacgacgtttattttcacggcgactttcttgctcgacaaggtaggtcggaggaagcttttgttgaccagcgtcggaggaatggtttgcgcgttgacgatgttgggatttgggcttacgatggcccagaactcaggcgggaagctagcttgggctttggtgctcagcatagtttcagcttacagtttcgtcgcggttttctctattgggcttggcccaataacttgggtctacagctctgaggtgttcccgttgaagcttagggcgcaaggagcgagtctcggcgttgcggtgaatagagtgatgaatgctacggtgtccatgtcgtttttgtcgctgactagggcgataacaaccggaggagctttctttatgtttgctggagttgcggcggtggcgtggaacttcttcttcttcctaatgccggagacgaaaggtaagtcgcttgaagagatcgaagcgctttttcaaagagatggtgacaataaaacaaaaggagagaacgtcaccgtttaa

SEQ ID NO: 12187 - protein, 507 aa, Brassica napus
MEDQVISSKNPDPVDQKPTNEKPPGVNRYALQCSIVASIVSIIFGYDTGVMSGAMVFIEEDLKTNEVQIEVLTGILNLCALFGSLLAGRTSDIIGRRYTIVLASILFMLGSVLMGWGPNYPVLLTGRCTAGLGVGFALMVAPVYSAEIATASHRGLLASLPHLCISIGILLGYLVNYFFSKLPMHIGWRLMLGIAAIPSLVLALGILKMPESPRWLVLQGRLGEAKKILKLVSNSPEEAEIRFKDIKTAAGIDANCEDEVVKMENKKTHGEGVWKELILRPTPAVRRVLLTALGIHFFQHATGIEAVLLYGPKIFKRAGITAKDKLFLVTIGVGIMKTTFIFTATFLLDKVGRRKLLLTSVGGMVCALTMLGFGLTMAQNSGGKLAWALVLSIVSAYSFVAVFSIGLGPITWVYSSEVFPLKLRAQGASLGVAVNRVMNATVSMSFLSLTRAITTGGAFFMFAGVAAVAWNFFFFLMPETKGKSLEEIEALFQRDGDNKTKGENVTV

SEQ ID NO: 12188 - DNA, 1683 bp, Glycine max
  CDS (1)..(1683)
atggcatcaacttctctcttcaacttcagactccctctgttcaacttcaacccactgcaccatcgacggataaagaggccaaaatctctgctctcctctcctcgcaacagtccacgcctcgtttcttccattaacgaccatttggcgctcacacgtgtcacatatccgcttctccaatctcactctgctccgaagcgcagattccacgttggtgtacagaaagagtattctgatggggaaagctctgagtcgattgtttctgacgctacataccaagaggaattttcctggtcttctgtagttcttccgtttctattccccgcattgggtggcttgttatttggttatgatattggtgccacctctggcgctacaatctcactgcagtcacctgagcttagcggtatatcatggttcaatctttctgccattcagcttggactagtggttagtggttccctatacggggctcttcttggctcgcttgttgcatttgcgatagctgatttccttgggaggaagaaacaactcattactgcagcactgttgtatttgtttggtggtgtgattactgcctatgcaccagaacttggtgttctcttaccaggaaggctgatttatggacttggtataggtttgggcatgcatggggctcctttatatattgcggagacttgcccatcacaaatccgtgggacattagtatcattaaaagaactcttcattgtccttgggattctgcttggttattttgtgggaagctttctgattgagacagttggaggatggcggttcatgtacggatttagtgctccagttgctgtattaatggggcttggaatgtggactctccccaattctccacggtggttgcttctcagagcagtgcaaggaaaaggttcttttcaagatttgaaggaacaggcaattgcttccctgagcaaattaaggggccgaccacctggtgacaaagaatctgagaagcaaatagaagagacccttgtctcattgaaatctgtctatgcagaccaggaatccgaggggaatttcttagaggtgtttcagggtcccaatctgaaagctttcataattggtggggggctagtcctatttcaacagataacaggtcaaccaagtgttctgtattatgcaggcccaattcttcagagtgctggattttctgctgcatctgatgctacaaaagtttcagttgttattggcctattcaagttactaatgacttggattgctgtcctaaaagttgatgatttggggagaagacctctgctgattggaggtgtcagtggcattgccctttctctagttctcctttctgcttattataaatttcttggaggttttccacttgttgctgttggagctttacttctttatgttggttgctaccagatatcatttgggccaataagttggctaatggtatcagaggtcttcccacttcgcactagaggcaaggggattagtctggctgttcttaccaacttcgcttcaaatgctgttgttacctttgcattctccccgctaaaggagtttctaggagctgaaaatctttttctcctttttggggctattgctactctatcacttttgttcattatcttttctgttccagagacaaaaggcatgagtttagaagatatagaatccaaaatcttgaagtga

SEQ ID NO: 12189 - protein, 560 aa, Glycine max
MASTSLFNFRLPLFNFNPLHHRRIKRPKSLLSSPRNSPRLVSSINDHLALTRVTYPLLQSHSAPKRRFHVGVQKEYSDGESSESIVSDATYQEEFSWSSVVLPFLFPALGGLLFGYDIGATSGATISLQSPELSGISWFNLSAIQLGLVVSGSLYGALLGSLVAFAIADFLGRKKQLITAALLYLFGGVITAYAPELGVLLPGRLIYGLGIGLGMHGAPLYIAETCPSQIRGTLVSLKELFIVLGILLGYFVGSFLIETVGGWRFMYGFSAPVAVLMGLGMWTLPNSPRWLLLRAVQGKGSFQDLKEQAIASLSKLRGRPPGDKESEKQIEETLVSLKSVYADQESEGNFLEVFQGPNLKAFIIGGGLVLFQQITGQPSVLYYAGPILQSAGFSAASDATKVSVVIGLFKLLMTWIAVLKVDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIATLSLLFIIFSVPETKGMSLEDIESKILK

SEQ ID NO: 12190 - DNA, 1467 bp, Glycine max
  CDS (1)..(1467)
atggaccaggcgaccacgttcaacaaatatgcctttgcttgtgctgcagttgcttcaatggtatccatcatatctggctatgacacgggtgttatgagtggagcaatgatattcatcaaggatgacattggaatcagtgacacccaacaagaggttctagcaggaatcttgaacctatgtgcattgggggggtccttagctgcgggaagaacctccgattatattggtcgtcgctacacaatcttgttggcctcactcctcttcatggtgggtgcaattctcatggggtatggtccaaactatgcaattctaatgcttggaagatgcattggtggtgttggtgtaggctttgctctcatgatagcaccagtttactcagcagagatttcttctgcatcatcaaggggttttctaacctcgttacccgagctttgcatcggcattgggatcttacttgggtacatatcaaactactttttggggaaattgactttgaggctgggatggagattaatgcttggggtagcagcttttccctcgctggctttggccttggggattctggggatgccagagtccccaaggtggttgacaatgcaaggtcgcctaggggatgcaaagaaagtgttattgcgagtttccaacacggaacacgaggccaagcttcggtttagagaaataaaagttgcaatgaggattaatgattgtgatggtgatgacaacaatgtgaaaccttcttacaagtcacaaggggaaggggtgtggaaagaattgctggtgaggcccacaccggaagtgcgttggatgctaattgcggcagtggggattcacttctttgagcatgcaactggcattgaggcagtgatgttgtatagtcccagaatcttcaagaaagctggtgtcacaagcaaggacaagcttcttcttgcaacggttggtattggcctcacaaagatcattttcttggtcatggctttgtttttgcttgacaaagttggtagaaggcgtcttttacaaatcagcactgggggaatggtttgtgggctcacacttttggggtttagtttgaccatggtggatcgttctagtgaaaagctcttgtgggctttgagccttagtattgtggccatttatgcttatgttgctttctttaatgttgggcttgggcctgttacttgggtttatgcgtcggagatttttcctttgaagttgagggcgcaaggggctagtataggagttgcggtgaatagaaccatgaatgctgtggtttccatgagttttatttcggtctacaaagcgatcactataggtgggagctttttcatgtttgctgggatatctatagtggcttgggtgttcttctactttttccttcctgaaaccaaaggtgtgcccttggaagagatggagatggttttcagcaaaaaatacagtgggaaaaatgtagcgatagaaactggtccatga

SEQ ID NO: 12191 - protein, 488 aa, Glycine max
MDQATTFNKYAFACAAVASMVSIISGYDTGVMSGAMIFIKDDIGISDTQQEVLAGILNLCALGGSLAAGRTSDYIGRRYTILLASLLFMVGAILMGYGPNYAILMLGRCIGGVGVGFALMIAPVYSAEISSASSRGFLTSLPELCIGIGILLGYISNYFLGKLTLRLGWRLMLGVAAFPSLALALGILGMPESPRWLTMQGRLGDAKKVLLRVSNTEHEAKLRFREIKVAMRINDCDGDDNNVKPSYKSQGEGVWKELLVRPTPEVRWMLIAAVGIHFFEHATGIEAVMLYSPRIFKKAGVTSKDKLLLATVGIGLTKIIFLVMALFLLDKVGRRRLLQISTGGMVCGLTLLGFSLTMVDRSSEKLLWALSLSIVAIYAYVAFFNVGLGPVTWVYASEIFPLKLRAQGASIGVAVNRTMNAVVSMSFISVYKAITIGGSFFMFAGISIVAWVFFYFFLPETKGVPLEEMEMVFSKKYSGKNVAIETGP

SEQ ID NO: 12192 - DNA, 1518 bp, Glycine max
  CDS (1)..(1518)
atggcaggagggtctttcacaacaggcactgtgagcaaggagagggcagagcagtacaaggggagagtcactgcttatgtcatcatctcttgcattgttgctgccacaggaggggctctctttggctatgatattggaatttcaggtggggttacatccatggatgactttcttatagagttcttcccctcagtatacagacagaaaaagcatgcccatgaaaacaactactgcaagtatgacaatcagggcctagcagcatttacctcttctctgtacattgctggtttagttgcatccctgatggcatcccctgtgacaagaaagtatggacgtcgagtaagtatcataggtggtggtatcagctttcttattggatcagctctgaatgcttcagctgttaacctgataatgttgatcttaggccgggttatgcttggtgttggcattggatttggaaatcaggctattcaattcggctcgtcagagatggcaccaacacaccttcgaggaggcctgaacatgatgtttcaagttgcaaccacttttgggattttcacagctaacatgatcaattttggaacacaaaagatcaagccttggggttggaggctgtccctaggcttggctgcagtaccagctcttttgatgactgtgggagggatatttcttcctgacactccaaatagcttaattgaacgaggattggcggaaaaaggaaggaagctgctggagaaaatccgaggaaccaaggaagttgatgcagagttccaagatatggttgatgcaagcgagttggcaaagtccataaagcacccatttcgtaacatccttgaaagaaggtacaggccagagttggtgatggcaatcttcatgcctacctttcagatcctgactggcataaattccattctcttctatgctccagtgctgtttcaaagcatgggatttggaggagatgcatcactcatctcttcagctttaaccggtggagttcttgctagttcaacattcatttccatagcaacagtagataggttgggcaggagagttcttcttgtcagtggtggactacaaatgatcacatgccaaatcatagtggccattattctaggggtcaagtttggagcagaccaagaattgtcaaaagggttttcaattttggtggttgtggtgatttgcctatttgttgttgcttttgggtggtcatggggtccacttgggtggacagtccctagtgagatatttccattggaaatccggtcagcagggcagggcatcacagttgctgtaaaccttctcttcactttcataattgctcaggcctttcttgctcttctctgctcattcaagtttgggatctttctcttctttgctggctggatcaccatcatgaccatatttgtttacctgttcttacctgaaaccaaagggattcccattgaggagatgtcatttatgtggaggaggcactggttctggaaaaggatttgcctcccaacagatggtagtatctga

SEQ ID NO: 12193 - protein, 505 aa, Glycine max
MAGGSFTTGTVSKERAEQYKGRVTAYVIISCIVAATGGALFGYDIGISGGVTSMDDFLIEFFPSVYRQKKHAHENNYCKYDNQGLAAFTSSLYIAGLVASLMASPVTRKYGRRVSIIGGGISFLIGSALNASAVNLIMLILGRVMLGVGIGFGNQAIQFGSSEMAPTHLRGGLNMMFQVATTFGIFTANMINFGTQKIKPWGWRLSLGLAAVPALLMTVGGIFLPDTPNSLIERGLAEKGRKLLEKIRGTKEVDAEFQDMVDASELAKSIKHPFRNILERRYRPELVMAIFMPTFQILTGINSILFYAPVLFQSMGFGGDASLISSALTGGVLASSTFISIATVDRLGRRVLLVSGGLQMITCQIIVAIILGVKFGADQELSKGFSILVVVVICLFVVAFGWSWGPLGWTVPSEIFPLEIRSAGQGITVAVNLLFTFIIAQAFLALLCSFKFGIFLFFAGWITIMTIFVYLFLPETKGIPIEEMSFMWRRHWFWKRICLPTDGSI

SEQ ID NO: 12194 - DNA, 1494 bp, Glycine max
  CDS (1)..(1494)
atggcatttgatcccgtgcaacccgtcgcaaagaaagcaaggtcaggtggtgagattgtgagtgcaagagagcctctgcttaatggggttcatgactctgaaagctattccgtctctgctgcaattctcccatttctcttcccagctttgggtggcctactatttggctatgatattggtgccacatcttcggcaaccatttccattcagtcaccaacactaagtggagtatcttggtacaagttgtcttctgttgaaattggtcttcttactagtggatcattgtatggtgccttaattggctccgtgttggccttcaatgttgctgacttcttaggtagaagaaaggagctgattggagctgcagtagtttatcttgttggagcccttgtaacagcattagctcctaattttcctgtattggtgcttgggagacttgtatttggcacaggaattggactggcaatgcatgctgctccaatgtacattgcagagacagctccaacaccaatacgtggacaactaatatctctaaaagagttctttatagtacttgggatggttgcaggatatggaattggtagcttgttcgtcgaaaccgtatctgggtggcggtatatgtatggagttagtagtcctgtggcaataatcatgggagttggaatgtggtggctcccagcttctcctagatggttacttttacgtgctatacagggaaaaggggatgttcagaattcaaaagacatagcaattcgtagtttgtgtcagcttcgaggtcaagctttttatgattcagttccttggcaagtagatgagattctggcagaactttcttatctaggtgaagaaaaagaagctacctttggagaactattccaaggaaaatgcttgaaagccctttggattggttcaggattggtcttgtttcagcagatcacagggcaaccaagtgtgctctactatgctggatcaatctttcagagtgcaggattctccggagcatctgatgcaacccgagtctctattctccttgggtttttcaagttgattatgactggagttgctgttgtcgttgttgataaacttggaaggaggcctttactacttgggggagtttcagggatagtgatctctttattctttctcggttcatattacattttcttggataattcaccagttgttgctgtaattggtctgctgttgtacgttggcagttatcagatttcctttggtccaattggttggttaatgatagcagagattttccccttgcgcctaagaggtcgaggactaagtatagctgtactcgtcaattttggtgcaaatgccctggtgacatttgctttttccccactgaaggcattattgggagctggaattttgttttacacattttgtgtaatagccgtggcatctcttgtattcatatactttgttataccagaaaccaaggggcttacactagaggagatcgaggccaaatgcctctag

SEQ ID NO: 12195 - protein, 497 aa, Glycine max
MAFDPVQPVAKKARSGGEIVSAREPLLNGVHDSESYSVSAAILPFLFPALGGLLFGYDIGATSSATISIQSPTLSGVSWYKLSSVEIGLLTSGSLYGALIGSVLAFNVADFLGRRKELIGAAVVYLVGALVTALAPNFPVLVLGRLVFGTGIGLAMHAAPMYIAETAPTPIRGQLISLKEFFIVLGMVAGYGIGSLFVETVSGWRYMYGVSSPVAIIMGVGMWWLPASPRWLLLRAIQGKGDVQNSKDIAIRSLCQLRGQAFYDSVPWQVDEILAELSYLGEEKEATFGELFQGKCLKALWIGSGLVLFQQITGQPSVLYYAGSIFQSAGFSGASDATRVSILLGFFKLIMTGVAVVVVDKLGRRPLLLGGVSGIVISLFFLGSYYIFLDNSPVVAVIGLLLYVGSYQISFGPIGWLMIAEIFPLRLRGRGLSIAVLVNFGANALVTFAFSPLKALLGAGILFYTFCVIAVASLVFIYFVIPETKGLTLEEIEAKCL

SEQ ID NO: 12196 - DNA, 1569 bp, Glycine max
  CDS (1)..(1569)
atggccggcggaggtttcaccagcggcggcggcgccggagatttcgaggccaaaatcactcccatcgtcatcatttcatgtatcatggctgccaccggaggtctcatgttcggctacgacgtcggcgtttcaggtggtgtgacgtctatgcccccgttcttgaagaagttttttccgacggtatacagaaagacagtggaagagaaaggactggacagtaattactgcaaatacgacaaccaaggattacagcttttcacgtcgtctctgtatctggctggtttgacttcgacgttctttgcttcatacacgactcgtaggttgggaagaaggctgaccatgttgattgctggggtattcttcatctgtggagttgtccttaatgctgctgctcaagaccttgccatgctcatcgttggcagaatcttacttggctgtggtgttggctttgctaatcaggccgtgccagtgttcctctctgagatagcaccttcaagaatacgaggagcattgaatatattgttccagctcaatgtcacaattggcattctatttgctaaccttgtcaactatggcaccaacaaaatcaaaggtgggtggggttggaggctatctcttgggttggctggtatcccagcagttctgctaacattgggagccttgttcgtggtggacacccccaacagtctgatcgaacgtgggcgcttggaagaaggaaaaacagtgcttaaaaagattcgcggcactgacaacattgaacttgagttccaggaattgcttgaggccagtcgtgtggctaaagaggtcaagcatccattcaggaatcttctcaagcgcaggaaccgaccccaacttgtcatttccgttgccctacagatattccagcaattcacaggcatcaacgcaatcatgttttatgccccggtgctgttcaacacgttaggattcaagaacgatgcatccctgtattctgctgtgataactggggctgtgaacgtgctctccactgttgtatcgatctactcagtggacaaagtgggacgtcgcattctgttgctggaagctggtgtgcagatgttcttgtctcaagtggtgattgcaatcatactgggaataaaggtgacggaccattctgatgacctttcaaaaggcattgcaattctggtggttgtgatggtctgcactttcgtgtcttcctttgcatggtcttggggtcctcttgggtggcttatccccagtgagactttcccattggagactcgttccgctggtcagagtgtcaccgtttgtgttaacctgctcttcaccttcgtcattgcacaagccttcctctctatgctctgccacttcaagtttggtatcttcttgttcttctctggctgggtcctcgtcatgtctgtcttcgtgcttttcctgttgcccgagactaagaatgtccccatcgaagagatgaccgagagagtgtggaagcagcattggttctggaagaggtttatcgatgatgccgcggatgagaaagtagcccatgtctctaatggtaatggatttgatccaacctccaggttgtaa

SEQ ID NO: 12197 - protein, 522 aa, Glycine max
MAGGGFTSGGGAGDFEAKITPIVIISCIMAATGGLMFGYDVGVSGGVTSMPPFLKKFFPTVYRKTVEEKGLDSNYCKYDNQGLQLFTSSLYLAGLTSTFFASYTTRRLGRRLTMLIAGVFFICGVVLNAAAQDLAMLIVGRILLGCGVGFANQAVPVFLSEIAPSRIRGALNILFQLNVTIGILFANLVNYGTNKIKGGWGWRLSLGLAGIPAVLLTLGALFVVDTPNSLIERGRLEEGKTVLKKIRGTDNIELEFQELLEASRVAKEVKHPFRNLLKRRNRPQLVISVALQIFQQFTGINAIMFYAPVLFNTLGFKNDASLYSAVITGAVNVLSTVVSIYSVDKVGRRILLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVAHVSNGNGFDPTSRL

SEQ ID NO: 12198 - DNA, 1536 bp, Glycine max
  CDS (1)..(1536)
atggctggtggaggagtagagattggaggaccaggaaaaagggctcatctttacgagcacaagttcagttggtatttcgtctatacatgcttcgttggggcccttggcggttctctctttggctatgatctcggtgtttcaggtggggtgacttcaatggatgatttcctgaaggaattcttcccaaaggtttacagaaggaagcagatgcatctgcatgaaacagactattgtaaatatgacgaccaagtgctgacactgtttacatcatctctttatttctcagcacttgtcatgacattctttgcttccttcttgacaagaaagaagggaagaaaggccagtatcattgtgggagcccttagcttcctggctggggctatcctcaatgccgcagccaagaacattgcaatgctaattattggcagagtccttcttggtggaggcattggatttggcaaccaagctgttccattgtatctttcggaaatggctccagctaagaaccgaggagcagtgaaccaactgtttcagttcacaacttgtgctggaatcttaattgcaaacctagtgaattactttactgaaaaaatccatccctatggatggaggatatctctgggtttggcaggtcttccagcatttgcaatgcttgttggaggtatttgttgtgctgagacaccaaacagccttgtggagcaaggaaggttggataaagcaaaacaagtattgcagagaattagaggtaccgagaacgttgaagccgaatttgaggatcttaaagaagccagtgaagaagcacaagctgttaagagcccgtttaggacactcctcaagaggaagtacaggccacaactgatcataggtgcattggggattccagcgttccagcagctaactggcaataactccatcctcttctatgcccctgtcatttttcagagcttgggctttggtgccaatgcttcactgttttcatcttttattaccaatggggctcttcttgttgccactgtcatctcaatgtttttggttgacaagtatggtagaagaaaattctttctggaagctggctttgaaatgatatgctgcatgattattacaggtgcagtcttggctgtgaactttgggcacggcaaagaaattgggaaaggagtgagtgcctttctggttgttgtgatcttcttgttcgttttggcatatgggagatcttggggtccccttgggtggttggttcccagtgagctcttcccattagagataagatcatctgcacagagtattgtggtctgtgtcaacatgatcttcactgcacttgttgctcaattgttcctcatgtcactttgccacctcaaatttgggatcttcttgctctttgcttccttaattatcttcatgagcttctttgtcttcttccttttgcccgaaaccaagaaagttccaattgaggagatttatcttctttttgagaatcattggttctggaggagatttgtaactgaccaagacccagagacatcaaaggggactgcttaa

SEQ ID NO: 12199 - protein, 511 aa, Glycine max
MAGGGVEIGGPGKRAHLYEHKFSWYFVYTCFVGALGGSLFGYDLGVSGGVTSMDDFLKEFFPKVYRRKQMHLHETDYCKYDDQVLTLFTSSLYFSALVMTFFASFLTRKKGRKASIIVGALSFLAGAILNAAAKNIAMLIIGRVLLGGGIGFGNQAVPLYLSEMAPAKNRGAVNQLFQFTTCAGILIANLVNYFTEKIHPYGWRISLGLAGLPAFAMLVGGICCAETPNSLVEQGRLDKAKQVLQRIRGTENVEAEFEDLKEASEEAQAVKSPFRTLLKRKYRPQLIIGALGIPAFQQLTGNNSILFYAPVIFQSLGFGANASLFSSFITNGALLVATVISMFLVDKYGRRKFFLEAGFEMICCMIITGAVLAVNFGHGKEIGKGVSAFLVVVIFLFVLAYGRSWGPLGWLVPSELFPLEIRSSAQSIVVCVNMIFTALVAQLFLMSLCHLKFGIFLLFASLIIFMSFFVFFLLPETKKVPIEEIYLLFENHWFWRRFVTDQDPETSKGTA

SEQ ID NO: 12200 - DNA, 1557 bp, Glycine max
  CDS (1)..(1557)
atgcctgcggtaggaggtattagcaacggagggggcaaggagtaccctggaagcctcactccttttgtgacggtaacatgtatagttgcagccatgggtgggttaatcttcggttacgatatcggaatttcaggtggggtgacatccatggatccgtttctgctcaagtttttcccgtcggtgttccggaagaagaattccgacaaaacggtgaaccagtactgtcaatacgacagccagacactgacgatgttcacgtcgtcgctgtatctcgccgcgttgctgtcgtcgttggttgcctccaccgtcacacgtaggttcggccgaaaactctccatgcttttcggaggcttgcttttcctcgtcggtgcccttatcaacggttttgcccaacacgtgtggatgctcatcgtgggtcggatcttgctcgggttcggtatcgggtttgccaatcagtctgtgccactctacctatctgaaatggctccatacaaatatagaggagcattgaacattggctttcagttgtccatcactgttggtatccttgtggccaatgtgttgaactatttctttgctaaaatcaaaggtggttggggatggaggttgagtttgggaggtgctatggtccctgcccttataatcacagtaggatcactagtccttccagacactcccaattccatgattgaaaggggtgatcgcgagaaggccaaggctcagcttcagagaattcgcggcatcgacaatgttgatgaagagttcaatgaccttgtggcagcaagtgaatcctctagccaagtggagcacccttggaggaacttgttgcaaagaaagtacagaccccacctcaccatggcagtgttgattccattcttccagcaactcactggaatcaatgtcatcatgttttacgcgccggtcctgttcagctccatcgggtttaaggatgatgctgctctaatgtcagctgtgatcaccggcgttgttaatgttgtcgcaacttgtgtctcaatttatggtgttgacaagtggggtaggagagcccttttccttgaaggtggagtccaaatgctcatttgccaggctgtagttgcagctgcaattggagcaaagtttggaactgatgggaacccaggtgatttgccaaagtggtatgcaattgttgtggttctcttcatttgcatttatgtatcagcatttgcctggtcatggggtcccctaggttggttggtgcctagtgagatctttcccttggagattcgttcagctgctcagagtatcaatgtgtcggtgaacatgcttttcactttcttgattgcacaagtcttcttgacaatgctttgccacatgaagttcggcttgttcctcttctttgccttcttcgtgttgatcatgacattcttcgtctacttcttcttgcccgaaacaaagggcattccaattgaagaaatggggcaggtttggcaggcacaccccttctggtccagattcgtggagcatgatgattatggcaatggtgttgagatgggaaagggagctattaaagaagtgtag

SEQ ID NO: 12201 - protein, 518 aa, Glycine max
MPAVGGISNGGGKEYPGSLTPFVTVTCIVAAMGGLIFGYDIGISGGVTSMDPFLLKFFPSVFRKKNSDKTVNQYCQYDSQTLTMFTSSLYLAALLSSLVASTVTRRFGRKLSMLFGGLLFLVGALINGFAQHVWMLIVGRILLGFGIGFANQSVPLYLSEMAPYKYRGALNIGFQLSITVGILVANVLNYFFAKIKGGWGWRLSLGGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 12202 - DNA, 1461 bp, Glycine max
  CDS (1)..(1461)
atgagtttgagggaagacaatgaagagggaagggatctgaagaagccatttcttcacacgggaagttggtatcgtatgagtgggagacaatccagtgtgttcggttccacacaggccattcgtgattcctccatctctgtctttgcttgtgttctaatcgttgctttgggtccaattcagtttggtttcactgctggttacacctcacctacacaatctgctatcatcaatgatctaggcctctcagtctctgagttttctttgtttggttctttgtccaatgtgggtgccatggttggagcaattgctagtggtcagattgctgagtacatagggcgcaaagggtctttgatgattgcatccattcctaatattattggttggctggctatctcatttgcaaaagattcttcttttctttatatgggaagattgttggaagggtttggtgtaggaataatatcttacacggtgcctgtgtacatagctgagatatcacctccaaacttgcgggggggtttggtttcagttaaccagctctctgtcaccattggaattatgctggcatatctgctggggatttttgttgaatggagaatccttgcaattataggaattttaccctgcacaatattgatacctgccctgtttttcattcccgagtctcctagatggctggcaaaaatgggaatgacagaagaatttgaaacttccttgcaagtgctccgaggctttgatactgatatttctgttgaagtgaatgaaattaagagggctgttgcttcaacaaacacaagaattacagttcgatttgcagacctcaaacaaagaagatattggcttcccttaatgattggaattggactgctaattttgcaacagctttctggaattaatggtgttcttttttattccagtaccatctttcgaaatgctggaatcagttcaagtgacgcggcaacatttggagttggtgctgttcaggttcttgccaccagtctaactttgtggctggcagacaaatctggtcgccggcttctccttattgtctctgcaactggaatgtcttttagtctcttagttgttgcaatcacattctacataaaggctagtatatcagaaacttcttccttgtatgggatattgagcaccttgtcgctggttggagtcgtggccatggttattgcattctctcttggaatgggagctatgccatggattataatgtctgagattcttccaataaacattaaaggcctcgcgggaagtgtggcaacacttgccaactggttgttttcctggttggttacattgacagcaaatatgcttttggattggagctctggaggaaccttcaccatatatgcagttgtatgtgccttgactgtagtatttgttaccatttgggtccctgagacaaagggaaaaactattgaagaaatccaatggtctttcagatga

SEQ ID NO: 12203 - protein, 486 aa, Glycine max
MSLREDNEEGRDLKKPFLHTGSWYRMSGRQSSVFGSTQAIRDSSISVFACVLIVALGPIQFGFTAGYTSPTQSAIINDLGLSVSEFSLFGSLSNVGAMVGAIASGQIAEYIGRKGSLMIASIPNIIGWLAISFAKDSSFLYMGRLLEGFGVGIISYTVPVYIAEISPPNLRGGLVSVNQLSVTIGIMLAYLLGIFVEWRILAIIGILPCTILIPALFFIPESPRWLAKMGMTEEFETSLQVLRGFDTDISVEVNEIKRAVASTNTRITVRFADLKQRRYWLPLMIGIGLLILQQLSGINGVLFYSSTIFRNAGISSSDAATFGVGAVQVLATSLTLWLADKSGRRLLLIVSATGMSFSLLVVAITFYIKASISETSSLYGILSTLSLVGVVAMVIAFSLGMGAMPWIIMSEILPINIKGLAGSVATLANWLFSWLVTLTANMLLDWSSGGTFTIYAVVCALTVVFVTIWVPETKGKTIEEIQWSFR

SEQ ID NO: 12204 - DNA, 1506 bp, Glycine max
  CDS (1)..(1506)
atgactggggggggtatcactatgcaatcgacgccgggaagctcaggatacttggatttgtatccagagcggaagatgtcctttttcaaaaatccttacattctcggactggctgctgtcgccggcatcggtggtctcctcttcggctacgacactggtgtgatatcaggggctcttttatacattaaggatgattttgaggaggttagaaacagcaatcttctccaggaaacaatagtcagcatggctattgccggggcaatcgtgggagcagcattgggtggttggattaatgatgcctatggtcgaaagaaggccaccctctttgccgatgttatctttaccgccggagcaataatcatggcttctgctccagatccttatgttctcattttgggacgccttctggttggtttgggtgtgggcatagcttctgtcactgctcccgtttatattgcagaagcatcaccttccgaaataaggggttcattagtcagcacaaatgtcctcatgataaccggtggacagtttctttcctatcttgttaacctcgcttttactggtgttcctggcacttggcgatggatgcttggtgtttctggtgtgcctgctgttgttcagtttgttctcatgctcttcctccccgaatccccaagatggctttttgtcaagaataggaaaaatgaagccgttgatgtgctttctaagatctttgacgttgctcgcttagaagacgaagtcgatttcctcactgctcaatccgagcaagagcgccaaagaaggtcaaatatcaaattctgggatgtttttagatccaaagaaatcagactggcattcctcgtcggtgccggacttctggcttttcagcagttcacgggtattaacacagtcatgtactacagcccgacaattgtccaaatggcagggttccatgctaatgaattggctcttcttctatcccttatagttgccggcatgaatgcagccggaacaattcttggcatttaccttatcgaccatgctggacgaaaaaaattagctctttctagtctgggaggagtaattgtatctttggtcatcttggcctttgcattttataagcaatcatccacgtcaaatgagttgtatggatggcttgcagttgtaggcttagccttgtatattggttttttctcgccaggaatggggcctgtgccatggactctgagttcagagatatatccggaagaatatcgaggtatctgtgggggcatgtcagctactgtgtgttgggtctcaaatttgattgtctcagagacctttctttcaattgcggagggtatagggattggttcaacttttctgattattggtgtcatagctgtggttgcatttgtatttgtgcttgtttatgttccagagaccaaaggattgacctttgatgaagtggaagtaatatggagggagagagcttggggcaagaaccccaacacacaaaaccttcttgagcagggaagtagttcctaa

SEQ ID NO: 12205 - protein, 501 aa, Glycine max; identical to SEQ ID NO: 4519

SEQ ID NO: 12206 - DNA, 1467 bp, Glycine max
  CDS (1)..(1467)
atgtgtgtgagaatggaagagagtggcgatgcgagggatcttcagaaaccgttcctccacacagggagttggtacaagatgggttccaggcagtccagcatcatgggatcctccactcaggttatccgcgacggcgccgtttccgtcctcttctgcgtcctcatcgtcgccttgggtcccattcaattcggcttcacgtgtgggtattcttctccaacccaaggggctatagttcgcgatctaaacctctctatttcggagttttctttctttggatctttgtctaatgtgggagcaatggtgggagctatagctagtggtcagatagctgaatacatcgggcgcaaagggtcattgatgattgctgcgatccccaatataatagggtggcttgctatttcttttgccaaagattcctcatttttgtatatggggaggttgttggaaggttttggcgttgggattatctcttatgtggtgcctgtttatatagctgagattgcacctcaaaacttgagaggtggccttggatcagtgaaccagctctctgttacaattggcattatgctggcttatctgttgggtctttttgtcaactggagagtccttgcaattctaggaattttgccttgtacagtattaatacctggattatttttcatacctgaatcccccagatggttggccaagatggggatgatagatgagtttgagacttctttgcaagtgttacgaggatttgacactgatatatctgttgaagtacatgaaattaagagatctgtggcttcaacgggaaaaagagctgcaatccgatttgcagatctcaagaggaaaagatattggttcccgttaatggttggtattggattacttgttcttcagcaattatctggtatcaatggaattttgttctattcaactaccatctttgcaaatgcaggaatttcatccagcgaagctgctacagttggacttggagccgttcaggtcatagcaactggaatttccacatggttggtggacaaaagtggccggaggctgcttctaataatatcctcatctgtaatgacagttagccttctcattgtttctatagcattttatctggagggggttgtatcagaggattcacatttattcagcattttgggaatagtttctattgttggactcgtggctatggtgattgggttctctctaggtctgggacccatcccttggcttataatgtctgagatacttccagtgaatataaagggccttgctggcagcatagcgacaatgggaaattggctgatttcgtgggggatcacgatgactgctaacttgcttttgaattggagcagtggagggacatttacaatctacacagtcgtagctgcctttactatagcttttatagcaatgtgggttcctgagaccaagggaagaacattggaagaaattcagttttccttcagatag

SEQ ID NO: 12207 - protein, 488 aa, Glycine max; identical to SEQ ID NO: 4783

SEQ ID NO: 12208 - DNA, 1572 bp, Glycine max
  CDS (1)..(1572)
atgactgagggaaagctagttgaagctgcagaagctcataagacacttcaggatttcgatcctccaaagaagcgcaaaaggaacaagtatgcttttgcttgtgctatgctggcctccatgacttccatcttgcttggttatgatattggagtgatgagtggagcagccatatacataaaaagggacctgaaagtctcggacgagcaaatcgagatcctgctcggaatcatcaacctatactctctgataggctcatgtctcgccggcagaacctccgactggataggtcgccgttacacgattgttttcgccggcaccatcttctttgtcggagcacttctcatgggtttctcccccaattattcctttctcatgtttggccgtttcgtcgctggcattggcatcggctacgccctcatgatagcccccgtctacaccgccgaggtctccccggcctcctctcgtggcttcctcacttccttccctgaggtatttattaatggagggatattaattggatacatatcaaactatgcattttcgaagctgacactaaaggtgggatggcgaatgatgcttggagttggtgcaataccttcggtactcctaacagtaggagtgttggcgatgccggagtccccaaggtggcttgtgatgaggggtcgtttgggagaggcaagaaaagtgcttaacaaaacctcagacagcaaggaagaggcccaactaaggctagcggaaatcaaacaagccgcagggatccccgagagttgcaacgacgacgtcgttcaggtaaataaacaaagcaacggtgaaggtgtatggaaagagctcttcctctatccaacgcccgcaattcgtcacatcgtaatcgctgcccttggtattcacttcttccaacaagcgtcgggcgtagacgccgtcgttttgtacagccccaggatcttcgaaaaggctgggattacaaacgacacgcataagcttcttgcaaccgtggccgttggattcgttaagaccgtgttcatcttggcggctacgtttacgttggaccgcgtgggtcgtcgtccgttgttattgtctagtgtcggcggcatggtgctctcgcttctcacgcttgcgatcagcctcactgttattgatcattcggagaggaaattaatgtgggccgttggatcgagcatagccatggtgttggcttacgtggccacgttctccatcggtgcgggtcccatcacgtgggtctatagttctgagatcttcccgttgaggctgcgggcgcagggtgcggccgcgggagttgcggtgaataggaccactagcgcggttgtctcaatgacttttctgtccctcactagagccatcactattggtggagctttcttcctttattgtggcattgctactgttgggtggatattcttttacaccgtcttgcctgagacccggggaaaaacgctcgaagacatggaagggtcttttggtacttttaggtccaaatccaacgccagcaaggctgtagaaaatgagaatgggcaagtagcacaagtccagctaggaaccaatgtccaaacttga

SEQ ID NO: 12209 - protein, 523 aa, Glycine max
MTEGKLVEAAEAHKTLQDFDPPKKRKRNKYAFACAMLASMTSILLGYDIGVMSGAAIYIKRDLKVSDEQIEILLGIINLYSLIGSCLAGRTSDWIGRRYTIVFAGTIFFVGALLMGFSPNYSFLMFGRFVAGIGIGYALMIAPVYTAEVSPASSRGFLTSFPEVFINGGILIGYISNYAFSKLTLKVGWRMMLGVGAIPSVLLTVGVLAMPESPRWLVMRGRLGEARKVLNKTSDSKEEAQLRLAEIKQAAGIPESCNDDVVQVNKQSNGEGVWKELFLYPTPAIRHIVIAALGIHFFQQASGVDAVVLYSPRIFEKAGITNDTHKLLATVAVGFVKTVFILAATFTLDRVGRRPLLLSSVGGMVLSLLTLAISLTVIDHSERKLMWAVGSSIAMVLAYVATFSIGAGPITWVYSSEIFPLRLRAQGAAAGVAVNRTTSAVVSMTFLSLTRAITIGGAFFLYCGIATVGWIFFYTVLPETRGKTLEDMEGSFGTFRSKSNASKAVENENGQVAQVQLGTNVQT

SEQ ID NO: 12210 - DNA, 1635 bp, Brassica napus
  CDS (1)..(1635)
atgcaatcgtcaacgtacgcagctgttaaaggaaacgctgcgtttgcgtttcagagacgtagcttctctaacctcgtcagcagatcggcgactactaccggaattcgcttctccaccggctcttacttcgcacaactccactcttccgcctcgaaagccatgggagcgaagcttgctcgcgctgagaacgggattcacagtctctcctcggtcaaagctcgatcggttagagcacaagcctcctctggtggtggtgacgaagaagaagcaatacctctgagatctgaaggaaaaatctcagggacggttttacccttcgttggtgttgcttgtcttggtgctatcttgtttggttatcatctcggggttgttaacggtgctcttgagtaccttgctaaggatcttggtatcgctgataatgctgttttgcaagggtggattgttagcgcgttgcttgctggtgcaacggtcggttctttcaccggaggtgcattagctgacaaattcggacgaactagaacttttcaattggatgctatcccgcttgccgttggagctttcttatgtgcaacagctcagagtgtgcagactatgattgtgggacgtctgctcgcaggggttggaatcggaatctcatcagccattgtaccactttacatttccgagatatcaccaactgaaattcgcggtgcactcggatctgtgaaccagttgttcatatgtataggaatactcgcagccttgatagctggattaccccttgcagcaaaccctctatggtggaggacgatgtttggtgttgcagttatcccttccgttctattagccataggaatggggttttctccagaaagcccaaggtggctcgttcagcaaggaaaacttactcaagcggaaaaggctatcaaaactctgtatggtaaagaaaaagtggttgaactagtgcgtgacttatcaaactctggccaaggtacttctgagccagaggcaggatggtttgatctattcagcagccgctactggaaagttgtaagcgttggtgcggcgctcttcttgtttcagcagttagctgggataaatgcagttgtgtactactctacatctgtgttccgcagcgccggaatccaatctgatgttgcagccagtgctcttgttggagcatcaaacgtgtttggaactgctgttgcttcgtctttgatggacaaaatgggaaggaaaagtcttctacttactagctttggtggaatggcgttgtctatgctgttgctctcgttgtccttcacatggaaagctcttgctgcatattcaggcactctcgctgttgttggaactgttctctatgtcctgtcattctcacttggtgctggcccggtaccagctcttcttcttccagagatattcgcatctcggatcagagcaaaagctgtcgctctttctctcggcatgcactggatctcaaactttgtgattggactctacttcttgagcgttgtgactaaattcggaatcagcagtgtgtacttgggattcgcaggagtgtgtgtccttgcagtcatgtacattgcaggaaacgtagtggagactaaaggacggtcactcgaggaaatagagcttgcacttacctctggagcttga

SEQ ID NO: 12211 - protein, 544 aa, Brassica napus
MQSSTYAAVKGNAAFAFQRRSFSNLVSRSATTTGIRFSTGSYFAQLHSSASKAMGAKLARAENGIHSLSSVKARSVRAQASSGGGDEEEAIPLRSEGKISGTVLPFVGVACLGAILFGYHLGVVNGALEYLAKDLGIADNAVLQGWIVSALLAGATVGSFTGGALADKFGRTRTFQLDAIPLAVGAFLCATAQSVQTMIVGRLLAGVGIGISSAIVPLYISEISPTEIRGALGSVNQLFICIGILAALIAGLPLAANPLWWRTMFGVAVIPSVLLAIGMGFSPESPRWLVQQGKLTQAEKAIKTLYGKEKVVELVRDLSNSGQGTSEPEAGWFDLFSSRYWKVVSVGAALFLFQQLAGINAVVYYSTSVFRSAGIQSDVAASALVGASNVFGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVMYIAGNVVETKGRSLEEIELALTSGA

SEQ ID NO: 12212 - DNA, 1542 bp, Zea mays
  CDS (1)..(1542)
atgaccggaggcgggttcgccgtggcggagggcggccacgcgcgcgacgactacgggggaggcgtcacggtctccgtcgtggtcacctgcctcatggccgcctcctgcggactcatcttcggctacgacattggcgtctcaggtggcgtgacacaaatggagtcgttcctggcgaagttcttcccggaagtgtcaagcgggacaaaggacgcgaagcacgacgcatactgcaaatacgacgaccagcggctcacggcgttcacctcgtcgctgtacatcgccgcgatgctgtcatcgctggtggcgagccgcgtgacgaggacggtgggccggcaggccgtgatgctgatgggcggcgtcctgttcctcctaggctccgcgatcaacgccggcgccgtcaacgtcgccatgctcatcctcggacggatgctgctcggcttcggggtcgggttcaccacgcaggccgcccctctgtacctcgcggagacatcgccggcgcggtggcgcggggcgttcaccgcggcgtacagcatcttccaggtgctgggcgcgctggccgccaccgtcactaactacctgaccaaccgcgtcccggggtggggctggcgcgtgtcgctcggcctcgccgccgtcccggccgccatcgtcgtcctcggcgccctgctcgtcccggacacccccagcagcctcgtgttgcgcggcgacgccgacggggcccgggcctcgctgcagcgcctccgtggcccgggcgcggagaccgacgcggagctcaaggacatcgtccgcgccgtggagcgcgcgcggcgggacgacgagggcgcgtacgggaggctgtgcgccaaggggtacggccactacctggtgatggtggtggccatcccttccttcttcgacctcaccggcgtcatcgtcatggccgtcttctcgccggtgctgttccggacggtcgggttcagcagccagaaggcgatatttgggtccgtgatccttagcctcgtcaaccttgcctcgtcattgctctcctccttcgtcttggaccgcgccggccgcaggttcttgttcatcgtcggtggcgcggcaatgatgatttgtcagttggccatgtcgtgcatcctggcgggccacttcggcaagcagaacgcggtgacgatgccgcgggactacgcggtggccgtgctggtgctcatgtgcctgtacaccttcagcttcggcgtgtcgtgggggccgctcaagtgggtggtgccgagcgagatctaccccgtggagatcaggtcggcggcgcaggcgctgacggtgtccatcgcgctctgcctctcattcgcgcagacgcaggtgttcgtctccctgctctgcgccatgaagcacgccatcttcctgttctacgccggatgggtcctcgtcatgactgccttcatcgccgcgttcctgccggagaccaaaggcgtgccgctggaggccatgcgcgccgtctgggcggggcactggtactggaggaggttcgtcagggacgccaagcaggaggttcaggtgaactgcatgtag

SEQ ID NO: 12213 - protein, 513 aa, Zea mays
MTGGGFAVAEGGHARDDYGGGVTVSVVVTCLMAASCGLIFGYDIGVSGGVTQMESFLAKFFPEVSSGTKDAKHDAYCKYDDQRLTAFTSSLYIAAMLSSLVASRVTRTVGRQAVMLMGGVLFLLGSAINAGAVNVAMLILGRMLLGFGVGFTTQAAPLYLAETSPARWRGAFTAAYSIFQVLGALAATVTNYLTNRVPGWGWRVSLGLAAVPAAIVVLGALLVPDTPSSLVLRGDADGARASLQRLRGPGAETDAELKDIVRAVERARRDDEGAYGRLCAKGYGHYLVMVVAIPSFFDLTGVIVMAVFSPVLFRTVGFSSQKAIFGSVILSLVNLASSLLSSFVLDRAGRRFLFIVGGAAMMICQLAMSCILAGHFGKQNAVTMPRDYAVAVLVLMCLYTFSFGVSWGPLKWVVPSEIYPVEIRSAAQALTVSIALCLSFAQTQVFVSLLCAMKHAIFLFYAGWVLVMTAFIAAFLPETKGVPLEAMRAVWAGHWYWRRFVRDAKQEVQVNCM

SEQ ID NO: 12214 - DNA, 1557 bp, Glycine max
  CDS (1)..(1557)
atgcctgcggtcggaggtataaacaccggagggggcaaggagtaccctggaagcctcactctatttgtgacggtaacatgtatagttgcagccatgggtggtttaatcttcggttacgatatcggaatttcaggtggagtgacgtccatggatccgtttctgctcaagttttttccgtcagtgttccggaagaaaaactccgacaaaacggtgaaccagtactgccaatacgacagccagacactgacgatgttcacgtcgtccttgtacctcgccgctttgctgtcgtcgttggttgccgccaccgtcacgcgtaaattcggccggaaactctccatgcttttcggaggcttgcttttcctcgtcggtgccctcatcaacggtttcgcccaacacgtttggatgttaatcgtgggtcggatcttgctcgggttcggtatcggcttcgccaatcagtctgtgccactctacctatctgaaatggctccatacaaatatagaggagcattgaacattggctttcagttgtccatcactgttggtatccttgtggccaatgtgttgaactatttctttgctaaaatcaaaggtggttggggatggaggttgagtttgggaggtgctatggtccctgcccttataatcacagtaggatcactagtccttccagacactcccaattccatgattgaaaggggtgatcgcgagaaggccaaggctcagcttcagagaattcgcggcatcgacaatgttgatgaagagttcaatgaccttgtggcagcaagtgaatcctctagccaagtggagcacccttggaggaacttgttgcaaagaaagtacagaccccacctcaccatggcagtgttgattccattcttccagcaactcactggaatcaatgtcatcatgttttacgcgccggtcctgttcagctccatcgggtttaaggatgatgctgctctaatgtcagctgtgatcaccggcgttgttaatgttgtcgcaacttgtgtctcaatttatggtgttgacaagtggggtaggagagcccttttccttgaaggtggagtccaaatgctcatttgccaggctgtagttgcagctgcaattggagcaaagtttggaactgatgggaacccaggtgatttgccaaagtggtatgcaattgttgtggttctcttcatttgcatttatgtatcagcatttgcctggtcatggggtcccctaggttggttggtgcctagtgagatctttcccttggagattcgttcagctgctcagagtatcaatgtgtcggtgaacatgcttttcactttcttgattgcacaagtcttcttgacaatgctttgccacatgaagttcggcttgttcctcttctttgccttcttcgtgttgatcatgacattcttcgtctacttcttcttgcccgaaacaaagggcattccaattgaagaaatggggcaggtttggcaggcacaccccttctggtccagattcgtggagcatgatgattatggcaatggtgttgagatgggaaagggagctattaaagaagtgtag

SEQ ID NO: 12215 - protein, 518 aa, Glycine max
MPAVGGINTGGGKEYPGSLTLFVTVTCIVAAMGGLIFGYDIGISGGVTSMDPFLLKFFPSVFRKKNSDKTVNQYCQYDSQTLTMFTSSLYLAALLSSLVAATVTRKFGRKLSMLFGGLLFLVGALINGFAQHVWMLIVGRILLGFGIGFANQSVPLYLSEMAPYKYRGALNIGFQLSITVGILVANVLNYFFAKIKGGWGWRLSLGGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 12216 - DNA, 1533 bp, Zea mays
  CDS (1)..(1533)
atgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggccaacatcgccatgctcatcgtcgggaggatgctgctcggcctggggctcggcttctccggccaggccacgccggtgtacctcgccgaggtgtcgcccccgcgctggcgcggcggcttcatctcggccttccccctcttcatcagcgtcgggtacctggtggccaacctcatcaactacggcacctcgcggatcccgggctggggctggcgcctctcgctcggcctcgcctccgtcccggccgccgtcatggtggtcggcgccgcgttcatcccggacacccccagcagcctcgtcctgcgcgggaagcacgacgacgcccgcgccgcgctccagcgggtgcgcggcaagggcgtggacatcggccccgagttcgcggacatcctcgccgcggcggagaacgaccgccggaacgaggagggcgcgttccgccggatcctgcgccgggagtaccggccctacctggtgatggccgcggcgttcccggcgttcctcaacctcacaggggtggccgtcaccgccttcttctcgccgatactgttccggaccgtcggcttcgagagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgacggtgctggtggtggcgctgatcttctcggcgagcttcagctggtcgtggggcgcgctgtactggaccatccccggcgagatataccccgtggaggtgcggtcggcggggcagggcgcggccgtggcgctcaacctggggctcaacttcttgcaggcgcagttcttcctggccatgctgtgctgcttcaagtacggcaccttcctcttctacgcgtcgtggctggttgtcatgaccgccttcgccgtggcgttcgtgccggagaccaagggcgtgccgctcgagtccatggctcacgtcttcgcgcgccactggtactggggcaggttcgtcaaggaccaccagaagttgggcgaagagtccacctag

SEQ ID NO: 12217 - protein, 510 aa, Zea mays
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQAVMLIGGGLFLAGALVNAAAANIAMLIVGRMLLGLGLGFSGQATPVYLAEVSPPRWRGGFISAFPLFISVGYLVANLINYGTSRIPGWGWRLSLGLASVPAAVMVVGAAFIPDTPSSLVLRGKHDDARAALQRVRGKGVDIGPEFADILAAAENDRRNEEGAFRRILRREYRPYLVMAAAFPAFLNLTGVAVTAFFSPILFRTVGFESDAALMGAVILGLMNIGGILASGFAMDRYGRKLLFMIGGALMFTCQVAMASIIGSHLGNGSKMPKGYAVTVLVVALIFSASFSWSWGALYWTIPGEIYPVEVRSAGQGAAVALNLGLNFLQAQFFLAMLCCFKYGTFLFYASWLVVMTAFAVAFVPETKGVPLESMAHVFARHWYWGRFVKDHQKLGEEST

SEQ ID NO: 12218 - DNA, 1503 bp, Zea mays
  CDS (1)..(1503)
atgggtggcggcagcaacagaggcggcgccggcgccggcgaggagagcggcagcgaccacgacggtgtgctgcggaggccgctgctcaacacggggagctggtaccggatgagctcgcggcagtccagctttgccccggggacctcctccatggccgtcctgcgcgagtcccacgtctccgccttcctctgcacgctcatcgtcgcgctcggccccatccagttcggcttcaccagcggcttctcctccccgacccaggacgccatggttcgggacctcaacctctctatctccgagttctcggcgttcggatcgctgtccaacgtcggcggcatggtcggggcgatcgccagcgggcagatggccgagtacattggccgtaaagggtcgttgatgattgctgcaatcccaaatatcatcggttggcttgcgatctcctttgcaaaagatgcctcatttctatatatgggacgattgcttgaagggtttggtgtcggcatcatatcctacacggtaccggtatacatagcagagatatctcctcagaacatgaggggagctcttggttctgtgaaccagttgtctgtgacctttggcatattcttggcctatttgctcggcatgtttattccttggagacttcttgctgtgatcggagccttgccctgcacaatgttgattcctggactattcttcattccagaatctcccagatggctggcaaagatgaatttgacggaagattgtgagacgtccctacaagtgctgagggggtttgagactgacatcacaacagaagtgaatgatataaagagggcagtggcatcatcaagtaagaggaccacaatcagttttcaagaattaaaccaaaagaaataccgcacgccactacttctagggattggcctacttgtactgcaaaatcttagtggaatcaacggtgtactgttttatgcaagtagcatcttcaaagctgcaggggttacaaacagcgacttggccacctgttcacttggtgctattcaggtccttgctactggagttacaacatggctgttagacagagctggacgacgcatccttctcattatttctacctctggcatgactctatgccttcttgccgtttctgttgtattttttctcaaggataacatttcacaggattctaactcatactacatcttaacaatgatctcccttgttggtattgtgtctttcgtcattaccttctcgtttggtatgggtgccattccatggctcatgatgtctgagatcctcccggttagcatcaagagccttggcggaagcatcgcaacactggccaactggctgacatccttcgccataacaatgacgacgaacttgatgctcacgtggagtgttggaggcacttttctctcgtacatggttgtgagcgccttcaccatcgtttttgttgtcctttgggtgccggagacgaaggggagaactctagaggagatacaattttcgtttcgctga

SEQ ID NO: 12219 - protein, 500 aa, Zea mays
MGGGSNRGGAGAGEESGSDHDGVLRRPLLNTGSWYRMSSRQSSFAPGTSSMAVLRESHVSAFLCTLIVALGPIQFGFTSGFSSPTQDAMVRDLNLSISEFSAFGSLSNVGGMVGAIASGQMAEYIGRKGSLMIAAIPNIIGWLAISFAKDASFLYMGRLLEGFGVGIISYTVPVYIAEISPQNMRGALGSVNQLSVTFGIFLAYLLGMFIPWRLLAVIGALPCTMLIPGLFFIPESPRWLAKMNLTEDCETSLQVLRGFETDITTEVNDIKRAVASSSKRTTISFQELNQKKYRTPLLLGIGLLVLQNLSGINGVLFYASSIFKAAGVTNSDLATCSLGAIQVLATGVTTWLLDRAGRRILLIISTSGMTLCLLAVSVVFFLKDNISQDSNSYYILTMISLVGIVSFVITFSFGMGAIPWLMMSEILPVSIKSLGGSIATLANWLTSFAITMTTNLMLTWSVGGTFLSYMVVSAFTIVFVVLWVPETKGRTLEEIQFSFR

SEQ ID NO: 12220 - DNA, 1611 bp, Zea mays
  CDS (1)..(1611)
atggcagtggcagctccggccgcggtgagcacgggagccgggcagggcaaggagtaccccggcgggctcaccctctacgttctcctcacctgcgccgttgctgccaccggcggccttgtctgcggctacgacatcggcatatccggcggcgtgacatccatggacgcgttcctgcacaagttcttcccgtcggtgtaccgcaaggagcagacggcgcggggaggcggcagccagtactgcaagttcgacagccagctgctgaccgcgttcacgtcgtcgctgtacctggcggcgctcgcggcctccttcttcgtcgcgtccgtggcgcactccctgggccggaaatggtgcatgtttggcggtggcgtctccttcctcgccggcgccgccctcaacgccgccgcgcaggacgtcgccatgctcatcgtcggccgcattcttcttggcatcggcgtcggcttcgctggcctgtccatcccaatctacctgtcggagatggcgccgcaccacctccgaggcacgctaaacatcggcttccagctgatgatcaccgtgggcatcttctccgccaacctcgtcaactacggcgtcgacaagatcagaggcggatggggctggcgtctcagcctcgggctcgccgccgtcccggcggccgtgatcaccgtgggctcgctcttcctccccgacacgccaaactccctcatccgccgcggctaccacgagcaggcgcggcaggtcctcgcccggatccgtggcgcggacgtcgacgtggccgacgaatacggcgacctcgtgtcggccagcgaggcgtccgccgccgtccggcgcccgtggctggacgtcctcgggcgcaggtaccggccgcagctaaccatggccgtcctcgtcccctttttccagcagctcaccggcatcaacgtcatcatgttctacgcgcccgtcctgttcaagacgatcgggctcggaggggacgcgtcgctcatgtcggccgtcatcaccgggctggtcaacatcgtcgcgacgttcgtgtccatcgccaccgtcgacaggctcggccggcgcagcctcttcctgcagggagggtgccagatgctcgtttgccagatcgtcatcggaaccctgatcggcgtccagttcggggcgagcggagacggagccgccatccccaaggcctccgcggccaccgtcgtggcgttcatctgcatctacgtcgcgggcttcgcgtggtcgtggggcccgctcggtgtcctggtgccgagcgagatcttcccgctggagatccgaccggcggggcagggaatcaacgtggccgtcaacatgatgtgcaccttcgccgtcgcgcaggccttcctcccgatgctctgccacttgaggttcggcctcttctacttcttcggcgggtgggtgctcgtgatgacgctgttcgtcgcggccttcctgccggagacgaagggcgtgcccgttgagaagatggggactgtgtggaggacgcactggttctggggaaggttcgttgctgacgctggcatggacggccgcgcgggaaaccgcgactccgccttccacaagggcaaggacattgctatagagagccgtagtcgtcctgtgtag

SEQ ID NO: 12221 - protein, 536 aa, Zea mays
MAVAAPAAVSTGAGQGKEYPGGLTLYVLLTCAVAATGGLVCGYDIGISGGVTSMDAFLHKFFPSVYRKEQTARGGGSQYCKFDSQLLTAFTSSLYLAALAASFFVASVAHSLGRKWCMFGGGVSFLAGAALNAAAQDVAMLIVGRILLGIGVGFAGLSIPIYLSEMAPHHLRGTLNIGFQLMITVGIFSANLVNYGVDKIRGGWGWRLSLGLAAVPAAVITVGSLFLPDTPNSLIRRGYHEQARQVLARIRGADVDVADEYGDLVSASEASAAVRRPWLDVLGRRYRPQLTMAVLVPFFQQLTGINVIMFYAPVLFKTIGLGGDASLMSAVITGLVNIVATFVSIATVDRLGRRSLFLQGGCQMLVCQIVIGTLIGVQFGASGDGAAIPKASAATVVAFICIYVAGFAWSWGPLGVLVPSEIFPLEIRPAGQGINVAVNMMCTFAVAQAFLPMLCHLRFGLFYFFGGWVLVMTLFVAAFLPETKGVPVEKMGTVWRTHWFWGRFVADAGMDGRAGNRDSAFHKGKDIAIESRSRPV

SEQ ID NO: 12222 - DNA, 1596 bp, Zea mays
  CDS (1)..(1596)
atggccggcgggtttggcagcggcggggcagccgccgggagggccgagctctacgagggcaagatcaccggctacttcatcctcgcttgcatcgtcggctccttcggcggatccctcttcggctatgacctcggagtctccagcggcgtgacttccatggacgacttcctggtgaagttcttcccggacgtgtaccggcggaagcaggcgcacctccacgagacggactactgcaagtacgacaaccaggtgctgacgctcttcacctcgtcgctctacttcgcgggcctcgtctccaccttcggcgcctcctacgtgaccaagcgccacggccggcgcgccagcatcatgggtggcgccgccagcttcttcctcggcggcgccatcaacggcgccgccatgaacatcgccatgctcatcgtcggacgcatcctcctcggcgtcggcgtcggcttcgcaaatcaggccgtgcctgtgtacctgtcggagatggcgccggcgcgtctccggggcatgctcaacatcggcttccagctgatgatcaccatcggcatcctggcggcggagctcatcaactacggcaccaacaagatcaaggccgggtacgggtggcgcgtgagcctggcgctggcggcggtgccggcggccatcatcaccctgggctccctcttcctcccggacacccccaactcgctgctggagcggggccacccggaggaggcacgccgcatgctccgccgcatccgcggcacggacgacatcggcgaggagtacgcggacctggtggcggccagcgaggaggcccgccaggtgcgccacccgtggcggaacatcctgcgccgccggtaccgcgcgcagctcaccatggccgtcgcgatccccttcttccagcagctcaaggggatcaacgtcatcatgttctacgcgcccgtgctgttcgacacgctgggattcaagaaagaagccttcctcatgtcctccgtcatcacgggcctcgtcaacgtcttcgccaccgtcgtgtccatcgtcaccgtcgaccgcgtcggccgccgcaagctgttcctccagggcggcgcgcagatgatcgtgtgccagctcatcgtgggcacgctcatcgccgccaaattcgggaccagcggcacgggggacatcgccaagggctacgccgcggtcgtcgtggtcttcatctgcgcctacgtcgccggcttcgcctggtcgtgggggcccctgggctggctcgtgccgtccgagatcttcccgctggagatccccccggcggggcagagcatcaacgtctccgtcaacatgttcttcaccttctgcatcgcgcaggccttcctcaccatgctctgccacttcaagttcggcctcttctacttcttcgccggcggggtcgtcatcatgaccgtcttcatcgccttcttcctgcccgagaccaagaacgtgcccatcgaggagatggtgcttggctggaagtcacactggttctggaaaaggttcatcgccgacgaggacgtgcacgtcggcattggcaacaaccacccgcagacgaccgtggccaaaaacggcagggacaacaagggggccggcgggtga

SEQ ID NO: 12223 - protein, 531 aa, Zea mays
MAGGFGSGGAAAGRAELYEGKITGYFILACIVGSFGGSLFGYDLGVSSGVTSMDDFLVKFFPDVYRRKQAHLHETDYCKYDNQVLTLFTSSLYFAGLVSTFGASYVTKRHGRRASIMGGAASFFLGGAINGAAMNIAMLIVGRILLGVGVGFANQAVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLKGINVIMFYAPVLFDTLGFKKEAFLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIPPAGQSINVSVNMFFTFCIAQAFLTMLCHFKFGLFYFFAGGVVIMTVFIAFFLPETKNVPIEEMVLGWKSHWFWKRFIADEDVHVGIGNNHPQTTVAKNGRDNKGAGG

SEQ ID NO: 12224 - DNA, 1509 bp, Zea mays
  CDS (1)..(1509)
atggcgaggagcaggacgtcgggcggcggcgagtacgagagcggcagcgaccacgacggcgcgctgcagaagccgctgctgcccaacagcgggagctggtaccggatggggatggggtcgcgccagtccagcctcaacgccgccggcacctcctccatggccgtcctgcgcgagtcccacgtctccgccttcctctgcacgctcatcgtcgcgctcggccccatccagttcggcttcaccggcggctactcctccccgacgcaggccagcatcatccgggacctcaacctctccatctccgagttctcggtgttcggctcgctgtccaacgtgggcgccatggtcggggcgatcgccagcggccagatggccgagtacgttggccgcaaagggtcgttgatgattgcagcaattccaaacgtcattggttggcttgcgatctcctttgcaaaagactcttcatttctgtatatgggacgcttgcttgaaggattcggtgtcggtatcatttcctatgtggtaccggtatacatagcagagatatctccacaaaacatgagaggggctcttggctctgtgaaccagttatctgtaacccttggtatcatgtttgcctatttgctcggcttgtttgttccttggaggcttcttgcagtaataggaaccttgccctgcatagtgttgatacctggccttttcttcattccggaatctccaagatggctggcaaagatgaatatgatggatgattgcgagacttctctacaagttctgagaggattcgatgctgacatcactgcagaattgaatgatataaagagagcagtaatgtcagcaaacaaaagggctacaattcgtttccaagagttgaaccaaaagaaataccgaacgcccctaattataggaattggtctacttgtgctgcaacagctaagtggaataaatggtatactattttatgcaagtagcatcttcaaagctgccggtctgaaggacagtgacttggacacctttgcacttggagctattcaggttcttgccacttttgttacaaccatgttcttggacagagctgggcggcgaatcctccttattatttcttctgctgggatgactctaagtcttcttgtagttgctattgtattttacatcaaggataatatttcacatgactctgacttgtatgacatcttaagtatggtgtccttggttggtgtcgtggcttatgtcattgccttctccttcggtatgggtgccattccttggatcataatgtctgagatcctcccagttagcatcaagagtcttgcaggaagcttcgcgacccttgccaactggttgacatcctttggaataacaatgacggcaaatttgctgatcagctggagtgctggaggtacgtttacctcctacatgattgtgagtgccttcactctcgtgttcgtaatcgtttgggtgccagagacaaagggaagaaccctcgaagagatacaatggtcgttccgctga

SEQ ID NO: 12225 - protein, 502 aa, Zea mays
MARSRTSGGGEYESGSDHDGALQKPLLPNSGSWYRMGMGSRQSSLNAAGTSSMAVLRESHVSAFLCTLIVALGPIQFGFTGGYSSPTQASIIRDLNLSISEFSVFGSLSNVGAMVGAIASGQMAEYVGRKGSLMIAAIPNVIGWLAISFAKDSSFLYMGRLLEGFGVGIISYVVPVYIAEISPQNMRGALGSVNQLSVTLGIMFAYLLGLFVPWRLLAVIGTLPCIVLIPGLFFIPESPRWLAKMNMMDDCETSLQVLRGFDADITAELNDIKRAVMSANKRATIRFQELNQKKYRTPLIIGIGLLVLQQLSGINGILFYASSIFKAAGLKDSDLDTFALGAIQVLATFVTTMFLDRAGRRILLIISSAGMTLSLLVVAIVFYIKDNISHDSDLYDILSMVSLVGVVAYVIAFSFGMGAIPWIIMSEILPVSIKSLAGSFATLANWLTSFGITMTANLLISWSAGGTFTSYMIVSAFTLVFVIVWVPETKGRTLEEIQWSFR

SEQ ID NO: 12226 - DNA, 1572 bp, Zea mays
  CDS (1)..(1572)
atggccggcggtggcatcgtgaacacgggcggtggcaaggactaccccggcaagctcaccctcttcgtgttgctcacctgcatcgtcgccgccaccggcggtctcatcttcggatatgacatcggtatctcaggcggcgtgacgtccatgaacccgttcctggagaagttcttcccggaggtgtaccggaagaagcaggaggccaagacgaaccagtactgcaagtacgacaaccagctgctgcagaccttcacctcctccctctacctggccgcgctggtcgcctccttcttcgccgccaccgtcacccgcgccgtcggccgcaagtggtccatgctcgtcggcggcctcaccttcctcgtcggagccgccctcaacggcgccgcccagaacatcgccatgctcatcatcggacgcatccttctcggcgtcggcgtcggcttcgcaaatcagtccgtgcctgtgtacctgtcggagatggcgccggcgcgtctccggggcatgctcaacatcggcttccagctgatgatcaccatcggcatcctggcggcggagctcatcaactacggcaccaacaagatcaaggccgggtacgggtggcgcgtgagcctggcgctggcggcggtgccggcggccatcatcaccctgggctccctcttcctcccggacacccccaactcgctgctggagcggggccacccggaggaggcacgccgcatgctccgccgcatccgcggcacggacgacatcggcgaggagtacgcggacctggtggcggccagcgaggaggcccgccaggtgcgccacccgtggcggaacatcctgcgccgccggtaccgcgcgcagctcaccatggccgtcgcgatccccttcttccagcagctcacggggatcaacgtcatcatgttctacgcgcccgtgctgttcgacacgctgggattcaagaacgacgcctccctcatgtcctccgtcatcacgggcctcgtcaacgtcttcgccaccgtcgtgtccatcgtcaccgtcgaccgcgtcggccgccgcaagctgttcctccagggcggcgcgcagatgatcgtgtgccagctcatcgtgggcacgctcatcgccgccaagttcgggaccagcggcacgggggacatcgccaagggctacgccgcggtcgtcgtggtcttcatctgcgcctacgtcgccggcttcgcctggtcgtgggggcccctgggctggctcgtgccgtccgagatcttcccgctggagatccgcccggcggggcagagcatcaacgtctccgtcaacatgttcttcaccttctgcatcgcgcaggccttcctcaccatgctctgccacttcaagttcggcctcttctacttcttcgccggctgggtcgtcatcatgaccgtcttcatcgccttcttcctgcccgagaccaagaacgtgcccatcgaggagatggtgcttgtctggaagtcacactggttctggaaaaggttcatcgccgacgaggacgtgcacgtcggcattggcaacaaccacccggccaaaaacggcagcgacaccaagggggccgacgcgtga

SEQ ID NO: 12227 - protein, 523 aa, Zea mays
MAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIIGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADA

SEQ ID NO: 12228 - DNA, 1602 bp, Zea mays
  CDS (1)..(1602)
atggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttgggatccttcttggctacgtttccaattatgccttctcaggcctttctgagcacatcaattggaggattatgcttggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttga

SEQ ID NO: 12229 - protein, 533 aa, Zea mays; identical to SEQ ID NO: 4533

SEQ ID NO: 12230 - DNA, 1545 bp, Zea mays
  CDS (1)..(1545)
atggcaggcggcgtggtggtgaacgcggccgggggcaagacgtaccccggccgcatgacgccgttcgtgttcttcacctgcctggtggcgtcatcgggcggcctcatcttcgggtacgacatcggcatctccggcggtgtcacgtccatggcgtcgttcctcaaggagttcttcccctccgtgtacgccaaggcggcggcgaacaaggacacgaaccagtactgcaagttcgacagccagctgctgacgctgttcacgtcgtcgctgtacctggcggcgctggcgacgtcgttcgtggcggcgtccgtgacgcgggtgttcgggcgcaagtggtccatgttctgcggcggggtgaccttcctggccgggtcggcgctaaacggcgccgccaccgacgtgatgatgctcatcatgggccgcatcctgctgggcgtgggcgtcggcttcgccaaccagtcggtgccgctgtacctgtcggagatggcgccggcgaagctgcgcggcatgctcaacatcgggttccagctgatgaccaccatcggcatcctggcggcgaacctgatcaacttctggacggcgggcatcgagggcgggtggggctggcgcatcgggctggggctcgcgggcgtgccggcgctcatcatcaccctgggcgcgctggtgctccccgacacgcccaactcccttatcgcccgcgggttcaacgacgacgccaaggcggtgctggtgaagatccgcggcacggacgacgtgcaggacgagtacgacgacatggtggcggcgagcgaggaggcgaacgccatcgagcacccgtggcgcaacatcctggagcgcaggtaccggccgcagctgacggtggcagcgctgatccccttcttccagcagctgacgggcatcaacgtgatcatgttctacgcgccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggtgttcgcgctggaggtccggtcggcggggcagagcatcgccgtgtgcgtcaacatgctgctcaccttcatcatcggccaggccttcctcagcatgctgtgctcgctcaagttcgggctcttctacttcttcgccgggtggatgttcatcatgaccaccttcatcgccctcttcctgccggagaccaagggggtgcccatcgaggagatgaacctcgtctggagccgccactggttctggggcaagtacgtcaacgtcgacacacaacacggcggcgccagcccgagatccaacggcgtctga

SEQ ID NO: 12231 - protein, 514 aa, Zea mays
MAGGVVVNAAGGKTYPGRMTPFVFFTCLVASSGGLIFGYDIGISGGVTSMASFLKEFFPSVYAKAAANKDTNQYCKFDSQLLTLFTSSLYLAALATSFVAASVTRVFGRKWSMFCGGVTFLAGSALNGAATDVMMLIMGRILLGVGVGFANQSVPLYLSEMAPAKLRGMLNIGFQLMTTIGILAANLINFWTAGIEGGWGWRIGLGLAGVPALIITLGALVLPDTPNSLIARGFNDDAKAVLVKIRGTDDVQDEYDDMVAASEEANAIEHPWRNILERRYRPQLTVAALIPFFQQLTGINVIMFYAPVLFLTIGFGDDASLMAAVITGLVNMFATVVSIVCVDRLGRRALFLQGGTQMFVSQIVVGTLIALQFGTAGVGEMSRSNAWLLVLFICLYVAGFAWSWGPLGWLVPSEVFALEVRSAGQSIAVCVNMLLTFIIGQAFLSMLCSLKFGLFYFFAGWMFIMTTFIALFLPETKGVPIEEMNLVWSRHWFWGKYVNVDTQHGGASPRSNGV

SEQ ID NO: 12232 - DNA, 1575 bp, Zea mays
  CDS (1)..(1575)
atggccggcggcgtggtggtgagctccggtgggggcaaggactaccccggcaagctcaccatgttcgtgctcttcgcctgcatcgtcgccgccaccggcggcctcatctttggatacgacatcggcatctctggtggcgtgacgtcgatgaacccgttcctgatgaagttcttcccgtcggtgtaccgcaaggagcaggaggcggagcggaaccagagcaaccagtactgcaagttcgacagccagctgctcaccatgttcacctcctcgctctacctggcggcgctcgtggcctccttcttcgccgccaccgtcacccgcgtggccggccgcaagtggtccatgttcggcggcggcgtcacgttcctggtcggcgccgcgctcaacggcgccgccaaggacgtgggcatgctcatcctcggccgcgtcctcctcggcgtcggcgtcggcttcgccaaccagtccgtgcccgtctacctctcggagatggcgccggcgcgcctccgcgggatgctcaacatcggcttccagctcatggtcaccatcggcatcctctgcgccaacctcatcaactacggcaccgccaagatcaggggcggctggggctggcgcgtcagcctcgcgctcgcggccgtgccggcgggcatcatcgccgtgggcgcgctcttcctgcccgacacacccaactccctcatcgaccgcggctacaccgacgccgccaagcggatgctcaagcgcgtgcggggcaccgacgacgtggaggaggagtacagcgacctggtggccgccagcgacgagtccaagctggtggcgcacccctggcgcaacatcctgcagccgcgctaccgcccgcagctcgtcatggccatcgccatccccatgttccagcagctcacgggcatcaacgtcatcatgttctacgccccggtcctcttcaagacgctgggcttcgcggacgacgcctccctcatgtccgccgtcatcacgggcctcgtcaacgtcttcgccaccttcgtgtccatcgtcaccgtcgaccgcctcggccgacgcaagctgttcctgcagggcggcacccagatgctcgcgtgccagatcgtcgtgggcagactcatcggcgccaattccggcttctccggcgtcgcggagatccccaaggggtacgccgccatcgtcgtgctcttcatctgcgcctacgtggccggcttcgcctggtcctggggccccctcggatggctggtgcccagcgagatcttcccgctggagatccgctcggcggggcagagcatcaacgtgtccgtcaacatgctctgcaccttcatcatcgcgcaggccttcctccccatgctctgccgcttcaagttcatcctcttcttcttcttcggcgcctgggtcgtcgtcatgaccatcttcgtcgcgctcttcctgccggagaccaagaacgtgcccatcgaggagatggggcgggtggggaaggcgcactggtactggggccgcttcatccgcgacgtccacgtgcacgtcggcgccgacctcgagatgccctccgccaacgccaagctcggcggcatgcagtag

SEQ ID NO: 12233 - protein, 524 aa, Zea mays
MAGGVVVSSGGGKDYPGKLTMFVLFACIVAATGGLIFGYDIGISGGVTSMNPFLMKFFPSVYRKEQEAERNQSNQYCKFDSQLLTMFTSSLYLAALVASFFAATVTRVAGRKWSMFGGGVTFLVGAALNGAAKDVGMLILGRVLLGVGVGFANQSVPVYLSEMAPARLRGMLNIGFQLMVTIGILCANLINYGTAKIRGGWGWRVSLALAAVPAGIIAVGALFLPDTPNSLIDRGYTDAAKRMLKRVRGTDDVEEEYSDLVAASDESKLVAHPWRNILQPRYRPQLVMAIAIPMFQQLTGINVIMFYAPVLFKTLGFADDASLMSAVITGLVNVFATFVSIVTVDRLGRRKLFLQGGTQMLACQIVVGRLIGANSGFSGVAEIPKGYAAIVVLFICAYVAGFAWSWGPLGWLVPSEIFPLEIRSAGQSINVSVNMLCTFIIAQAFLPMLCRFKFILFFFFGAWVVVMTIFVALFLPETKNVPIEEMGRVGKAHWYWGRFIRDVHVHVGADLEMPSANAKLGGMQ

SEQ ID NO: 12234 - DNA, 1602 bp, Zea mays
  CDS (1)..(1602)
atgccggcctctgaagaggaattgtcgaactggaaagggctctctcgctgcaggagggggacgaataggatggccggaggcgtcatagttccgagcgatggtcctgccgccgaccacggcgggagcctgacgctgtcggtgttcatgacctgccttgtggctgcctcgggcggcctcatcttcggctacgacatcggcatctcaggcggcgtctcggagatggagccgttcctgcggcgcttcttcccgcgcgtactggagcggatggcgtcggccagggggaacgagtactgcctctacgacagccagacgctgacggccttcacgtcgtcgctgtacgtggccgggctgctggcgtcgctcgtggccagccgcgtgaccagggccatgggccggcaggccgtcatgctcatgggcggcgccctgttcttcgccgggggagccgtgaccggcgccgccgtcaacatcgccatgctcatcgtcggccgcatgctgctcggcttcggcgtcgggttcaccaaccaggccgcccctctgttcctcgccgagatggccccgccgcggtggcgcggctccctgaccgcgggctaccagttcttcctcgcgctcggggtgctgatcgccaacctcgtgaactacgcgacggcacacgcctcctgggggtggcgcgtctcgctgggcctggcgggcgcgtcggccgtcgccatcttcgtgggcgcgctcttcctcaccgacacccccagcagcctcgtgatgcgggggcgcgccgacggggcccgggcggcgctgctccgggtgcgcgggcccgacgccgacgtggaggccgagctcagggacatcgccaaggccgtggaggccgcgcgccgcggcgaggacggcgcgttccgccggatggccacgcggcgcgagtaccgcccgcacctggtgctcgccgtggccgtgcccatgttcttccagctcacgggcgtcatcgtgctcgccttcttcgcgccgctcgtgttccggaccgtcggcttcgggagcagagccgccctcatgggcgccgtcgtactcggcgccgtcaacctgggctcgctcgtgctctccaccttcgtcatcgaccggtacggacggaaggtgctcttcatggccggcggcgtacagatggtcgtctgccaggtcgcgattgcttggatcatgggggcgaagatcggcaagggcggcgaggcggcaatggcgcacccgtacgccgtggcggtgctggtgttcacctgcctgcacactgccgggttcgggtggtcgtggggcccgctggggtgggtgatcccgagcgagatattcccggtggacatccggtcggcagggcaggccatgaacgtctccatcggcctctgcctcacctttgtgcagacgcagtcgttcctcgccatgttttgccgcttcaagtacgccaccttcgcctactacgccgcctgggtcgccgtcatgaccgttttcatcgccctcttcctgccggagaccaagggcatcccgctcgagtccatgggcaccatttgggtgaaacactggtattggaagaggtttgtccacgacggaaagcagagcaacgtggcactgacctaa

SEQ ID NO: 12235 - protein, 533 aa, Zea mays
MPASEEELSNWKGLSRCRRGTNRMAGGVIVPSDGPAADHGGSLTLSVFMTCLVAASGGLIFGYDIGISGGVSEMEPFLRRFFPRVLERMASARGNEYCLYDSQTLTAFTSSLYVAGLLASLVASRVTRAMGRQAVMLMGGALFFAGGAVTGAAVNIAMLIVGRMLLGFGVGFTNQAAPLFLAEMAPPRWRGSLTAGYQFFLALGVLIANLVNYATAHASWGWRVSLGLAGASAVAIFVGALFLTDTPSSLVMRGRADGARAALLRVRGPDADVEAELRDIAKAVEAARRGEDGAFRRMATRREYRPHLVLAVAVPMFFQLTGVIVLAFFAPLVFRTVGFGSRAALMGAVVLGAVNLGSLVLSTFVIDRYGRKVLFMAGGVQMVVCQVAIAWIMGAKIGKGGEAAMAHPYAVAVLVFTCLHTAGFGWSWGPLGWVIPSEIFPVDIRSAGQAMNVSIGLCLTFVQTQSFLAMFCRFKYATFAYYAAWVAVMTVFIALFLPETKGIPLESMGTIWVKHWYWKRFVHDGKQSNVALT

SEQ ID NO: 12236 - DNA, 1572 bp, Zea mays
  CDS (1)..(1572)
atggcgggcggaggggtggcggcgctgggcgtgaagacggagcgcgcggcgcagtacaaggggcgcatgacgctcgccgtcgccacgacctgcctcgtggccgccgtcgggggcgccatcttcggctacgacatcggcatctccggaggcgtgacatccatggacccattcctggagaaattcttcccggtagtgttccaccggaagaactccggcgggaagaacaactactgtaagtacgacaaccagggactagcggcgttcacatcgtcactctacctcgccggcctcgttgcctccctcgtcgcgtcccccgtgacgaggaactacggccgcaaagctagcattgtctgcggcggcgtgagcttcctcatcggcgcggccctcaacgtggccgccgtgaatctggctatgctcatcctcgggcgcatcatgctcggcgtcggcatcggttttggcaaccaggctgtgccgctgtacctgtcggagatggcgccggcgcacctccgcggcggcctgaacatgatgttccagctcgcgacgacgctgggcatcttcacggcgaacctgatcaactatggcacgcagaacatcaagccgtgggggtggcggctgtcgctgggcctcgcggcggtgccggcgctgctgatgacgttgggcgggctctttcttccggagactcccaacagcctcattgagcgcgggcgcgtggaggagggtcggcgcgtgctggagcgcatccggggcacggccgacgtggacgccgagttcacggacatggtggaggcgagcgagctggccaacaccgtcgagcacccgttccggaacatcctgcagccgcgcaaccggccgcagctggtgatggccgtgtgcatgccggcgttccagatcctgacgggcatcaactccatcctcttctacgcgccggtcctgttccagagcatgggtttcggcgggaacgcgtccctctactcctccgtgctcaccggcgccgtgctcttctcctcgacgctcatctccatcggcatcgtcgaccgcctcggccgccggaagctcctcatcagcggcgggatccagatgatcgtctgccaggtgatcgtggcggtgatcctgggcgtgaagttcggggcggagaagcaactggcgcggagctactcggtcgcggtggtggtggtgatctgcctgttcgttctggcgttcgggtggtcgtggggcccgctgggatggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctctttttcgcggggtggatcaccgtcatgaccgtgttcgtctacgtcttcctgccggagaccaagggcgtgcccatcgaagagatggtgctgctatggcggaagcactggttctggaagaaggtcatgccggacatgccgctcgaggatggctggggcgcggctgagggtcatgcggcacctgccagcaacaatcacaagggatga

SEQ ID NO: 12237 - protein, 523 aa, Zea mays
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 12238 - DNA, 1533 bp, Zea mays
  CDS (1)..(1533)
atgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggccaacatcgccatgctcatcgtcgggaggatgctgctcggcctggggctcggcttctccggccaggccacgccggtgtacctcgccgaggtgtcgcccccgcgctggcgcggcggcttcatctcggccttccccctcttcatcagcgtcgggtacctggtggccaacctcatcaactacggcacctcgcggatcccgggctggggctggcgcctctcgctcggcctcgcctccgtcccggccgccgtcatggtggtcggcgccgcgttcatcccggacacccccagcagcctcgtcctgcgcgggaagcacgacgacgcccgcgccgcgctccagcgggtgcgcggcaagggcgtggacatcggccccgagttcgcggacatcctcgccgcggcggagaacgaccgccggaacgaggagggcgcgttccgccggatcctgcgccgggagtaccggccctacctggtgatggccgtggcgttcccggtgttcctcaacctcacaggggtggccgtcaccgccttcttctcgccgatactgttccggaccgtcggcttcgagagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgacggtgctggtggtggcgctgatcttctcggcgagcttcagctggtcgtggggcgcgctgtactggaccatccccggcgagatataccccgtggaggtgcggtcggcggggcagggcgcggccgtggcgctcaacctggggctcaacttcttgcaggcgcagttcttcctggccatgctgtgctgcttcaagtacggcaccttcctcttctacgcgtcgtggctggttgtcatgaccgccttcgccgtggcgttcgtgccggagaccaagggcgtgccgctcgagtccatggctcacgtcttcgcgcgccactggtactggggcaggttcgtcaaggaccaccagaagttgggcgaagagtccacctag

SEQ ID NO: 12239 - protein, 510 aa, Zea mays
MPGGAFLLNGSGGGMADYGGGLTVPVVVTCLMAASGGLIFGYDIGISGGVSEMEDFLNKFFPGLLKRTARANKDVYCIYNNQALTAFTSSLYAFGMVGTLLASRVTRRLGRQAVMLIGGGLFLAGALVNAAAANIAMLIVGRMLLGLGLGFSGQATPVYLAEVSPPRWRGGFISAFPLFISVGYLVANLINYGTSRIPGWGWRLSLGLASVPAAVMVVGAAFIPDTPSSLVLRGKHDDARAALQRVRGKGVDIGPEFADILAAAENDRRNEEGAFRRILRREYRPYLVMAVAFPVFLNLTGVAVTAFFSPILFRTVGFESDAALMGAVILGLMNIGGILASGFAMDRYGRKLLFMIGGALMFTCQVAMASIIGSHLGNGSKMPKGYAVTVLVVALIFSASFSWSWGALYWTIPGEIYPVEVRSAGQGAAVALNLGLNFLQAQFFLAMLCCFKYGTFLFYASWLVVMTAFAVAFVPETKGVPLESMAHVFARHWYWGRFVKDHQKLGEEST

SEQ ID NO: 12240 - DNA, 1563 bp, Zea mays
  CDS (1)..(1563)
atggcgatcggggcgttcgtggagggcgctccggcggacggcggagaaggttacagcggccgcgtgacgcccttcgtggtgctgtcctgcgtcgtcgccggcagcggcggcgtcctcttcggatacgacctcggcatctccggtggtcttacctcaatggactgcttcctgaagagattcttcccaaaggtgtaccgtcagaagcaggacagcaaagtgagccactactgcgagttcaacagcgagctcctcaccgtcttcacgtcctccctctatatcgccggccttgttgcaactctggctgcagcaaccatcacaaggaggtatggccgtcgcacatcaatgctgatcggcggcagtgtcttcatcgcgggctcagtgttcggtggtgcagccaccaatattcccatgctcctaatgaacaggattctactggggattggtctggggttcactaatcagtcaatcccattgtacctgtccgaaatggcgccaccccaataccgcggggcaatcaacaacggcttcgagctctgcatcagccttggcatcctcttcgcgaacgtgctcaactatttcgtcataaaaatcacagcaggatggggatggaggatatccctgtccatggccgcactgcccgccgcattcctaaccatcggcgcgatcttcctccccgagacgccaagcttcataatccaacgtgacggcaacaacacggacaaggcaagggtgctgctccagaagctgcgcggaacggcctcggtccagaaagagctcgacgacctggtccgtgctagcgacctctcacgagcaacccggtacccattcaggaacatactcgagaggaagtacaggccgcagcttgtggtggcgctgctggtccctttcttcaaccaggttagcgggatcaacgtggtgaacttctacgcgccggtcatgttcaggacgatcggtctcaaggagagcgcgtccctcctgtcctcggtggtgacacgcctgtgcgcgacgtctgccaacgtcgtggcgatggtggtggtcgacagggttgggcgcaggaagctcttccttgccggcggcgtgcagatgatactttcgcagttcaccgtcggcgcgatcctggctgcgaagttcagggactacgaggagatgggtgatgggtacgcgtacctggtgctgaccacactgtgtgtgttcgttgcaggctttgcgtggtcgtggggccctctcaccttcttggtccctgccgaggtctgcccgctggagatcaggtccgcggggcagagcatcgtggtcgctgtggttttcttgatgacgtttgtgattagccagacgtttcttgaggtcctctgccgcatcaagtcggcgacgttcttcgtcttcggtggatggatctgcctgatgacgttgttcgtttatctgttcctgcctgagaccaagaagctgcccatggagcagatggagcaggtatggaagacacactggttctggaagaaggttgtgggagaggaagcggataggaaagaaacaggagcagggaagatagctttgtcgggcttgtcttag

SEQ ID NO: 12241 - protein, 520 aa, Zea mays
MAIGAFVEGAPADGGEGYSGRVTPFVVLSCVVAGSGGVLFGYDLGISGGLTSMDCFLKRFFPKVYRQKQDSKVSHYCEFNSELLTVFTSSLYIAGLVATLAAATITRRYGRRTSMLIGGSVFIAGSVFGGAATNIPMLLMNRILLGIGLGFTNQSIPLYLSEMAPPQYRGAINNGFELCISLGILFANVLNYFVIKITAGWGWRISLSMAALPAAFLTIGAIFLPETPSFIIQRDGNNTDKARVLLQKLRGTASVQKELDDLVRASDLSRATRYPFRNILERKYRPQLVVALLVPFFNQVSGINVVNFYAPVMFRTIGLKESASLLSSVVTRLCATSANVVAMVVVDRVGRRKLFLAGGVQMILSQFTVGAILAAKFRDYEEMGDGYAYLVLTTLCVFVAGFAWSWGPLTFLVPAEVCPLEIRSAGQSIVVAVVFLMTFVISQTFLEVLCRIKSATFFVFGGWICLMTLFVYLFLPETKKLPMEQMEQVWKTHWFWKKVVGEEADRKETGAGKIALSGLS

SEQ ID NO: 12242 - DNA, 23 bp, Artificial sequence
  primer
atgtctgaattcgctactagccg

SEQ ID NO: 12243 - DNA, 26 bp, Artificial sequence
  primer
ttattcctcggaaactcttttttctt

SEQ ID NO: 12244 - protein, 668 aa, Artificial sequence
  consensus sequence
  Variant (3)..(4): Xaa in position 3 to 4 is any amino acid
  Variant (7)..(7): Xaa in position 7 is any amino acid
  Variant (8)..(23): Xaa in position 8 to 23 is any or no amino acid
  Variant (25)..(25): Xaa in position 25 is any amino acid
  Variant (27)..(29): Xaa in position 27 to 29 is any amino acid
  Variant (31)..(55): Xaa in position 31 to 55 is any amino acid
  Variant (56)..(85): Xaa in position 56 to 85 is any or no amino acid
  Variant (87)..(89): Xaa in position 87 to 89 is any amino acid
  Variant (91)..(101): Xaa in position 91 to 101 is any amino acid
  Variant (104)..(116): Xaa in position 104 to 116 is any amino acid
  Variant (117)..(117): Xaa in position 117 is any or no amino acid
  Variant (119)..(133): Xaa in position 119 to 133 is any amino acid
  Variant (134)..(152): Xaa in position 134 to 152 is any or no amino acid
  Variant (154)..(156): Xaa in position 154 to 156 is any amino acid
  Variant (158)..(160): Xaa in position 158 to 160 is any amino acid
  Variant (162)..(167): Xaa in position 162 to 167 is any amino acid
  Variant (169)..(172): Xaa in position 169 to 172 is any amino acid
  Variant (174)..(175): Xaa in position 174 to 175 is any amino acid
  Variant (176)..(177): Xaa in position 176 to 177 is any or no amino acid
  Variant (179)..(181): Xaa in position 179 to 181 is any amino acid
  Variant (184)..(189): Xaa in position 184 to 189 is any amino acid
  Variant (191)..(195): Xaa in position 191 to 195 is any amino acid
  Variant (197)..(207): Xaa in position 197 to 207 is any amino acid
  Variant (208)..(249): Xaa in position 208 to 249 is any or no amino acid
  Variant (252)..(271): Xaa in position 252 to 271 is any amino acid
  Variant (272)..(272): Xaa in position 272 is any or no amino acid
  Variant (278)..(278): Xaa in position 278 is any amino acid
  Variant (280)..(284): Xaa in position 280 to 284 is any amino acid
  Variant (285)..(296): Xaa in position 285 to 296 is any or no amino acid
  Variant (298)..(341): Xaa in position 298 to 341 is any amino acid
  Variant (342)..(385): Xaa in position 342 to 385 is any or no amino acid
  Variant (388)..(389): Xaa in position 388 to 389 is any amino acid
  Variant (391)..(391): Xaa in position 391 is any amino acid
  Variant (393)..(394): Xaa in position 393 to 394 is any amino acid
  Variant (395)..(396): Xaa in position 395 to 396 is any or no amino acid
  Variant (398)..(399): Xaa in position 398 to 399 is any amino acid
  Variant (400)..(401): Xaa in position 400 to 401 is any or no amino acid
  Variant (403)..(434): Xaa in position 403 to 434 is any amino acid
  Variant (435)..(446): Xaa in position 435 to 446 is any or no amino acid
  Variant (450)..(454): Xaa in position 450 to 454 is any amino acid
  Variant (456)..(497): Xaa in position 456 to 497 is any amino acid
  Variant (498)..(565): Xaa in position 498 to 565 is any or no amino acid
  Variant (567)..(570): Xaa in position 567 to 570 is any amino acid
  Variant (572)..(573): Xaa in position 572 to 573 is any amino acid
  Variant (575)..(577): Xaa in position 575 to 577 is any amino acid
  Variant (578)..(578): Xaa in position 578 is any or no amino acid
  Variant (580)..(586): Xaa in position 580 to 586 is any amino acid
  Variant (587)..(593): Xaa in position 587 to 593 is any or no amino acid
  Variant (595)..(628): Xaa in position 595 to 628 is any amino acid
  Variant (629)..(643): Xaa in position 629 to 643 is any or no amino acid
  Variant (646)..(646): Xaa in position 646 is any amino acid
  Variant (648)..(648): Xaa in position 648 is any amino acid
  Variant (649)..(666): Xaa in position 649 to 666 is any or no amino acid
GGXXFGXXXXXXXXXXXXXXXXXDXGXXXGXXXXXXXXXXXXXXXXXXXXXXXXXXXXXXXXXXXXXXXXXXXXXXXXXXXXXXXGXXXGXXXXXXXXXXXGRXXXXXXXXXXXXXXGXXXXXXXXXXXXXXXXXXXXXXXXXXXXXXXXXXRXXXGXXXGXXXXXXPXXXXEXXXXPXXXRGXXXXXXQXXXXXGXXXXXXXXXXXXXXXXXXXXXXXXXXXXXXXXXXXXXXXXXXXXXXXXXXXXXWRXXXXXXXXXXXXXXXXXXXXXPESPRXLXXXXXXXXXXXXXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXQQXXGXNXXXXYXXXXFXXXXXXXXXXXXXXXXXXXXXXXXXXXXXXXXXXXXXXXXXXXXGRRXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXEXXPXXXXRXXXXXXXXXXXXXXWXXXXXXXXXXXXXXXXXXXXXXXXXXXXXXXXXXXXXXXXXXXXXXXXXETXGXXXXXXXXXXXXXXXXXXXLE

SEQ ID NO: 12245 - protein, 30 aa, Artificial sequence
  protein pattern
  Variant (2)..(4): Xaa in position 2 to 4 is any amino acid
  Variant (6)..(6): Xaa in position 6 is any amino acid
  Variant (7)..(7): Xaa in position 7 is Ala, Cys, Gly, Ser, Thr or Val
  Variant (8)..(8): Xaa in position 8 is any amino acid
  Variant (10)..(15): Xaa in position 10 to 15 is any amino acid
  Variant (17)..(19): Xaa in position 17 to 19 is any amino acid
  Variant (20)..(20): Xaa in position 20 is Ala, Gly, Ser or Thr
  Variant (22)..(23): Xaa in position 22 to 23 is any amino acid
  Variant (24)..(24): Xaa in position 24 is any or no amino acid
  Variant (26)..(27): Xaa in position 26 to 27 is any amino acid
  Variant (28)..(28): Xaa in position 28 is any or no amino acid
RXXXGXXXGXXXXXXPXXXXEXXXPXXXRG

SEQ ID NO: 12246 - DNA, 2115 bp, Saccharomyces cerevisiae
  CDS (1)..(2115)
atgacggtcgaccatgatttcaatagcgaagatattttattccccatagaaagcatgagtagtatacaatacgtggagaataataacccaaataatattaacaacgatgttatcccgtattctctagatatcaaaaacactgtcttagatagtgcggatctcaatgacattcaaaatcaagaaacttcactgaatttggggcttcctccactatctttcgactctccactgcccgtaacggaaacgataccatccactaccgataacagcttgcatttgaaagctgatagcaacaaaaatcgcgatgcaagaactattgaaaatgatagtgaaattaagagtactaataatgctagtggctctggggcaaatcaatacacaactcttacttcaccttatcctatgaacgacattttgtacaacatgaacaatccgttacaatcaccgtcaccttcatcggtacctcaaaatccgactataaatcctcccataaatacagcaagtaacgaaactaatttatcgcctcaaacttcaaatggtaatgaaactcttatatctcctcgagcccaacaacatacgtccattaaagataatcgtctgtccttacctaatggtgctaattcgaatcttttcattgacactaacccaaacaatttgaacgaaaaactaagaaatcaattgaactcagatacaaattcatattctaactccatttctaattcaaactccaattctacgggtaatttaaattccagttattttaattcactgaacatagactccatgctagatgattacgtttctagtgatctcttattgaatgatgatgatgatgacactaatttatcacgccgaagatttagcgacgttataacaaaccaatttccgtcaatgacaaattcgaggaattctatttctcactctttggacctttggaaccatccgaaaattaatccaagcaatagaaatacaaatctcaatatcactactaattctacctcaagttccaatgcaagtccgaataccactactatgaacgcaaatgcagactcaaatattgctggcaacccgaaaaacaatgacgctaccatagacaatgagttgacacagattcttaacgaatataatatgaacttcaacgataatttgggcacatccacttctggcaagaacaaatctgcttgcccaagttcttttgatgccaatgctatgacaaagataaatccaagtcagcaattacagcaacagctaaaccgagttcaacacaagcagctcacctcgtcacataataacagtagcactaacatgaaatccttcaacagcgatctttattcaagaaggcaaagagcttctttacccataatcgatgattcactaagctacgacctggttaataagcaggatgaagaccccaagaacgatatgctgccgaattcaaatttgagttcatctcaacaatttatcaaaccgtctatgattctttcagacaatgcgtccgttattgcgaaagtggcgactacaggcttgagtaatgatatgccatttttgacagaggaaggtgaacaaaatgctaattctactccaaatttcgatctttccatcactcaaatgaatatggctccattatcgcctgcatcatcatcctccacgtctcttgcaacaaatcatttctatcaccatttcccacagcagggtcaccataccatgaactctaaaatcggttcttcccttcggaggcggaagtctgctgtgcctttgatgggtacggtgccgcttacaaatcaacaaaataatataagcagtagtagtgtcaactcaactggcaatggtgctggggttacgaaggaaagaaggccaagttacaggagaaaatcaatgacaccgtccagaagatcaagtgtcgtaatagaatcaacaaaggaactcgaggagaaaccgttccactgtcacatttgtcccaagagctttaagcgcagcgaacatttgaaaaggcatgtgagatctgttcactctaacgaacgaccatttgcttgtcacatatgcgataagaaatttagtagaagcgataatttgtcgcaacacatcaagactcataaaaaacatggagacatttaa

SEQ ID NO: 12247 - protein, 704 aa, Saccharomyces cerevisiae
MTVDHDFNSEDILFPIESMSSIQYVENNNPNNINNDVIPYSLDIKNTVLDSADLNDIQNQETSLNLGLPPLSFDSPLPVTETIPSTTDNSLHLKADSNKNRDARTIENDSEIKSTNNASGSGANQYTTLTSPYPMNDILYNMNNPLQSPSPSSVPQNPTINPPINTASNETNLSPQTSNGNETLISPRAQQHTSIKDNRLSLPNGANSNLFIDTNPNNLNEKLRNQLNSDTNSYSNSISNSNSNSTGNLNSSYFNSLNIDSMLDDYVSSDLLLNDDDDDTNLSRRRFSDVITNQFPSMTNSRNSISHSLDLWNHPKINPSNRNTNLNITTNSTSSSNASPNTTTMNANADSNIAGNPKNNDATIDNELTQILNEYNMNFNDNLGTSTSGKNKSACPSSFDANAMTKINPSQQLQQQLNRVQHKQLTSSHNNSSTNMKSFNSDLYSRRQRASLPIIDDSLSYDLVNKQDEDPKNDMLPNSNLSSSQQFIKPSMILSDNASVIAKVATTGLSNDMPFLTEEGEQNANSTPNFDLSITQMNMAPLSPASSSSTSLATNHFYHHFPQQGHHTMNSKIGSSLRRRKSAVPLMGTVPLTNQQNNISSSSVNSTGNGAGVTKERRPSYRRKSMTPSRRSSVVIESTKELEEKPFHCHICPKSFKRSEHLKRHVRSVHSNERPFACHICDKKFSRSDNLSQHIKTHKKHGDI

SEQ ID NO: 12248 - DNA, 1794 bp, Candida glabrata CBS 138
  CDS (1)..(1794)
atgagtgtggaacaggagcctagctcgtggtcgacacagatggaaaacatgttctcgctcaatatacaggaccagaatgccgacgtgaagtatcagtcgccattgacaccgaactacatgtctctggatatataccagggccataaggcggacattgcgagcaatcgtggtgatgccaacaatgacaacggcgatgacaacgagattgcttctgcgcgtggggaaagcaatggcagagacacagacaatgggattaacacaaacaccacgaccacgaccaactcgagtacggttgagaccaacatgacgacgacacctgcgacgctggacgacttcttgatgaactttgactctggtgcgaccacagcgactggcaaggacaagaacccgctggtgtcggataaaccgttgggcactcacctacagatgaattttgtcgatagctcttctaatggtgcgttgcctttcagcgaccaaaagggcagaagggcaactatatacaacggcttcttcgagtccatgcacttggacaccatgctggatgactacttatccacagagctgttactaaatgaaaaacctaacggtagcaataacaacaacgatgacgacgaaactgttgccaatgagagaagacacagtgaagtagttaccgggaataccattaacttggcctctgctagaaattctatttcacacggtgtcgacttctggaacgtcgactcccataggaaaagaggttccaataatggcttacatcgggatggtcatgtaaataaaagtattaccagaagagccacaggcgggaccgaaaaacatttgactgacgatagcttacttcttgacagtgacatctcttctcacaaaatagacaacgaactgtcacagatcttaagcgactacaatatgaacttcaagccagggacagaggagtctccactgaaatacaacacagcagactactacaattttgatggaaactcagaagatgtgtcgcactcaagtgctggccaaagccacagacctttcatgaaaaatccacacagagcatccctaccgattctgtcagaggctactccaccagaatatgatttagacattaagaaaaaacaacctgatgtatcaatatttaaagatattccgtgggaatcattcaatgcggaaggtgctgatgagaacgatttgtctgtagcaaaccaaaacttctacaaccctgaaataatctcaagccccaagtcaccaaacgataagttcatcaaacctaccatgatattatcagatgcaagtctagctgaagttgaaatgatgaataacagcataaagagtttaaatactagcctggatatatcgattcctcctgatgtacttaacaaggacctgaaggaatcctggcaaaatagccaatcaagaaaaagtattagtggaagctcaggcagacgtagatcttctgcggcactatcgatgtccaattttaacaataacttacatttcaatatcaatgcttccaaatccaatccaagaagaaaaagcaagccaagtataagccctaactcgtcattactatcaagcaatatcgacagaaacaatgatatcgataaaccatttggatgtcacctttgctcaaaggctttcaagagaagtgaacacttgaaaagacacgttcggtccgttcattctactgaccgtccattcagttgtcatctatgtgagaagaaatttagtagaagtgataacctttcacaacacattaaaacacataaaaagtcgggaagtacttccacaactaaagaataa

SEQ ID NO: 12249 - protein, 597 aa, Candida glabrata CBS 138
MSVEQEPSSWSTQMENMFSLNIQDQNADVKYQSPLTPNYMSLDIYQGHKADIASNRGDANNDNGDDNEIASARGESNGRDTDNGINTNTTTTTNSSTVETNMTTTPATLDDFLMNFDSGATTATGKDKNPLVSDKPLGTHLQMNFVDSSSNGALPFSDQKGRRATIYNGFFESMHLDTMLDDYLSTELLLNEKPNGSNNNNDDDETVANERRHSEVVTGNTINLASARNSISHGVDFWNVDSHRKRGSNNGLHRDGHVNKSITRRATGGTEKHLTDDSLLLDSDISSHKIDNELSQILSDYNMNFKPGTEESPLKYNTADYYNFDGNSEDVSHSSAGQSHRPFMKNPHRASLPILSEATPPEYDLDIKKKQPDVSIFKDIPWESFNAEGADENDLSVANQNFYNPEIISSPKSPNDKFIKPTMILSDASLAEVEMMNNSIKSLNTSLDISIPPDVLNKDLKESWQNSQSRKSISGSSGRRRSSAALSMSNFNNNLHFNINASKSNPRRKSKPSISPNSSLLSSNIDRNNDIDKPFGCHLCSKAFKRSEHLKRHVRSVHSTDRPFSCHLCEKKFSRSDNLSQHIKTHKKSGSTSTTKE

SEQ ID NO: 12250 - DNA, 2085 bp, Kluyveromyces lactis NRRL Y-1140
  CDS (1)..(2085)
atggctctgggtcggtatgagtctggaaaccgaggctcttatacttcagagaattcattagatataagaaacgattcggtatcgacaaattacggtgataaagttgcaactgagccaacacttggctatacacggaggaacgaaagtacgggcagcacaccgcctgctgttaggaatgttaagagggaaacgctgcaaaacaacatgggaagtacgccgacagaattgaatgacttcttggcaatgctagatgataaaacaacgtattccgaggttgttcagtcggcagaaccacggctggggtttgaggaccggcagaaatcgacggaataccatacggggtctgaattgagcgggaatagtaacggaatagctcttagtgggagtcccgtcgatagctaccctaattctcaaaagatttctaatcatagctcaaggaacaatacactgaactattctcccaatatagaaccctcagtaatgtctgtcggtaccctgtcgccgcaggtggccgatataagctccaggaaaaactctaccgttggtaactcgttaaattcgaactctatacaggagtttttgaaccaaattgatctgagtcattccgaagaacagtatattaatccctacttactcaacaaggagtcctactctacaaacaataatacaaacaatggacataatagctttgaagttacacattccgattcgttgtttatggacagtggtgctgatgctgaagccgaagatcatggagagttgaaccaacttaatgaaaatccgttgctattggacgacgtgacagtatcaccaaaccctacctcagacgatagaagacggatgagtgaggttgtaaacggcaatatagcataccctgcacattcaagaggttctatttctcaccaggtggacttttggaatttgggttcaggtaatcctatttcctctaaccaaaaccaaagtagtaattctcaagttcagcaagataacaattcggagttgtttgacttaatgagtttcaaaaataagggaagacaacatctgcaacagcaactgcaacaacagcaacaacaggctcagctgcaatcacaaatgcaccgccaacagatacaacagcgccagcagcaccagcagcaacagtcacagcaacgccatagtgcgtttaagattgataacgagctcactcaactattgaatgcttataatatgacacaatccaacctgcctagcaacggcagtaacataaacactaacaagttaaggactggttcctttacacaatcgaatgtcaagagaagcaattcatcaaatcaggaagcacataatagagttggtaagcaacgatattcaatgtcacttttggatggtaaccaagatgttatatcgaagctatatggagacatgacgcgcaatggactttcttgggaaaatgctataatatccgatgatgaagaagatccagaagatcatgaagatgctttaaggctcagaagaaaatctgcattgaataggtcaacccaagttgcatcacagaatcctacggaaacttcatcaagtggacgatttatttctccacaattgttgaacaacgatccactactagagactcaaatttccacgagccaaacttcgttaggccttgatagagctggtttgaattttaaactcaatttacccattacaaaccctgaagcccttattggatcaagccaacctgatgtccaaactcttaatgtttactctgaatcaaatgttctccccacaagtgcacagtcgacaaccacgaagaagaaacggtccagcatgtccaaatcaaagggccctaaatctacctctccgatggatgaagaagaaaagcctttcaaatgtgatcaatgtaataagaccttccgccgtagcgaacacttgaaaagacatgtacgttctgttcactcgacggaaagacctttccactgtcagttttgtgataagaagttcagtagaagcgacaatttatcacagcatttaaagacacacaagaagcacggcgatataactgagctacccccaccgagaagagtcacgaattcttcaaacaagcactga

SEQ ID NO: 12251 - protein, 694 aa, Kluyveromyces lactis NRRL Y-1140
MALGRYESGNRGSYTSENSLDIRNDSVSTNYGDKVATEPTLGYTRRNESTGSTPPAVRNVKRETLQNNMGSTPTELNDFLAMLDDKTTYSEVVQSAEPRLGFEDRQKSTEYHTGSELSGNSNGIALSGSPVDSYPNSQKISNHSSRNNTLNYSPNIEPSVMSVGTLSPQVADISSRKNSTVGNSLNSNSIQEFLNQIDLSHSEEQYINPYLLNKESYSTNNNTNNGHNSFEVTHSDSLFMDSGADAEAEDHGELNQLNENPLLLDDVTVSPNPTSDDRRRMSEVVNGNIAYPAHSRGSISHQVDFWNLGSGNPISSNQNQSSNSQVQQDNNSELFDLMSFKNKGRQHLQQQLQQQQQQAQLQSQMHRQQIQQRQQHQQQQSQQRHSAFKIDNELTQLLNAYNMTQSNLPSNGSNINTNKLRTGSFTQSNVKRSNSSNQEAHNRVGKQRYSMSLLDGNQDVISKLYGDMTRNGLSWENAIISDDEEDPEDHEDALRLRRKSALNRSTQVASQNPTETSSSGRFISPQLLNNDPLLETQISTSQTSLGLDRAGLNFKLNLPITNPEALIGSSQPDVQTLNVYSESNVLPTSAQSTTTKKKRSSMSKSKGPKSTSPMDEEEKPFKCDQCNKTFRRSEHLKRHVRSVHSTERPFHCQFCDKKFSRSDNLSQHLKTHKKHGDITELPPPRRVTNSSNKH

SEQ ID NO: 12252 - DNA, 2115 bp, Saccharomyces cerevisiae
  CDS (1)..(2115)
atgacggtcgaccatgatttcaatagcgaagatatcttattccccatagaaagcatgagtagtatacaatacgtggagaataataacccaaataatattaacaacgatgttatcccgtattctctagatatcaaaaacactgtcttagatagtgcggatctcaatgacattcaaaatcaagaaacttcactgaatttggggcttcctccactatctttcgactctccactgcccgtaacggaaacgataccatccactaccgataacagcttgcatttgaaagctgatagcaacaaaaatcgcgatacaagaactattgaaaatgatagtgaaattaagagtaccaataatgctaatggctctggggcaaatcaatacacaactcttacttcaccttatcctatgaacgacattttgtacaacatgaacaatccgttacaatcaccgtcaccttcatcggtacctcaaaatccgactataaatcctcccataaatacagcaagtaacgaaaccaatttatcgcctcaaacttcaaatggtaatgaaactcttatatctcctcgagcccaacaacatacgtccattaaagataatcgtctgtccttacctaatggtgctaattcgaatcttttcattgacactaacccaaacaatttgaacgaaaaactaagaaatcaattgaactcagatacaaattcatattctaactccatttctaattcaaactccaattctacgggtaatttaaattccagttattttaattcactgaacatagactccatgctagatgattacgtttctagtgatctcttattgaatgatgatgatgatgacactaatttatcacgccgaagatttagcgacgttataacaaaccaatttccgtcaatgacaaattcgaggaattctatttctcactctttggacctttggaaccatccgaaaattaatccaagcaatagaaatacaaatctcaatatcactactaattctacctcaagctccaatgcaagtccgaataccactactatgaacgcaaatgcagactcaaatattgctggcaacccgaaaaacaatgacgctaccatagacaatgagttgacacagattcttaacgaatataatatgaacttcaacgataatttgggcacatccacttctggcaagaacaaatctgcttgcccaagttcttttgatgccaatgctatgacaaagataaatccaagtcagcaattacagcaacagctaaaccgagttcaacacaagcagctcacctcgtcacataataacagtagcactaacatgaaatccttcaacagcgatctttattcgagaaggcaaagagcttctttacccataatcgatgattcactaagctacgatctggttaataagcaggatgaagaccccaagaacgatatgctgccgaattcaaatttgagttcatctcaacaatttatcaaaccgtctatgattctttcagacaatgcgtccgttattgcgaaagtggcgactacaggcttgagtaatgatatgccatttttgacagaggaaggtgaacaaaatgctaattctactccaaatttcgatctttccatcactcaaatgaatatggctccattatcgcctgcgtcatcatcctccacgtctcttgcaacaaatcatttctatcaccatttcccacagcagggtcaccataccatgaactctaaaatcggttcttcccttcggaggcggaagtctgctgtgcctttgatgggtacggtgccgcttacaaatcaacaaaatgatataagcagtagtagtgtcaactcaactggcaatggtgctggggttacgaaggaaagaaggccaagttacaggagaaaatcaatgacaccgtccagaagatcaagtgtcgtaatagaatcaacaaaggaactcgaggagaaaccgttccactgtcacatttgtcccaagagctttaagcgcagcgaacatttgaaaaggcatgtgagatctgttcactctaacgaacgaccatttgcttgtcacatatgtgataagaaatttagtagaagcgataatttgtcgcaacacatcaagactcataaaaaacatggagacatttaa

SEQ ID NO: 12253 - protein, 704 aa, Saccharomyces cerevisiae
MTVDHDFNSEDILFPIESMSSIQYVENNNPNNINNDVIPYSLDIKNTVLDSADLNDIQNQETSLNLGLPPLSFDSPLPVTETIPSTTDNSLHLKADSNKNRDTRTIENDSEIKSTNNANGSGANQYTTLTSPYPMNDILYNMNNPLQSPSPSSVPQNPTINPPINTASNETNLSPQTSNGNETLISPRAQQHTSIKDNRLSLPNGANSNLFIDTNPNNLNEKLRNQLNSDTNSYSNSISNSNSNSTGNLNSSYFNSLNIDSMLDDYVSSDLLLNDDDDDTNLSRRRFSDVITNQFPSMTNSRNSISHSLDLWNHPKINPSNRNTNLNITTNSTSSSNASPNTTTMNANADSNIAGNPKNNDATIDNELTQILNEYNMNFNDNLGTSTSGKNKSACPSSFDANAMTKINPSQQLQQQLNRVQHKQLTSSHNNSSTNMKSFNSDLYSRRQRASLPIIDDSLSYDLVNKQDEDPKNDMLPNSNLSSSQQFIKPSMILSDNASVIAKVATTGLSNDMPFLTEEGEQNANSTPNFDLSITQMNMAPLSPASSSSTSLATNHFYHHFPQQGHHTMNSKIGSSLRRRKSAVPLMGTVPLTNQQNDISSSSVNSTGNGAGVTKERRPSYRRKSMTPSRRSSVVIESTKELEEKPFHCHICPKSFKRSEHLKRHVRSVHSNERPFACHICDKKFSRSDNLSQHIKTHKKHGDI

SEQ ID NO: 12254 - DNA, 1893 bp, Saccharomyces cerevisiae
  CDS (1)..(1893)
atgctagtcttcggacctaatagtagtttcgttcgtcacgcaaacaagaaacaagaagattcgtctataatgaacgagccaaacggattgatggacccggtattgagcacaaccaacgtttctgctacttcttctaatgacaattctgcgaacaatagcatatcttcgccggaatatacctttggtcaattctcaatggattctccgcatagaacggacgccactaatactccaattttaacagcgacaactaatacgactgctaataatagtttaatgaatttaaaggataccgccagtttagctaccaactggaagtggaaaaattccaataacgcacagttcgtgaatgacggtgagaaacaaagcagtaatgctaatggtaagaaaaatggtggtgataagatatatagttcagtagccacccctcaagctttaaatgacgaattgaaaaacttggagcaactagaaaaggtattttctccaatgaatcctatcaatgacagtcattttaatgaaaatatagaattatcgccacaccaacatgcaacttctcccaagacaaaccttcttgaggcagaaccttcaatatattccaatttgtttctagatgctaggttaccaaacaacgccaacagtacaacaggattgaacgacaatgattataatctagacgataccaataatgataatactaatagcatgcaatcaatcttagaggattttgtatcttcagaagaagcattgaagttcatgccggacgctggtcgcgacgcaagaagatacagcgaggtggttacctcttcctttccttctatgacggattctagaaattcgatctctcattcgatagagttttggaatctcaatcacaaaaatagtagcaacagtaaacccactcaacaaattatccctgaaggtactgccactactgagaggcgtggatcaaccatttcacctactaccactataaacaactctaatccaaacttcaaattattagatcatgacgtttctcaagctctgagcggttatagtatggatttttctaaggactctggtataacaaagccaaaaagcatttcctcttctttaaatcgcatctcccatagcagtagcaccacaaggcaacagcgtgcctctttgcccttaattcatgatattgaatcttttgcaaatgattcggtgatggcaaatcctctgtctgattccgcatcatttctttcagaagaaaatgaagacgatgcttttggtgcgctaaattacaatagcttagatgcaaccacaatgtcggcattcgacaataacgtagaccccttcaacattctcaagtcatctccggctcaggatcaacagtttatcaaaccctctatgatgttgtcggataatgcctctgctgccgctaaattggcgacttctggtgttgataatatcacacctacaccagctttccaaagaagaagctatgatatctcgatgaactcttcgttcaaaatacttcctactagtcaagctcaccatgcagctcaacatcatcaacaacaacctactaaacaggcaacggtaagcccaaacacaagaagaagaaagtcgtcaagtgttactttaagtccaactatttctcataacaacaacaatggtaaggttcctgtccaacctcggaaaaggaaatctattactaccattgaccccaacaactacgataaaaataaacctttcaagtgtaaagactgtgagaaggcattcagacgcagtgagcacttgaaaaggcatataagatccgttcattcaacggaacgcccttttgcttgtatgttctgtgagaaaaaattcagtagaagtgacaatttatcacaacatctaaaaactcacaaaaagcacggtgatttttga

SEQ ID NO: 12255 - protein, 630 aa, Saccharomyces cerevisiae
MLVFGPNSSFVRHANKKQEDSSIMNEPNGLMDPVLSTTNVSATSSNDNSANNSISSPEYTFGQFSMDSPHRTDATNTPILTATTNTTANNSLMNLKDTASLATNWKWKNSNNAQFVNDGEKQSSNANGKKNGGDKIYSSVATPQALNDELKNLEQLEKVFSPMNPINDSHFNENIELSPHQHATSPKTNLLEAEPSIYSNLFLDARLPNNANSTTGLNDNDYNLDDTNNDNTNSMQSILEDFVSSEEALKFMPDAGRDARRYSEVVTSSFPSMTDSRNSISHSIEFWNLNHKNSSNSKPTQQIIPEGTATTERRGSTISPTTTINNSNPNFKLLDHDVSQALSGYSMDFSKDSGITKPKSISSSLNRISHSSSTTRQQRASLPLIHDIESFANDSVMANPLSDSASFLSEENEDDAFGALNYNSLDATTMSAFDNNVDPFNILKSSPAQDQQFIKPSMMLSDNASAAAKLATSGVDNITPTPAFQRRSYDISMNSSFKILPTSQAHHAAQHHQQQPTKQATVSPNTRRRKSSSVTLSPTISHNNNNGKVPVQPRKRKSITTIDPNNYDKNKPFKCKDCEKAFRRSEHLKRHIRSVHSTERPFACMFCEKKFSRSDNLSQHLKTHKKHGDF

SEQ ID NO: 12256 - DNA, 25 bp, Artificial sequence
  primer
atgacggtcgaccatgatttcaata

SEQ ID NO: 12257 - DNA, 27 bp, Artificial sequence
  primer
ttaaatgtctccatgttttttatgagt

SEQ ID NO: 12258 - protein, 670 aa, Artificial sequence
  consensus sequence
  Variant (2)..(17): Xaa in position 2 to 17 is any amino acid
  Variant (19)..(25): Xaa in position 19 to 25 is any amino acid
  Variant (26)..(26): Xaa in position 26 is any or no amino acid
  Variant (28)..(28): Xaa in position 28 is any amino acid
  Variant (30)..(70): Xaa in position 30 to 70 is any amino acid
  Variant (71)..(73): Xaa in position 71 to 73 is any or no amino acid
  Variant (75)..(93): Xaa in position 75 to 93 is any amino acid
  Variant (95)..(114): Xaa in position 95 to 114 is any amino acid
  Variant (116)..(129): Xaa in position 116 to 129 is any amino acid
  Variant (131)..(131): Xaa in position 131 is any amino acid
  Variant (132)..(135): Xaa in position 132 to 135 is any or no amino acid
  Variant (137)..(139): Xaa in position 137 to 139 is any amino acid
  Variant (140)..(147): Xaa in position 140 to 147 is any or no amino acid
  Variant (149)..(151): Xaa in position 149 to 151 is any amino acid
  Variant (153)..(153): Xaa in position 153 is any amino acid
  Variant (155)..(170): Xaa in position 155 to 170 is any amino acid
  Variant (172)..(173): Xaa in position 172 to 173 is any amino acid
  Variant (174)..(180): Xaa in position 174 to 180 is any or no amino acid
  Variant (182)..(186): Xaa in position 182 to 186 is any amino acid
  Variant (188)..(201): Xaa in position 188 to 201 is any amino acid
  Variant (203)..(204): Xaa in position 203 to 204 is any amino acid
  Variant (205)..(220): Xaa in position 205 to 220 is any or no amino acid
  Variant (222)..(235): Xaa in position 222 to 235 is any amino acid
  Variant (237)..(237): Xaa in position 237 is any amino acid
  Variant (239)..(241): Xaa in position 239 to 241 is any amino acid
  Variant (242)..(242): Xaa in position 242 is any or no amino acid
  Variant (245)..(245): Xaa in position 245 is any amino acid
  Variant (247)..(247): Xaa in position 247 is any amino acid
  Variant (249)..(249): Xaa in position 249 is any amino acid
  Variant (251)..(258): Xaa in position 251 to 258 is any amino acid
  Variant (266)..(267): Xaa in position 266 to 267 is any amino acid
  Variant (269)..(269): Xaa in position 269 is any amino acid
  Variant (272)..(275): Xaa in position 272 to 275 is any amino acid
  Variant (277)..(280): Xaa in position 277 to 280 is any amino acid
  Variant (282)..(317): Xaa in position 282 to 317 is any amino acid
  Variant (318)..(322): Xaa in position 318 to 322 is any or no amino acid
  Variant (324)..(327): Xaa in position 324 to 327 is any amino acid
  Variant (329)..(329): Xaa in position 329 is any amino acid
  Variant (331)..(332): Xaa in position 331 to 332 is any amino acid
  Variant (334)..(334): Xaa in position 334 is any amino acid
  Variant (336)..(336): Xaa in position 336 is any amino acid
  Variant (338)..(428): Xaa in position 338 to 428 is any amino acid
  Variant (429)..(439): Xaa in position 429 to 439 is any or no amino acid
  Variant (441)..(443): Xaa in position 441 to 443 is any amino acid
  Variant (444)..(445): Xaa in position 444 to 445 is any or no amino acid
  Variant (447)..(453): Xaa in position 447 to 453 is any amino acid
  Variant (458)..(458): Xaa in position 458 is any amino acid
  Variant (460)..(460): Xaa in position 460 is any amino acid
  Variant (464)..(464): Xaa in position 464 is any amino acid
  Variant (466)..(492): Xaa in position 466 to 492 is any amino acid
  Variant (493)..(504): Xaa in position 493 to 504 is any or no amino acid
  Variant (506)..(512): Xaa in position 506 to 512 is any amino acid
  Variant (513)..(514): Xaa in position 513 to 514 is any or no amino acid
  Variant (516)..(546): Xaa in position 516 to 546 is any amino acid
  Variant (547)..(552): Xaa in position 547 to 552 is any or no amino acid
  Variant (554)..(571): Xaa in position 554 to 571 is any amino acid
  Variant (572)..(595): Xaa in position 572 to 595 is any or no amino acid
  Variant (597)..(602): Xaa in position 597 to 602 is any amino acid
  Variant (604)..(610): Xaa in position 604 to 610 is any amino acid
  Variant (611)..(611): Xaa in position 611 is any or no amino acid
  Variant (615)..(615): Xaa in position 615 is any amino acid
  Variant (617)..(618): Xaa in position 617 to 618 is any amino acid
  Variant (620)..(620): Xaa in position 620 is any amino acid
  Variant (622)..(622): Xaa in position 622 is any amino acid
  Variant (624)..(624): Xaa in position 624 is any amino acid
  Variant (639)..(639): Xaa in position 639 is any amino acid
  Variant (644)..(644): Xaa in position 644 is any amino acid
  Variant (646)..(647): Xaa in position 646 to 647 is any amino acid
  Variant (649)..(649): Xaa in position 649 is any amino acid
  Variant (662)..(662): Xaa in position 662 is any amino acid
NXXXXXXXXXXXXXXXXSXXXXXXXXSXDXXXXXXXXXXXXXXXXXXXXXXXXXXXXXXXXXXXXXXXXXXXXNXXXXXXXXXXXXXXXXXXXNXXXXXXXXXXXXXXXXXXXXNXXXXXXXXXXXXXXNXXXXXSXXXXXXXXXXXQXXXSXKXXXXXXXXXXXXXXXXDXXXXXXXXXLXXXXXSXXXXXXXXXXXXXXNXXXXXXXXXXXXXXXXXXLXXXXXXXXXXXXXXDXTXXXXRRXSXVXTXXXXXXXXSRNSISHXXDXWNXXXXNXXXXNXXXXXXXXXXXXXXXXXXXXXXXXXXXXXXXXXXXXXXXXXDXXXXQXLXXYXMXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXSXXXXXXXFIKPXMXLSDXAXXXXXXXXXXXXXXXXXXXXXXXXXXXXXXXXXXXXXXXNXXXXXXXXXSXXXXXXXXXXXXXXXXXXXXXXXXXXXXXXXXXXXXXLXXXXXXXXXXXXXXXXXXXXXXXXXXXXXXXXXXXXXXXXXXSXXXXXXIXXXXXXXXKPFXCXXCXKXFXRSEHLKRHVRSVHSXERPFXCXXCXKKFSRSDNLSQHXKTHKKHGD

SEQ ID NO: 12259 - protein, 59 aa, Artificial sequence
  protein pattern
  Variant (4)..(4): Xaa in position 4 is any amino acid
  Variant (6)..(6): Xaa in position 6 is Asp or His
  Variant (7)..(7): Xaa in position 7 is any amino acid
  Variant (9)..(9): Xaa in position 9 is Asn, Pro or Ser
  Variant (11)..(11): Xaa in position 11 is Ala, Ser or Thr
  Variant (13)..(13): Xaa in position 13 is Lys or Arg
  Variant (28)..(28): Xaa in position 28 is Asn or Thr
  Variant (29)..(29): Xaa in position 29 is Asp or Glu
  Variant (33)..(33): Xaa in position 33 is any amino acid
  Variant (35)..(35): Xaa in position 35 is any amino acid
  Variant (36)..(36): Xaa in position 36 is Phe, Ile or Leu
  Variant (38)..(38): Xaa in position 38 is Asp or Glu
  Variant (51)..(51): Xaa in position 51 is Ile or Leu
  Variant (57)..(57): Xaa in position 57 is any amino acid
  Variant (59)..(59): Xaa in position 59 is Asp or Ser
KPFXCXXCXKXFXRSEHLKRHVRSVHSXXRPFXCXXCXKKFSRSDNLSQHXKTHKKXGX

SEQ ID NO: 12260 - protein, 42 aa, Artificial sequence
  protein pattern
  Variant (2)..(5): Xaa in position 2 to 5 is any amino acid
  Variant (6)..(7): Xaa in position 6 to 7 is any or no amino acid
  Variant (10)..(10): Xaa in position 10 is any amino acid
  Variant (11)..(11): Xaa in position 11 is any or no amino acid
  Variant (13)..(13): Xaa in position 13 is Asp or Glu
  Variant (15)..(15): Xaa in position 15 is Ile or Val
  Variant (17)..(17): Xaa in position 17 is Gly, Asn or Ser
  Variant (18)..(18): Xaa in position 18 is Asn, Gln or Ser
  Variant (19)..(19): Xaa in position 19 is any amino acid
  Variant (20)..(20): Xaa in position 20 is Ile or Pro
  Variant (21)..(21): Xaa in position 21 is Asn or Ser
  Variant (22)..(22): Xaa in position 22 is Leu or Met
  Variant (23)..(23): Xaa in position 23 is Ala or Thr
  Variant (24)..(24): Xaa in position 24 is Asp, Asn or Ser
  Variant (25)..(25): Xaa in position 25 is Ala or Ser
  Variant (32)..(32): Xaa in position 32 is Gly or Ser
  Variant (33)..(33): Xaa in position 33 is Ile, Leu or Val
  Variant (34)..(34): Xaa in position 34 is Asp or Glu
  Variant (35)..(35): Xaa in position 35 is Phe or Leu
  Variant (38)..(38): Xaa in position 38 is any amino acid
  Variant (39)..(39): Xaa in position 39 is Asp, Asn or Pro
  Variant (40)..(41): Xaa in position 40 to 41 is any amino acid
  Variant (42)..(42): Xaa in position 42 is Asn or Arg
DXXXXXXRRXXSXVXTXXXXXXXXXRNSISHXXXXWNXXXXX

SEQ ID NO: 12261 - protein, 17 aa, Artificial sequence
  protein pattern
  Variant (6)..(6): Xaa in position 6 is Ser or Thr
  Variant (8)..(8): Xaa in position 8 is Ile or Leu
  Variant (10)..(12): Xaa in position 10 to 12 is any or no amino acid
  Variant (14)..(14): Xaa in position 14 is any amino acid
  Variant (15)..(15): Xaa in position 15 is any or no amino acid
  Variant (17)..(17): Xaa in position 17 is Phe or Met
IDNELXQXLXXXNXXNX

SEQ ID NO: 12262 - protein, 19 aa, Artificial sequence
  protein pattern
  Variant (5)..(5): Xaa in position 5 is Ser or Thr
  Variant (7)..(7): Xaa in position 7 is Ile or Met
  Variant (11)..(11): Xaa in position 11 is any or no amino acid
  Variant (14)..(14): Xaa in position 14 is any amino acid
  Variant (15)..(15): Xaa in position 15 is any or no amino acid
  Variant (17)..(17): Xaa in position 17 is Glu or Lys
  Variant (18)..(18): Xaa in position 18 is Leu or Val
  Variant (19)..(19): Xaa in position 19 is Ala or Glu
FIKPXMXLSDXASXXAXXX

SEQ ID NO: 12263 - DNA, 2424 bp, Saccharomyces cerevisiae
  CDS (1)..(2424)
atgatggctaagaacaacaaaactaccgaggcaaagatgtcgaaaaagagagcagctagcgaagaatctgatgtcgaggaagatgaggacaagcttttatccgttgacggtttgatcgatgcggaagcaagtgagagtgacgaggatgatgacgaatacgagtctgccgttgaagaaaaggaatcatcttctgataaagaagcccaagatgattctgatgatgactccgatgctgaattaaacaaactgcttgccgaagaagaaggtgatggggaagaggactatgacagttctgagttttcagacgacacaacttccttaacagacagattatcgggtgtgaaattgcaaacgatcgttgatccgaatatttactcaaaatatgcagatggcagtgatagaattatcaaacctgaaattaatccagtttatgatagcgatgatagtgatgccgaaacgcaaaataccattggtaatattccactttctgcatacgatgaaatgccacacattggatacgatatcaacggtaaaaggattatgagacctgccaagggttctgctttagatcaactgttggattctatcgagctacctgaaggctggactggtttactggacaagaattccggttcaagtttgaacttaaccaaagaggaattagaacttatttccaaaatccaaaggaacgaacaaactgatgatagcataaatccatacgaaccgttaatcgattggttcacgagacacgaagaagtgatgccattaactgctgttccggagccaaaaagaagatttgttccatccaaaaacgaagccaagagagttatgaaaattgtaagagctatcagagagggccgtattattcctcctaaaaaattaaaggaaatgaaagaaaaggaaaaaattgaaaactatcaatacgatttatggggtgattctacggaaacaaatgatcatgtaatgcatctaagggcaccaaaattacctccaccaactaatgaagagagttataatccaccagaagagtatcttttgtctcctgaagaaaaggaggcctgggaaaatactgaatatagtgaaagagaaagaaacttcatacctcaaaagtattctgccttaagaaaggtccctggttacggtgaatctattagggaaagatttgaaagatctttggatttatatttagctcctcgtgtccgtaaaaacaaattgaatattgatcctaattctctaattccagaacttccctctcccaaggatttaagacccttccctattcgttgctcaacaatatacgctggtcacaaaggaaaagtacgcacattatccattgatccttctggattatggctagcaacaggatctgatgacggaacagtcagggtatgggaaattttaactggtagagaagtttatagaactactttaatcgatgacgaggaaaacccagattaccacattgaatgcattgaatggaatcctgatgctaataatggtattctcgccgttgctgttggtgaaaacattcatttaatagtaccaccaatattcggctacgatattgaaaataacggcaaaactaagattgaagatggttttggctacgatacttttgggactgttaaaaaatctaacctagaagtgaacgagaatggtgatggcgatgaagatggagagaatgaatctgctaagaatgctgtaaaaaaacaagtagcccaatggaacaagccttctcaaaagcaactagaaaaggatatttgtatcactatttcttgcaaaaaaacagtaaaaaagctttcatggcatagaaaaggtgattactttgtcactgttcaacctgactctggtaacacttctgttttgattcaccaagtttccaagcatttaacccaatccccattcaaaaaatcgaagggcattattatggatgcgaagttccatccttttaaacctcaattatttgtctgttcccaaagatatgtcagaatttatgatttatctcaacaaatattggtcaagaaactgttgcctggtgcccgttggttatcgaaaatcgatattcacccaaggggtgataatttaattgcgtcatcgtttgacaagagagttttatggcacgacctggatttggctagcacaccttacaagacactaagatatcatgaaaaagccgtcagaagtgtgaatttccacaaaaagttacctctattcagctctgccgctgatgacggtaccatacatgttttccatgccactgtttatgatgacatgatgaaaaatccgatgattgtgccactaaagaaactaaccggtcataaagtaatcaatagtctgggtgttcttgatgctatttggcatccgagggaagcttggctgttttctgccggtgctgataatacggctcgcttatggaccacctag

SEQ ID NO: 12264 - protein, 807 aa, Saccharomyces cerevisiae
MMAKNNKTTEAKMSKKRAASEESDVEEDEDKLLSVDGLIDAEASESDEDDDEYESAVEEKESSSDKEAQDDSDDDSDAELNKLLAEEEGDGEEDYDSSEFSDDTTSLTDRLSGVKLQTIVDPNIYSKYADGSDRIIKPEINPVYDSDDSDAETQNTIGNIPLSAYDEMPHIGYDINGKRIMRPAKGSALDQLLDSIELPEGWTGLLDKNSGSSLNLTKEELELISKIQRNEQTDDSINPYEPLIDWFTRHEEVMPLTAVPEPKRRFVPSKNEAKRVMKIVRAIREGRIIPPKKLKEMKEKEKIENYQYDLWGDSTETNDHVMHLRAPKLPPPTNEESYNPPEEYLLSPEEKEAWENTEYSERERNFIPQKYSALRKVPGYGESIRERFERSLDLYLAPRVRKNKLNIDPNSLIPELPSPKDLRPFPIRCSTIYAGHKGKVRTLSIDPSGLWLATGSDDGTVRVWEILTGREVYRTTLIDDEENPDYHIECIEWNPDANNGILAVAVGENIHLIVPPIFGYDIENNGKTKIEDGFGYDTFGTVKKSNLEVNENGDGDEDGENESAKNAVKKQVAQWNKPSQKQLEKDICITISCKKTVKKLSWHRKGDYFVTVQPDSGNTSVLIHQVSKHLTQSPFKKSKGIIMDAKFHPFKPQLFVCSQRYVRIYDLSQQILVKKLLPGARWLSKIDIHPRGDNLIASSFDKRVLWHDLDLASTPYKTLRYHEKAVRSVNFHKKLPLFSSAADDGTIHVFHATVYDDMMKNPMIVPLKKLTGHKVINSLGVLDAIWHPREAWLFSAGADNTARLWTT

SEQ ID NO: 12265 - DNA, 2391 bp, Aspergillus fumigatus
  CDS (1)..(2391)
atgaatacttcaaaggcttcaaagaagcgcaaggcagttacccgtgatgtggaggaggaggcaggcgtgttttctggagacgaattgaacacaggcaaccttgacggagcgctttcggataacgcccacgacctgtcgagcgacgaggatgagagcgattcagaggtcgagctgatcgatgattttagtgatgaagaggatgaggaagaagaagacgtacttgacagtgatgagatcccgtcggatggagaggattcagccaagaaaaagtcgaacgccgcgcctggtgaacttggcgcagtgatagatgatgatgatgatgatgatgatgatgagagcccgagcgaggaagaacagttgaactaccgcattgaaaaggacgccaatgggaatgaccgcttcgtctacgacgagatcaatccggacgataattctgactattctgatgtcgacgagaatgccaacactatcggcaacattcctctctcattttacgatcagtatcctcatatcggttacgatatcaacgggaagaagattatgcgccctgcgaaaggcgaagctttagatgcactgctcgatagtattgagatacccaagggttggacaggtcttactgatccttccactggtaaacctctggagctgagccaggaggagctggagctgctgcgcaaagttcaaatgaacgaaattcccgaagatggatacaacccttatgagcccattgttgagtggtttaccagtcagcaggaaatcatgccattgagtgctgcgccagaacccaaacggcggtttgtgccctcgaaacacgaagctaagcgggttatgaagattgtgaaggcaatcagagaaggccggattctcccatttaagcctcccacggaagaggatgaggaggatgatacgattgtcaagtatgatctctgggccgatgaagcggagcggaaggatcatcctatgcatatccctgcgcctaaacttccacctccaggctatgaggaaagttaccacccgcctccagagtacttgcctagtcggaaggaacgaaagacttgggaggaagctgaccctgaagaccgggaccgcgagtttcttcctaacgatttcggttctctgcgcagagttcctggctatgaaaactttgtcaaggagaagttcgagcggtgcctggatctttacctagcccctagagttcgtaggagcaagttgaacatcgaccctgaaagccttttgcccaaacttccgagccctgaagaattgaaaccgttccccactgcttgtgctaccgtgttcagagggcataagggacgggtgcgcacactggctgttgatccttccggtctgtggctggcttctggtggcgatgacggaactgttcgtgtttgggaacttcttacgggacgccagttgtggagcgtgaaattgagcgaggaagaccctgtcaatgttgttcgctggagaccgggcaaggatgctcttatccttgctgcagcggctggagacgacattttccttgctgttcccccaattgttgacccagcaatggaaaaagctagcctggacattctggatgcgggctggggatatgctgcatctgtccctcctcccactcctgctgaagcaaacaagaagaataaccctcccaagtggatgcgtccttcatcgtctcttgccgattcgggagtttgcgctgtcatccctcttcgctacgtcgccaagtccctttcgtggcatcgccgtggagactactttgtcacagtttgccctggctcatcaaccccagcttcggtggccattgccatacacactctttctaagcatctgactcagtaccctttccggcgacgtatcaagggcggcggccctcctcaggctgctcacttccacccctcgaaaccgatcctctttgtcgcaaaccaacgaagcattcgcgcatacgatctttcacgtcaacttctcgtcaagattttacaacctggtgctcgatggatttcttctttcgacatccacccgacttcctccaccgcttccggtggagacaatcttattgtcggctcgtatgatcgccgtctcctttggcatgatctcgaattatcgcagcgtccttataagactctgcgctaccaccgcaaggccatccgtgctgtcaagttccacccaggcggccgttaccccctgtttgcagatgccagtgacgacggctcgcttcaaattttccacggcagtgttaccggagacatgctcagcaatgccaccattgtaccgctcaaggttctcaagggacacaaaatcactggcgaactcggtgtattggacgtcgactggcatcccagagaaccatggtgtgtcagtgcaggcgcagatggaacttgccgtctctggatgtaa

SEQ ID NO: 12266 - protein, 796 aa, Aspergillus fumigatus
MNTSKASKKRKAVTRDVEEEAGVFSGDELNTGNLDGALSDNAHDLSSDEDESDSEVELIDDFSDEEDEEEEDVLDSDEIPSDGEDSAKKKSNAAPGELGAVIDDDDDDDDDESPSEEEQLNYRIEKDANGNDRFVYDEINPDDNSDYSDVDENANTIGNIPLSFYDQYPHIGYDINGKKIMRPAKGEALDALLDSIEIPKGWTGLTDPSTGKPLELSQEELELLRKVQMNEIPEDGYNPYEPIVEWFTSQQEIMPLSAAPEPKRRFVPSKHEAKRVMKIVKAIREGRILPFKPPTEEDEEDDTIVKYDLWADEAERKDHPMHIPAPKLPPPGYEESYHPPPEYLPSRKERKTWEEADPEDRDREFLPNDFGSLRRVPGYENFVKEKFERCLDLYLAPRVRRSKLNIDPESLLPKLPSPEELKPFPTACATVFRGHKGRVRTLAVDPSGLWLASGGDDGTVRVWELLTGRQLWSVKLSEEDPVNVVRWRPGKDALILAAAAGDDIFLAVPPIVDPAMEKASLDILDAGWGYAASVPPPTPAEANKKNNPPKWMRPSSSLADSGVCAVIPLRYVAKSLSWHRRGDYFVTVCPGSSTPASVAIAIHTLSKHLTQYPFRRRIKGGGPPQAAHFHPSKPILFVANQRSIRAYDLSRQLLVKILQPGARWISSFDIHPTSSTASGGDNLIVGSYDRRLLWHDLELSQRPYKTLRYHRKAIRAVKFHPGGRYPLFADASDDGSLQIFHGSVTGDMLSNATIVPLKVLKGHKITGELGVLDVDWHPREPWCVSAGADGTCRLWM

SEQ ID NO: 12267 - DNA, 2415 bp, Cryptococcus neoformans
  CDS (1)..(2415)
  misc_feature (187)..(187): n is a, g, c or t
  misc_feature (188)..(188): n is a, g, c or t
  misc_feature (189)..(189): n is a, g, c or t
atggtcaaatcagccccaaaaaccgctggaaagtcaaagaagcgagcagtagagcaggtgtcagaagagagcgacgaagaatttggggaccaagggagtggaattgatatgagtgatgatgaggaagaggttgatggagacgatgaggaggatgaagatgaagcttttcctgaattcgacagcgagnnngaggataatgatcaagaagaagccagtgatgaggagcaagatgaacaggatactgactctgagtcaggttacaacacgtctgacatcgagcgaatgtacgcttctgatgatgatctctcgtccgaagagaacaaagacctccctgtcgacgagaagctctcgagacttatcgccaagaacactgtcaagcccgacgactctattggcacagatgacaaaatcagtcgtgcaaaggaaggggtagggagattggtgcccagcaaacacgtgaagggatcatttgtgcgagagtacgacgaatatgaggccggatatggcagtgaaagtagcaccgaggataaccccaatactgtcggtaacattccgatggagtggtacgatgaccttcctcatatcggttacgatgtcaacggtcgcaagatcttccggcctttgcaaggcgacgaacttgacaagttccttgccaatgtcgaggatccgtccgcttggacctctgccgaagacaaacttcttcaacaaaatgttcagttgtcagacaaggagctcgatatcattaggcgattggagagggccgaaaaccctgatgccgactttgacccctatcaacctactattgaatggtttaccggcgaaggcaaggagagagtcatgccgcttagtgcggcgcctgagcccaagaggagattcgtgccttccaaatgggagcataagaagattatgaagatcgtcaaggctatcagagagggccgaatcatccccaacaaaccttccgccgaaaaacctcgcttctatcctatctggtctgacgccgaccagcacaaccctcacgtcatgtatatgcccgcccctcaacttccccctccgaagacggccgaatcctacaatcctcctgaagagtaccttcctaccgaggaagagaaggctgagtgggaggcgatggacaaggaagaccgaaagaccgatttcttgcccgagaagtatgatgcccttagaaaagttcctggctacaagaacttggtgcaagagaagttcgagagatgtcttgatttgtacctcgcccctcgaactcgacgagtcaagctcaacattgacccagactctcttattcctaaacttcccgctcccaaggagctcaaacccttccctatcgcttctactgtccagtaccgtcatcccggagacactcgtgtccgatccgtttccaccagccctgatggtcagtggattgcttctggctcagaagatggtgtggtgcgagtctgggacctgggtaacggtcgtgaagtctggagatgggatttacacgctggtcctattcagtacgttgagtggtcaccttctcgtgaggagtctttgcttgtggctcttgtcgccggtaagatcgctgtgctctctcctcttgctctcgtcgctcctcatattgccgcccaaaccctcacccactccaataccgcttttgctactagttctgcgacgacaaagcaaggtgccggtaacgaagttaaaggaattgagtctgtcaaatggacgagaccgagtgagagggaaagagaaaggggtgtcttggtgtatgtggaagttcctggtactcctaaacaagttacatggcacaggaagggggactactttgccacggttgcatccgacgccgctaacaaatccgtccttatccaccaactctcccgccacggcagtcaatcccccttccgtaagactcccggcacaatccagcgcgttgcattccatccttctaagcctcatttctttgctgccactcaacgttacatccgtctttacgaccttgctgctcaaaagctcattagaactttacagtctggtgtcaaatggatttcatccatggatgtgcactccggaggtgacaatttaattatcggtagttacgataagaaattagcttggttcgacatggatttgagcgcaaagccttataaaaccttaagataccacaaccgtgctcttcgatccgttgcctatcaccctactctccctctcttcgcctctgcctcagacgatggcacagtccacattttccactgcaccgtttacactgatctcatgcaaaacccgctcattgttcctctgaagatcttgagggggcataaagtaatcgatggtatcggagttttggatttgagatgggtgcctggaaaaccgtggttggtcagctccggtgcggatggagaggttaggctttggtgttcgtag

SEQ ID NO: 12268 - protein, 804 aa, Cryptococcus neoformans
  misc_feature (63)..(63): The Xaa at location 63 stands for Stop, Ala, Arg, Asn, Asp, Cys, Gln, Glu, Gly, His, Ile, Leu, Lys, M et, Phe, Pro, Ser, Thr, Trp, Tyr, or Val.
MVKSAPKTAGKSKKRAVEQVSEESDEEFGDQGSGIDMSDDEEEVDGDDEEDEDEAFPEFDSEXEDNDQEEASDEEQDEQDTDSESGYNTSDIERMYASDDDLSSEENKDLPVDEKLSRLIAKNTVKPDDSIGTDDKISRAKEGVGRLVPSKHVKGSFVREYDEYEAGYGSESSTEDNPNTVGNIPMEWYDDLPHIGYDVNGRKIFRPLQGDELDKFLANVEDPSAWTSAEDKLLQQNVQLSDKELDIIRRLERAENPDADFDPYQPTIEWFTGEGKERVMPLSAAPEPKRRFVPSKWEHKKIMKIVKAIREGRIIPNKPSAEKPRFYPIWSDADQHNPHVMYMPAPQLPPPKTAESYNPPEEYLPTEEEKAEWEAMDKEDRKTDFLPEKYDALRKVPGYKNLVQEKFERCLDLYLAPRTRRVKLNIDPDSLIPKLPAPKELKPFPIASTVQYRHPGDTRVRSVSTSPDGQWIASGSEDGVVRVWDLGNGREVWRWDLHAGPIQYVEWSPSREESLLVALVAGKIAVLSPLALVAPHIAAQTLTHSNTAFATSSATTKQGAGNEVKGIESVKWTRPSERERERGVLVYVEVPGTPKQVTWHRKGDYFATVASDAANKSVLIHQLSRHGSQSPFRKTPGTIQRVAFHPSKPHFFAATQRYIRLYDLAAQKLIRTLQSGVKWISSMDVHSGGDNLIIGSYDKKLAWFDMDLSAKPYKTLRYHNRALRSVAYHPTLPLFASASDDGTVHIFHCTVYTDLMQNPLIVPLKILRGHKVIDGIGVLDLRWVPGKPWLVSSGADGEVRLWCS

SEQ ID NO: 12269 - DNA, 2262 bp, Arabidopsis thaliana
  CDS (1)..(2262)
atgacgaagaggagcaaaggagctaacgaagataagctgatagaaaccaaaagcaaaaacgtttctggaaaatctcagaaacagaagaaaccagtagaagcagaaagcttaaaagaggaagaccttctacaagcatccggaactgattctgattacgacggagatagtttgcctggttctttgaattccgacgatttcgactccgatttttccgattcagaggatgatggaacacatgaaggaacagaagatggagatgtagaattttccgatgacgacgacgtgcttgagcatgatgggtcaattgataacgaggatgatgatggaagtgaacatgtaggtagtgacaataatgaggaacatgggagtgatgaagattctgagcgaggtgaagcggttgaagagagcgattcctcagaagatgaggttccatctagaaatacagttgggaatgttcccttaaagtggtatgaagatgagaaacatattggttatgacctcactgggaagaagattactaagaaagaaaaacaagataaactcgactcttttcttgcaactatagatgactctaagacttggcgcaaaatttatgatgaatataatgacgaggacgttgagctgactaaagaggagagcaagatcgttcagagaatactcaaaggggaagctccacatgcggactttgatccatatgcaccttatgttgagtggttcaaacatgatgatgcaatacatccactctcaagtgcaccagagcccaagcgaagattcatcccttcaaaatgggaggccaaaaaggttgttaagattgttagagcaatacgtaaggggtggatcaagtttgataagcctgaagaagagcccaatgtataccttttatggggtgatgattcgacatctgatcaaaagagcaagcatttaacttatattcctccacccaagcttaaattgccaggacacgatgaatcatacaatccttctttggaatatattccaacagaggaggagaaagcctcatatgagttgatgtttgaggaagatcgtccaaaattcattcctacaaggtttacatctttgagaagcatccctgcgtatgagaatgcactgaaggagtcttttgagcgttgtttggatctatacctatgtccaagagttcgaaagaagagaataaacatcgaccctgaatctttgaagcctaagctacctagtaggaaggatcttagaccttatcctaactcctgttatcttgaatataaaggccatacaggggctgttacttcaatatccactgatagttctggcgagtggatagcctcaggttcaactgatggatctgtccgtatgtgggaagtggagactggtagatgccttaaggtctggcagtttgacgaagctatcatgtgtgtggcttggaatcctctttccaggcttccagttttagccgttgccatgggacgagatttgttttttctgaacactgaacttgggactgatgaggaacaggaaattactaaagagaggcttcactcaggaaacatcccagaaccagacgcatctgttgcagcaattgtaacctggctacctgatgagttatatggagggattaagataagacattttaagagcatatcgtctattgactggcatcgtaaaggagactatctctcaacagtgatggcatccggggaaacacggggagtggtattgcaccaactgtcaaaacagaaaacacaaaggctcccatttaagattcgtggacttccagtctgtacactttttcatcccagcctttcttacttcttcgttgcgacaagaaaggacgtgcgtgtttacaatcttttgaagccaggcgaggccaccaaaaagcttgagacaggattgagagaaatctcatcaatggcgattcatcctggtggtgataatctgatagtaggaagcaaagaagggaagatgtgttggtttgacatggatctatcttcgaaaccatacaagactctcaagaatcatcctaaagacattacaaatgtggcagttcatcgatcatatccgttatttgcttcgtgctcggaggattcaacagcttatgttttccatggaatggtgtataatgatctgaaccagaatcctctgattgtgccattggagattctaagaggtcattcttcaaaaggaggagtcttggactgcaagtttcatccgagacaaccatggctattcactgcaggcgctgactctattatcaaactctattgccactag

SEQ ID NO: 12270 - protein, 753 aa, Arabidopsis thaliana
MTKRSKGANEDKLIETKSKNVSGKSQKQKKPVEAESLKEEDLLQASGTDSDYDGDSLPGSLNSDDFDSDFSDSEDDGTHEGTEDGDVEFSDDDDVLEHDGSIDNEDDDGSEHVGSDNNEEHGSDEDSERGEAVEESDSSEDEVPSRNTVGNVPLKWYEDEKHIGYDLTGKKITKKEKQDKLDSFLATIDDSKTWRKIYDEYNDEDVELTKEESKIVQRILKGEAPHADFDPYAPYVEWFKHDDAIHPLSSAPEPKRRFIPSKWEAKKVVKIVRAIRKGWIKFDKPEEEPNVYLLWGDDSTSDQKSKHLTYIPPPKLKLPGHDESYNPSLEYIPTEEEKASYELMFEEDRPKFIPTRFTSLRSIPAYENALKESFERCLDLYLCPRVRKKRINIDPESLKPKLPSRKDLRPYPNSCYLEYKGHTGAVTSISTDSSGEWIASGSTDGSVRMWEVETGRCLKVWQFDEAIMCVAWNPLSRLPVLAVAMGRDLFFLNTELGTDEEQEITKERLHSGNIPEPDASVAAIVTWLPDELYGGIKIRHFKSISSIDWHRKGDYLSTVMASGETRGVVLHQLSKQKTQRLPFKIRGLPVCTLFHPSLSYFFVATRKDVRVYNLLKPGEATKKLETGLREISSMAIHPGGDNLIVGSKEGKMCWFDMDLSSKPYKTLKNHPKDITNVAVHRSYPLFASCSEDSTAYVFHGMVYNDLNQNPLIVPLEILRGHSSKGGVLDCKFHPRQPWLFTAGADSIIKLYCH

SEQ ID NO: 12271 - DNA, 2211 bp, Schizosaccharomyces pombe 972h-
  CDS (1)..(2211)
atgaataggaagaggtccaggtccaaaagagccaattccaacgttggcgtagagaaggataaggaaaaagaaaagtctaaaggagtttcaaatgtgccaaatgaggttgagactgagagttcttcacatgaaccaagttttaaaaaagatgttgatgaggaaattccatctttgacggccgagttatccgaggaagaagaaggggaatattcttctgaaagtggacgttctactccagagttatccccggatgattttgaggatgctgatgatgaagaagaatttgaggaaatcgatgctggttattcttccgattcctctacagaagatgtcgctcctggactatatgaatctccttatgatgagaatttgtatataaattatgatatagatggaaaaaagattacccgacctgcgacacctgctgctttggattctttaattgctagcattgataaggacaaaggatggactggaatagttgatcctatgacgggaaagccggttaacttgactacggaagagctcggtttgctaaagcgacttgctcaatccgagattcctgacgaaaactttgatccatatcctgattatgatgatttttttacaaacaccgtacgggaaactcctctttcaagcgctcctgagcccaaacgtcgatttgctccctctaagcatgaacaaaagcgtattttacagcttgcttatgctatccgtaaaggaagaattctcacttctgaacagcgtgctgaacgtgaacgcgaaagtcaaagcaattatgcagatcatgatctttgggcggatgatgatcaagcaactgttaaccagagaaagttggactatgcacctgcacctaagcttcctcctccatcacacgaggaaagctataaccctcctgaagaatacttaaaacagtcttcggactttcctaagaaatataaatccttacgtgttgttcctgcttactcaaaccttataaaggagaagtttgaacgttgcttggatctttatttagctccccgtgttagacgtaccaaacttaatattgatccagaatcgttacttcctaaacttcctaccccctctgagcttcgtccatttccgacacgctgcaccaatgttttcatcggtcataaaggtcgtgttcgttgtctttcggtccatgttagcggaaattggcttgcaagtggaggtgatgatggagttttacgtatttgggaagtaatgactggtcgttgtgtttggaaatgcagcttggacagttttggtaatgcacataatattgatagcgatgaggatgcggttaatgaatctttaagtcactctacaaagagctctataattcaatcacttgcttggggacctctttcagatagtccagtgcttgctgttgctgttgatgaaacagtctatttcatcacacccccgatcttttctgacgagcagattgaagcttctaaagaattgtttacttctgctccttaccaagaatctagtgcaatatggagaagaggagccaaacaatctttacaattacatggtggtatagtccatgctactgtttctactcccagtagcattaagtccttgtcttggcatcgtcgcggtgattacctagctacttcttctcctacttcttctagccaggcggttcttattcatcagttgtcaagaggtgcaagtcaatcgccattttctaagtctaaaggttctgtgcaagctgttacgtttcaccctactatgccttatcttctggttgctactcaacgatatgtccgcatatacaatcttgttaagcaagagcttgtaaagaccttgttaactggtgtcaaatgggtttcgagtttaagtgtccattcgagtggggaccatgtcataataggttcctatgataaaaggctatgttggttcgacttagacttttcttctaaaccatataaaaatcttcgatatcattcacgtgctcttcgcgatgtctcatatcatccttcccttccactattttgctctggctctgatgatggtgatgttcaagtgttccacggtcgtgtttacagtgaccttctggctaatcccttgattgttcctcttaagattttgcggaatcataaagtggttgataatgtcggtgttttatccacatgctggcatccaaaagaagcctggttattcagtgcaggtgctggtggagaaattcggatgtggacttga

SEQ ID NO: 12272 - protein, 736 aa, Schizosaccharomyces pombe 972h-
MNRKRSRSKRANSNVGVEKDKEKEKSKGVSNVPNEVETESSSHEPSFKKDVDEEIPSLTAELSEEEEGEYSSESGRSTPELSPDDFEDADDEEEFEEIDAGYSSDSSTEDVAPGLYESPYDENLYINYDIDGKKITRPATPAALDSLIASIDKDKGWTGIVDPMTGKPVNLTTEELGLLKRLAQSEIPDENFDPYPDYDDFFTNTVRETPLSSAPEPKRRFAPSKHEQKRILQLAYAIRKGRILTSEQRAERERESQSNYADHDLWADDDQATVNQRKLDYAPAPKLPPPSHEESYNPPEEYLKQSSDFPKKYKSLRVVPAYSNLIKEKFERCLDLYLAPRVRRTKLNIDPESLLPKLPTPSELRPFPTRCTNVFIGHKGRVRCLSVHVSGNWLASGGDDGVLRIWEVMTGRCVWKCSLDSFGNAHNIDSDEDAVNESLSHSTKSSIIQSLAWGPLSDSPVLAVAVDETVYFITPPIFSDEQIEASKELFTSAPYQESSAIWRRGAKQSLQLHGGIVHATVSTPSSIKSLSWHRRGDYLATSSPTSSSQAVLIHQLSRGASQSPFSKSKGSVQAVTFHPTMPYLLVATQRYVRIYNLVKQELVKTLLTGVKWVSSLSVHSSGDHVIIGSYDKRLCWFDLDFSSKPYKNLRYHSRALRDVSYHPSLPLFCSGSDDGDVQVFHGRVYSDLLANPLIVPLKILRNHKVVDNVGVLSTCWHPKEAWLFSAGAGGEIRMWT

SEQ ID NO: 12273 - DNA, 2334 bp, Magnaporthe grisea 70-15
  CDS (1)..(2334)
atggcccccacagccccagccaagaaacgaaagcagtcggccgaggttacggagctttcagatgacgaaattatcgatgggctcctcgacggcgcgctttctcaaagcgaggacgacagcgattttgtagcttcaggggatgaggatgaggaggacgaggacgaggatgaggatgaagataaggatgaagatgacgagcatgacgacaagcaagacattggagacctacaagacctcagtctcaacgacttggatgacgatgcgcagagcaaggaattggccaaagatggcgcaaatggcggttcaggagatggaccagaggcggacgacgaagacaggccaaactacagggttgtcgaggatgcgaatggcggtatacgctacgtatacgacgagattaacccagtctacgactcggacgattcggacaaggaggaagataacagaattggcgacatcccgctctctttctacgaggcgtacccccacgttggttacactatcgacggcaagaagcttatgcgcccgtcagagaggaggcaggctttggactctctgctagacagtattgagatacccaagggctggactggcttgacggatccgactaccggaaagccgctcaacttgagccaagatgagcttgagcttctgaagcgtgtccagatgaacgagattcctgaggaaggatacgatccttaccctgacaccgtcgaatactttaccggtatcgaggagaagatgcccctgagcgctgcccctgaaccaaagcgaagatttattccctcaaaacatgaagcaaagagagttatgaaacttgttcgcgccatcagggagggccgcatccagccgtacaagtcaaaggaggagcgcgagaaggaggaagagggcaaggaagagaaatactacgacgtgtggcaggacgagcagccacgcgatccccacgttatgcacatcccggcaccgaagctcgcgccaccgggctacgatatgagttacaatccgccaccggagtacctcccaacaaaggcagagagggaagaatgggagaagatggatcccgaggacagagaaaaggagtatctgcctcaaaagttcgatgccctgaggaaggtacctggatatgaaacttttgtaaaggagcgctttgagcgttgcttggacctttaccttgcgcccagagtgcgcaagaacaggttgaacattgatccggcctcattattacccaaacttcccaggcccgaagagctcaagccgttccctaccgtctgtcaagcaatcttcagaggccatgagggtcgtgtcagatcgtcggcgattgaccccacgggactgtggcttgcaacaggaggtgacgacggctacgttaggatatggctcatcaacccagctcgtcaagtatgggccgtgaaactgagcagcgacgaggctgtgaacgccgtgcgatggaggccgacaaaggacacaatgatccttgccgcggccgccggagaggaaatattcctgatggtgcccccagacattgatccggaggttgaacagaccagccgcgctgtccttgatgctggttttggacatgctgcgggtggcgcagataagcagacgaccgacggcaaggcgccggcagcgaaatgggcacgccctggtgctaggttggaggacgagggtgtgctcgtgaaggtgacagtccgatcccccgtcaaggttatcagctggcacaggagaggcgaccacttctgtaccgtgtctccatctggccagcgcagctcggtggccgtacataccctttccaagcacctatcgcaaatccccttccgaaagctttctggtcttgcacaggtggctcacttccacccgtccaggccgctcttcttcgtcgcgacacagcgcacgatccgatgctacgacttgcaacggttggaactggtcaaggtggtgcagcccggtgccagatggatctcctcattcgacatacatcctggtggcgacaaccttattgttggttcttacgacaggcgtctgctgtggcacgatcttgacttgtccactcgtccttacaagacgatgcgcttccacccgcaagccatcagggctgtcaaataccaccgcgggggactcccattgtttgcagatgccagtgacgacggttcgttgcagatcttccacggcaaggttgtcagcgatctcatggagaacgcaaccattgttccgctcaaatcactcaagggccaccgggttgtagattcgcttggtgtcatggatgtagactggcacccatcagaaccttggtgtatctcggccggtgcggatggaacgtgccgactgtggatgtag

SEQ ID NO: 12274 - protein, 777 aa, Magnaporthe grisea 70-15
MAPTAPAKKRKQSAEVTELSDDEIIDGLLDGALSQSEDDSDFVASGDEDEEDEDEDEDEDKDEDDEHDDKQDIGDLQDLSLNDLDDDAQSKELAKDGANGGSGDGPEADDEDRPNYRVVEDANGGIRYVYDEINPVYDSDDSDKEEDNRIGDIPLSFYEAYPHVGYTIDGKKLMRPSERRQALDSLLDSIEIPKGWTGLTDPTTGKPLNLSQDELELLKRVQMNEIPEEGYDPYPDTVEYFTGIEEKMPLSAAPEPKRRFIPSKHEAKRVMKLVRAIREGRIQPYKSKEEREKEEEGKEEKYYDVWQDEQPRDPHVMHIPAPKLAPPGYDMSYNPPPEYLPTKAEREEWEKMDPEDREKEYLPQKFDALRKVPGYETFVKERFERCLDLYLAPRVRKNRLNIDPASLLPKLPRPEELKPFPTVCQAIFRGHEGRVRSSAIDPTGLWLATGGDDGYVRIWLINPARQVWAVKLSSDEAVNAVRWRPTKDTMILAAAAGEEIFLMVPPDIDPEVEQTSRAVLDAGFGHAAGGADKQTTDGKAPAAKWARPGARLEDEGVLVKVTVRSPVKVISWHRRGDHFCTVSPSGQRSSVAVHTLSKHLSQIPFRKLSGLAQVAHFHPSRPLFFVATQRTIRCYDLQRLELVKVVQPGARWISSFDIHPGGDNLIVGSYDRRLLWHDLDLSTRPYKTMRFHPQAIRAVKYHRGGLPLFADASDDGSLQIFHGKVVSDLMENATIVPLKSLKGHRVVDSLGVMDVDWHPSEPWCISAGADGTCRLWM

SEQ ID NO: 12275 - DNA, 2298 bp, Gibberella zeae PH-1
  CDS (1)..(2298)
atggcaccaacaacattgccttctcgtaagcgaaaggttctcgcggagcctgctcctgttgatgatgaactcgctggtgtggaactcgatggtatcttatcccagagcgaggacgattcagacttcgaagaaagcgacgttgaaggtgaattacacgacaactcttccgagaatgatctagatgagcacgaccaagacgccgagggagatgacgatgacgacgatgcatacagcgaggacgcttcttccgacgccggcgacagcttcggggcgcctcctaccctcgacgctgataactcggaaccgaactatcgcgttgtaaaggatgccaatggaggcgagcgctacgaatacgcagaggtcgatcctgtctatgacagtgatgactctgatgcccaaggtcccgtgaacacgatcggagacattcctctttcgttctatgattcgtacccccatattggctacgatatcaatggcaaaaagattatgcgcccagctactggggaggcgctagatgccctcctcgacagcattgagatccccaagggctggactggcctgacagatccggaaactggaaagccgcttgaccttacccaggatcaactcgagcttctcaagcgactgcagatgaacgaggtcccgaatgagggatatgatccttatcccgacatggtcccatatttcacaaatattgaggagaagatgcccctcagcgctgcaccagagccgaaacgacgatttgttccctccaagcatgaggcaaagcgagtggctaagctggttcgagctatcaaagaggggcgcattctgccatacaaacccccggaggagcgccaaagagaggacgaagagaaggaggagtcgtactatgatgtgtgggcaaacgaagagcctcaggatccccatgtcatgaacatcccagctcccaaactcgctcctcccggatacgacctcagttacaaccctccacccgaatacttgcccaccgaagaggagaaggaagcttggaagaatcaagatccagaagagcgagaaaaggagtacctaccagccaagttcgactcgttgcgcaaggttcctggttacggcgagttcgtcaaggagcgtttcgatcgctgcttggatctctatcttgcaccacgaattaggaagaacaggctcaatatcgatcctaactctcttctgccaaagctcccccgcccggaggacctcaagccattccctacccttaaccagacgatcttccgcgggcacgatgggcgggttcgttctgtggcattcagccctgacggtgaatttgtagcctctggtggcgatgatggcactgttcgcgtatgggccctgaatggtcatcaggaatggatggccaagctcaatagcgaggagcccgtcaacatggtacgatggcgccctaacaaggagaccttcatattagcagccgctgctggagaggatctgttcttcatgattccatctgttgctagcgacgccgtggagaaggcgagtcgcgaagtccttgacgttgggttcggttacgctaccaacggtgcgcagtctagtgcaatgaacggcataaagaaagagcccccagccaagtggtcccgacctggcgccaaattggaggctgctggagtgctcttaatggccactgttaggtcggcgatcaaggttatcaattggcacaaacgaggtgaatatatctgcacggtttctccaactggacaacgaagctcagtcgccatccatgctatctctaagcacctgagtcaactacccttcagaaaacttcctggtcttgcacagacagcccagttccatccgtcaaggccactcttcttcgttgccacgcagcgcatgatccgatgctatgatctccagcgtgaagaacttgtcaaggttgtccaacctggtgcccgatggatctcctctttcgatgtgcaccctggcggagacaatcttattgttggatcttatgatcgaaggctcttgtggcatgatcttgacctatctgctcgtccttataagactatgcgattccatcctgaggctatccgagccgttaaattccaccgcacacttcctctctttgctgacgccagtgatgatggcacactgcagattttccacggtaaggttgtcagcgacctcatggaaaacgctacaattgtgcctgtcaagatgctccgaggccacaaggttatcagcaaattaggtgttctggacgtggattggcaccccaaacacccgtggtgtctcagcgctggtgccgatggaacatgcaggctgtggacataa

SEQ ID NO: 12276 - protein, 765 aa, Gibberella zeae PH-1
MAPTTLPSRKRKVLAEPAPVDDELAGVELDGILSQSEDDSDFEESDVEGELHDNSSENDLDEHDQDAEGDDDDDDAYSEDASSDAGDSFGAPPTLDADNSEPNYRVVKDANGGERYEYAEVDPVYDSDDSDAQGPVNTIGDIPLSFYDSYPHIGYDINGKKIMRPATGEALDALLDSIEIPKGWTGLTDPETGKPLDLTQDQLELLKRLQMNEVPNEGYDPYPDMVPYFTNIEEKMPLSAAPEPKRRFVPSKHEAKRVAKLVRAIKEGRILPYKPPEERQREDEEKEESYYDVWANEEPQDPHVMNIPAPKLAPPGYDLSYNPPPEYLPTEEEKEAWKNQDPEEREKEYLPAKFDSLRKVPGYGEFVKERFDRCLDLYLAPRIRKNRLNIDPNSLLPKLPRPEDLKPFPTLNQTIFRGHDGRVRSVAFSPDGEFVASGGDDGTVRVWALNGHQEWMAKLNSEEPVNMVRWRPNKETFILAAAAGEDLFFMIPSVASDAVEKASREVLDVGFGYATNGAQSSAMNGIKKEPPAKWSRPGAKLEAAGVLLMATVRSAIKVINWHKRGEYICTVSPTGQRSSVAIHAISKHLSQLPFRKLPGLAQTAQFHPSRPLFFVATQRMIRCYDLQREELVKVVQPGARWISSFDVHPGGDNLIVGSYDRRLLWHDLDLSARPYKTMRFHPEAIRAVKFHRTLPLFADASDDGTLQIFHGKVVSDLMENATIVPVKMLRGHKVISKLGVLDVDWHPKHPWCLSAGADGTCRLWT

SEQ ID NO: 12277 - DNA, 2418 bp, Candida glabrata CBS 138
  CDS (1)..(2418)
atggttaagggcaggaagagccagaaggcggataaagttacgaaggccaagaagagagttgctgatgaggtcgacgagtcagagtcagagcctgagttgcaagtcgagggactaatagatgctgaggctgagagtgaggatgatgagtccttcgaatctgctgaagaaaatgcttccgctgaagaggacgaggaggatgaggaggatgaagaggactccgatgcggaattgaacaagctattggctgaggaagaaggcgatgattctgaaagtgagtacaatacatctgacttctctgaggacgacactaaatcaatgaccgataagctatcaggcgttaagttgactacaattgcagagccaattattaaaactaaattttctgatgggacaccaagagtaataaaaccagaaatcaatccagtttacgatagcgatgacagtgacatcgaatcgaagaacactattggtaatatcccactatcagtctacgatgaaatgccacatattggttacgacgtcaatggtaaaagaatcatgagaccagccagagcctccgctttggatcaactgttagacaccattgagcttcctgaaggatggactggtctgttggacaaggaatcaggtgccagtctgaatatcagtaaagaagaacttgaattgatctccaaaatacaaagaaatgagcaaactgacgaaagcacaaatccatacgaaccattgattgattggtttactagacatgaagaagtgatgcctctatctgctgctccagaaccaaagagaagatttgttccatccaagaatgaagctaagagaatcatgaagattgttaaggctatcagagaaggccgtatcatcccacctaagaaaatgaaggaattaagagagaaggaaaagagtgaagacttcaattacgatctatggggtgactcaacagaaacaaatgatcacataatgaacttaagagcaccaaagttgcctcctccaacaaatgaagaaagttacaacccacccgctgaatatctaccaacagaagaagaaataaaggaatgggaaaatactgaatatagtgaaagagagaggaactttgttcctaagaagtatgattctttaagaaaggtcccaggttatacagaatctgtgagagagagattcgagagatctctagatctttacttagcaccaagaatgcgtaaaaacaagcttaacattgatcctgaatcattaattcctgagttaccatctccaaaggacttgagaccattcccaattcgctgttccaccatctattctggtcatgaaggtaaaattcgtacattatccatcgatcctactggtatttggcttgcgactgggtcagatgatggttcagtaagaatttgggaaattttaacaggcagagaggtttatagggttcaattagtgaataaagaagataatcctgaagataacatacacagtgtagagtggaatccagatgggtctgttggtatattagctgttgcagtcggtaacaatattttcttaatcgtcccaccaatttttggttatgacattgagaatgccggtaaagttagaattgagcatggttttggttacgatactttcggctcaacaaagaaagctaatctagaggttaatggatctgatttagaatccgatgatgaagcagcaaatgcaaatacagccgtaaagaaacaagttgcgcaatggcataaacctacccagagacaaatggaacaagatatctgtattgtcattgtatgtaagaagcctgtcaagaagctatcatggcatagaaagggtgactacttcgtcacagttcaaccagactctggtaatacatccgtattgatccatcaactatcgaagcatttaacacaatcccctttcagaaaatcaaagggtattataatggatgccaagttccatcctttcaagccgcagctatttgtttgttcacaaagatatgttagaatctatgacttatcacaacaagtattggtcaagaaacttttgccaggcgctcgttggttatctaatatagatatccatccaagaggtgacaacttgatagcatcctcatatgataagagagttctatggcatgatctggacttggctgctaccccatataagactctgagataccacgataaagccgttagaagtacgactttccacaaaaaactaccactattctgctctgctgcagatgatggtttcatccatatcttccatgctacagtctatgatgacatgatgaaaaacccaatgattgtgccgttaaagaaactaacaggtcataaagtgcaaggccatctgggtgttcttgatactatttggcatcctaaggaagcttggttattctccgctggtgctgataacacagccagaatgtggactacctga

SEQ ID NO: 12278 - protein, 805 aa, Candida glabrata CBS 138
MVKGRKSQKADKVTKAKKRVADEVDESESEPELQVEGLIDAEAESEDDESFESAEENASAEEDEEDEEDEEDSDAELNKLLAEEEGDDSESEYNTSDFSEDDTKSMTDKLSGVKLTTIAEPIIKTKFSDGTPRVIKPEINPVYDSDDSDIESKNTIGNIPLSVYDEMPHIGYDVNGKRIMRPARASALDQLLDTIELPEGWTGLLDKESGASLNISKEELELISKIQRNEQTDESTNPYEPLIDWFTRHEEVMPLSAAPEPKRRFVPSKNEAKRIMKIVKAIREGRIIPPKKMKELREKEKSEDFNYDLWGDSTETNDHIMNLRAPKLPPPTNEESYNPPAEYLPTEEEIKEWENTEYSERERNFVPKKYDSLRKVPGYTESVRERFERSLDLYLAPRMRKNKLNIDPESLIPELPSPKDLRPFPIRCSTIYSGHEGKIRTLSIDPTGIWLATGSDDGSVRIWEILTGREVYRVQLVNKEDNPEDNIHSVEWNPDGSVGILAVAVGNNIFLIVPPIFGYDIENAGKVRIEHGFGYDTFGSTKKANLEVNGSDLESDDEAANANTAVKKQVAQWHKPTQRQMEQDICIVIVCKKPVKKLSWHRKGDYFVTVQPDSGNTSVLIHQLSKHLTQSPFRKSKGIIMDAKFHPFKPQLFVCSQRYVRIYDLSQQVLVKKLLPGARWLSNIDIHPRGDNLIASSYDKRVLWHDLDLAATPYKTLRYHDKAVRSTTFHKKLPLFCSAADDGFIHIFHATVYDDMMKNPMIVPLKKLTGHKVQGHLGVLDTIWHPKEAWLFSAGADNTARMWTT

SEQ ID NO: 12279 - DNA, 2376 bp, Kluyveromyces lactis NRRL Y-1140
  CDS (1)..(2376)
atggccagaaagaattcttctttgaatggttctgaatcagcggagcttgttgtaaaaaagagagttctcgaggaatctgaattgtccgattctgaagatgaaagaattgaagttgatggtttaatcgatgaagaggctagcgaaaatgaagctgaggaagctgaagatgacgactctgatgctgaattcaatcgcttattagctgaagaagaaaatggacaggaggaggagtataatacttcagatttttctgaagaaggcgatgctttttccattaccgacaaattgtcaaatgtaaagttaacagtgattccagaaacaagcgatgaaggcattgttcgtaccaagtattcagatggaagaccaagaattcttaagtcagaaattaatcctgtttatgatagtgatgatagtgatgcagaagctaagaacacaattggtaacatcccactatctgcatatgatgaaatgccacatattggttatgacattaatggtaagagaataatgagaccagccaaaggatctgctttagatcaattattggaatctatagaattgccagagggttggacaggtttactagacaaagacagcggtgcctctttgaatttgaccgaagaagaacttgaattaatcaataagttgcaaaataatcaacagacggacgaatctgtgaatccatacgaacctttaatcgactggttcactagacacgaatctgtaatgccagttacggccgtcccagaaccgaaaagacgtttcgttccgtcaaagcacgaagccaagcgtgtgatgaaaatagtcaaagcaatcagagaaggtagaattatcccaccaaagaaactaaaggaattaagagaaaaagaagaacaagacagtcataactacgatctctggggagatgccgaagaaatctctgaacatgttatgaacttgagagccccaaaattgccaccaccaacaaatgaggagtcttacaaccctccggaagagtatcttttgaccccagaggaaattgatgcatgggaaaagatggaaccaagtgaaagagagagaaattttgtgcctcacaaattcgctgcattaagaaaagttccaggttactctgaatctgtcagagaaaggtttgaaagatcattagatttgtatttagcgcctcgtgttcgcaaaaataagttgaacattgatcctgaatctttgatcccagaattgccctctacaaaagatttgagaccatttccaatccgttgctctaccgtttatgtcggtcataaaggaaaaattcgtacaatgtccattgatccaactggattatggttggctactggttccgatgatggcactgtcagagtatgggaaattcttacaggtagagaagtttaccaagtcacaatacttaatgcggaagaaaacaatgatgaccacatagacgttgttgaatggaatcccgacagtactaccggtatccttgcggttactgctggcgaaaacatcttcttgcttgttccaccaattttcggctttgaaattgaaaacacaggtaaatcaaagattgaatacggttttggtttcgatactttcggaaacgtcaaaaagagtaatctcaatgtgaatagcgatgatgaggatgacggtgctgaatcacatgctgtcaagaaacaggttgctcaatggaataaaccaaccgaaaggcaagctgccaatgatatttgtatcgtaataacttgtcgtaaatcagtgaaaaagctttcatggcatagaaaaggtgattactttgtcactgttcaaccagactcaggtaatacatcagttttgattcatcaattatccaagcatttaactcaatcgccattcaaaaaatctaagggtatcattatggatgcaaaattccatccattcaagccacagctcttggtctgttctcaaagatacgtcagaatttatgacctatcgcaacaagtgctaatcaagaaacttctacctggtgctcgttggttatctactattgatattcacccaagaggtgataacttaattgcatcctcgtttgacaagagagtgttgtggcatgatcttgaccttgcaagcactccatataagaccttgagataccatgagaaggctgtaagaagcgtaagtttccacaagaaactaccactgttttgctcagctgcggatgatggtaacatccatgttttccatgccacggtctatgacgatttaatgaagaaccctatgatcgtcccgttgaagaaactaaccggccacaagattgtgaatagtttaggtgttctagatactatatggcatccacgtgaagcttggctattctctgcaggtgccgacaaaaccgctcgtttgtggactacctga

SEQ ID NO: 12280 - protein, 791 aa, Kluyveromyces lactis NRRL Y-1140
MARKNSSLNGSESAELVVKKRVLEESELSDSEDERIEVDGLIDEEASENEAEEAEDDDSDAEFNRLLAEEENGQEEEYNTSDFSEEGDAFSITDKLSNVKLTVIPETSDEGIVRTKYSDGRPRILKSEINPVYDSDDSDAEAKNTIGNIPLSAYDEMPHIGYDINGKRIMRPAKGSALDQLLESIELPEGWTGLLDKDSGASLNLTEEELELINKLQNNQQTDESVNPYEPLIDWFTRHESVMPVTAVPEPKRRFVPSKHEAKRVMKIVKAIREGRIIPPKKLKELREKEEQDSHNYDLWGDAEEISEHVMNLRAPKLPPPTNEESYNPPEEYLLTPEEIDAWEKMEPSERERNFVPHKFAALRKVPGYSESVRERFERSLDLYLAPRVRKNKLNIDPESLIPELPSTKDLRPFPIRCSTVYVGHKGKIRTMSIDPTGLWLATGSDDGTVRVWEILTGREVYQVTILNAEENNDDHIDVVEWNPDSTTGILAVTAGENIFLLVPPIFGFEIENTGKSKIEYGFGFDTFGNVKKSNLNVNSDDEDDGAESHAVKKQVAQWNKPTERQAANDICIVITCRKSVKKLSWHRKGDYFVTVQPDSGNTSVLIHQLSKHLTQSPFKKSKGIIMDAKFHPFKPQLLVCSQRYVRIYDLSQQVLIKKLLPGARWLSTIDIHPRGDNLIASSFDKRVLWHDLDLASTPYKTLRYHEKAVRSVSFHKKLPLFCSAADDGNIHVFHATVYDDLMKNPMIVPLKKLTGHKIVNSLGVLDTIWHPREAWLFSAGADKTARLWTT

SEQ ID NO: 12281 - DNA, 2436 bp, Debaryomyces hansenii CBS767
  CDS (1)..(2436)
atggctcgtaacagtaaggctactgatacaccaaagacagttgttgagaaacagctgagaaagagaaagcaggatgtagaagatgcagaagaaagctcatcggatgaagaattgcaagttgaaggaatattagatgatgcagctagtgaggacgaagaatctgattctgaagatgcagacaaggaagacgacgaagaagaagaattagaaggagactcagatgaagagtttaacgagttattaggcgaagaggaagatctcagcgatgttgattctgaagaattttcagacgaaccaagagatgagactgcgtctatcactgataaattgtctggcactaagattagatcatattctaatgccactgaggatgaagagaacgaagtgcatacaaagttctctgatggacgtccaagaattataaaaccagaaatcaacccaatctacgatagtgatgatagtgacaacgagaatttcaatactattggtaatattccgttaagtgcatacgaggaaatgcctcatataggttatgatatcaatggtaagagaatcatgagacctgctaaaggttctgcattggaccaattgttggaatccattgatttacctgaaggctggactggtttgtttgatcagaataccggtacatcattaaagatcacagatgatgaattagagttgattagaaagatccaagcccaagaaagtactgatgaaaatattaatccgtacgaaccaactattgaatggttcacatcaaaaactgaggtaatgccattaacggctgttccagaaccaaagagaagattcgttccttctaagcatgaagccaagaaagttatgaaaatagtgagagcaataagggaaggtagaattgttcctcctaataaggtcaaagaacaacaggaagaagagaaatacaatttcgatttatggaatgataatgaatcagagacaaaagatcatataatgaacttgagagctccaaaattaccacctcctactaatgaagaatcttataacccaccagaagaatatttgatggacgaggaagaaaagaaaaagtggttagaaatggaacctgaagatagagataaaaattatattccgcaaaagtacaattcgttgagaaaggttccaggttaccaagaaggattaagagagagattcgaaaggtgtttagacttatacttagctccaagaactcgtcataataaattaaacattgatcctgattctttgattcctgaattgccatctccaaaggacttgagacctttcccaatccgttgttccacaattttccaaggtcatacggaaaagatacgtaccttatctatcagtcctgatggattgtggttagcaactggttccgatgatgggtcagtgcgtatttgggaaattttgactggtagacaagtctataaaactgtccttgttgctgatgacaatactgatgataacattgaaagtttagaatggaatcccgacagtaattcaggtattttagctgctattgctggtgaacatatttaccttattgtcccaccaatttttggattcgatattgaaaacaatggtagattacgtattgagtctggttggggttacgatacatttggtaataagtctaagaccaagaacagtaatattaaggttaactcagatgatgaagatgaagaagtagagaaagctgacactaataccggtaagaaagatgtttgcaaatggtttacacctaacacagagcaatcacaagcaggtatctcagctataatccaatgtcgtaagacagtgaagaagatttcatggcatagaaagggtgattactttgttactgtatcaccagacagtggtcattcatcagtattgatccatcaattatcaaaacatttgtctcaatcgccatttaagaaatctaagggtattattatggatgccaaattccatccatttaagccacagttatttgttgcatcgcaacgttacattagaatctacgatttagcgcaacaagtattagttaaaaaattaatgcctggtgcaagatggttgtctaacatcgatatccacccaagaggtgataatttgttagcatcgagttatgacaagagagttttatggcatgatttggatttatcatccactccttacaagacattacgttatcacgataaggcagttagatccatcaaattccataaagctaacttaccacttttcgcatccgcatcagatgatggttcgattcatgtgttccatggtactgtttacgatgacttaatgaccaatccgttattggtgcctttgaagaagttgactggccacaaaattataaatagtcttggtgttttggatttagtttggcatccaaaggaagcctggttatttagtgctggtgctgacggaactgctcgtctttggactacatag

SEQ ID NO: 12282 - protein, 811 aa, Debaryomyces hansenii CBS767
MARNSKATDTPKTVVEKQLRKRKQDVEDAEESSSDEELQVEGILDDAASEDEESDSEDADKEDDEEEELEGDSDEEFNELLGEEEDLSDVDSEEFSDEPRDETASITDKLSGTKIRSYSNATEDEENEVHTKFSDGRPRIIKPEINPIYDSDDSDNENFNTIGNIPLSAYEEMPHIGYDINGKRIMRPAKGSALDQLLESIDLPEGWTGLFDQNTGTSLKITDDELELIRKIQAQESTDENINPYEPTIEWFTSKTEVMPLTAVPEPKRRFVPSKHEAKKVMKIVRAIREGRIVPPNKVKEQQEEEKYNFDLWNDNESETKDHIMNLRAPKLPPPTNEESYNPPEEYLMDEEEKKKWLEMEPEDRDKNYIPQKYNSLRKVPGYQEGLRERFERCLDLYLAPRTRHNKLNIDPDSLIPELPSPKDLRPFPIRCSTIFQGHTEKIRTLSISPDGLWLATGSDDGSVRIWEILTGRQVYKTVLVADDNTDDNIESLEWNPDSNSGILAAIAGEHIYLIVPPIFGFDIENNGRLRIESGWGYDTFGNKSKTKNSNIKVNSDDEDEEVEKADTNTGKKDVCKWFTPNTEQSQAGISAIIQCRKTVKKISWHRKGDYFVTVSPDSGHSSVLIHQLSKHLSQSPFKKSKGIIMDAKFHPFKPQLFVASQRYIRIYDLAQQVLVKKLMPGARWLSNIDIHPRGDNLLASSYDKRVLWHDLDLSSTPYKTLRYHDKAVRSIKFHKANLPLFASASDDGSIHVFHGTVYDDLMTNPLLVPLKKLTGHKIINSLGVLDLVWHPKEAWLFSAGADGTARLWTT

SEQ ID NO: 12283 - DNA, 2463 bp, Yarrowia lipolytica CLIB122
  CDS (1)..(2463)
atggtacgaagtcgttccaactccgttaagaaggatttgaagcgcaaagtcgacgagcctgtcgacgtgcaagacgagttcgatgtcgagggactcattgatgagggcgactccgacgacgaggatgaagctgagcaggaagtggcacaagaaaatgtgacaaaggacaagaagaacaccagcaagactgaaaacgaagaagatgccgacgatgaaagtgactctgacgccgagcttgaggcactcatcggtgaagaggaggatctgtctggaagcgagctggaagacgagctggcttacttttctgatgctggagacgacgaggtcgacccctcgattctaaagcatttggatgacggagttcgtctgcgatctctgtctcgatcttccgaccagactgatgagctcaaggacgtggttgaaattgtgcctggagccgacggcaagcctcgaatgatcaagaaggaaatccatgctgtctacgactcggacgattcggaccaggaggaatccaataccattggaaacgtgcccctgtctgcctacgaccagatgcctcacattggatatgacatcaacggtaagcgaatcatgcgacccgctaccggttctgctctggacaacctactggagacgattgatttgcccgagggatggaccggcctgctagacaagagcaccggaaagggtctcaacatttccaaggaggaactggaactcatcaagcggattcagaagaatgagaccaccgatgacgcctccaatccctacgaggacctggtggagtggttctcttccaagacagagatcatgcctctgtctgctgcgcccgagcccaagagacgattcattccctccaagcacgaggccaagcgagtcatgaagatggtgcaggccattagacagggtaaactgctgacaaagcccaaggaggaccctgacgcccgacccaactacgacgtgtgggccgacaacctcacggacgtccaggaccacgtcatgactctgcgagcccccaaaatgccccctcccacccacgacgagtcctacaacccccctgccgagtatctgcccaccgaagaggagattgccgagtggaatgctcttgctccttccgagagagagcgaaactacgtgcccaagaagtacactgctctgcgacatgtgcccggctactccgagtctgttcgagagcgtttcgagcggtctttggatctctacctggctcctcgagtgcgaaagaacaagctcaacattgatcccgactctctgattcccgatctcccctcccccaaggatctcatgcctttccccatcagatgtgctaccacctacaagggccacaagggcaaggttcgagccatctctgtggatcccagtggagagttccttgccactggaggcgacgacggaactcttcgagtttgggaagtgctcactggtcgagagctgtaccgatgtcgtctggtggcgtccattgatgctcaggatgactcagtcgagtgtgtgcagtggaaccccgctgtccctggcatgctggctgcctctgctggtgagcatattttcctgattgtgcctcccacgctgtttgactttgatatcgagaacaccggccgagagaagattgagcagggatggggttttgccgagggaggacgagagcagcaggatatcgataccaagggtctggatgacgatgctgactccgactcggacgacgagaccggtcacgtcaagaagaagagccctcctgccaagtggatcacccccaccgccaagcagcaggcctctggtattggagccatcattaccgccaccaaaaccatcaagcgactcgcatggcaccgaaagggagactatctggtcactgtggccccctcggcgcagcacagagccgtggccatccaccagatctctaagcattcgtcacagtcgcctttcaataagtccaagggtattgtgcaggacgccatgttccatcccttccgacctcatctgtacgttgccacccagcgatacgtgcgtatttacgatctggccaagcaggtcatggccaagaagcttatgcccggtgctagatgggtgtcttctctggacattcatccccgtggtgataacgtgatcctgtcgtcgttcgacaaacggcttctgtggcacgatctcgacctcagtgataagccctacaagaccctgcgataccacgaaaaggccgtgcggcacgcagcattccacaagggtggtctgccgttgttctgctccgcttctgacgacggtaatattaacattttccacggcaccgtctacgacgacatgatgaccaaccctctgctggtgcctctcaaggtgctcaagggccacgatgtcaagagcggtctgggtattctgcgggttgagtggcatccccgggaggcttggttgttttcagccgctgctgacggaactgcaaagctgtggaccacgtaa

SEQ ID NO: 12284 - protein, 820 aa, Yarrowia lipolytica CLIB122
MVRSRSNSVKKDLKRKVDEPVDVQDEFDVEGLIDEGDSDDEDEAEQEVAQENVTKDKKNTSKTENEEDADDESDSDAELEALIGEEEDLSGSELEDELAYFSDAGDDEVDPSILKHLDDGVRLRSLSRSSDQTDELKDVVEIVPGADGKPRMIKKEIHAVYDSDDSDQEESNTIGNVPLSAYDQMPHIGYDINGKRIMRPATGSALDNLLETIDLPEGWTGLLDKSTGKGLNISKEELELIKRIQKNETTDDASNPYEDLVEWFSSKTEIMPLSAAPEPKRRFIPSKHEAKRVMKMVQAIRQGKLLTKPKEDPDARPNYDVWADNLTDVQDHVMTLRAPKMPPPTHDESYNPPAEYLPTEEEIAEWNALAPSERERNYVPKKYTALRHVPGYSESVRERFERSLDLYLAPRVRKNKLNIDPDSLIPDLPSPKDLMPFPIRCATTYKGHKGKVRAISVDPSGEFLATGGDDGTLRVWEVLTGRELYRCRLVASIDAQDDSVECVQWNPAVPGMLAASAGEHIFLIVPPTLFDFDIENTGREKIEQGWGFAEGGREQQDIDTKGLDDDADSDSDDETGHVKKKSPPAKWITPTAKQQASGIGAIITATKTIKRLAWHRKGDYLVTVAPSAQHRAVAIHQISKHSSQSPFNKSKGIVQDAMFHPFRPHLYVATQRYVRIYDLAKQVMAKKLMPGARWVSSLDIHPRGDNVILSSFDKRLLWHDLDLSDKPYKTLRYHEKAVRHAAFHKGGLPLFCSASDDGNINIFHGTVYDDMMTNPLLVPLKVLKGHDVKSGLGILRVEWHPREAWLFSAAADGTAKLWTT

SEQ ID NO: 12285 - DNA, 2400 bp, Aspergillus nidulans FGSC A4
  CDS (1)..(2400)
atggagctgttgcctccgatggccgccttaaaagcttcgaagaaaagaaaggcggtgacgcgtgacgtggaggaggaagcaggagtcttctctggtgatgagctgagttccaaggacttggacggcgccctttcggacaatgcgcacgaccttttgagtgacgaggacgctagtgattctgagatcgagcttatcgatgattactccagtagtgaagaagaggacgacgaggagcttgatagtgacgagattccgtcagagggagaagacgaaggtgtggtaaagaaaaagtcaactgcggtgcttgacctagatgggcttgaagatagagaagaatcgactaaggaggaggaggaggaggagcaattgaactatcgcattgagaaggatgcgaatggaaatgaccgctacgtctacgatgagattaacccagacgacaattccgactactcggatgtggacgaaaattcaaacacaattggcaacattccgttgtcgttctacgatcaatacccccatattggctatgacattaatggcaagaagatccttcgccctgctaagggagaggcccttgatgcgttgctcgacagtatcgaaattcccaaaggttggaccggtctcactgatccctcaaccggaaaaccgttggaactgagccaagacgagctggaattgctgcgcaaagtgcagatgaacgaaattccagatgaagaatacaacccatacgaacctctgacagaatggtttacgactgagaaagaaattatgcctcttagtgctgctcctgaaccgaagcgtcgatttgtaccgtcaaagcatgaagccaaacgcgtcatgaaaattgtgaaggcaatcagagagggccgcatcttaccattcaagccccaaacacaagaagatgaagaagacaaggacgtcataaagtacgacctctgggctgatgaggctgagcgacctgatcatcctatgcatgtcccggctcccaagcttcccccaccagggtatgaggagagctaccacccaccgcccgaatatttacccgacaagaaggaacgaaaagcatgggaggatgcagaccccgaagacagagagcgggagttccttcctcaggactttggttcccttcgcagggtgcctggctacgagaactttgtcaaagaaaagtttgaaagatgtttggatctttacttggcacctcgagttcggaggagcaagttgaatattgatcccgagagtctgctccccaaacttcctagcccagaggagttgaagccattcccgaccgcatgcgcagccgtcttcagagggcacaaaggccgtgtgcgcagcctggctgttgaccctactggtatttggcttgctactggtggagatgacggtactgtcagggtttgggagctaattactggccgtcagttatggagtgtcaaactgggtgaagatgagccggtgaacgtcgtccgctggcgtccgggcaaggatgctgttatccttgctgctgctgcaggcgacgacatattcctcgcagtgccgcctattgctgatcccgagacagagaaagccagtcttgacctactggacgctggctggggttatgctgcctcgaagcccgccccaaagcccgcagacgaggagaagaagagcacacctcctcagtggatacggccttcagcagccctggcagactccggtgtatgtgtggttattcctcttcgttacatcgccaaaacaatttcatggcaccgccgcggagattatttcgtcacagtctgttccggcgcctcgacgcccgcctcggttgctatcgcgatccacaccgtctccaagcatcttacccagtatcccttccgtcgacgtattaagggtggtggccccccacaaacagcccatttccacccgtctaagccaatcctcttcgtcgccaaccagcgtacaatccgtgcctatgatctttcccgccaactcctcgtcaagatcgtccagcccggtgcccgctggatctcctcattcgacattcacccgacatccgctaccgccgcgggaggtgacaacctcattgtcggttcttacgaccgccgcctcctctggcacgatctcgagctctctcaacgtccctataaaaccctccgctaccaccgcaaggccatccgtgccgtcaaatttcaccccggtggccgctatcctctctttgctgatgctagtgatgacggttctctccaaatatttcacggcaatgtcactggtgatatgcttagcaatgctaccattgttccgctgaaagtgctgagaggtcacaagatcacgggtgaattaggtgttctggatatcgattggcacccacgggaagcatggtgtgtcagcgcaggtgcggatggaacgtgtcggctgtggatgtaa

SEQ ID NO: 12286 - protein, 799 aa, Aspergillus nidulans FGSC A4
MELLPPMAALKASKKRKAVTRDVEEEAGVFSGDELSSKDLDGALSDNAHDLLSDEDASDSEIELIDDYSSSEEEDDEELDSDEIPSEGEDEGVVKKKSTAVLDLDGLEDREESTKEEEEEEQLNYRIEKDANGNDRYVYDEINPDDNSDYSDVDENSNTIGNIPLSFYDQYPHIGYDINGKKILRPAKGEALDALLDSIEIPKGWTGLTDPSTGKPLELSQDELELLRKVQMNEIPDEEYNPYEPLTEWFTTEKEIMPLSAAPEPKRRFVPSKHEAKRVMKIVKAIREGRILPFKPQTQEDEEDKDVIKYDLWADEAERPDHPMHVPAPKLPPPGYEESYHPPPEYLPDKKERKAWEDADPEDREREFLPQDFGSLRRVPGYENFVKEKFERCLDLYLAPRVRRSKLNIDPESLLPKLPSPEELKPFPTACAAVFRGHKGRVRSLAVDPTGIWLATGGDDGTVRVWELITGRQLWSVKLGEDEPVNVVRWRPGKDAVILAAAAGDDIFLAVPPIADPETEKASLDLLDAGWGYAASKPAPKPADEEKKSTPPQWIRPSAALADSGVCVVIPLRYIAKTISWHRRGDYFVTVCSGASTPASVAIAIHTVSKHLTQYPFRRRIKGGGPPQTAHFHPSKPILFVANQRTIRAYDLSRQLLVKIVQPGARWISSFDIHPTSATAAGGDNLIVGSYDRRLLWHDLELSQRPYKTLRYHRKAIRAVKFHPGGRYPLFADASDDGSLQIFHGNVTGDMLSNATIVPLKVLRGHKITGELGVLDIDWHPREAWCVSAGADGTCRLWM

SEQ ID NO: 12287 - DNA, 2550 bp, Candida albicans SC5314
  CDS (1)..(2550): transl_table=12
atggctaggaatagtattaaaaaatctcctgtggtgaagaaaaaggatactccaatagttagaaaaagaaagccaatccaacaagaagcagaagaagattccaatgatgaagaatctgaagatgagttaaatgttgaaggattgatagatgcaagtgatgatgaagatgaagaagaagaacaagaacaagaagaacaaccccaagaagaggaaaataacagtgatgatgatgatgatgacgatgatgatgacgatgacaacaactcagaagcagattctgaagaagaattaaatcaattattaggtgaagaagaagaagaagatcctagtgattataattctgatgaattttctgatgaaccaaaagatgatgatttatcaaggatcaacatcaaatcattatcagtttctgatccttcaattcaaaaaaattcaatttcaaaattttctgatggttcaataagaattttaaaaccagaaattgaacctaaatatgatagtgatgatagtgatgctgaaaatttcaacactattggtaatattcctatttctgcttatgatgaaatgccacatattggatatgatattaatggtaaaagaatcatgagaccagctaaagggtccgctttagatcaattattagaatctattgatttacctgaaggttggaccggtttattggatcaaaatactggtacttcattgaaattaactgatgaagaattagaattaattagaaagattcaacaacaagaaaatactgatgaaaatattaatccatatgaacctttaattgattggtttactaaagatgaagaaatcatgccggtaactgctgtcccggaaccgaaacgaagatttgttccttctaaacatgaagctaaacgagttatgaaaatagttaaagccattagagaaggtagaattatcccaccaaataaagttaaacaacaattaactgaagaagaagaagaagatcaatttaattttgatctttggcaagatgaaattgaaatatctgatcatattatgaatttaagagctcctaaattaccaccaccaactaatgaagaaagttataatccaccagaagaatatcttttaactgaagaagaaaaatctaaatggttacaagaatctcctattgatagagaaagaaatttcttaccacaaaaatataattcattaagacaagttcctggttatcaagattccgttagagaaagatttgaaagatctttagatttatatttagctccaagagtacgtcataataaattgaatattgatcctgatagtttgattcctgatttaccttcaccaaaagatttaagacctttccctattcgttgttctactatatatgaaggtcatactggtaaaattagaactatttctattgatcctcaaggtctttggttagctactggttcagatgatggtagtgttagaatatgggaaattttaactggtagacaagtttacaaaattcaattaattaataaagaaatcaataatgaagatcatattgaatgtttagaatggaatcccgattctagttgtggaattttagcagtttgtgttggtgaaaatatttatttaattgtcccaccaatttttggatttgatattgaaaattctggtaaattaagaattgaaagtggttggggttatgatacttttggtaataaaaagaaagatcttaaaatttcctcccaaaaagaggaagacaataaagaatcagacaacgaagacgaagacgaagaagaagataatgatgatgatgatgatgatgatgaaccagaaactagctcaactgttgaaccaaagaaagaagttgctaaatggtatccaccaaatactgaacaagcttctatgggtatatcagcaattattcaatgtcgtaaaacaattaaaaaattatcatggcatagaaaaggtgattatttcgtcacggtttctcccgatagtaaaaacactgcggtattaattcatcaaatttctaaacatttatcccaatcaccatttaaaaaatctaaagggattataatggatgctaaatttcatccatttaaaccacaattatttgttgcttcacaacgtcaaattaaaatttatgatttagctcaacaagtattattaaaaaaattaatgcccggggttcgattattatcaactattgatattcatcctcgtggtgataatttaattgctggttcttatgataaacgtgtattatggcatgatttaaatttaagtgctaccccatacaagacattaagatatcatgaaaaagccgttagatcaataaaatttcataaaggaaatttaccattatttgcaagtgcttctgatgatggtaatattcatattttccatgggacagtatatgatgatttaatgacaaatcctttattggtaccattgaaaaaattaaatggtcataaaattattaatcaaattggtatattggatttaatttggcatcctaaagaaccttggttatttagtgctggtgctgatggaactgctcgtctttggactacatag

SEQ ID NO: 12288 - protein, 849 aa, Candida albicans SC5314
MARNSIKKSPVVKKKDTPIVRKRKPIQQEAEEDSNDEESEDELNVEGLIDASDDEDEEEEQEQEEQPQEEENNSDDDDDDDDDDDDNNSEADSEEELNQLLGEEEEEDPSDYNSDEFSDEPKDDDLSRINIKSLSVSDPSIQKNSISKFSDGSIRILKPEIEPKYDSDDSDAENFNTIGNIPISAYDEMPHIGYDINGKRIMRPAKGSALDQLLESIDLPEGWTGLLDQNTGTSLKLTDEELELIRKIQQQENTDENINPYEPLIDWFTKDEEIMPVTAVPEPKRRFVPSKHEAKRVMKIVKAIREGRIIPPNKVKQQLTEEEEEDQFNFDLWQDEIEISDHIMNLRAPKLPPPTNEESYNPPEEYLLTEEEKSKWLQESPIDRERNFLPQKYNSLRQVPGYQDSVRERFERSLDLYLAPRVRHNKLNIDPDSLIPDLPSPKDLRPFPIRCSTIYEGHTGKIRTISIDPQGLWLATGSDDGSVRIWEILTGRQVYKIQLINKEINNEDHIECLEWNPDSSCGILAVCVGENIYLIVPPIFGFDIENSGKLRIESGWGYDTFGNKKKDLKISSQKEEDNKESDNEDEDEEEDNDDDDDDDEPETSSTVEPKKEVAKWYPPNTEQASMGISAIIQCRKTIKKLSWHRKGDYFVTVSPDSKNTAVLIHQISKHLSQSPFKKSKGIIMDAKFHPFKPQLFVASQRQIKIYDLAQQVLLKKLMPGVRLLSTIDIHPRGDNLIAGSYDKRVLWHDLNLSATPYKTLRYHEKAVRSIKFHKGNLPLFASASDDGNIHIFHGTVYDDLMTNPLLVPLKKLNGHKIINQIGILDLIWHPKEPWLFSAGADGTARLWTT

SEQ ID NO: 12289 - DNA, 2799 bp, Ustilago maydis 521
  CDS (1)..(2799)
atggtgcgaccgtcctcttccagctcagcgtcagcctctgctgcgcgcagcggcgctgcaaagaggaagcgcaacctgcccacagccacgaaccccaccacaagagcgtcagtcgccgccaacgtcaagggcaagggcaagacaaaagcgctcgagcttgatcttgttgtttcagatgacggtgaagaggatggcgagcttgatctggagtccgacagtggcgacgatgatgccaacgacgacgacgacaacgacaacgaacaggacgatttccccgagatcgatctcgaagacagcgacgatgatcaagatgtggaagatgaagacgagccaggagctcaggaggaggtagacagtgacaataacaaacaagcatccacacaagtgcatgacattcaagtagaagaagacgactcctcagaagaaggctacaactcttccgacattgataattctgactttgacgacgatgccgacgaaggtgatctggcctacgattcggctgacgaagacgagcgtgcttccgcttttgctgctcgcagcgacgcttcgcagaccagcatcgacgaggagttatcacgtatgatgtcgcgctactcttccaagccggatgagcactcgggctcgctctcggccaccaacaagctcggcatcccgcgttctcaagcagcacaggcgtttgatctgcgtgttcgcaacccagacggctcggccaagggtgtcttcaagcgcagcgagataaccggcgagatgaagcgtgtctaccccgagatcgatgcagcctatgactcggacagcagcacagaggatccagaaaacaggatcggcaacgttccgctcgaatggtacgacgacctgccgcacattggctatgacatcaacggacgcaaggtgatgaagccagccaccaaggacgagctggacaagttcctcgacacggtagacggcgatggcgaggcatggttctctgcgcgtgacaagtctaccggcaaagacgttcggttgagcgacgaggaactggccattattcgcaagctccagaacgccgagatcccagatgacgcttacgacccgtatgaagactacgtcgattggtttaccggcgaagacaaggtcatgcagacagcattgagcggtcgaccggaacccaagtcacgctttgtacccagtaaatgggagcacaagaaggtcatgaagatcgttcgtgccatccgcgagggtcgcatcgtgcccggtgcagctgccaacaaggacgccaaacccaagttttacaacatctgggctgacgctcacgagaacgacacgcgtagcccgtgggcagtcatggcggcgcccaagcttgcgctccccggtcacgccgagtcgtacaacccaccggcagagtacctgttcaacgagcaggagcaaaaggaatggcaagaggccgaagccgaggaccgcaagcaaaacttcctgcctaccaaacacgattcgttgcgtcgcgtcggtgcctatcaaaactttgtccaggaacgcttcgagcgatgcctggatctgtatttggcgcctaggatgatgcgcaagaagttggatattcacaatccggaaaacctgttgcccaagctgccatcaccgaaggagctcaggccgttccccatcacgacgagcgtggtgtatgtccatccggacggcgggcgcgtgcgctgtttgtcggtcgacccgacgggtaattggctcgtgacgggtggcgatgatggacgcgcgagattgtgggatgtagcgatcggaagatgtaccgcctcatgggatgtgtgcgaaggtatgcccaaggccgaacgttccgccgtacattcgatcgcctggtgtccgaccaagaactactcgctcttcaccgctgttgtccacggtcgggtcgccgtgatcgcaccaccgcagacgcagaactacgcaaagacatcagccaatgccatatcttcgaaatcggcctcttcctccagcggtgctacggccacctcaaccgcatcgttcctctacgccacctcggcagcggcgacctcgatgcccagcaaaccggacgcgcgctcgcccgtcgcttggactcgtccttcggaagcggaacgtcgtaccggtgtcgccatgcatctcaacatcacctctccctccgccgccaacctcaagacggtggtctggcacaacaagggcgactactttgccaccgtctgtcctgactcggctgcgggctcggcgggtttgctcatccaccaactctcgaaacaccgatctcagtctccgttccgaaaggcgtcaaagggatcgtcgattcagaaactcgtcttccacccgaccaaaccatggatctttgtcgccacccaacgctacatccgcatctacgatcttatggcgcagtcgctcatcaagacgctgcagtcgggcttcaaatggatctcgacactcgacgtccacccctcgggtgatcatctcatggtaggaagctacgataagaaacttgcctggttcgatctcgacctctcggcgcgaccgtacaaggtgttgaagtaccacgctagggcgatcaggtcggttcactttagtaccagctggaacctcgtcgctgatgcaagtgacgatggaacgctgcagctcttctacgccaaggttggtgccgattatggagagaacctcaccctggttccgttgaaagtgctcaggggccacgaggtcaagaatggccttggcgtgttggacgtcaagtggcaccccaatcagccgtggttgttctctgcgggtgctgacggtaacgcacttctgtggacaacgtag

SEQ ID NO: 12290 - protein, 932 aa, Ustilago maydis 521
MVRPSSSSSASASAARSGAAKRKRNLPTATNPTTRASVAANVKGKGKTKALELDLVVSDDGEEDGELDLESDSGDDDANDDDDNDNEQDDFPEIDLEDSDDDQDVEDEDEPGAQEEVDSDNNKQASTQVHDIQVEEDDSSEEGYNSSDIDNSDFDDDADEGDLAYDSADEDERASAFAARSDASQTSIDEELSRMMSRYSSKPDEHSGSLSATNKLGIPRSQAAQAFDLRVRNPDGSAKGVFKRSEITGEMKRVYPEIDAAYDSDSSTEDPENRIGNVPLEWYDDLPHIGYDINGRKVMKPATKDELDKFLDTVDGDGEAWFSARDKSTGKDVRLSDEELAIIRKLQNAEIPDDAYDPYEDYVDWFTGEDKVMQTALSGRPEPKSRFVPSKWEHKKVMKIVRAIREGRIVPGAAANKDAKPKFYNIWADAHENDTRSPWAVMAAPKLALPGHAESYNPPAEYLFNEQEQKEWQEAEAEDRKQNFLPTKHDSLRRVGAYQNFVQERFERCLDLYLAPRMMRKKLDIHNPENLLPKLPSPKELRPFPITTSVVYVHPDGGRVRCLSVDPTGNWLVTGGDDGRARLWDVAIGRCTASWDVCEGMPKAERSAVHSIAWCPTKNYSLFTAVVHGRVAVIAPPQTQNYAKTSANAISSKSASSSSGATATSTASFLYATSAAATSMPSKPDARSPVAWTRPSEAERRTGVAMHLNITSPSAANLKTVVWHNKGDYFATVCPDSAAGSAGLLIHQLSKHRSQSPFRKASKGSSIQKLVFHPTKPWIFVATQRYIRIYDLMAQSLIKTLQSGFKWISTLDVHPSGDHLMVGSYDKKLAWFDLDLSARPYKVLKYHARAIRSVHFSTSWNLVADASDDGTLQLFYAKVGADYGENLTLVPLKVLRGHEVKNGLGVLDVKWHPNQPWLFSAGADGNALLWTT

SEQ ID NO: 12291 - DNA, 2493 bp, Cryptococcus neoformans var. neoformans B-3501A
  CDS (1)..(2493)
atggcaccccaaccgctcaaggtgggaacttcaaaactgtccaagatggtcaaatcagccccaaaaaccgctggaaagtcaaagaagcgagcagtagagcaggtgtcagaagagagcgacgaagaatttggggaccaagggagtggaattgatatgagtgatgatgaggaagaggttgatggagacgatgaggaggatgaagatgaagcttttcctgaattcgacagcgagcttgaggataatgatcaagaagaagccagtgatgaggagcaagatgaacaggatacgtctgacgaaagtgaaatcgtggaggaggacagtgactctgagtcaggttacaacacgtctgacatcgagcgaatgtacgcttctgatgatgatctctcgtccgaagagaacaaagacctccctgtcgacgagaagctctcgagacttatcgccaagaacactgtcaagcccgacgactctattggcacagatgacaaaatcagtcgtgcaaaggaaggggtagggagattggtgcccagcaaacacgtgaagggatcatttgtgcgagagtacgacgaatatgaggccggatatggcagtgaaagtagcaccgaggataaccccaatactgtcggtaacattccgatggagtggtacgatgaccttcctcatatcggttacgatgtcaacggtcgcaagatcttccggcctttgcaaggcgacgaacttgacaagttccttgccaatgtcgaggatccgtccgcttggacctctgccgaagacaaacttcttcaacaaaatgttcagttgtcagacaaggagctcgatatcattaggcgattggagagggccgaaaaccctgatgccgactttgacccctatcaacctactattgaatggtttaccggcgaaggcaaggagagagtcatgccgcttagtgcggcgcctgagcccaagaggagattcgtgccttccaaatgggagcataagaagattatgaagatcgtcaaggctatcagagagggccgaatcatccccaacaaaccttccgccgaaaaacctcgcttctatcctatctggtctgacgccgaccagcacaaccctcacgtcatgtatatgcccgcccctcaacttccccctccgaagacggccgaatcctacaatcctcctgaagagtaccttcctaccgaggaagagaaggctgagtgggaggcgatggacaaggaagaccgaaagaccgatttcttgcccgagaagtatgatgcccttagaaaagttcctggctacaagaacttggtgcaagagaagttcgagagatgtcttgatttgtacctcgcccctcgaactcgacgagtcaagctcaacattgacccagactctcttattcctaaacttcccgctcccaaggagctcaaacccttccctatcgcttctactgtccagtaccgtcatcccggagacactcgtgtccgatccgtttccaccagccctgatggtcagtggattgcttctggctcagaagatggtgtggtgcgagtctgggacctgggtaacggtcgtgaagtctggagatgggatttacacgctggtcctattcagtacgttgagtggtcaccttctcgtgaggagtctttgcttgtggctcttgtcgccggtaagatcgctgtgctctctcctcttgctctcgtcgctcctcatattgccgcccaaaccctcacccactccaataccgcttttgctactagttctgcgacgacaaagcaaggtgccggtaacgaagttaaaggaattgagtctgtcaaatggacgagaccgagtgagagggaaagagaaaggggtgtcttggtgtatgtggaagttcctggtactcctaaacaagttacatggcacaggaagggggactactttgccacggttgcatccgacgccgctaacaaatccgtccttatccaccaactctcccgccacggcagtcaatcccccttccgtaagactcccggcacaatccagcgcgttgcattccatccttctaagcctcatttctttgctgccactcaacgttacatccgtctttacgaccttgctgctcaaaagctcattagaactttacagtctggtgtcaaatggatttcatccatggatgtgcactccggaggtgacaatttaattatcggtagttacgataagaaattagcttggttcgacatggatttgagcgcaaagccttataaaaccttaagataccacaaccgtgctcttcgatccgttgcctatcaccctactctccctctcttcgcctctgcctcagacgatggcacagtccacattttccactgcaccgtttacactgatctcatgcaaaacccgctcattgttcctctgaagatcttgagggggcataaagtaatcgatggtatcggagttttggatttgagatgggtgcctggaaaaccgtggttggtcagctccggtgcggatggagaggttaggctttggtgttcgtag

SEQ ID NO: 12292 - protein, 830 aa, Cryptococcus neoformans var. neoformans B-3501A
MAPQPLKVGTSKLSKMVKSAPKTAGKSKKRAVEQVSEESDEEFGDQGSGIDMSDDEEEVDGDDEEDEDEAFPEFDSELEDNDQEEASDEEQDEQDTSDESEIVEEDSDSESGYNTSDIERMYASDDDLSSEENKDLPVDEKLSRLIAKNTVKPDDSIGTDDKISRAKEGVGRLVPSKHVKGSFVREYDEYEAGYGSESSTEDNPNTVGNIPMEWYDDLPHIGYDVNGRKIFRPLQGDELDKFLANVEDPSAWTSAEDKLLQQNVQLSDKELDIIRRLERAENPDADFDPYQPTIEWFTGEGKERVMPLSAAPEPKRRFVPSKWEHKKIMKIVKAIREGRIIPNKPSAEKPRFYPIWSDADQHNPHVMYMPAPQLPPPKTAESYNPPEEYLPTEEEKAEWEAMDKEDRKTDFLPEKYDALRKVPGYKNLVQEKFERCLDLYLAPRTRRVKLNIDPDSLIPKLPAPKELKPFPIASTVQYRHPGDTRVRSVSTSPDGQWIASGSEDGVVRVWDLGNGREVWRWDLHAGPIQYVEWSPSREESLLVALVAGKIAVLSPLALVAPHIAAQTLTHSNTAFATSSATTKQGAGNEVKGIESVKWTRPSERERERGVLVYVEVPGTPKQVTWHRKGDYFATVASDAANKSVLIHQLSRHGSQSPFRKTPGTIQRVAFHPSKPHFFAATQRYIRLYDLAAQKLIRTLQSGVKWISSMDVHSGGDNLIIGSYDKKLAWFDMDLSAKPYKTLRYHNRALRSVAYHPTLPLFASASDDGTVHIFHCTVYTDLMQNPLIVPLKILRGHKVIDGIGVLDLRWVPGKPWLVSSGADGEVRLWCS

SEQ ID NO: 12293 - DNA, 2349 bp, Phaeosphaeria nodorum
  CDS (1)..(2349)
atgtctgttaattcgcgcaagaggaaggtagcgacaaaggctgcgcctgtacagagcagctcggatgaagaactggcggatggtctgctcgatggcatcttgtcgcattcggaagacgagtcggaagacgaccaggatgcagaggataccgatgcgagcagtgtgatcgaggggttatcggacgaggattttgaagacgaagaagattcaggcgacgaggccgaagagattcgcaagcagatgcgaaatctcaacacctccggaggctcacagcagcgcaagacaagacagccagcgcatgaaagactagacgacggcgcagatggcgagttggaaggagaagaagacgagagcttaaaaccaaactacactgtcacgaccgatgcgcatggtcaggtccgttacctgtacaaagaaatcgaccccgtctacgagtccgacgattccgatgctgaggcgaccaacacgattggaaacattcctctgacatactacgacgaatacccacacattggctatgatatcaatggaaagaagatcatgcgacctgcgaagggcgaggccctcgatgcgctcctggacagcatcgacatacccaagggatggactggcctgacggatcctcagacaggcaaaccattgaatctgtcagaggaagagctagacgtactgaagaggttgactagaaatgaagttgtagaagatggctatgacccctatcccgagatggtggcatacttttctggaaagcaggagatcatgcccttgagcgctgcgccagagccgaaacgacgattcattccttccaagcacgaagccaagcgcgtcatgaagattgtgaaggcgatcagagaaggccgcattaagccgtataaggcgccggaggagcgggaagaagatgagcagatttcgtatgatgtttgggcagatgaaaagcctcgtcctgagcactcgatgcacatacctgcccccaagctacctccaccagggtacgaggcgagctaccatccaccgccggagtatttaccagacaaggccgaggaagaagcatggctgcaagcggacgaggaggatcgcgagaaggacttcctgcccaaaaactacgaagcattgcgcaaagttcccgggtacgagacgtttgtcaaagagcgtttcgagcgcagtctggatctatacctggcacctcgagtgcgcaggaacaggctcaatatcgatcccgaatccttattaccaaagctacctgatcccgaagatcttaaaccgttcccaaccacctgcgcagcaatctttagaggccaggaaggccgtgttcgttgtgtctctgttgatccacagggtatattcgttgccagtggaggcgatgatggatatgtgcgcatatgggagcttctgaccggccgacaagtatggaatgcgaaattgtcagacgaggaagccgtcgatgctgtacaatggagacctaccaaagatgcttcagtcctggctgctgcctccggagagcacgtctacctgattgttccctttacgcttttgtctcccgacgtcgaacaatctagtcgcgatgtactggacgcaggttggggttacgcaacttcgaaaccctccacggcagccaatggcgaagccccgaagcaatcacccgggaagtggagtcgccctggtagccgcatggagaataagggaatactggtccagattgaagttcgttccgccgtcaagatcatcaactggcataggcgaggagactacttcgccacagtttctcctcggggacaaagtactgcagtagccatacacacagtctcgaagcacctgactcaactcccattccgtcgcctcaagggaatcgctcagaccgcgcaattccacccttccaaagccattttcttcgttgccacgcgcaatactatccgcagctacgatctcgcgaagcaagagcttgtcaagatcctgcaacctggtgccaagtggatctcatccatcgacgtccaccccggcggagacaacatcatcgtaggcacttacgataagcgactcctgtggcacgacttggatctctcaaacaagccttacaagactctgcggttccacaaggaagccatccgagctgtcaagtttcaccaaggaggtctgccactctttgcggatgctagcgacgacggtagcttgcaaatcttccacggcaaggtcgtggacgatctcatggaaaatgctactattgtgccattgaaggtgcttcggggtcacaaggtcaagagcaggttgggtgtgatggatctggactggcatcccagggagccgtggtgtgttagtgctggagctgacgggacgctgagactgtggaactag

SEQ ID NO: 12294 - protein, 782 aa, Phaeosphaeria nodorum
MSVNSRKRKVATKAAPVQSSSDEELADGLLDGILSHSEDESEDDQDAEDTDASSVIEGLSDEDFEDEEDSGDEAEEIRKQMRNLNTSGGSQQRKTRQPAHERLDDGADGELEGEEDESLKPNYTVTTDAHGQVRYLYKEIDPVYESDDSDAEATNTIGNIPLTYYDEYPHIGYDINGKKIMRPAKGEALDALLDSIDIPKGWTGLTDPQTGKPLNLSEEELDVLKRLTRNEVVEDGYDPYPEMVAYFSGKQEIMPLSAAPEPKRRFIPSKHEAKRVMKIVKAIREGRIKPYKAPEEREEDEQISYDVWADEKPRPEHSMHIPAPKLPPPGYEASYHPPPEYLPDKAEEEAWLQADEEDREKDFLPKNYEALRKVPGYETFVKERFERSLDLYLAPRVRRNRLNIDPESLLPKLPDPEDLKPFPTTCAAIFRGQEGRVRCVSVDPQGIFVASGGDDGYVRIWELLTGRQVWNAKLSDEEAVDAVQWRPTKDASVLAAASGEHVYLIVPFTLLSPDVEQSSRDVLDAGWGYATSKPSTAANGEAPKQSPGKWSRPGSRMENKGILVQIEVRSAVKIINWHRRGDYFATVSPRGQSTAVAIHTVSKHLTQLPFRRLKGIAQTAQFHPSKAIFFVATRNTIRSYDLAKQELVKILQPGAKWISSIDVHPGGDNIIVGTYDKRLLWHDLDLSNKPYKTLRFHKEAIRAVKFHQGGLPLFADASDDGSLQIFHGKVVDDLMENATIVPLKVLRGHKVKSRLGVMDLDWHPREPWCVSAGADGTLRLWN

SEQ ID NO: 12295 - DNA, 2352 bp, Aspergillus oryzae
  CDS (1)..(2352)
atggatgcctctaagtcttcaaagaaacgcaaggcggttactcgagatgttgaggaggaggctggtgtgttttctggggatgaattgcaggttgatgtcctagacggcgcactttcagataatgcaaacgacctatccagcgacgaggatgttagcgattcggaaatcgaactagtggatgattttagcgacgaggaagacggcgatgaagaggaagagctcgatagtgatgaaattccttcggatgggggagagtcctttaagaaggcgtctggcacaggaaacgctcgtgatgaaagctctagcgatgaagaacagttgaactaccgcattgaaaaggatgccaatggaaatgaccgttacgtctacgatgagataaacccagatgataactctgattattctgatgtcgaagaaaatgcgaacaccatcggcaacattcccttgtccttttacgatcaataccctcatatcggctacgatattaacggaaagaaaatcatgcgccctgccacaggggaagctcttgatgcgctgctcgatagcatcgaaattcccaagggctggactggtcttaccgatccctcgaccggtaaaccattggaattgagccaagatgagctggaattattgcgcaaggttcagatgaacgaaatacctgaagagggatacaatccctatgagcccacagtggaatggttcagtagcaaacaagagattatgcccttgagtgctgcccccgagccgaaacgtcggtttgtgccatcgaaacatgaagccaagcgggttatgaagatcgtcaaagcgatcagagaaggccgcattttaccttataagccccccacggaggaggaggataaggaacaggatgtagtcaactatgacttgtgggccgacgaaacggagcgaccagaccatcccatgcatatccctgctcctaaacttccaccacctggttacgaggaaagttaccatccaccccctgaatatttgcccgataaaaaggaacgaaaggcttgggaggaggctgaccctgaagaccgtgagcgggagtatcttccaaatgactttggctcacttcgaaaggttcctgggtacgaaagtttcgtcaaagagaagttcgagcgctgtttggacctttacttagcacccagagttcggagaagcaagttaaatattgatcctgaaagccttcttccgaagctccctagtcccgaggaattgaagccattcccgaccgcctgtgctacggtgtttagaggacataaggggcgtgttcgcaccctggccgttgacccatctggactctggcttgctactggcggtgacgatggaactgcgcgggtatgggagttacttaccggtcgccaattgtggagtgtgaagttaagtgaagaggacccagtgaacgttgtccgttggaggcctgggaaggacgctgtcattcttgcggctgcggcaggcgacgatatcttccttgcagtgccccctatcgcggatccgaaaattgagaagaccagtctggagatcattgacgcaggttggggatacgcagcgtcgaagcctcccccgagtgccgcagaggaaaacaagaagaacgttcctccacagtggattcgcccatcattatcgctcgcagaatccggggtgtgcgctgtcattcccctccgatatgtggttaagtctctctcatggcatcgtcgcggtgattactttgttactgtgtgccccggctcctcgaccccagcttctgtggccatatctattcacactctttccaaacatctaactcagttccccttccgccgacgtatcaaaggtggtgggccacctcaaaccgctcatttccatccctcgaaacctatccttttcgttgcgaatcaacgaacaattcgtgcttacgatctatcgcgccaactcctcgtcaagatcatccaacccggagctcgctggatctcttctttcgacattcacccaacgtcttccaccgcctccggaggggacaacctcatcgttggatcgtacgaccgccgtctactgtggcatgatcttgagctttctcagcgtccgtacaagacgttgcggtaccatcgcaaggctatccgctctgtccggtttcacccaagcggacgctatcctctattcgccgacgcaagtgatgatgggtccctccagattttccacggcagcgttacgggtgatatgctcagcaatgctagtattgtacctctcaaagtccttaagggtcacaagattaccggagaattgggtgtcttggatgttgactggcaccctcgggaagcttggtgtgtcagtgcaggcgcagacggaacttgtcggttgtggatgtga

SEQ ID NO: 12296 - protein, 783 aa, Aspergillus oryzae
MDASKSSKKRKAVTRDVEEEAGVFSGDELQVDVLDGALSDNANDLSSDEDVSDSEIELVDDFSDEEDGDEEEELDSDEIPSDGGESFKKASGTGNARDESSSDEEQLNYRIEKDANGNDRYVYDEINPDDNSDYSDVEENANTIGNIPLSFYDQYPHIGYDINGKKIMRPATGEALDALLDSIEIPKGWTGLTDPSTGKPLELSQDELELLRKVQMNEIPEEGYNPYEPTVEWFSSKQEIMPLSAAPEPKRRFVPSKHEAKRVMKIVKAIREGRILPYKPPTEEEDKEQDVVNYDLWADETERPDHPMHIPAPKLPPPGYEESYHPPPEYLPDKKERKAWEEADPEDREREYLPNDFGSLRKVPGYESFVKEKFERCLDLYLAPRVRRSKLNIDPESLLPKLPSPEELKPFPTACATVFRGHKGRVRTLAVDPSGLWLATGGDDGTARVWELLTGRQLWSVKLSEEDPVNVVRWRPGKDAVILAAAAGDDIFLAVPPIADPKIEKTSLEIIDAGWGYAASKPPPSAAEENKKNVPPQWIRPSLSLAESGVCAVIPLRYVVKSLSWHRRGDYFVTVCPGSSTPASVAISIHTLSKHLTQFPFRRRIKGGGPPQTAHFHPSKPILFVANQRTIRAYDLSRQLLVKIIQPGARWISSFDIHPTSSTASGGDNLIVGSYDRRLLWHDLELSQRPYKTLRYHRKAIRSVRFHPSGRYPLFADASDDGSLQIFHGSVTGDMLSNASIVPLKVLKGHKITGELGVLDVDWHPREAWCVSAGADGTCRLWM

SEQ ID NO: 12297 - DNA, 2169 bp, Cucumis melo
  CDS (1)..(2169)
atgaagttgaagcttgacaacaagagctcgcgaaaggcatgcaagctacagacaaagcatggtaaaaagaaaagccacgtcaatgaaagcaaaagtcaacccacaaagcagaatgatgttgaactagatttggaacaagaagctccaactctagatgaggatccagtacaacaacatttagattcttctccaccctccgattgtaacgaggataatgtcaatgcgggcgatgatcatcataatttagagaacgatgaggaccaagaaaatggtaatgacaaccccatacctgatcaagtagaggaggaaagtgattcatctgaggatgaggtagctcctaggaatacagttggagatgttcccttggaatggtatagagatgagaaacatatcggatatgacatatctggaaagaaaatattgaagaaagaaagagaagacagattacaatcatttttagcaagtgccgacgactcaaaaagttggcgcaaggtatatgatgaatataatgatgaggtaatagagttgtcgaaggaagaagtcaggcaactgcggagactgctcaaaggaaaggcgccacatgcagactttgatcctcatgcgccttatgttgattggtttaagtgggatgatgctaagcacccactgtcaaatgcacctgaaccaaagaggcgttttatccggtcaaaatgggaggccaagaaggttgttcgattagttcgggcaattcgaaatggacatattaagtttgacaagcccaaagaggagcaacagttctacgatttgtggggtgatgagtcgagcaccacagagaagacctcacatctgtcttacattcctgcaccaaaaccaaagttgccaggtcatgatgaatcatataatccttcactggaatatatccctactcaagaagaaataaactcatatcagttaatgtatgaagaagatcgaccaaagtttattcctaggaggtttacgtccatgagaagtgtacctgcctatgacaatgctcttaaggatgcatttgagcgttgtttggatctctatttgtgccctcgtgttcggaagaagcgtattaatattgatcctgaatctttgaaacctaagctgccaaaccggaaagatcttagaccttatccgactacatgctatcttgaatttagaggtcataaggatgcggtaatgtccatttcaactgaagccaatggtcaatggattgcctcaggttcattggatggaactgttcggatatgggaagttgaaacaggcagatgtcttaaagtgtgggagcttggggaacctgtgaagtatgtagcttggaatcctaagcctgatcttccgatattggctgctgctgcgggtgttgatgtattgcttttaaacactggtcttggggatggggaggttcaagcaaaaattaaggaagttctccatgttgacaaacttcctgcaacagaaaattctgataaaacgccagctgcgacctggcttcaagatgacaagactggggggattagattaaggcattttaagagtgtatctgcagttgaatggcaccgtaaaggagactacctttcaacacttgttttacgtgaatcaagagcagttcttattcatcagctctctaaaaagttaacacaaaaaattccattcaagttgcatgggcttcctgtttcatcagtttttcatcccactcaatctattctttttgtatcaacgaagaaggaggttcgtgtttataatttattgaagcaaaagctcctgaaaaaactgaaaactggactccgtgaagtttcttctattgctgtgcatccagctggtgacaatgttatcgtggggagcagagaaggaaagttatgttggtttgacatggatctttcatcagagccttacaaaattctccgctgccatccgaaagatatcacaaatgttgccttccatcgatcacgtccattatttgcatcttgctccgatgatggcaccgcatatgttttccatgggatggtttactccgatcttacgcagaatcctcttattacaccgttggaaatactaagaggacacaaaaatgttaatggaagaggagtaatggattgcaagtttcacccaatgcagccatggttattcactgctggtgccgattcagtgatcaaattgtactgccattga

SEQ ID NO: 12298 - protein, 722 aa, Cucumis melo
MKLKLDNKSSRKACKLQTKHGKKKSHVNESKSQPTKQNDVELDLEQEAPTLDEDPVQQHLDSSPPSDCNEDNVNAGDDHHNLENDEDQENGNDNPIPDQVEEESDSSEDEVAPRNTVGDVPLEWYRDEKHIGYDISGKKILKKEREDRLQSFLASADDSKSWRKVYDEYNDEVIELSKEEVRQLRRLLKGKAPHADFDPHAPYVDWFKWDDAKHPLSNAPEPKRRFIRSKWEAKKVVRLVRAIRNGHIKFDKPKEEQQFYDLWGDESSTTEKTSHLSYIPAPKPKLPGHDESYNPSLEYIPTQEEINSYQLMYEEDRPKFIPRRFTSMRSVPAYDNALKDAFERCLDLYLCPRVRKKRINIDPESLKPKLPNRKDLRPYPTTCYLEFRGHKDAVMSISTEANGQWIASGSLDGTVRIWEVETGRCLKVWELGEPVKYVAWNPKPDLPILAAAAGVDVLLLNTGLGDGEVQAKIKEVLHVDKLPATENSDKTPAATWLQDDKTGGIRLRHFKSVSAVEWHRKGDYLSTLVLRESRAVLIHQLSKKLTQKIPFKLHGLPVSSVFHPTQSILFVSTKKEVRVYNLLKQKLLKKLKTGLREVSSIAVHPAGDNVIVGSREGKLCWFDMDLSSEPYKILRCHPKDITNVAFHRSRPLFASCSDDGTAYVFHGMVYSDLTQNPLITPLEILRGHKNVNGRGVMDCKFHPMQPWLFTAGADSVIKLYCH

SEQ ID NO: 12299 - DNA, 26 bp, Artificial sequence
  primer
atgatggctaagaacaacaaaactac

SEQ ID NO: 12300 - DNA, 22 bp, Artificial sequence
  primer
ctaggtggtccataagcgagcc

SEQ ID NO: 12301 - protein, 727 aa, Artificial sequence
  consensus sequence
  Variant (2)..(7): Xaa in position 2 to 7 is any amino acid
  Variant (8)..(8): Xaa in position 8 is any or no amino acid
  Variant (10)..(15): Xaa in position 10 to 15 is any amino acid
  Variant (17)..(18): Xaa in position 17 to 18 is any amino acid
  Variant (20)..(24): Xaa in position 20 to 24 is any amino acid
  Variant (25)..(25): Xaa in position 25 is any or no amino acid
  Variant (28)..(28): Xaa in position 28 is any amino acid
  Variant (30)..(31): Xaa in position 30 to 31 is any amino acid
  Variant (33)..(35): Xaa in position 33 to 35 is any amino acid
  Variant (37)..(39): Xaa in position 37 to 39 is any amino acid
  Variant (46)..(47): Xaa in position 46 to 47 is any amino acid
  Variant (50)..(50): Xaa in position 50 is any amino acid
  Variant (52)..(52): Xaa in position 52 is any amino acid
  Variant (55)..(59): Xaa in position 55 to 59 is any amino acid
  Variant (60)..(60): Xaa in position 60 is any or no amino acid
  Variant (63)..(64): Xaa in position 63 to 64 is any amino acid
  Variant (66)..(73): Xaa in position 66 to 73 is any amino acid
  Variant (74)..(74): Xaa in position 74 is any or no amino acid
  Variant (77)..(79): Xaa in position 77 to 79 is any amino acid
  Variant (81)..(88): Xaa in position 81 to 88 is any amino acid
  Variant (90)..(92): Xaa in position 90 to 92 is any amino acid
  Variant (95)..(103): Xaa in position 95 to 103 is any amino acid
  Variant (105)..(111): Xaa in position 105 to 111 is any amino acid
  Variant (114)..(119): Xaa in position 114 to 119 is any amino acid
  Variant (121)..(127): Xaa in position 121 to 127 is any amino acid
  Variant (128)..(129): Xaa in position 128 to 129 is any or no amino acid
  Variant (132)..(134): Xaa in position 132 to 134 is any amino acid
  Variant (142)..(142): Xaa in position 142 is any amino acid
  Variant (146)..(146): Xaa in position 146 is any amino acid
  Variant (148)..(148): Xaa in position 148 is any amino acid
  Variant (150)..(152): Xaa in position 150 to 152 is any amino acid
  Variant (154)..(154): Xaa in position 154 is any amino acid
  Variant (156)..(156): Xaa in position 156 is any amino acid
  Variant (160)..(160): Xaa in position 160 is any amino acid
  Variant (164)..(174): Xaa in position 164 to 174 is any amino acid
  Variant (175)..(183): Xaa in position 175 to 183 is any or no amino acid
  Variant (185)..(186): Xaa in position 185 to 186 is any amino acid
  Variant (188)..(188): Xaa in position 188 is any amino acid
  Variant (190)..(195): Xaa in position 190 to 195 is any amino acid
  Variant (196)..(198): Xaa in position 196 to 198 is any or no amino acid
  Variant (200)..(204): Xaa in position 200 to 204 is any amino acid
  Variant (209)..(209): Xaa in position 209 is any amino acid
  Variant (212)..(214): Xaa in position 212 to 214 is any amino acid
  Variant (218)..(218): Xaa in position 218 is any amino acid
  Variant (221)..(221): Xaa in position 221 is any amino acid
  Variant (225)..(228): Xaa in position 225 to 228 is any amino acid
  Variant (230)..(232): Xaa in position 230 to 232 is any amino acid
  Variant (234)..(240): Xaa in position 234 to 240 is any amino acid
  Variant (242)..(242): Xaa in position 242 is any amino acid
  Variant (243)..(246): Xaa in position 243 to 246 is any or no amino acid
  Variant (248)..(252): Xaa in position 248 to 252 is any amino acid
  Variant (255)..(255): Xaa in position 255 is any amino acid
  Variant (258)..(258): Xaa in position 258 is any amino acid
  Variant (260)..(264): Xaa in position 260 to 264 is any amino acid
  Variant (266)..(266): Xaa in position 266 is any amino acid
  Variant (270)..(270): Xaa in position 270 is any amino acid
  Variant (279)..(279): Xaa in position 279 is any amino acid
  Variant (281)..(283): Xaa in position 281 to 283 is any amino acid
  Variant (288)..(288): Xaa in position 288 is any amino acid
  Variant (290)..(290): Xaa in position 290 is any amino acid
  Variant (293)..(293): Xaa in position 293 is any amino acid
  Variant (295)..(295): Xaa in position 295 is any amino acid
  Variant (298)..(298): Xaa in position 298 is any amino acid
  Variant (300)..(301): Xaa in position 300 to 301 is any amino acid
  Variant (303)..(303): Xaa in position 303 is any amino acid
  Variant (307)..(314): Xaa in position 307 to 314 is any amino acid
  Variant (316)..(320): Xaa in position 316 to 320 is any amino acid
  Variant (321)..(321): Xaa in position 321 is any or no amino acid
  Variant (323)..(327): Xaa in position 323 to 327 is any amino acid
  Variant (329)..(329): Xaa in position 329 is any amino acid
  Variant (331)..(331): Xaa in position 331 is any amino acid
  Variant (333)..(333): Xaa in position 333 is any amino acid
  Variant (335)..(335): Xaa in position 335 is any amino acid
  Variant (337)..(338): Xaa in position 337 to 338 is any amino acid
  Variant (341)..(342): Xaa in position 341 to 342 is any amino acid
  Variant (344)..(344): Xaa in position 344 is any amino acid
  Variant (346)..(348): Xaa in position 346 to 348 is any amino acid
  Variant (349)..(349): Xaa in position 349 is any or no amino acid
  Variant (352)..(357): Xaa in position 352 to 357 is any amino acid
  Variant (359)..(366): Xaa in position 359 to 366 is any amino acid
  Variant (367)..(374): Xaa in position 367 to 374 is any or no amino acid
  Variant (376)..(376): Xaa in position 376 is any amino acid
  Variant (378)..(382): Xaa in position 378 to 382 is any amino acid
  Variant (383)..(383): Xaa in position 383 is any or no amino acid
  Variant (385)..(429): Xaa in position 385 to 429 is any amino acid
  Variant (430)..(475): Xaa in position 430 to 475 is any or no amino acid
  Variant (477)..(478): Xaa in position 477 to 478 is any amino acid
  Variant (479)..(479): Xaa in position 479 is any or no amino acid
  Variant (481)..(484): Xaa in position 481 to 484 is any amino acid
  Variant (485)..(487): Xaa in position 485 to 487 is any or no amino acid
  Variant (489)..(498): Xaa in position 489 to 498 is any amino acid
  Variant (499)..(503): Xaa in position 499 to 503 is any or no amino acid
  Variant (505)..(507): Xaa in position 505 to 507 is any amino acid
  Variant (511)..(511): Xaa in position 511 is any amino acid
  Variant (515)..(516): Xaa in position 515 to 516 is any amino acid
  Variant (519)..(527): Xaa in position 519 to 527 is any amino acid
  Variant (528)..(531): Xaa in position 528 to 531 is any or no amino acid
  Variant (534)..(535): Xaa in position 534 to 535 is any amino acid
  Variant (539)..(540): Xaa in position 539 to 540 is any amino acid
  Variant (542)..(542): Xaa in position 542 is any amino acid
  Variant (543)..(543): Xaa in position 543 is any or no amino acid
  Variant (546)..(548): Xaa in position 546 to 548 is any amino acid
  Variant (549)..(552): Xaa in position 549 to 552 is any or no amino acid
  Variant (554)..(559): Xaa in position 554 to 559 is any amino acid
  Variant (563)..(564): Xaa in position 563 to 564 is any amino acid
  Variant (566)..(567): Xaa in position 566 to 567 is any amino acid
  Variant (570)..(571): Xaa in position 570 to 571 is any amino acid
  Variant (574)..(575): Xaa in position 574 to 575 is any amino acid
  Variant (577)..(577): Xaa in position 577 is any amino acid
  Variant (581)..(582): Xaa in position 581 to 582 is any amino acid
  Variant (583)..(583): Xaa in position 583 is any or no amino acid
  Variant (585)..(585): Xaa in position 585 is any amino acid
  Variant (587)..(587): Xaa in position 587 is any amino acid
  Variant (589)..(592): Xaa in position 589 to 592 is any amino acid
  Variant (594)..(595): Xaa in position 594 to 595 is any amino acid
  Variant (597)..(597): Xaa in position 597 is any amino acid
  Variant (599)..(600): Xaa in position 599 to 600 is any amino acid
  Variant (602)..(602): Xaa in position 602 is any amino acid
  Variant (605)..(605): Xaa in position 605 is any amino acid
  Variant (606)..(611): Xaa in position 606 to 611 is any or no amino acid
  Variant (615)..(615): Xaa in position 615 is any amino acid
  Variant (617)..(618): Xaa in position 617 to 618 is any amino acid
  Variant (620)..(620): Xaa in position 620 is any amino acid
  Variant (622)..(625): Xaa in position 622 to 625 is any amino acid
  Variant (627)..(627): Xaa in position 627 is any amino acid
  Variant (629)..(630): Xaa in position 629 to 630 is any amino acid
  Variant (633)..(634): Xaa in position 633 to 634 is any amino acid
  Variant (641)..(641): Xaa in position 641 is any amino acid
  Variant (643)..(644): Xaa in position 643 to 644 is any amino acid
  Variant (646)..(646): Xaa in position 646 is any amino acid
  Variant (648)..(651): Xaa in position 648 to 651 is any amino acid
  Variant (653)..(655): Xaa in position 653 to 655 is any amino acid
  Variant (656)..(657): Xaa in position 656 to 657 is any or no amino acid
  Variant (661)..(662): Xaa in position 661 to 662 is any amino acid
  Variant (668)..(671): Xaa in position 668 to 671 is any amino acid
  Variant (674)..(675): Xaa in position 674 to 675 is any amino acid
  Variant (677)..(678): Xaa in position 677 to 678 is any amino acid
  Variant (680)..(682): Xaa in position 680 to 682 is any amino acid
  Variant (684)..(686): Xaa in position 684 to 686 is any amino acid
  Variant (691)..(691): Xaa in position 691 is any amino acid
  Variant (693)..(693): Xaa in position 693 is any amino acid
  Variant (696)..(700): Xaa in position 696 to 700 is any amino acid
  Variant (701)..(701): Xaa in position 701 is any or no amino acid
  Variant (706)..(707): Xaa in position 706 to 707 is any amino acid
  Variant (711)..(713): Xaa in position 711 to 713 is any amino acid
  Variant (715)..(716): Xaa in position 715 to 716 is any amino acid
  Variant (722)..(725): Xaa in position 722 to 725 is any amino acid
GXXXXXXXEXXXXXXSXXSXXXXXXNTXGXXPXXXYXXXPHIGYDXXGKXIXRPXXXXXXLDXXLXXXXXXXXXWTXXXDXXXXXXXXLXXXELXXXXXXXXXEXXXXXXXPYXXXXXXFXXXXXXXXXPLXXXPEPKRRFXPSKXEXKXXXKXVXAIRXGRIXXXXXXXXXXXXXXXXXXXXYXXWXDXXXXXXXXXHXXXXXAPKLXPPXXXESYXPPXEYLXXXXEXXXWXXXXXXXRXXXXXPXXXXXLRXVPXYXXXXXEXFERXLDLYLAPRXRXXXLNIDXPXSLXPXLPXPXXLXPFPXXXXXXXXGXXXXXXRXXXXXPXGXWXAXGXXDGXXRXWXXXXGRXXXXXXLXXXXXXXXXXXXXXXXWXPXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXPXXXXXXXGXXXXXXXXXXXXXXXKXXXWHRXGDYXXTVXXXXXXXXXXXXXIHXXSKHXXQXXPFXXXXXXXGXXXXXXFHPXXPXXFVXXQRXXRXYDLXXXQXLXKXXXXGXXWXSXXDXHPXXXXXXXGDNXIXXSXDXXXXWXDXXLSXXPYKTLRXHXXAXRXXXXHXXXXXPLFXXASDDGXXXXFHXXVXXDXXXNXXXVPLKXLXGHXXXXXXGVLDXXWHPXXXWXXSAGADXXXXLW

SEQ ID NO: 12302 - protein, 34 aa, Artificial sequence
  protein pattern
  Variant (3)..(3): Xaa in position 3 is Ser or Thr
  Variant (4)..(4): Xaa in position 4 is Ala, Asn or Ser
  Variant (5)..(5): Xaa in position 5 is Ala or Val
  Variant (13)..(13): Xaa in position 13 is Ala, Ile or Val
  Variant (14)..(14): Xaa in position 14 is any amino acid
  Variant (17)..(17): Xaa in position 17 is any amino acid
  Variant (19)..(19): Xaa in position 19 is any amino acid
  Variant (21)..(21): Xaa in position 21 is Lys or Arg
  Variant (22)..(22): Xaa in position 22 is Ile or Val
  Variant (23)..(24): Xaa in position 23 to 24 is any amino acid
  Variant (25)..(25): Xaa in position 25 is Ile, Leu or Met
  Variant (26)..(26): Xaa in position 26 is Ala or Val
  Variant (27)..(27): Xaa in position 27 is any amino acid
  Variant (30)..(30): Xaa in position 30 is Lys or Arg
  Variant (31)..(31): Xaa in position 31 is any amino acid
  Variant (33)..(33): Xaa in position 33 is any amino acid
  Variant (34)..(34): Xaa in position 34 is Ile or Leu
PLXXXPEPKRRFXXSKXEXKXXXXXXXAIXXGXX

SEQ ID NO: 12303 - protein, 34 aa, Artificial sequence
  protein pattern
  Variant (3)..(3): Xaa in position 3 is any amino acid
  Variant (6)..(6): Xaa in position 6 is Ala or Gly
  Variant (8)..(8): Xaa in position 8 is any amino acid
  Variant (9)..(9): Xaa in position 9 is Asp, Glu, Asn, Ser or Thr
  Variant (10)..(10): Xaa in position 10 is any amino acid
  Variant (11)..(11): Xaa in position 11 is Ile, Leu or Val
  Variant (12)..(12): Xaa in position 12 is any amino acid
  Variant (14)..(14): Xaa in position 14 is Lys or Arg
  Variant (16)..(16): Xaa in position 16 is Asp or Glu
  Variant (18)..(18): Xaa in position 18 is Cys or Ser
  Variant (27)..(27): Xaa in position 27 is any amino acid
  Variant (29)..(29): Xaa in position 29 is His, Lys or Arg
  Variant (30)..(30): Xaa in position 30 is Asn, Ser, Thr or Val
  Variant (31)..(31): Xaa in position 31 is Lys or Arg
LRXVPXYXXXXXEXFXRXLDLYLAPRXRXXXLNI

SEQ ID NO: 12304 - protein, 41 aa, Artificial sequence
  protein pattern
  Variant (3)..(3): Xaa in position 3 is any amino acid
  Variant (4)..(4): Xaa in position 4 is Leu or Val
  Variant (5)..(5): Xaa in position 5 is Ile, Leu or Met
  Variant (6)..(6): Xaa in position 6 is Ala, Ile, Leu or Val
  Variant (7)..(7): Xaa in position 7 is Gly or Ser
  Variant (9)..(9): Xaa in position 9 is Phe or Tyr
  Variant (11)..(12): Xaa in position 11 to 12 is any amino acid
  Variant (13)..(13): Xaa in position 13 is any or no amino acid
  Variant (15)..(15): Xaa in position 15 is any or no amino acid
  Variant (17)..(17): Xaa in position 17 is Phe or His
  Variant (19)..(19): Xaa in position 19 is Leu or Met
  Variant (20)..(20): Xaa in position 20 is Asp, Glu or Asn
  Variant (21)..(21): Xaa in position 21 is Phe or Leu
  Variant (22)..(22): Xaa in position 22 is Ala or Ser
  Variant (23)..(23): Xaa in position 23 is Ala, Asp, Gln, Ser or Thr
  Variant (24)..(24): Xaa in position 24 is any amino acid
  Variant (28)..(28): Xaa in position 28 is Asn, Thr or Val
  Variant (29)..(29): Xaa in position 29 is Leu or Met
  Variant (30)..(30): Xaa in position 30 is Lys or Arg
  Variant (31)..(31): Xaa in position 31 is Phe or Tyr
  Variant (33)..(34): Xaa in position 33 to 34 is any amino acid
  Variant (36)..(36): Xaa in position 36 is Ile, Leu or Val
  Variant (38)..(40): Xaa in position 38 to 40 is any amino acid
  Variant (41)..(41): Xaa in position 41 is Phe or Tyr
GDXXXXXSXDXXXLXWXDXXXXXXPYKXXXXHXXAXRXXXX

SEQ ID NO: 12305 - protein, 40 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is any or no amino acid
  Variant (11)..(11): Xaa in position 11 is any amino acid
  Variant (12)..(12): Xaa in position 12 is Ile, Leu or Val
  Variant (13)..(13): Xaa in position 13 is any amino acid
  Variant (14)..(14): Xaa in position 14 is Ile or Val
  Variant (17)..(17): Xaa in position 17 is Ala, Cys or Gly
  Variant (18)..(18): Xaa in position 18 is any amino acid
  Variant (20)..(20): Xaa in position 20 is any amino acid
  Variant (21)..(21): Xaa in position 21 is Asp, Gly, Ser or Thr
  Variant (23)..(24): Xaa in position 23 to 24 is Leu or Met
  Variant (25)..(25): Xaa in position 25 is any amino acid
  Variant (27)..(27): Xaa in position 27 is Ala or Pro
  Variant (28)..(28): Xaa in position 28 is any amino acid
  Variant (29)..(29): Xaa in position 29 is Ile or Leu
  Variant (32)..(32): Xaa in position 32 is Leu or Val
  Variant (34)..(34): Xaa in position 34 is any amino acid
  Variant (36)..(36): Xaa in position 36 is any amino acid
  Variant (37)..(37): Xaa in position 37 is Gly or Asn
  Variant (39)..(39): Xaa in position 39 is Asp, Lys or Arg
  Variant (40)..(40): Xaa in position 40 is Ile or Val
FXXXSXXDDGXXXXFHXXVXXDXXXNXXXVPXKXLXXHXX

SEQ ID NO: 12306 - protein, 29 aa, Artificial sequence
  protein pattern
  Variant (2)..(2): Xaa in position 2 is any or no amino acid
  Variant (4)..(6): Xaa in position 4 to 6 is any or no amino acid
  Variant (8)..(8): Xaa in position 8 is Ile, Leu or Met
  Variant (9)..(9): Xaa in position 9 is Glu, Ser or Thr
  Variant (10)..(10): Xaa in position 10 is any amino acid
  Variant (12)..(12): Xaa in position 12 is Asp or Glu
  Variant (13)..(13): Xaa in position 13 is Ala, Asp, Glu, Gln or Ser
  Variant (14)..(14): Xaa in position 14 is any amino acid
  Variant (17)..(17): Xaa in position 17 is Ile or Val
  Variant (20)..(20): Xaa in position 20 is Asp or Thr
  Variant (21)..(21): Xaa in position 21 is Ile or Val
  Variant (22)..(22): Xaa in position 22 is Asp or Asn
  Variant (24)..(25): Xaa in position 24 to 25 is Lys or Arg
  Variant (26)..(26): Xaa in position 26 is Ile, Leu or Val
  Variant (27)..(27): Xaa in position 27 is Phe, Leu or Met
  Variant (28)..(28): Xaa in position 28 is Lys or Arg
NXIXXXPXXXYXXXPHXGYXXXGXXXXXP

SEQ ID NO: 12307 - protein, 25 aa, Artificial sequence
  protein pattern
  Variant (2)..(2): Xaa in position 2 is Leu or Met
  Variant (4)..(5): Xaa in position 4 to 5 is any amino acid
  Variant (6)..(6): Xaa in position 6 is Phe or Trp
  Variant (7)..(7): Xaa in position 7 is any amino acid
  Variant (9)..(10): Xaa in position 9 to 10 is any amino acid
  Variant (11)..(11): Xaa in position 11 is Ala or Pro
  Variant (13)..(13): Xaa in position 13 is any amino acid
  Variant (14)..(14): Xaa in position 14 is Phe, Ile, Leu or Val
  Variant (15)..(15): Xaa in position 15 is Ser or Thr
  Variant (16)..(16): Xaa in position 16 is Ala or Ser
  Variant (20)..(23): Xaa in position 20 to 23 is any amino acid
  Variant (24)..(24): Xaa in position 24 is Leu or Met
  Variant (25)..(25): Xaa in position 25 is Trp or Tyr
VXDXXXXPXXXWXXXXGADXXXXXX

SEQ ID NO: 12308 - protein, 30 aa, Artificial sequence
  protein pattern
  Variant (4)..(5): Xaa in position 4 to 5 is any amino acid
  Variant (6)..(6): Xaa in position 6 is Ala, Pro or Ser
  Variant (7)..(7): Xaa in position 7 is any amino acid
  Variant (8)..(8): Xaa in position 8 is Phe, Ile or Leu
  Variant (9)..(9): Xaa in position 9 is any amino acid
  Variant (11)..(12): Xaa in position 11 to 12 is any amino acid
  Variant (13)..(13): Xaa in position 13 is any or no amino acid
  Variant (15)..(18): Xaa in position 15 to 18 is any amino acid
  Variant (19)..(19): Xaa in position 19 is any or no amino acid
  Variant (21)..(21): Xaa in position 21 is Asp or Asn
  Variant (23)..(28): Xaa in position 23 to 28 is any amino acid
  Variant (29)..(29): Xaa in position 29 is any or no amino acid
FHPXXXXXXVXXXRXXXXXYXLXXXXXXXK

SEQ ID NO: 12309 - protein, 31 aa, Artificial sequence
  protein pattern
  Variant (2)..(2): Xaa in position 2 is Ala, Cys, Ser or Thr
  Variant (3)..(3): Xaa in position 3 is any amino acid
  Variant (4)..(4): Xaa in position 4 is Ala or Ser
  Variant (5)..(6): Xaa in position 5 to 6 is any amino acid
  Variant (7)..(7): Xaa in position 7 is Pro or Val
  Variant (8)..(8): Xaa in position 8 is Asp, Gln, Ser or Thr
  Variant (10)..(10): Xaa in position 10 is any amino acid
  Variant (11)..(11): Xaa in position 11 is Phe or Trp
  Variant (12)..(12): Xaa in position 12 is Ile, Leu or Val
  Variant (14)..(14): Xaa in position 14 is Ser or Thr
  Variant (16)..(16): Xaa in position 16 is any amino acid
  Variant (17)..(17): Xaa in position 17 is any or no amino acid
  Variant (19)..(19): Xaa in position 19 is any or no amino acid
  Variant (21)..(21): Xaa in position 21 is any amino acid
  Variant (22)..(22): Xaa in position 22 is Ala, Leu or Val
  Variant (24)..(24): Xaa in position 24 is Ile or Val
  Variant (26)..(26): Xaa in position 26 is any amino acid
  Variant (27)..(27): Xaa in position 27 is Ile, Leu or Val
  Variant (28)..(28): Xaa in position 28 is any amino acid
  Variant (29)..(29): Xaa in position 29 is Gly, Asn, Pro or Thr
  Variant (30)..(30): Xaa in position 30 is any amino acid
  Variant (31)..(31): Xaa in position 31 is Gln or Arg
RXXXXXXXGXXXAXGXXDXGXXRXWXXXXXX

SEQ ID NO: 12310 - protein, 57 aa, Artificial sequence
  protein pattern
  Variant (2)..(9): Xaa in position 2 to 9 is any amino acid
  Variant (10)..(10): Xaa in position 10 is any or no amino acid
  Variant (13)..(13): Xaa in position 13 is Gly or Ser
  Variant (14)..(14): Xaa in position 14 is Ala, Ile or Leu
  Variant (15)..(15): Xaa in position 15 is any amino acid
  Variant (17)..(19): Xaa in position 17 to 19 is any amino acid
  Variant (20)..(20): Xaa in position 20 is Gly or Gln
  Variant (21)..(21): Xaa in position 21 is any amino acid
  Variant (22)..(22): Xaa in position 22 is Gly, Asn, Pro or Ser
  Variant (23)..(23): Xaa in position 23 is Leu or Val
  Variant (24)..(24): Xaa in position 24 is any amino acid
  Variant (25)..(25): Xaa in position 25 is Ile or Leu
  Variant (26)..(26): Xaa in position 26 is Ser or Thr
  Variant (27)..(27): Xaa in position 27 is any amino acid
  Variant (28)..(28): Xaa in position 28 is Asp, Glu or Lys
  Variant (29)..(29): Xaa in position 29 is Glu or Gln
  Variant (31)..(31): Xaa in position 31 is Asp, Glu or Gly
  Variant (32)..(32): Xaa in position 32 is Ile, Leu or Val
  Variant (33)..(33): Xaa in position 33 is Ile or Leu
  Variant (34)..(34): Xaa in position 34 is any amino acid
  Variant (35)..(35): Xaa in position 35 is Lys or Arg
  Variant (36)..(36): Xaa in position 36 is Ile, Leu or Val
  Variant (37)..(37): Xaa in position 37 is Ala, Glu, Gln or Thr
  Variant (38)..(38): Xaa in position 38 is any amino acid
  Variant (39)..(39): Xaa in position 39 is Ala, Asn, Gln or Ser
  Variant (40)..(40): Xaa in position 40 is Glu or Gln
  Variant (41)..(41): Xaa in position 41 is any amino acid
  Variant (42)..(42): Xaa in position 42 is Pro, Thr or Val
  Variant (43)..(43): Xaa in position 43 is Asp, Glu or Asn
  Variant (44)..(44): Xaa in position 44 is Ala, Asp or Glu
  Variant (45)..(45): Xaa in position 45 is Ala, Asp, Glu, Gly, Asn or Ser
  Variant (46)..(46): Xaa in position 46 is any amino acid
  Variant (47)..(47): Xaa in position 47 is Asp or Asn
  Variant (50)..(50): Xaa in position 50 is Glu, Pro or Gln
  Variant (51)..(51): Xaa in position 51 is Asp, Glu or Pro
  Variant (52)..(54): Xaa in position 52 to 54 is any amino acid
  Variant (55)..(55): Xaa in position 55 is Phe, Trp or Tyr
  Variant (57)..(57): Xaa in position 57 is Ser or Thr
LXXXXXXXXXWTXXXDXXXXXXXXXXXXXLXXXXXXXXXXXXXXXXXPYXXXXXXFX

SEQ ID NO: 12311 - protein, 38 aa, Artificial sequence
  protein pattern
  Variant (2)..(7): Xaa in position 2 to 7 is any or no amino acid
  Variant (9)..(11): Xaa in position 9 to 11 is any amino acid
  Variant (12)..(12): Xaa in position 12 is Ile, Leu, Met or Val
  Variant (13)..(13): Xaa in position 13 is any amino acid
  Variant (14)..(14): Xaa in position 14 is Ala or Pro
  Variant (16)..(16): Xaa in position 16 is any amino acid
  Variant (17)..(17): Xaa in position 17 is Leu or Met
  Variant (18)..(18): Xaa in position 18 is any amino acid
  Variant (19)..(19): Xaa in position 19 is Leu or Pro
  Variant (21)..(22): Xaa in position 21 to 22 is any amino acid
  Variant (23)..(23): Xaa in position 23 is Ala, Asp or Glu
  Variant (24)..(24): Xaa in position 24 is any amino acid
  Variant (27)..(27): Xaa in position 27 is any amino acid
  Variant (29)..(29): Xaa in position 29 is Pro or Ser
  Variant (30)..(30): Xaa in position 30 is any amino acid
  Variant (33)..(33): Xaa in position 33 is Ile or Leu
  Variant (34)..(34): Xaa in position 34 is any amino acid
  Variant (35)..(35): Xaa in position 35 is Asp, Ser or Thr
  Variant (36)..(37): Xaa in position 36 to 37 is any amino acid
DXXXXXXHXXXXXXPXXXXPXXXXSYXPXXEYXXXXXE

SEQ ID NO: 12312 - protein, 25 aa, Artificial sequence
  protein pattern
  Variant (2)..(2): Xaa in position 2 is any amino acid
  Variant (5)..(5): Xaa in position 5 is Ile or Leu
  Variant (7)..(7): Xaa in position 7 is Asp, Glu or Lys
  Variant (10)..(10): Xaa in position 10 is any amino acid
  Variant (11)..(11): Xaa in position 11 is Pro or Thr
  Variant (12)..(12): Xaa in position 12 is any amino acid
  Variant (13)..(13): Xaa in position 13 is Asp or Glu
  Variant (15)..(15): Xaa in position 15 is any amino acid
  Variant (19)..(20): Xaa in position 19 to 20 is any amino acid
  Variant (21)..(21): Xaa in position 21 is Cys, Asn or Ser
  Variant (22)..(22): Xaa in position 22 is Ala, Gln, Ser or Thr
  Variant (23)..(23): Xaa in position 23 is Ala, Asn, Thr or Val
  Variant (24)..(24): Xaa in position 24 is any amino acid
  Variant (25)..(25): Xaa in position 25 is Phe or Tyr
PXSLXPXLPXXXXLXPFPXXXXXXX

SEQ ID NO: 12313 - protein, 10 aa, Artificial sequence
  protein pattern
  Variant (4)..(4): Xaa in position 4 is Lys or Arg
  Variant (8)..(8): Xaa in position 8 is Phe or Leu
  Variant (9)..(9): Xaa in position 9 is Ala, Ser or Val
WHRXGDYXXT

SEQ ID NO: 12314 - protein, 14 aa, Artificial sequence
  protein pattern
  Variant (2)..(2): Xaa in position 2 is Ala or Leu
  Variant (4)..(5): Xaa in position 4 to 5 is any or no amino acid
  Variant (7)..(7): Xaa in position 7 is Ala, Gln or Thr
  Variant (8)..(8): Xaa in position 8 is Ile, Leu or Val
  Variant (10)..(10): Xaa in position 10 is Lys or Arg
  Variant (11)..(12): Xaa in position 11 to 12 is any amino acid
  Variant (13)..(13): Xaa in position 13 is Ser or Thr
VXIXXHXXSXXXXQ

SEQ ID NO: 12315 - protein, 12 aa, Artificial sequence
  protein pattern
  Variant (2)..(2): Xaa in position 2 is any amino acid
  Variant (3)..(3): Xaa in position 3 is Lys or Arg
  Variant (5)..(5): Xaa in position 5 is Ile, Leu or Val
  Variant (7)..(7): Xaa in position 7 is any amino acid
  Variant (8)..(8): Xaa in position 8 is Phe, Ile, Leu or Met
  Variant (9)..(9): Xaa in position 9 is Asp or Ser
  Variant (10)..(10): Xaa in position 10 is Ile or Val
  Variant (12)..(12): Xaa in position 12 is Pro or Ser
GXXWXSXXXXHX

SEQ ID NO: 12316 - DNA, 615 bp, Saccharomyces cerevisiae
  CDS (1)..(615)
atgaatagcggtggtagtgatagtttcgattatcttcttcaattaacaaaagctttaagtgcagagtgtcgggctaacagacaagagaccgatcgaatagaactattgttaaagcgccttgccaaacagtcaggaatatcttatgataatttgagcaaaaacataattccagattcatggaaagataatgcatctcaaaaagcatctccccccactgaggcacagaagcttatcagcgaaaattttaaactcatatacgagattgaaaaacaagagtacttcaatacaaaggctgttgcgctaattaacaacataaatgagcatttctcatatattaaaaattttatcgacgaacagaatgcaataagagaacgaaatattgccacattttcatcagagaagcttgatgaaaggaacaaaagtcttcaacaaaattacgagtcattgaagacagaaaatgaagaaacaaaaaaaaaattgcattcaattatcaaacagtttgaaaaacttttgaaggaagtggattgggatcgtatatctaaagattccagagattacagccgctttaaaaaacagttggaatacctgcaagacacgtaccaggtactgaaatag

SEQ ID NO: 12317 - protein, 204 aa, Saccharomyces cerevisiae
MNSGGSDSFDYLLQLTKALSAECRANRQETDRIELLLKRLAKQSGISYDNLSKNIIPDSWKDNASQKASPPTEAQKLISENFKLIYEIEKQEYFNTKAVALINNINEHFSYIKNFIDEQNAIRERNIATFSSEKLDERNKSLQQNYESLKTENEETKKKLHSIIKQFEKLLKEVDWDRISKDSRDYSRFKKQLEYLQDTYQVLK

SEQ ID NO: 12318 - DNA, 609 bp, Candida glabrata CBS 138
  CDS (1)..(609)
atgaacgaaggaagctatgataacttcgaatacttgaacttgctggcgaagaacctgagcgttggttgccgagatagcaggaaagagacagataaaatagaactgttattgaaacggttatctaaacaatctgtagtttcatatgaagagttcagccaaagacctagtgaagagaccctagatgcgtataaaaaattatcagaacccaccacaacagagcagttgataagagagaattaccaattgatgtatgaaattgagcaacaggagtacatcaataagagaatcatcgctcttgtaaatagcataaatgagcatctaatatccatcagaaacttcatcatagagcagaaactggctagagatcaaaataacgagatatacatgcatgagaacttcacagtacgagaaaacctactcaagaatagtacagaactactgaaagctagggaacaatgctctcgaaccaatacagaggtggtggtggagaaattcaaaaagctatatgctgagatagattgggatacactacctagtaatctacctgatatcatacaggtgaaggagaaaatcaaacatatcaaggaaacgtataaacttgatttatag

SEQ ID NO: 12319 - protein, 202 aa, Candida glabrata CBS 138
MNEGSYDNFEYLNLLAKNLSVGCRDSRKETDKIELLLKRLSKQSVVSYEEFSQRPSEETLDAYKKLSEPTTTEQLIRENYQLMYEIEQQEYINKRIIALVNSINEHLISIRNFIIEQKLARDQNNEIYMHENFTVRENLLKNSTELLKAREQCSRTNTEVVVEKFKKLYAEIDWDTLPSNLPDIIQVKEKIKHIKETYKLDL

SEQ ID NO: 12320 - DNA, 630 bp, Kluyveromyces lactis NRRL Y-1140
  CDS (1)..(630)
atggagggatctggagacagttttgagtaccttcttcagttgatgaagactttgagctctcaggcttgggcaacgagacaacagacagaaaaagtggagcagtcattgaagaggctagcgaagcagaatcagataagttacaacgaatattcgaaatctcctaatgatgaaacgctaggacaagtcaatactttaaagcaaaaaactaaggaagaagaactggtcgaagaaaactatcggttaatgtaccagatcgaacatcaagaatacattcactcgaagatatatctgcttatccaacaaatagacgagatgatagtatcaatgcgtaactttatcgtagaatataaaacatcagcgccacagaaacaacaagaattcataacaaaaagtgttacagcaccaatgtcacgactcaagtatagcgagaaacaactaaatgatggccacattaatgccgaaaagcaattaaaaatattgatgggagaattgacggatctattcaatagagtaccatggcataaggtaccgaatgataacctaaactatctacggcttaaaaatgtgatcggagattttgaagataaatatcaaacaaagattgttccggaatcaattgcattgaaatga

SEQ ID NO: 12321 - protein, 209 aa, Kluyveromyces lactis NRRL Y-1140
MEGSGDSFEYLLQLMKTLSSQAWATRQQTEKVEQSLKRLAKQNQISYNEYSKSPNDETLGQVNTLKQKTKEEELVEENYRLMYQIEHQEYIHSKIYLLIQQIDEMIVSMRNFIVEYKTSAPQKQQEFITKSVTAPMSRLKYSEKQLNDGHINAEKQLKILMGELTDLFNRVPWHKVPNDNLNYLRLKNVIGDFEDKYQTKIVPESIALK

SEQ ID NO: 12322 - DNA, 25 bp, Artificial sequence
  primer
atgaatagcggtggtagtgatagtt

SEQ ID NO: 12323 - DNA, 24 bp, Artificial sequence
  primer
ctatttcagtacctggtacgtgtc

SEQ ID NO: 12324 - protein, 197 aa, Artificial sequence
  consensus sequence
  Variant (2)..(3): Xaa in position 2 to 3 is any amino acid
  Variant (5)..(5): Xaa in position 5 is any amino acid
  Variant (7)..(7): Xaa in position 7 is any amino acid
  Variant (10)..(11): Xaa in position 10 to 11 is any amino acid
  Variant (13)..(13): Xaa in position 13 is any amino acid
  Variant (15)..(15): Xaa in position 15 is any amino acid
  Variant (18)..(23): Xaa in position 18 to 23 is any amino acid
  Variant (25)..(26): Xaa in position 25 to 26 is any amino acid
  Variant (28)..(30): Xaa in position 28 to 30 is any amino acid
  Variant (32)..(33): Xaa in position 32 to 33 is any amino acid
  Variant (38)..(38): Xaa in position 38 is any amino acid
  Variant (41)..(43): Xaa in position 41 to 43 is any amino acid
  Variant (46)..(48): Xaa in position 46 to 48 is any amino acid
  Variant (50)..(51): Xaa in position 50 to 51 is any amino acid
  Variant (52)..(53): Xaa in position 52 to 53 is any or no amino acid
  Variant (55)..(68): Xaa in position 55 to 68 is any amino acid
  Variant (70)..(73): Xaa in position 70 to 73 is any amino acid
  Variant (75)..(76): Xaa in position 75 to 76 is any amino acid
  Variant (79)..(80): Xaa in position 79 to 80 is any amino acid
  Variant (82)..(82): Xaa in position 82 is any amino acid
  Variant (84)..(84): Xaa in position 84 is any amino acid
  Variant (87)..(87): Xaa in position 87 is any amino acid
  Variant (91)..(97): Xaa in position 91 to 97 is any amino acid
  Variant (99)..(101): Xaa in position 99 to 101 is any amino acid
  Variant (103)..(103): Xaa in position 103 is any amino acid
  Variant (105)..(110): Xaa in position 105 to 110 is any amino acid
  Variant (114)..(114): Xaa in position 114 is any amino acid
  Variant (116)..(138): Xaa in position 116 to 138 is any amino acid
  Variant (140)..(145): Xaa in position 140 to 145 is any amino acid
  Variant (147)..(166): Xaa in position 147 to 166 is any amino acid
  Variant (168)..(172): Xaa in position 168 to 172 is any amino acid
  Variant (174)..(186): Xaa in position 174 to 186 is any amino acid
  Variant (188)..(196): Xaa in position 188 to 196 is any amino acid
GXXDXFXYLXXLXKXLSXXXXXXRXXTXXXEXXLKRLXKQXXXSYXXXSXXXXPXXXXXXXXXXXXXXTXXXXLXXENXXLXYXIEXQEYXXXXXXXLXXXIXEXXXXXXNFIXEXXXXXXXXXXXXXXXXXXXXXXXLXXXXXXLXXXXXXXXXXXXXXXXXXXXLXXXXXWXXXXXXXXXXXXXKXXXXXXXXXY

SEQ ID NO: 12325 - protein, 46 aa, Artificial sequence
  protein pattern
  Variant (3)..(3): Xaa in position 3 is any or no amino acid
  Variant (5)..(5): Xaa in position 5 is Asn or Ser
  Variant (7)..(7): Xaa in position 7 is Asp or Glu
  Variant (10)..(10): Xaa in position 10 is any or no amino acid
  Variant (12)..(12): Xaa in position 12 is any or no amino acid
  Variant (14)..(14): Xaa in position 14 is any amino acid
  Variant (16)..(16): Xaa in position 16 is Ala, Asn or Thr
  Variant (19)..(19): Xaa in position 19 is Ala, Ser or Val
  Variant (20)..(20): Xaa in position 20 is Glu, Gly or Gln
  Variant (21)..(21): Xaa in position 21 is Ala or Cys
  Variant (22)..(22): Xaa in position 22 is any amino acid
  Variant (23)..(23): Xaa in position 23 is Ala or Asp
  Variant (24)..(24): Xaa in position 24 is Asn, Ser or Thr
  Variant (26)..(26): Xaa in position 26 is any amino acid
  Variant (27)..(27): Xaa in position 27 is Glu or Gln
  Variant (29)..(29): Xaa in position 29 is Asp or Glu
  Variant (30)..(30): Xaa in position 30 is Lys or Arg
  Variant (31)..(31): Xaa in position 31 is Ile or Val
  Variant (33)..(34): Xaa in position 33 to 34 is any amino acid
  Variant (39)..(39): Xaa in position 39 is Ala or Ser
  Variant (42)..(42): Xaa in position 42 is Asn or Ser
  Variant (43)..(43): Xaa in position 43 is any amino acid
  Variant (44)..(44): Xaa in position 44 is Ile or Val
GSXDXFXYLXLXLXKXLSXXXXXXRXXTXXXEXXLKRLXKQXXXSY

SEQ ID NO: 12326 - protein, 46 aa, Artificial sequence
  protein pattern
  Variant (2)..(2): Xaa in position 2 is any or no amino acid
  Variant (4)..(4): Xaa in position 4 is any amino acid
  Variant (5)..(6): Xaa in position 5 to 6 is any or no amino acid
  Variant (8)..(8): Xaa in position 8 is Ile or Val
  Variant (9)..(9): Xaa in position 9 is Glu, Arg or Ser
  Variant (12)..(12): Xaa in position 12 is Phe or Tyr
  Variant (13)..(13): Xaa in position 13 is any amino acid
  Variant (15)..(15): Xaa in position 15 is Ile or Met
  Variant (17)..(17): Xaa in position 17 is Glu or Gln
  Variant (20)..(20): Xaa in position 20 is any amino acid
  Variant (24)..(24): Xaa in position 24 is Phe or Ile
  Variant (25)..(26): Xaa in position 25 to 26 is any amino acid
  Variant (27)..(27): Xaa in position 27 is Lys or Arg
  Variant (28)..(28): Xaa in position 28 is Ala or Ile
  Variant (29)..(29): Xaa in position 29 is any amino acid
  Variant (30)..(30): Xaa in position 30 is Ala or Leu
  Variant (32)..(32): Xaa in position 32 is Ile or Val
  Variant (33)..(33): Xaa in position 33 is Asn or Gln
  Variant (34)..(34): Xaa in position 34 is Asn, Gln or Ser
  Variant (36)..(36): Xaa in position 36 is Asp or Asn
  Variant (38)..(38): Xaa in position 38 is any amino acid
  Variant (39)..(39): Xaa in position 39 is Phe, Ile or Leu
  Variant (40)..(41): Xaa in position 40 to 41 is any amino acid
  Variant (42)..(42): Xaa in position 42 is Ile or Met
  Variant (43)..(43): Xaa in position 43 is Lys or Arg
TXEXXXLXXENXXLXYXIEXQEYXXXXXXXLXXXIXEXXXXXXNFI

SEQ ID NO: 12327 - DNA, 357 bp, Saccharomyces cerevisiae
  CDS (1)..(357)
atgactatcgctgaaataactataagacaaaagttctcttacccctttttatttggcaatgttttaggtcatccgtggccaagaaatgtgccaaggaaggaaattaaaatgcttttatttcgaaccgcaaataatagtttccccggatttttacttatttttacgagaaagcgaaggaacttaccaaaacaacgtgacaacgaaattccccgcacacgcgcattagaaacatatctacgggttttctctgccgctagaaaacagcgcgaggcagatgccaccgcctcgttctggcggctcgtaacatctgcttcgagaagccattaccatatgtggcccatcaagcggattatctag

SEQ ID NO: 12328 - protein, 118 aa, Saccharomyces cerevisiae
MTIAEITIRQKFSYPFLFGNVLGHPWPRNVPRKEIKMLLFRTANNSFPGFLLIFTRKRRNLPKQRDNEIPRTRALETYLRVFSAARKQREADATASFWRLVTSASRSHYHMWPIKRII

SEQ ID NO: 12329 - DNA, 26 bp, Artificial sequence
  primer
atgactatcgctgaaataactataag

SEQ ID NO: 12330 - DNA, 23 bp, Artificial sequence
  primer
ctagataatccgcttgatgggcc

SEQ ID NO: 12331 - DNA, 2577 bp, Saccharomyces cerevisiae
  CDS (1)..(2577)
atgattttaccgttagacttcgatgaagatgaaaattaccgtgattttaggcctcgcatgcctaaaagacagagaatcccacctgttgtacaactgtgtaaagaaatgatgcccgatattcgcactattggtgaatctgttaaagcttttgaagatgatatcaaattcttgagtgaagctataatgaatgagtatggccatgaggactactttaataatgctttactgagcactttaaacgctgttgttgtggagcaaccacagaagcaagctgctatcgctctcttaaccatggttgttaattcgaaaaataatgttgccggaaagagtattatcaattacttcttcgaagaattacaaaaatggtgcaagcaaacatataatgatgaattcaagagtacgtcaaatgaaactgggccatggaacaagatcaagttaatcctgagatttttatccattctatcgcccatgtttttagttgatgaactaatcaatatctacaagagcttatttgaattgagtatcgaattaaacaatctggatccaggtaacagagttcctttatctgaagcaatttacaccaatacattattaaatatcccgtatttgttcttttttaataggaataatgacggtttgaggacaaaagtggaggagttacttgcatacgttgaacaaaactatctagttaaaacaacggatataaacctattaagagaatacaatggtgaacctccatatgaaatggtagaacttgtccgagtcgtattaccaaacgtcaagaaggcgctaatcaataacttggaacagctgaatgaattatttcctgattggaatcatttattaactccccaaaccggtgatgaagggttcaatgacgctttaacccttccatcagtagatgatctaaagtctttcgtgcgcttgaataaaaactttggttcagttgatagcatgtggaagacaccaaggtatgcttttcatgtttacttgccaaactccgctggtaatttcgaaacagttgtaccaatcagcacttatgctggtcaattattcaacgatatcattattgatctggtggaaagtttagaattcaatagaaaggaagtagctagacaagtgataactttggatctttttttcaaagcaggtatatttacagaacctggtgaatctattgcccaattaattgccacttatgaagagaacccattggctcctacatttaagatagaagatttggctattgaaaccattttgggacttatttttaaattacctagtgtttcccagccttttgcatacttttacactttattggtggatatttgtcaaaattctccaaaagcaattgctcctgtctttggtagagcctttaggtttttttatagtcatttggattcattagattttgaactaaaattaagatatttggactggttttcaattcaaatgagcaactttaatttttcttggaagtggaatgaatgggaagacgattcgatcaaatttggcaagtatttttataatccaaaggtaaattttgctaaaaatttgattcaaaaagaactacgattgacctctaacttttcagaagtagaggacagcctaccacaagaattcacgaaatatttggatacttcttacattccaagagatcaactgattaactactatcaatcattattcaccggttatacggtagaagaagattccgttagaaaaaatgatctatattttagacaagaaggtgtacctatggaaaacacagtccgtaaaattttagattatacccacaaagcaaacaattctagggaagttactgaattagaaagtattctaggtgagttaaagaatgagtatggttccataatttccgactttaacagatttgttatcatattgttagtccaggccgttacagactctggtagtagatctttatcacatgctaataaatatattaatgatttaaaagaagatctcaaaaccatatttgcgaagattgaattggatatcgagacaaaagagtatatcataattgaagccgtcctaacattttggaacgccaaccctcagacaggtttcttagtagcagatgcattcaaatatgcaggtttacttacttccagaaccatttttacatttatatttaacgaaactggtttgaagaataatggtttgattgaagctacagcaattgaagcggtctttagaaatttatctcaacaaatctcggaagagaacgaaagtggaaataattttgagttcgttttcgaaagattatgtaccatcgccaacagtactatagacttactagatgtcaatgctgatgaagatattgagatacctaaagtcaacggggaaatggacatcgacgatattgaagatgataaactggatttgaaatggaaatattttacagtgattgggtttattaaaagtatattaagaaggtattcccacgaatatcgtgagttagcagacaaattcattgccaacattgataacgctattccacacgaatccactaggagaacaatttcgaattggattcaagaaacaaaggaagtttaa

SEQ ID NO: 12332 - protein, 858 aa, Saccharomyces cerevisiae
MILPLDFDEDENYRDFRPRMPKRQRIPPVVQLCKEMMPDIRTIGESVKAFEDDIKFLSEAIMNEYGHEDYFNNALLSTLNAVVVEQPQKQAAIALLTMVVNSKNNVAGKSIINYFFEELQKWCKQTYNDEFKSTSNETGPWNKIKLILRFLSILSPMFLVDELINIYKSLFELSIELNNLDPGNRVPLSEAIYTNTLLNIPYLFFFNRNNDGLRTKVEELLAYVEQNYLVKTTDINLLREYNGEPPYEMVELVRVVLPNVKKALINNLEQLNELFPDWNHLLTPQTGDEGFNDALTLPSVDDLKSFVRLNKNFGSVDSMWKTPRYAFHVYLPNSAGNFETVVPISTYAGQLFNDIIIDLVESLEFNRKEVARQVITLDLFFKAGIFTEPGESIAQLIATYEENPLAPTFKIEDLAIETILGLIFKLPSVSQPFAYFYTLLVDICQNSPKAIAPVFGRAFRFFYSHLDSLDFELKLRYLDWFSIQMSNFNFSWKWNEWEDDSIKFGKYFYNPKVNFAKNLIQKELRLTSNFSEVEDSLPQEFTKYLDTSYIPRDQLINYYQSLFTGYTVEEDSVRKNDLYFRQEGVPMENTVRKILDYTHKANNSREVTELESILGELKNEYGSIISDFNRFVIILLVQAVTDSGSRSLSHANKYINDLKEDLKTIFAKIELDIETKEYIIIEAVLTFWNANPQTGFLVADAFKYAGLLTSRTIFTFIFNETGLKNNGLIEATAIEAVFRNLSQQISEENESGNNFEFVFERLCTIANSTIDLLDVNADEDIEIPKVNGEMDIDDIEDDKLDLKWKYFTVIGFIKSILRRYSHEYRELADKFIANIDNAIPHESTRRTISNWIQETKEV

SEQ ID NO: 12333 - DNA, 2604 bp, Oryza sativa (japonica cultivar-group)
  CDS (1)..(2604)
atgagcgcgggctggaggacgctgctgctgcggatcggcgacaggtgcccggagtacgggggctccgccgaccacaaggagcacatcgaaacttgttatggtgtgctttgtcgagaatacgaacactccaaagatgcaatgtttgagtttctcctccaatgtgcagatcaattgcctcacaagattcctttctttggagtattgataggtttgataaacttggaaaatgaagatttttccaagggtattgtcgatacaacacatgccaatttacaggatgccttgcataatgaaaatcgtgacagaatcaggatattgctgcgatttctctgtggcctgatgtgcagcaaagttgtcctgccaaattctattattgaaacatttgaggcactattatcatctgctgcaacaatattagatgaggaaaccggaaatccttcgtggcaaccacgtgctgatttctatgtttattgtatcttggcttcccttccatggggtggctcagaattgtttgagcaagttccagatgaatttgagagagttctggttggtatacagtcttatataagcattagaaggcattttgatgatattgctttctcagtctttgaaacagatgaaggcaactctcccaacaaaaaggatttcatcgaagatttatgggagcgtattcaagttctttctcgcaatgggtggaaggttaagagtgttccaaaacctcacctgtcgtttgaagctcagctggtagctggagtttctcaccgtttctccccaattagttgccccccacctactatctcgcaatcatcttctgaaatagtaaaaggtcaagaaaagcatgaagctgatctgaagtatcctcaaaggcttcgtaggcttcacatatttccaacaaataaagctgagaacatgcaacctgtagatcgttttgttgttgaagaatgcatattggatgtgctacttttcttcaatggatgtcgcaaagaatgtgcattttatctggtcagcttacctgtgcctttccgttatgaatacctgatggctgagaccatattttcacagctactgttattgccgaatccccctttcaggccaatttactataccttggttattatcgacctttgcaaggcattgccaggtgcatttccttcagttgtggtaggagcagtacatgctctttttgacagaattagcaacatggatatggagtgccgcacccgacttatcctatggttttcacatcacttgtcaaattttcagttcatttggccttggcaggagtgggcttacgtcaaggaccttccaaaatgggctccacagcgtgtttttgtccaagaagtattagaaagggaaattcgcttgtcctactttgacaaaattaagcagagcatagaggatgctgttgaattggaagaactgttacccccaaaagctgggcctaacttcagatatcatagtgatgaaggcaaagaaagcactgatggccacagactctccaaggaacttgttgccatggttagaggaaggaagacacaaggtgatattatttcatgggtagacgaaaaaataattcctgtaaatggtgccaaatttgcacttgatgtagttagccagacacttctggacattggctcaaaaagtttcacccatcttatcactgttttggagagatatggtcaaataatatcaaagctgtgcccgaatgaagaaatgcagttattgttgatggatgaagtcagtgcttattggaagaacagtacccagatgattgccatagctattgataggatgatgggttatcgcctactttccaatctggctatagtcaaatgggttttttctcctgctaatgttgatcaatttcatgtttcagatcgtccatgggagattcttagaaatgctgttagtaaaacatacaatcggatttttgacctccggaaagaaattcagacactcaggaaaggtcttcaagctgctaaagaggccagtgaaaaggccgccagagagttggaggaggctaaatctattattgagattgtagatggccaacctgtgccatctgaaaatccaggaaggctaagacgacttcaagcgcgtgctgacaaagcgaaagaaggagaagtaaccactgaagaatctttagaagcaaaggaggccctccttgctcgagggcttgaagaaagcaaggaattgcttaggttactattcaagagctttgttgaagtgctaactgaacgtttgccacctatttctgctgatggagatgttcctaatttacgtgctggagacccgaatgtaaattcttcagcccgtgaccctgaagcaacaaccatggaaatagacaatgaaaatggaggagataacgatagtcagctgaatggtcaaaacaagaaaatcagtcacaatgttggagagcttgagcaatggtgtctctgcacattgggctatctcaagtcgttttctcgtcaatatgctactgagatctggtcccatattgccatgttggatcaggagattttcgttgggaatattcaccctcttatccggaaagctgctttctccggtttgtgcagacctaccagtgaagggtctcacctttga

SEQ ID NO: 12334 - protein, 867 aa, Oryza sativa (japonica cultivar-group)
MSAGWRTLLLRIGDRCPEYGGSADHKEHIETCYGVLCREYEHSKDAMFEFLLQCADQLPHKIPFFGVLIGLINLENEDFSKGIVDTTHANLQDALHNENRDRIRILLRFLCGLMCSKVVLPNSIIETFEALLSSAATILDEETGNPSWQPRADFYVYCILASLPWGGSELFEQVPDEFERVLVGIQSYISIRRHFDDIAFSVFETDEGNSPNKKDFIEDLWERIQVLSRNGWKVKSVPKPHLSFEAQLVAGVSHRFSPISCPPPTISQSSSEIVKGQEKHEADLKYPQRLRRLHIFPTNKAENMQPVDRFVVEECILDVLLFFNGCRKECAFYLVSLPVPFRYEYLMAETIFSQLLLLPNPPFRPIYYTLVIIDLCKALPGAFPSVVVGAVHALFDRISNMDMECRTRLILWFSHHLSNFQFIWPWQEWAYVKDLPKWAPQRVFVQEVLEREIRLSYFDKIKQSIEDAVELEELLPPKAGPNFRYHSDEGKESTDGHRLSKELVAMVRGRKTQGDIISWVDEKIIPVNGAKFALDVVSQTLLDIGSKSFTHLITVLERYGQIISKLCPNEEMQLLLMDEVSAYWKNSTQMIAIAIDRMMGYRLLSNLAIVKWVFSPANVDQFHVSDRPWEILRNAVSKTYNRIFDLRKEIQTLRKGLQAAKEASEKAARELEEAKSIIEIVDGQPVPSENPGRLRRLQARADKAKEGEVTTEESLEAKEALLARGLEESKELLRLLFKSFVEVLTERLPPISADGDVPNLRAGDPNVNSSARDPEATTMEIDNENGGDNDSQLNGQNKKISHNVGELEQWCLCTLGYLKSFSRQYATEIWSHIAMLDQEIFVGNIHPLIRKAAFSGLCRPTSEGSHL

SEQ ID NO: 12335 - DNA, 2541 bp, Aspergillus terreus NIH2624
  CDS (1)..(2541)
atggccgactacgaacgccggaatcatgggtataggggagggcgcaagagacgctacagagaggacgatgattatgatcgccgtcaacggcgcagatatgaagagccattggtcgtgaaagttcggaggcagctgctcaccattgctgaatctgctgcccggcgcgtggaagacgataccgtcgctatcgcaaagagcgtgacggacaactacgaggacgaggaaatcaagcagactttccttgatgtcatttttgcacttgtgctcgaacaaccgttgaagatccctttcgttgcctccacggttcttgtcgccaacgctctgaaaccagaggtcgtgtcggacgtcctcaagaagttcggcgaatcgctacaggcttacattgactccgggtcgtggcgtgaggtcaaacttctccttcggtttttgggttgcatccaatgcctttttgaaggagatggtgtcttccccatcttggaggaactgtttgcccgtgctgttgaccttcagacggcttcgtcggaagatctgcttgggttagaactcgtgaagatcattctgttcaccattccgtatgtcatcgcctcgcccgcgacgggcttcgagtcgcacgccagctctctcctcgaaaaaacagatatcatcgcgtccaccccgcatacgctcgtcgacctggtcaacccatttggtctggaaaacggaaaaacagagggggttcagagtgtcattagtctgctccagggccagcttcaagaagaggccagccgcggctggaagctcgtctgtcttccgcgggtatggaaggatattcgtctgccagaggcgcaggacgagtccaagccagaagaagagaagccggaagacgacaagccgtggtatgagggaacgaaacatccgttccctcaaatcaccattcctaaccctgtgccgaaaggatcgagggcaatcttcccgcaggtgtacttctcggtctacgccaaccaggagatcgagacggttcctccgatgtctgatatctcctcttctctgttgcgggatgttctggtcgatactatcaatattctcgatttcaaccgcatcgcagctgccaagttcttgatcgacgtcgactgcttttttacaccatacactttcgtgaagcgtgcgacgcctttcgacagactccgcgagatttccggagaccatgcgacttggaagcccgaagacgtggcagtggatgcggtcttttcgcagttgttccagcttcctactccggaacacaagctgatctgctaccactccgtccttactgaatgttgcaagatcgcccccgcggctattgctcctagcttgggtcgtgcgattcgcttcctgtaccgcggactggagactatggacttggatctatcgtaccggttcctggactggtttgctcaccaccttagcaactttggtttcacctggaagtggagtgaatggattgaagatcttgagctgcccgccgtgcacccccgaatggcgtttatcaacggggctctcgataaggagattcggttgagctttgcacagcgcatccgcggaaccctccccgacccgtatcaggacctgatcactgaagggaaggagaaggacactcctgactttaagtattcctcagagaacgccccttacgccaaagagggcatggagatcatgcaactcattcgcaagaaagcaagtgacgaggagatccagccattcatcgccgccattgaagaacaagccaagtctctgggcgtcgaagaccccctgctcccttcgacggacgccttcgtgacggccatctgcttcgtcggctcgaagtcgctctcgcacgtgttgtcctgcatcgagcgcaacaaggagcgcctgctggccatcgggccgaaatcgcccgccgcgcgccgccaaatcatcacctccgtcctggagtactgggccgaccagccgggcatcggcatcaacatcatcgacaagctcctgaactacaccatcctgacgccgctgtccgtcgtcgaatgggccctcgtcgacaaactcgaggccggcaccatcctcgccaagctgcacgtctacgagatggtctcggccaccgtcggcaaagtcaccaaccgcatgcgccagatcgtcgccgcgcgcatccagccgggcctctatgagccgcagctcagcgtcctccacgacaccctcgtccgcgagaaggctgacatgcaggccctcttcaaggtcatcgaagacgccctcgtctccgtcgccgccggcagcaacgacgagatgatggagcgcggcgatggtagcggcgcccttcccgaggacgagctcatccggcaatggggccgccgctggctccgcgtcttccgccgccgtgctggtgtcgaggagtccttcatcgccgaggccatggtccatgctacccctgtcggcacggaagcgccccctccgccccctgctgcgccgtctggttcccaggatggaggggcggtggtggccccggacggtgatatggatattggggatgcggatggacctgttgtgctttcgtag

SEQ ID NO: 12336 - protein, 846 aa, Aspergillus terreus NIH2624
MADYERRNHGYRGGRKRRYREDDDYDRRQRRRYEEPLVVKVRRQLLTIAESAARRVEDDTVAIAKSVTDNYEDEEIKQTFLDVIFALVLEQPLKIPFVASTVLVANALKPEVVSDVLKKFGESLQAYIDSGSWREVKLLLRFLGCIQCLFEGDGVFPILEELFARAVDLQTASSEDLLGLELVKIILFTIPYVIASPATGFESHASSLLEKTDIIASTPHTLVDLVNPFGLENGKTEGVQSVISLLQGQLQEEASRGWKLVCLPRVWKDIRLPEAQDESKPEEEKPEDDKPWYEGTKHPFPQITIPNPVPKGSRAIFPQVYFSVYANQEIETVPPMSDISSSLLRDVLVDTINILDFNRIAAAKFLIDVDCFFTPYTFVKRATPFDRLREISGDHATWKPEDVAVDAVFSQLFQLPTPEHKLICYHSVLTECCKIAPAAIAPSLGRAIRFLYRGLETMDLDLSYRFLDWFAHHLSNFGFTWKWSEWIEDLELPAVHPRMAFINGALDKEIRLSFAQRIRGTLPDPYQDLITEGKEKDTPDFKYSSENAPYAKEGMEIMQLIRKKASDEEIQPFIAAIEEQAKSLGVEDPLLPSTDAFVTAICFVGSKSLSHVLSCIERNKERLLAIGPKSPAARRQIITSVLEYWADQPGIGINIIDKLLNYTILTPLSVVEWALVDKLEAGTILAKLHVYEMVSATVGKVTNRMRQIVAARIQPGLYEPQLSVLHDTLVREKADMQALFKVIEDALVSVAAGSNDEMMERGDGSGALPEDELIRQWGRRWLRVFRRRAGVEESFIAEAMVHATPVGTEAPPPPPAAPSGSQDGGAVVAPDGDMDIGDADGPVVLS

SEQ ID NO: 12337 - DNA, 2490 bp, Coccidioides immitis RS
  CDS (1)..(2490)
atggtggaccacgaagcgcgtcggccagcgggaggatttaaccgcaaaaggcggtacagagaggatgaaggaggggagcgccatcgaccgcgacggcgatacgaggagccgctgtctgcgtcagttaggagacagcttttgacaatcgcggagtcggccgtacgaagagtcgaagacgatgtggccaagatcgcaaacactatctgcgaacattctgaagatgaagaggtgcaaaatgatttccaggatttggtgttgcaattggttatcgaacagccctttaaaattcccttcgttgcggcggtagtcctcctgatcaacgctcaaaagtctgaaatcgctagccgggccttcaccaaagctggcgaaatggcccagtcctatattgctgctggcgagtggcgcgaagtgaaacttgtccttcgctttcttggctgccttcagggcgctttcgaaggggatggtatcttcccaatactggaagagcttttttctcgggctgttgacttgcagacagcgtcttctgatgattctctcggccttgagcttgttaagattattctatacacgatatcctatgttatggggtcctcagcatcggggttcgaatcccatgcatccgcgctcttggagaagacggatatcatcgcctcgacaccgcatacgctagaggctctcgtggatcctttcccatcggaagaaaaaacggaggaagagagattgagcgcactgggcctacttcaaaaacaacttcagaacgaagctaagaattcttgggaacttgcgtgccttccccgaccatggaagatgccacccaaggaggaggacaactctgacagagaccctctcaaaaacgccaccaagcatcccttcccgagcatctctattcccgacccagtgaagaacggcccacgggcaatattccctgagattttcctttcggtttatgctgaccagaatattgagaccgtccctccgactacggatatcgcctcttccttgattagagatgtgttggttgacacaatcaacatcctcgactacaaccgaattgccgcagccaagtttctgattgacgttgactgctatttcgcaccaaccacgttcatcaagcgtgctactccctttgataaattgcgtgatgtagctccggataagccgacctggaagccagaggatgtcgcgcttgatgcggtattttctcaactattacagctgccttcgcctgaacataagcaggtatattaccactccgtcttgactgaagcttgcaaaattgccccggcagccattgcgccaagcctgggtcgagcaattcgattcctttaccgcaatgtggacaaactagatctagctcctacatacagatttcttgattggttctctcatcatctgagcaatttcggtttcacttggaagtggactgagtgggtcgatgacgttgaattgccagccgtgcatccaaagaaggctttcattattggcgccttggataaagagatccgtttgagcttcgctcagcgcatcaagggaactatcccggagccgtaccaggctttgatttctgaaaataaggagaaggatactcctgatttcaaatacgcacaagagactaccccgtattcaaaagagggccaggaaattctccaactcatccgtaaaaaggcgtcggacgaagaaattgcccctgtcatcgcctctatcgaggagcaagccaaggcccatggaatcgctgacccatcaatcccgtcaacggacgcctttgtcacatccatttgctgcgtcggctccaaatcgttatctcatcttctttcctccattgaacgatgcaaagagagactacttgccattggccccagatctgcagctgcccgccgccaaataatcacttctgtgatggaatactgggtcgaccagcccggaaatgcggtgaatatcgtagacaagctcctcaattataccatccttacgcctctatcggtcatcgagtgggctctcgtcgataatcttgctgctggcagtattctcgccaaaccccacattttcgaaatgatctccgccaccatgggcaaggttacgaaccgcatccgacagattgtggctgcccgcactcagccgacgctcgtggaaccacaactcagcgtgatacaagatgcgttgacgagggagagcgcagacatgagagcaatgtttcgacttatcgacgactctattgtgcccgttgctagcggaacaaacgatgtgatgatggagcgcgatgatgatagtgcgttggctccggagaatgagcttattcgtgagtgggggaaaaggtggctgagagtgtttaggcggaaggctgctgtggaggacgcgtttatcactgaggcgatggttaatgcggtgcctgtagggacgatgccgccaccacagccgcaaccgcagccggtacagactgctatggaaacccatggagcggatggacagaatgagatgaccgatattcagtag

SEQ ID NO: 12338 - protein, 829 aa, Coccidioides immitis RS
MVDHEARRPAGGFNRKRRYREDEGGERHRPRRRYEEPLSASVRRQLLTIAESAVRRVEDDVAKIANTICEHSEDEEVQNDFQDLVLQLVIEQPFKIPFVAAVVLLINAQKSEIASRAFTKAGEMAQSYIAAGEWREVKLVLRFLGCLQGAFEGDGIFPILEELFSRAVDLQTASSDDSLGLELVKIILYTISYVMGSSASGFESHASALLEKTDIIASTPHTLEALVDPFPSEEKTEEERLSALGLLQKQLQNEAKNSWELACLPRPWKMPPKEEDNSDRDPLKNATKHPFPSISIPDPVKNGPRAIFPEIFLSVYADQNIETVPPTTDIASSLIRDVLVDTINILDYNRIAAAKFLIDVDCYFAPTTFIKRATPFDKLRDVAPDKPTWKPEDVALDAVFSQLLQLPSPEHKQVYYHSVLTEACKIAPAAIAPSLGRAIRFLYRNVDKLDLAPTYRFLDWFSHHLSNFGFTWKWTEWVDDVELPAVHPKKAFIIGALDKEIRLSFAQRIKGTIPEPYQALISENKEKDTPDFKYAQETTPYSKEGQEILQLIRKKASDEEIAPVIASIEEQAKAHGIADPSIPSTDAFVTSICCVGSKSLSHLLSSIERCKERLLAIGPRSAAARRQIITSVMEYWVDQPGNAVNIVDKLLNYTILTPLSVIEWALVDNLAAGSILAKPHIFEMISATMGKVTNRIRQIVAARTQPTLVEPQLSVIQDALTRESADMRAMFRLIDDSIVPVASGTNDVMMERDDDSALAPENELIREWGKRWLRVFRRKAAVEDAFITEAMVNAVPVGTMPPPQPQPQPVQTAMETHGADGQNEMTDIQ

SEQ ID NO: 12339 - DNA, 2499 bp, Neosartorya fischeri NRRL 181
  CDS (1)..(2499)
atggccgactacgaacgccgaccacacggacactcaaggggagggcgcaagaggcgttatagagatgatgaggattttgaccggcgtccgcagaggcgcagatacgaagagccactcgtggtcaaggtccgacgacaactgctaactcttgccgaatctgctgctcgaagagcagaggacgacgctgtggtcatcgcaaaaagtgtcgcagagaactatgaggacgaagagctgagaaaaagctatgtcgaaatagccattgatcttgtcatagagcaaccgttgaaggttccctttatcgccgctacagttctggtcgccaataactataaatcagagcttgtggaagatgtcctcaaacgagcacgcgaatcactgcaacagtacattgatgccggagcctggcgcgaggtcaagcttcttctgcgatttctgggttgccttcaatctattttcgagggagacggcgtctttccaatcctggaggaactttttgcgcgtgcggttgatctccaaaccgcgtcatctgaagacttgctaggactcgagctcgtcaaaatcattctcttcacgatcccatacactatggcgtctccagccaccgggtttgaagcacaagcaagtgccctcttggagaaaacagacatcatcgcctcaacgccgcatgctctagttgacttggtgaatccatttgctttacaggatggtgaaccaactgctgtgcagagcgtcatcggcttgcttcagaaccaactccaagccgaggcaaaccgtggctgggaacttgcttgccttcctcggccctggaagaggtcggaaagcgaagaagacggtcctatagaagccgggcctaaacatgccttccctcagatcaccgtcccgaatcctgtacgaaaaggagccagggcgattttccccgagatctacctctctgtatacgcgaatcaagacttggagacggtccctccgacgtcggacattgcatcgtctttgttgagagaagctctcgtggatacaatcaacatcctcgacttcaaccgcatcgctactgccaaatttctgatagatgtggattgttacttcacgccaaacacttttgtgaagcgtgctacgccatttgacaggctgcgcgatctccctggggatcgccctacatggaagcctgaggatgttgctgtcgacgccgtcttctcccagctattccagcttccttccccagaacacaagctggtttattatcactcagtcctcactgaatgttgcaagattgcgcccgctgcaattgcccccagtttaggtagagctattcgtttcctgtatcgaagccttgacacaattgatttggagctcattcaccgattcttggattggttcgctcatcacctgagcaactttggattcacatggaaatggagcgaatggattgaggacctcgagctcccgcttgtccatccaagaatggcgttcattacgggcgccatcgacaaagagattcgattgagctttgcccaacgcatcagaggaactctgccagatccgtaccaggaattgataaccgaaggaaaggagaaggatactcctgatttcaaatactcctcagatactactccttacgccaaagaaggcagagagatcatgcaactcattcgcagaaaagcgggcgatgaggagattcagccactgatcaccgccatcgaggagcaagcgaaggctctaggagtcgacgatcctatgttgccctctaccgatgcctttgtcacgtctatctgcttcgttgggtccaagtctctttctcacgtcctgtcatgcattgagcggaacaaggagagactgttggcgattgggcccaaatcagctcgtgcccgttgtcagatcatcacctcggtgatggagtactgggtagatcaaccaggcgtcgcgatcaatattatcgacaagctgttgaactacaccatcctgacacccttatccgtcatcgaatgggccctggtggagaggttgcaagcaggaacaattcttagcagaacacatatttttgagatgatttctgctacggttggcaaggtcaccaatcgtctgcggcagattgtggctgcacgcacccaggccggtctgtatgaacctcaattgagtgtcttggacgagaccctgagccgcgaaaaggccgatatgcaggctcttttcagagtaatcgaagactctatcgtgtcggtcgctggcggtagtaacgatggactgatggagagaggggatggaagtgggaacctgccagaggacgagatcatccgtcagtggggtcgccgatggctcagggtattccgacgcaaggctggtgtggaggaatcattcatcaccgaggccatggctgatgccacaccggtcgggacggtggcccctgcgccccagcctgctgcctctgagactggggcggctgcgaatgcagcagcagatggagacatggacattgctggcgctgatgaagccgtcgagatttcgtag

SEQ ID NO: 12340 - protein, 832 aa, Neosartorya fischeri NRRL 181
MADYERRPHGHSRGGRKRRYRDDEDFDRRPQRRRYEEPLVVKVRRQLLTLAESAARRAEDDAVVIAKSVAENYEDEELRKSYVEIAIDLVIEQPLKVPFIAATVLVANNYKSELVEDVLKRARESLQQYIDAGAWREVKLLLRFLGCLQSIFEGDGVFPILEELFARAVDLQTASSEDLLGLELVKIILFTIPYTMASPATGFEAQASALLEKTDIIASTPHALVDLVNPFALQDGEPTAVQSVIGLLQNQLQAEANRGWELACLPRPWKRSESEEDGPIEAGPKHAFPQITVPNPVRKGARAIFPEIYLSVYANQDLETVPPTSDIASSLLREALVDTINILDFNRIATAKFLIDVDCYFTPNTFVKRATPFDRLRDLPGDRPTWKPEDVAVDAVFSQLFQLPSPEHKLVYYHSVLTECCKIAPAAIAPSLGRAIRFLYRSLDTIDLELIHRFLDWFAHHLSNFGFTWKWSEWIEDLELPLVHPRMAFITGAIDKEIRLSFAQRIRGTLPDPYQELITEGKEKDTPDFKYSSDTTPYAKEGREIMQLIRRKAGDEEIQPLITAIEEQAKALGVDDPMLPSTDAFVTSICFVGSKSLSHVLSCIERNKERLLAIGPKSARARCQIITSVMEYWVDQPGVAINIIDKLLNYTILTPLSVIEWALVERLQAGTILSRTHIFEMISATVGKVTNRLRQIVAARTQAGLYEPQLSVLDETLSREKADMQALFRVIEDSIVSVAGGSNDGLMERGDGSGNLPEDEIIRQWGRRWLRVFRRKAGVEESFITEAMADATPVGTVAPAPQPAASETGAAANAAADGDMDIAGADEAVEIS

SEQ ID NO: 12341 - DNA, 2826 bp, Pichia stipitis CBS 6054
  CDS (1)..(2826): transl_table=12
atggattcgtacaatcccggtaagagatcgagagacgatttcgagtcggacaattatgcagcaccgcagcagcaatttgaagacgaaaatgctgagtccaagagacagcatgtggatccaacccaggaattgatcaacaatgtgtgtaaggatatccggaggttgggagaaaatcccaacatagccaatcaggtcgcggatgtttcgtatatttcgaatccaattgttgctgaatttgaaaagatcgacaatttgagaaatgccattctcagtactatctatgctgtgattattgaacaaccacagaagatcaatgccttgagcaacttaattcttatctgtaactccaagaatttcgttgttgccaaatacgttattgaatatttacatgctaaagctcagacgttgttggactctattgctcctaaaaaagaagaagctgatgaagatgtagacgaagaagatgctggagtgttcaacaacttgaagtctattctcaaattcttagccactttggctcctatcattgaaggatattcgattatcaacatattcaaacaatttttgaaacttgcaattgatttgcagaacgaaaccccagacaacagaaatggaactgctcaggaaatcttctataacctgttgattgccgttccttacttgttcagcaacgacttttcgcaggaactaattgaccaggtaaacgagttagtcgctttagccaaagacttcaaaatcgtagaaagtgctacaaacaccttgttacagccttttgactcaaagctcgacaattacaaattgccttatgaaccagtcaagatgattgatttgatttacaacgccattcttacattgcaaggtgaagaaaaagattgggtcaacttgaagcacaagcttttcttggatttctccgagttgttggcttctattatcgaggaagcattgcagaataaccctatttcaaatgccttagttaagcaccaattacctcaactttctttgccaacaattgcacaagttcaagagtacaagccagtgggttcgattgacaagttatggaaagaaaattctcgtgtcttgttccaagtctacaactccactgagttcgaaacggtaccaagaattgattcttactttggtttgttcttcaaggatctttcgtttgacattttaacaaacttatcgttcaacaagaatgaggcttctatccaattatccatcttggatttgttcttctctaaagatttgtttgcccctccaggatcttctatcgacctgttgactatgattcacgaagataacaaatctggtgaaaacgttcctcctttgtcgacttggaaaattgaagatattgctgtcgaaagtatcttgacgatgattttccaattgccagtcacattataccgtgaaatctactattatacggtgttgatttcctgttgtagagaaagtccggaatcaattgctcccgtttttggaagagccatcagatacttttacaataacttggagacattggattatgagttgaagttgagattcttggattggatgactactcaaatttccaacttcgagttcagctggaagtgggatgaatgggttgctgattcacaaaagttcaaacacttgagacatcatccaaagaagaattttatcaagaatttgatcgctaaagaagtcagattatcaaacaagaatagaatcaaagacagttttgtggctgtcaatccagaaacatccgagatggtgaacttggaagaattctatcagtacttgaatatctctctttttgaagatgaaacaaaattcattttggattatgacactgccctatacaaccaagaaggcacgagagaaattctcgaaaagattcatctcgaaaagagagaacaattagctgctaagccagctgtatttgcacaagaagagatcttcttcaacttctcccttcctgaattgccattgcatggtgttgccagtaaagtgtatgactttgtcgttgctcattggaagcctaacactgatttcgacgagttgtgcaaggaaattcttgaagctaccaaggagttccctgacattaatgggattaagttcatgatcaatttaatattccaaacatatgcctacattggatctagatccatctattcggttgtgagtatcttatctcgtgacgtcaacaaattgaagtacttgagtggctctcctattgaatatactgagcaggagcctaaatttgaggagcaagagatttctccagaagaaatcactgacagacaaaactggatcattgaatccattttcagagtgtggattcatcaaccacaagaagtattcttgattcttgaatatttgattgaatttggaatcttgaagccggagaacttggtcttgaagaccttagatcttgagaataacttgattctcgagaatgtttcttgtatggagtccatgaacagggtgttgtttaacagttctattgccacggacaaaggcgactcattcaaaaaattgattttgctacttttcaatgcgattacacgcaacttgaatgccatctctggtgagcttcaagaagataaaaatgaaatcatcaagattacaaaggatatcgaagatccggaagcattggaagtatcgaaaagaatcgaccaggaatggctcttctacgagtacaagggccttttgaagtcgtatttcagaaggtatatcaagaacctggaaattgactacttgagcgatatcagggagattttcgacaccatcgagaatgttcctgccaaggacgatatgttgcagtggctcgatgaagtcagcccatag

SEQ ID NO: 12342 - protein, 941 aa, Pichia stipitis CBS 6054
MDSYNPGKRSRDDFESDNYAAPQQQFEDENAESKRQHVDPTQELINNVCKDIRRLGENPNIANQVADVSYISNPIVAEFEKIDNLRNAILSTIYAVIIEQPQKINALSNLILICNSKNFVVAKYVIEYLHAKAQTLLDSIAPKKEEADEDVDEEDAGVFNNLKSILKFLATLAPIIEGYSIINIFKQFLKLAIDLQNETPDNRNGTAQEIFYNSLIAVPYLFSNDFSQELIDQVNELVALAKDFKIVESATNTLLQPFDSKLDNYKLPYEPVKMIDLIYNAILTLQGEEKDWVNLKHKLFLDFSELLASIIEEALQNNPISNALVKHQLPQLSLPTIAQVQEYKPVGSIDKLWKENSRVLFQVYNSTEFETVPRIDSYFGLFFKDLSFDILTNLSFNKNEASIQLSILDLFFSKDLFAPPGSSIDSLTMIHEDNKSGENVPPLSTWKIEDIAVESILTMIFQLPVTLYREIYYYTVLISCCRESPESIAPVFGRAIRYFYNNLETLDYELKLRFLDWMTTQISNFEFSWKWDEWVADSQKFKHLRHHPKKNFIKNLIAKEVRLSNKNRIKDSFVAVNPETSEMVNLEEFYQYLNISLFEDETKFILDYDTALYNQEGTREILEKIHLEKREQLAAKPAVFAQEEIFFNFSLPELPLHGVASKVYDFVVAHWKPNTDFDELCKEILEATKEFPDINGIKFMINLIFQTYAYIGSRSIYSVVSILSRDVNKLKYLSGSPIEYTEQEPKFEEQEISPEEITDRQNWIIESIFRVWIHQPQEVFLILEYLIEFGILKPENLVLKTLDLENNLILENVSCMESMNRVLFNSSIATDKGDSFKKLILLLFNAITRNLNAISGELQEDKNEIIKITKDIEDPEALEVSKRIDQEWLFYEYKGLLKSYFRRYIKNSEIDYLSDIREIFDTIENVPAKDDMLQWLDEVSP

SEQ ID NO: 12343 - DNA, 2550 bp, Aspergillus niger CBS 513.88
  CDS (1)..(2550)
atggccgactacgaacgccggcctcatggccccaggggtggtgggcgcaagaggcgctacagagaagatgatgactatgaccgccgccagaggcgtcgttatgaggagccgcttgttgtcaaggtccggaggcaactgcttacgatcgctgaatctgctgccagacgagcagaagacgacgctgtaagcatcgcaagaagtgtaacagacaactacgaagatcaggagttcaggaactcgtttgtcgatattgcgcttgaccttgttttggagcagccgctaaagatcccttttatcgccgcgaccgtcctcattgcaaacttccagaaatccgagctcgtgtccgacgttctcaacaagtcaggcgtgtgcttgcagaagtacattgacgctggcgcgtggcgcgaggtcaagcttcttctgcggttcctgggttgtctccaatgtgtcttcgaaggggatggcatcttcccgatactggaggagctctttgcgcgtgctgtcgaccttcaaacagcatcctcggaagatttgatcggtctggagctggtgaaaattattctcttcaccattccgtacgttatggcctctccagcagccggtttcgagtcccaagccaccgcacttctggagaagacagacatcatcgcttccaccccacatactcttgtggacctggttaatccattcggcctggagaatgggaagtcaattgccacgccaagtgtcattagcctactccagaatcagttacaaaaagagtccggccggggttgggagctcgcgtgtcttcctaggccatggagaggagcattagaggcactaaatgcacaagagcccgaggaagcacaagaggggcaagagacacaggacaatggcgcagagccgaaggcttatgaaaacggcccaaagcatgcattcccccagatcactgttccgagtccggtgaagaatggaacaagagcaatctttccggaggtgtacctttccgtgtacgcaaatcaagacatggaaacagtccctcctacttcagatatcgcatcttccttgctgcgtgatgccctcgtcgataccatcaacattcttgatttcaaccgcattgcgacggcgaagtttttgattgatgtcgactgctatttcacgccacacaccttcgtgaagcgagcgactcctttcgataggctgcgtgatttaccaggagacatcaatctctggaaaccagaggatgttgctgtggacgccgtgttctcccaactgttccagctgccgtctcccgagcacaaactggtctactaccactcagttctcacggagtgctgtaagatcgccccggccgcgatcgcacccagtttaggacgtgccattcgcttcttgtatcgcagcctggagacaatagatttggacctaagccatcgtttcttggattggttctctcatcacttgagcaactttgggttcacttggaaatggagtgaatggattgatgacttggagctgcctctggttcaccctaggatggcttttatcaatggtgccctcgacaaggagatccggctgagctttgcacagcgtattaggggcactctccctgacccataccaagacttgattacggaagggaaagagaaagacacacctgatttcaagtactcgtctgatactactccgtatgccaacgaaggcagagaaattatgcagctggtccgcaagaaggctagcgatgaggagatccagccacttataaacgcaattgaagagcaagccagatctctcggtgtcgaagacccgctgctgccttcaacggacgcctttgttacggctatctgctttgttggctccaagtctctgtctcatgtactgtcctgcattgagcggaacaaggaacgactcctggccatcgggccccaatctgcacaggcgaggcgtcagatcataacctccgtcatggagtattgggttgatcagcctggcgtcggaatcaacatcattgacaagcttctcaactacaccattctgaccccgctgtcagtcattgaatgggcactggtagacaagctagaggcaggaaccgtccttgccaaatctcacgttttcgagatgatctccgccacagtcggaaaggtcaccaaccgcctgcgccagattgttgccgcacgtactcagccaggtctctacgagccgcagctcagcgtcctcgatgagacgctcagtcgtgagagggttgatatgcaatctcttttcagggtcatcgaagactccatcgtctcagtggccggcggaagcaacgacgagcagatggaaagaggagatggaagtggaaacttgccagaggatgaaatcatccggcaatggggccagcgctggctcagagtgttccgcaggaaagccggcgtcgaggaatcgttcattgcggatgccatggccacagctactcctgtcggcacagtcgctccgcctccggctccggaagagaccgccgcttctgaaagtatcccggcagatggggaaatggatattgctgaagccgatgcgagcgtggacatcgaatga

SEQ ID NO: 12344 - protein, 849 aa, Aspergillus niger CBS 513.88
MADYERRPHGPRGGGRKRRYREDDDYDRRQRRRYEEPLVVKVRRQLLTIAESAARRAEDDAVSIARSVTDNYEDQEFRNSFVDIALDLVLEQPLKIPFIAATVLIANFQKSELVSDVLNKSGVCLQKYIDAGAWREVKLLLRFLGCLQCVFEGDGIFPILEELFARAVDLQTASSEDLIGLELVKIILFTIPYVMASPAAGFESQATALLEKTDIIASTPHTLVDLVNPFGLENGKSIATPSVISLLQNQLQKESGRGWELACLPRPWRGALEALNAQEPEEAQEGQETQDNGAEPKAYENGPKHAFPQITVPSPVKNGTRAIFPEVYLSVYANQDMETVPPTSDIASSLLRDALVDTINILDFNRIATAKFLIDVDCYFTPHTFVKRATPFDRLRDLPGDINLWKPEDVAVDAVFSQLFQLPSPEHKLVYYHSVLTECCKIAPAAIAPSLGRAIRFLYRSLETIDLDLSHRFLDWFSHHLSNFGFTWKWSEWIDDLELPLVHPRMAFINGALDKEIRLSFAQRIRGTLPDPYQDLITEGKEKDTPDFKYSSDTTPYANEGREIMQLVRKKASDEEIQPLINAIEEQARSLGVEDPLLPSTDAFVTAICFVGSKSLSHVLSCIERNKERLLAIGPQSAQARRQIITSVMEYWVDQPGVGINIIDKLLNYTILTPLSVIEWALVDKLEAGTVLAKSHVFEMISATVGKVTNRLRQIVAARTQPGLYEPQLSVLDETLSRERVDMQSLFRVIEDSIVSVAGGSNDEQMERGDGSGNLPEDEIIRQWGQRWLRVFRRKAGVEESFIADAMATATPVGTVAPPPAPEETAASESIPADGEMDIAEADASVDIE

SEQ ID NO: 12345 - DNA, 3075 bp, Lodderomyces elongisporus NRRL YB-4239
  CDS (1)..(3075)
atggaatttggctcttccaacaaaagatcgcgtgatgattttgaacaagaccaaggtttcggtggatcactgggccctacacatgcacgtgaacaccatcaacacccacaccagcacttgcatccgaacccgagttcaacctctagcctctacgaatccaagagacagcgcattgacccggctcaagaattaatcaacaatgtctgtaaagacatcagaagacttggagagaatccaaatgttgcagcacaagttgacgatgtcaactacatttcgaatccaattgtcgctgaatttgagaaaattgatactttgcgtaatgccatcttgtcgactatatatgcaataattgttgaacaaccacataagattaatgctattagcaatatggttttcatttgtaacgcaaaaaactttgtgattgccaaatacgtgattgagtatttgcataccaagattcagatcttattagactctgtcaatggagtcgttgatgtaagtcacgaaaagagggaagatgctggagttttcaacaacatcaagagtatcttaaaattcttgagtgtgctctcgcctattattgatgactatgctataatcaatgtctattctcagtttttgcaatttgcaattgacttgcaaacgcaaacggggcaagaaaaaagaaacggtattgcccaagagattttttacaatacattggtagccatgccttatttgttgagcaatgacaagtctgaagaagtcaaaggtcacttgaacgatttgattgagttggcaggtaagttccccattgtagaaccagaaacaaataaattgatacaaccgtttgattcaaagatggataacttggatattccatatacaccaaagaaattagttgacttgatactcccgtcattgaaagctttgcaaacaaatgactgggaattgaaattgtttctcgattttgagccattcttggagcctataatcaaaaatgctttggaaaataatgccgttgccaaagaaattgtaaaacacaagttgccacaattttccttgccaacctttgacaaagtccaagcttacaagtccaaacacaaagaaagtattgataatgtatggaaacaaaatctgaggctattgtttcaagtatacaatcaaaataccgagtttgagaccgtgccaccaattgaaacatacactggcttatttttcaaggacttggcatttgatattttgactaacctctcgtttaataaaaacgaagcctcgatccagctttccgtgttggatttgttctttgatagtgatttgtttgccccattaggaacgtctattgaccagctcacaatgattgatgctgataacaaaagtggggagaatgatcctcctttatctacatggaagattgaagatgttgctgtcgaaagtattttgacgatgattttccaacttccgcgtaccttgcacagagaaatttattactatactgtcttgattgcatgttgtaaggagagccccgaatctatggctcccgtttttggtagagctattcgttacttttatgcaaacttgcaaacattggactatgagttgaaaatacgttttttggattggatgacaacgcaaatctcaaattttgaattcagttggaaatgggaagagtgggttaaagactcgcaacaatactcacagttgaaatatcatccaaaaaagaactttatcaaaaatctcattgcaaaggaaattagactttcaaacaaaaagagaatcagggaaagttttgttgatgttattgacggcaacgttgttaatttcgaggagttttaccaatatttggatatttcaatgtttgccaatgccaaggactatatactaagctacgactctgctttatacggagatctggcagaaataaaggacttgttgagtagcctttatgatgagaaacaagctctattgctggcgaaatcaaatcctagttaccaagaagagatatttttcaatttcacgaatccgagattaccattgcatgcaactggtctgaggacttatgaatttattatgtctcatcataaatccaataaggattttagcgagctttacaagtccatattagacgatgtaaacaagcttaatgaggaagcttcacaatcacttggtgggaacaatggagaaactaaagagactgaagaaactcgagaaactgacgaaactgaggcaactaaagagactgacgaaactgacaaaaccaagcagcagcagcagcaacaacaacaacaacaacaatcacaacaccttgaggctttgatcccagaaccagtgaaatttgctatcaacttaatcatgcaatcatattgttatatcggttcaagatcgatatattccgaagtgagtattttgagcagagatgcagataaattaaagtaccttagcggacaaccgattgaacccaaaaccactgcgccggtatctcttgttgaaggagaaacagagtttgaaaatttagatttgacagaagaggacgtacagaatcgtcaaaactggatcattgactcgatattccggatttgggtgcatcagccacaagttgtgtttttgattttagaaaacttgattgagtttggtgtaatcaagcccgaatttttacttgctaaagctttcaagtcaaacctaattatcgataatgtttcttgtatggagtctgtaaaccgaattttggaaaacagtaaacctgcagtgttgaagcaaggaattgcagtgttattcaagactattgttgccagattgaatgaattggagttgggggttgacgaaattgtcaacattgatgagcttgattctagtaatgctgaaagggttgataaacaatggttgttttacgaatacctcggtttattaaaatcatattttagaaaattcattaagcaacaagattttgatgagaatggtggcagtgatggagctgctgctaatgatgaagaagcgaacaaggactttattgaaaacatcaagtcaatattcaatgacatacaaaacatacctaccaggatcaatattctttcctggtttagtgaattggaagtataa

SEQ ID NO: 12346 - protein, 1024 aa, Lodderomyces elongisporus NRRL YB-4239
MEFGSSNKRSRDDFEQDQGFGGSLGPTHAREHHQHPHQHLHPNPSSTSSLYESKRQRIDPAQELINNVCKDIRRLGENPNVAAQVDDVNYISNPIVAEFEKIDTLRNAILSTIYAIIVEQPHKINAISNMVFICNAKNFVIAKYVIEYLHTKIQILLDSVNGVVDVSHEKREDAGVFNNIKSILKFLSVLSPIIDDYAIINVYSQFLQFAIDLQTQTGQEKRNGIAQEIFYNTLVAMPYLLSNDKSEEVKGHLNDLIELAGKFPIVEPETNKLIQPFDSKMDNLDIPYTPKKLVDLILPSLKALQTNDWELKLFLDFEPFLEPIIKNALENNAVAKEIVKHKLPQFSLPTFDKVQAYKSKHKESIDNVWKQNLRLLFQVYNQNTEFETVPPIETYTGLFFKDLAFDILTNLSFNKNEASIQLSVLDLFFDSDLFAPLGTSIDQLTMIDADNKSGENDPPLSTWKIEDVAVESILTMIFQLPRTLHREIYYYTVLIACCKESPESMAPVFGRAIRYFYANLQTLDYELKIRFLDWMTTQISNFEFSWKWEEWVKDSQQYSQLKYHPKKNFIKNLIAKEIRLSNKKRIRESFVDVIDGNVVNFEEFYQYLDISMFANAKDYILSYDSALYGDLAEIKDLLSSLYDEKQALLLAKSNPSYQEEIFFNFTNPRLPLHATGLRTYEFIMSHHKSNKDFSELYKSILDDVNKLNEEASQSLGGNNGETKETEETRETDETEATKETDETDKTKQQQQQQQQQQQSQHLEALIPEPVKFAINLIMQSYCYIGSRSIYSEVSILSRDADKLKYLSGQPIEPKTTAPVSLVEGETEFENLDLTEEDVQNRQNWIIDSIFRIWVHQPQVVFLILENLIEFGVIKPEFLLAKAFKSNLIIDNVSCMESVNRILENSKPAVLKQGIAVLFKTIVARLNELELGVDEIVNIDELDSSNAERVDKQWLFYEYLGLLKSYFRKFIKQQDFDENGGSDGAAANDEEANKDFIENIKSIFNDIQNIPTRINILSWFSELEV

SEQ ID NO: 12347 - DNA, 2466 bp, Magnaporthe grisea 70-15
  CDS (1)..(2466)
atggccgattacgatcgtcgatatcgcggtgatggtggtcgcggaggctacaacccaaggaagcgcaggtacaatgatgacgacgactatggccgaaatcgcggtggtggccgtcgacgacacgatggtagctcccacgcaccacccttcatccggatacgaaagcagctgctgggccttgccgagtcagcggcgcgcaagtggcatgaggatgtcgtctctgtttcgcggctggtcgtagagaattatgacgacgagttcgtgcgcaacggcttcctggacctcgtgtgccagcttgtggtcgagcaaccactcaaaaccccatttgtcgccgccgttgtcctagtcacaaacacgctcaagtctgagcttgttgccgagttactggccagggtgggcaaggccttggaaacagccatcacagcgggcgagtggcgcgatgtcaaggcgctgcttaagctgctggcatgccttcagacatgccttgagggtgaaggcatcttccctgtactggatgagttgttcaaccgcgcagttgacctgcagactgcgagctctgatgataccattggtatcgaactggtcaagatcatcctcctgacaattccatacatcatggctgcggcgcctggccagtggatagacaaggccgctgagctgatggacaagaccgacgtcatcgcctctgaagaccacccaatgcagaagctggttgacccatactgccccgaggcgggcgagaaggacgtggaggcatcgccgagtctgcttagtctgctgcagaaacagctccagactgaggcgggtaatggctggggccttgagtgtctgcctcgggcgtggaagatgcccctagaggaggtcgagcagcagtccaagttggacgactgtcccaggcaccctctgcctaccatatcggtccctgagactataatcgcgggcagccgaccgctcttccctgaggtttctatctcgatctacgctgcacaggatgtcgcctcagtaccccctgacacgaccatcgcagcctcgctcatacgtgacgccattctcgatacgatcaataccctgcactacaaccgcaacgtagtggcgcggtttttgattgacctcgactgttatttctcaaacggcactttcgtcaaacgtgctacgccttttgatcgtttgcgagacgtggaggcgggcaagtcgacttggaagcctgaagacgtagtggtggatgccgtattctctcagattctgcagctacccaggccggaacacaagttggtgttttatcattctgttctgacggagacgtgcaagatcgctccagccgccattgcgccaagtcttggaagggcaattaggcacatataccgcaacattccgcgccacgatctggagctgaatcaccgcttcatcgactggttctcgcaccatctgagcaatttcggattcacctggaagtgggttgaatgggttgacgatgtagagctgccagctctacatcctctcaaggctttcattgtcggtgctctggacaaggagatccgactgagctttgcgcagcgcataaagaacactgtgccggacgagtacaagtcgttgatcggtcccgagaaagagatagacgttccggaattcaagtacaagaatgatgatgttccttttgcttctcagggacgtgagatagcaaacctcctcaagaagaaagagccggatgaggccatccagcccttgattgaggaaatacaaaacggtgcggtcgaccaaggccttgatcctttggtcaccagcaccgatgtctttatgacagcagttctggccgtggggagcaagtccttgtcgcatgtgcttgcatgcatcgagcgagtcaaggacagacttcttgatgccggggccgcatcggttgctgcacggatacaggttatcgaggccgtcatggcatactggtccgcccatcagggcgtggccctttccatcgtcgagaagctgctcaattacgccatcctgacaccggccgtcgttgtcgagtgggccgttggtgcaggacgaggcgcagttactgccatagaggatgacgagtcacggctggcgcaagatcacatctacgagctcgttctcaacactgtccgcaaggttactggccgagtgaggcaagtggccctgaccaaggcgcaaaacctggatggtgatgtctccatgactgaggaccaggacggccccgaggtcaaagagatgcgcgagttgtttcagcttatagagcacgctctcgcagcaagggcatcgtcgcttgcaagcaataagctactcgcccgcctctgggtggaccgctggcaacgcgcatttaagagatgcgcggccattgaggagaacttcctgatcgaggtagagaagaatcgcaagaagcaggcggccattgctgctgctgcacctgcccccgaggccaagcccgaggtcaaggacggcgacattgagtaa

SEQ ID NO: 12348 - protein, 821 aa, Magnaporthe grisea 70-15
MADYDRRYRGDGGRGGYNPRKRRYNDDDDYGRNRGGGRRRHDGSSHAPPFIRIRKQLLGLAESAARKWHEDVVSVSRLVVENYDDEFVRNGFLDLVCQLVVEQPLKTPFVAAVVLVTNTLKSELVAELLARVGKALETAITAGEWRDVKALLKLLACLQTCLEGEGIFPVLDELFNRAVDLQTASSDDTIGIELVKIILLTIPYIMAAAPGQWIDKAAELMDKTDVIASEDHPMQKLVDPYCPEAGEKDVEASPSLLSLLQKQLQTEAGNGWGLECLPRAWKMPLEEVEQQSKLDDCPRHPLPTISVPETIIAGSRPLFPEVSISIYAAQDVASVPPDTTIAASLIRDAILDTINTLHYNRNVVARFLIDLDCYFSNGTFVKRATPFDRLRDVEAGKSTWKPEDVVVDAVFSQILQLPRPEHKLVFYHSVLTETCKIAPAAIAPSLGRAIRHIYRNIPRHDLELNHRFIDWFSHHLSNFGFTWKWVEWVDDVELPALHPLKAFIVGALDKEIRLSFAQRIKNTVPDEYKSLIGPEKEIDVPEFKYKNDDVPFASQGREIANLLKKKEPDEAIQPLIEEIQNGAVDQGLDPLVTSTDVFMTAVLAVGSKSLSHVLACIERVKDRLLDAGAASVAARIQVIEAVMAYWSAHQGVALSIVEKLLNYAILTPAVVVEWAVGAGRGAVTAIEDDESRLAQDHIYELVLNTVRKVTGRVRQVALTKAQNLDGDVSMTEDQDGPEVKEMRELFQLIEHALAARASSLASNKLLARLWVDRWQRAFKRCAAIEENFLIEVEKNRKKQAAIAAAAPAPEAKPEVKDGDIE

SEQ ID NO: 12349 - DNA, 2577 bp, Candida glabrata CBS 138
  CDS (1)..(2577)
atgattcttgtaacagattttgatgatgaagattaccacgactatagacctcgtatgcctaaaaggcagaggattccacctgtggtccaattgtgtaaagaaatgatgcctgatattagaactattggtgaatctgtcaaggcttttgaagaagatattcaatttttgagtgatgccatagtaaacgaatttggtcatgaagaatatttcaatgatgctttattgcaaacgtttagagccgttgttttggaacaaccacagaaactaccagcaattgccctattgacgatggttgtcaattcaagaaatgaggctgctggtaagggtgtggtcaatttcttcttcagtgaactacaaaaatattgcaaccaaagtgttgatcctgaatacaagccagaatctagtgatactggtccatggaacaagattaaattaatcttgagatttttggcaacattatctccaatgctgttgaatgatgagttgatctccatcttcaaagattttttgcagttgagtatagatcttaaccaatctgatactaacaagaggaacccattatctgaagcgctgtacacaaacacactacttaacataccttatctgtttttcttcaacagaaatgatgacgacttgaaacaaaaggttggttctcttctagagtttgttgaagataattataaggtgaaatcaacagaaattaatctcttaagagaatataataatggtgctccatttgacagtgcagagcttgttcaattagttttaagcaatgtcaaaaagtcactaatggatgatttgaaggatctagaacaattatttcctgattggatacatttgttaactgaacaatctggcgaccaaggatttaacgaccctctccaacttccaagtattgaagatcttgccgaatatatggatttggggcaccagagaggttctgtggattctatgtggcatacaccaaggtatgttttcaaagtttatgttccaaatgagacacatgactttgaaactgtgatccctatcactacatatgctggccaactgttcaatgatattattattgacttagtagagagtttagagtttaaccgtaaagaagttgcaagacaagttgtttcattggatttgttttttaagaagggaatatttgcagaacctggcatctctattgctcagctatcgaatgtttatgaagagaatcctttagccactacatttaaaattgaagacttggctattgaaacaattattagtctaatcttcaaattgcctgatgtttctcaaccatttgcttatttttacaccctgttagttgaaatatgtcaaaattctccaaaagcaatcgcacctgtatttggtagggcatttagatttttctacagtcatttgaaaaatatggattttgaattaaggttacgttacctagattggttttcaattcaaatgagtaacttcaacttttcttggaagtggaatgaatgggaggacgattctaaaaatctatcaaagtctttctacgatcccaacataaactttatcagaaatttgattcataaagaattgaggttgacatctaatcctattgatgttgaagaaagtttacctgaagagtttaagcaatatctggattcgtcatacattgctcatgacgcattagttgcttattatcagtcattttatgttgattacactgttgaaccaatcaacattaaaaagaatgatttctatttcaagcacgagtcatctcctcttagggatgttgttgttgaattattagattacattcataaacctaataatactcgtgaagtttctgagttagaacaacttcttgaaaagataaaagctaatcatggctccataatcaaaaattttgatcgcttcataatagtattaattgtacaagctttgttggaatctggtagtaggtcactttcccacgctaataaatacatcagcgatcttaaagacgattttaaatatgttctggataaaattgagcttgatcaagatcaaaaggaatttattattattgaagcagttataaggttttggaattcgaactctcagaatggttatttgattgttgatgctttcaagtttgctgagcttgtttcttctagaagtattatcaatttcgctcttaatgaggaattggctaacaattacggattagtcgatagcactgcaattgaagctatcttcagaactctatcgcatgaaataacattagaaattgagcatgcggacgactttgagtttgtcttagagaaactatgcattatcataaataacactgttagtcagctaaacattcaattagatgaagatattgatgttcctcagatatttgaattaacagatggagacaatgcatctgacttggctgcatatgacttgaaatggaaatactacacatcaattgtttttattaagagtttgctgagaaagtacagcctcaagtacaagagtctatcagacaagattttgggtaatttagacacagctgtacctcatcaatcaaccaaagagcaaataaagatttggttgggtgagcttaatagcatatga

SEQ ID NO: 12350 - protein, 858 aa, Candida glabrata CBS 138
MILVTDFDDEDYHDYRPRMPKRQRIPPVVQLCKEMMPDIRTIGESVKAFEEDIQFLSDAIVNEFGHEEYFNDALLQTFRAVVLEQPQKLPAIALLTMVVNSRNEAAGKGVVNFFFSELQKYCNQSVDPEYKPESSDTGPWNKIKLILRFLATLSPMLLNDELISIFKDFLQLSIDLNQSDTNKRNPLSEALYTNTLLNIPYLFFFNRNDDDLKQKVGSLLEFVEDNYKVKSTEINLLREYNNGAPFDSAELVQLVLSNVKKSLMDDLKDLEQLFPDWIHLLTEQSGDQGFNDPLQLPSIEDLAEYMDLGHQRGSVDSMWHTPRYVFKVYVPNETHDFETVIPITTYAGQLFNDIIIDLVESLEFNRKEVARQVVSLDLFFKKGIFAEPGISIAQLSNVYEENPLATTFKIEDLAIETIISLIFKLPDVSQPFAYFYTLLVEICQNSPKAIAPVFGRAFRFFYSHLKNMDFELRLRYLDWFSIQMSNFNFSWKWNEWEDDSKNLSKSFYDPNINFIRNLIHKELRLTSNPIDVEESLPEEFKQYLDSSYIAHDALVAYYQSFYVDYTVEPINIKKNDFYFKHESSPLRDVVVELLDYIHKPNNTREVSELEQLLEKIKANHGSIIKNFDRFIIVLIVQALLESGSRSLSHANKYISDLKDDFKYVLDKIELDQDQKEFIIIEAVIRFWNSNSQNGYLIVDAFKFAELVSSRSIINFALNEELANNYGLVDSTAIEAIFRTLSHEITLEIEHADDFEFVLEKLCIIINNTVSQLNIQLDEDIDVPQIFELTDGDNASDLAAYDLKWKYYTSIVFIKSLLRKYSLKYKSLSDKILGNLDTAVPHQSTKEQIKIWLGELNSI

SEQ ID NO: 12351 - DNA, 2574 bp, Kluyveromyces lactis NRRL Y-1140
  CDS (1)..(2574)
atgtcaaaaagaggttttgattatgaagaagagagtggttatcgtgaagcgaggccacattttgccaaaaggcaaaggctgccacccgttgtcatgctttgtaaggacatgatgcctgatatcaggaccatgggtgaatcggccaaggcttttccagaagatatcaagttcctaagtgaggccattgttcatgaattcggtaatgacgagtatttcaacaacgcacttttgaaaactttcagagcagttatcttggaacaacctcataagcaaccaggtattgctcttttaaccatggtgctaaattcagctaaaccagaaattggtaaaagtattttgaattatttctttgaccaaattcaagagttacttaattcaagtcatgaccccgactaccaaaccaaatctcatgatattggaccatgggataaaattaagttagtactcagatttatctccattctatcgccaatggtggtaccagatgatttgcttgacttgtacaagaaattattgcagtttaccgtcgatttaaacaattccacggagaaaagatccccactttctgaagccatctataccaacaccttgttgaacgttccatatttgttctacttcaactcggataatcgtgaatcgttaaaaactttagttgaggagttactcacttttgtcgaaaacgaatataacattaaagatactgatattcaattgctcaaagcatacaataagaacccaccatatgaaccagttcattgggttactgctgtcttgccaaatgtcaagaacgcattggcaaacgatatgcaacaactaggcgagcttttcctgaattatgacaccttattgacccaacaaatagcaattcattcttttaatgagccgttgaatctaccaactttagaacaaattattccattttcaggtttagacaaaggcttcggttcagtcgatagtctatggaaaactccaagatattcattcgaggtttacttaccgaacagtgtgggtccattttctaccgtgataccaactaccaccttcacaggtatgttatttcaagatattcttcttgatataatcgaaagtatggagttcaatagacttgaagttgcgagacaattagtaacgattgatcttttcttcactgcgggtattttcactgaaccgggccttcctgtcgcccaactcttggaacaatttgaagaaaacccagcaagaagtactttcaaaatcgaagatttagccgttggtgccatcttagaattaacttttaaattacctactgtttctcaatcttttgcctatttctattctcttttggtagaaatttgcaagaactcgccaaaagctattgctcctgttttcggtagagctttcagatatttctataacaatttggataaactagacttcgagttaaaagctaggttcctagattggttctcaattcaaatgagtaacttcaatttctcatggaaatggaatgagtgggaagttgattccattcagtggaatagaactatttacaatccaagaatgatattcattaagaatttgatcagaaaggaattaagattaacgtccaattctgctgatgttgaagaaagtgttactgatgaattccaaaaattcatggatccatctttcatcaagagagaagatcttgttaactattactcctctcttttcaaagatttccaattggatgaaggcgatcttcgtaacaatgagctatatttcagatctccatctttcccattccatgaaaacgtaactcaacttttggatttcttccacaagcaacctgacaccagatctgttgcagagttggagggtattctcaaggacattgctgtaaaccatgggtcaattattgaagatttcaatagatttactgtgactcttctgattcaaaccattgttttctgtggtagtagatctctctcccatgcaaacaaatatattgatgattcgagagaagagttgaaagcaattatggcacaggtagaggtgtcgccgcaaattaaagatcaatggatttgtgaggcggttgtcagatactggaatagtaactctcaaactggttacttgattttggactctttgagatataatggtctaatttcaaatgaatcagttttaaacttttctttgaccgaacagtgtggagtaaacatgagtctcgtcgactctacttctattgagtctattttcagaattttgaatgagctggctatggctgctgacaaagatgttggttcttttgagtatgtcttcaacaggttggtgggtgctgctaacgaggtattgtcgcaattgaacactattgatccaattgttgttccagatcttgatcaagacattcaggcaacagacgaagagttaccatcattagaccttgcgtggaaatacgaagcaattatgggtttcttaaagagtgtgctcagaaaatactcggatgagtttagcgttctgacggaaaagttcatcaatgatgtattacaaggcgtgccacatgaacccaccaagcaacaattgaacagatggatttcggaagtttcagaattatga

SEQ ID NO: 12352 - protein, 857 aa, Kluyveromyces lactis NRRL Y-1140
MSKRGFDYEEESGYREARPHFAKRQRLPPVVMLCKDMMPDIRTMGESAKAFPEDIKFLSEAIVHEFGNDEYFNNALLKTFRAVILEQPHKQPGIALLTMVLNSAKPEIGKSILNYFFDQIQELLNSSHDPDYQTKSHDIGPWDKIKLVLRFISILSPMVVPDDLLDLYKKLLQFTVDLNNSTEKRSPLSEAIYTNTLLNVPYLFYFNSDNRESLKTLVEELLTFVENEYNIKDTDIQLLKAYNKNPPYEPVHWVTAVLPNVKNALANDMQQLGELFLNYDTLLTQQIAIHSFNEPLNLPTLEQIIPFSGLDKGFGSVDSLWKTPRYSFEVYLPNSVGPFSTVIPTTTFTGMLFQDILLDIIESMEFNRLEVARQLVTIDLFFTAGIFTEPGLPVAQLLEQFEENPARSTFKIEDLAVGAILELTFKLPTVSQSFAYFYSLLVEICKNSPKAIAPVFGRAFRYFYNNLDKLDFELKARFLDWFSIQMSNFNFSWKWNEWEVDSIQWNRTIYNPRMIFIKNLIRKELRLTSNSADVEESVTDEFQKFMDPSFIKREDLVNYYSSLFKDFQLDEGDLRNNELYFRSPSFPFHENVTQLLDFFHKQPDTRSVAELEGILKDIAVNHGSIIEDFNRFTVTLLIQTIVFCGSRSLSHANKYIDDSREELKAIMAQVEVSPQIKDQWICEAVVRYWNSNSQTGYLILDSLRYNGLISNESVLNFSLTEQCGVNMSLVDSTSIESIFRILNELAMAADKDVGSFEYVFNRLVGAANEVLSQLNTIDPIVVPDLDQDIQATDEELPSLDLAWKYEAIMGFLKSVLRKYSDEFSVLTEKFINDVLQGVPHEPTKQQLNRWISEVSEL

SEQ ID NO: 12353 - DNA, 2907 bp, Debaryomyces hansenii CBS767
  CDS (1)..(2907)
atggattctttcaatccatcgaagagaactagagacgaattcgaaagagacaatcaacatacagaactagatgttgattctaaaaagcaacatttagatccaactactgaattagttacaaatgtttgtaaagatatcagaagaatcggagaaaatgcaaaccttacaagccagattgacgatatttcatatatttcaaatccgatagttgcagaatttgaaaagattgataaattgagagtttctatcttaaacaccttatatgctattataattgaacaaccccagaagataacttcattgagtatcttaatcttactatgcaatgctaaaaacttcttagtatccaaatacgttatagaattctttcattcaaaagcacaaggattgttagagaaagtgagcgaagaacaagaaaagaagaacgaagaaaaaaaggatgaagaaatgaaggatgaagtagaagaaggagaagggaaagagaataatggtaagaaagaagtaaatgaagacttgcagcgagaagatgcaggtatattcaataatttgaaatcaattttgaaattcttagcttgtttgtcccctataatcgataattattcaattatcaatgtttttaaacaatttttgaatctatccattgacttacaaaaacagactgaaagcaggaatggaattgctgaagaaatattctataacaccttaatctctttaccatacttattgagtaatgattcttcagaggaaataatcaatcattgtaatgatttgttagaaattgcgtctaactttgaaattaaagaaggcgccaaatccatctcgttactacaaccatttgattcaaaattaaacaatttttcagatcagttgccatatagtcctgaaaagatgataaatgtaatctatccatccttactcgctttacaaggggaaaataaagactgggctaatttaaatggtaaattattcttgaatttcaaagaattaattgatcctattattgaaacttcgttgaaaaataatgtaatttcgaatgaaattgttaagcattcgttgccacaattatctctcccttcagttgaaactttatcaacttataagccacagggtttaattgatgatttgtggtataggaatactagacttttatttcaagtttacaataccacggaatttgaaacagttccagctgttaactcttattttggattgatctttaaagatttggcattcgacatcttaacaaatttatcattcaataagaatgagacagcaatccaattgtcaatcttagatctttattttgcgaagaatttatttgcaccaccaggatcctctgttgatcaattaactttgattaataatgataacgtctcgggtgaaaacaatccaccattgtctacctggaaaattgaggatattgctgtcgaaagtatattgacaatgattttccaattaccaaacccattgaattatgagatatattactataccgtgttaatagcttgttgcagagaaagtcctgaatcgattgcccctgtatttggtagagctattagatttttttataacaatttagaaactttagactacgaattaaagattcgttatttggattggatgacaatccaaatttcaaattttgagtttagctggaaatgggatgaatgggttaaagattctcaaaagtttaagaatttaaaatatcatcctaaaaagaatttcattaaaaatttaatagcaaaggaagtcagattatcgaataaaaatagaatcaaagaaagttttgtaacagttcatccagacccggctgcaaccgataaattaattcttttggatgagttttatcaatatttgaatatttcattatttccaaatgaatcaaaatatattattgattacgataatgaattatatggcaataacgatgagctcaaagaagttttggccaagttagagtttgaaagaaaggaaaaattagcaaataatataacagtttctccacaagaagaattgatttataatttttcgaattcgggtttacctttgcacgaagggtccagtaaagtttatgatttaattatagccaactggaaaccaaatagcgaattctatgatttatataaggagatttcaacgaatttagatgattacgcgtcaataaattcggacaaattccttattaatttatttttccaaacttacgcatacattggatccagatcaatctattctgtggttagtctattatcgagagatataatcaaattgaaattcttgagtggtgtggaaataaaggatgaaaattatcaagcaagtgaatttcagtttccggttgctgaattggctgagcaacactttgataacaagcagaattggattattgattctatcttcagaatttgggttcatcaacctcaagtagtgttcttaattttagagtacttgattgaatttgaagtattaaaaccaaagtatttaataggcaagacattaaacttagcttccaatttaattattgagaatgtctcttgtatggaatccgtcaataggatcttgattaacttttctaaatcttctaatgatgagttcaaagtccttacgttgaaattatttgagttgattgtcaacaacttgaatgagataaccaaaaccctagaaactaataactctgatgaggtaacaattcttaaggattttagtgatgaagaatccgaagacatagaattaatgaacaaagttgataaccagtggctattctatgaatataaaggattattaaagagttacttaagaaagttcagtattcataactccaatttcatcgacgaaattgaaacaatatttaaaggcattgaaaacgagccagttagaaatgatacgttgaattggttgatagaattatag

SEQ ID NO: 12354 - protein, 968 aa, Debaryomyces hansenii CBS767
MDSFNPSKRTRDEFERDNQHTELDVDSKKQHLDPTTELVTNVCKDIRRIGENANLTSQIDDISYISNPIVAEFEKIDKLRVSILNTLYAIIIEQPQKITSLSILILLCNAKNFLVSKYVIEFFHSKAQGLLEKVSEEQEKKNEEKKDEEMKDEVEEGEGKENNGKKEVNEDLQREDAGIFNNLKSILKFLACLSPIIDNYSIINVFKQFLNLSIDLQKQTESRNGIAEEIFYNTLISLPYLLSNDSSEEIINHCNDLLEIASNFEIKEGAKSISLLQPFDSKLNNFSDQLPYSPEKMINVIYPSLLALQGENKDWANLNGKLFLNFKELIDPIIETSLKNNVISNEIVKHSLPQLSLPSVETLSTYKPQGLIDDLWYRNTRLLFQVYNTTEFETVPAVNSYFGLIFKDLAFDILTNLSFNKNETAIQLSILDLYFAKNLFAPPGSSVDQLTLINNDNVSGENNPPLSTWKIEDIAVESILTMIFQLPNPLNYEIYYYTVLIACCRESPESIAPVFGRAIRFFYNNLETLDYELKIRYLDWMTIQISNFEFSWKWDEWVKDSQKFKNLKYHPKKNFIKNLIAKEVRLSNKNRIKESFVTVHPDPAATDKLILLDEFYQYLNISLFPNESKYIIDYDNELYGNNDELKEVLAKLEFERKEKLANNITVSPQEELIYNFSNSGLPLHEGSSKVYDLIIANWKPNSEFYDLYKEISTNLDDYASINSDKFLINLFFQTYAYIGSRSIYSVVSLLSRDIIKLKFLSGVEIKDENYQASEFQFPVAELAEQHFDNKQNWIIDSIFRIWVHQPQVVFLILEYLIEFEVLKPKYLIGKTLNLASNLIIENVSCMESVNRILINFSKSSNDEFKVLTLKLFELIVNNLNEITKTLETNNSDEVTILKDFSDEESEDIELMNKVDNQWLFYEYKGLLKSYLRKFSIHNSNFIDEIETIFKGIENEPVRNDTLNWLIEL

SEQ ID NO: 12355 - DNA, 2604 bp, Yarrowia lipolytica CLIB122
  CDS (1)..(2604)
atgtcgtacaacaagcgaggacgagatgacgatgacgggtatgacggcgggcgacggcagcgacacacgcagaccacgcaccagatcttcgaccggctgtactttgacattgtcgagataggcgacccttctcgaatgtctctgacaaatcgagttgctcaggcgggattcggatttgcgcaggatctggacaacctggcgatccgaaacggagttctcgagacgttcattgccacgatcatggagcagccccacaaaacaccgctggttgcagccattgttctcgtggccaactcctccaactcgctggcaggtcagctggcagtggagcatctgcacagcaagattgaaggatggctcaagcagggcaactataaccacgtcaagatagccgtgcgacttttggcgtgtctcgaaggagccattgaggagggacgaggagtgctggttttcctggatcgactgttggatcgagcaattgagcgggaccaggccaagggtagcgagtcgcgtgatcccctggtggaggagctgtacgccaccatatttctgactcttccctacatcggatccactttggtgtctctgggcaagtctgtggaggcctgtgatcagctgctggagaaggccaacggtcatttcggtatcgaaaagttcctgtcgaaccccatcgtcgagccctacaccggcgacgacaagccctacgagtgcgatctgttcctggccaacctctacgagggagtcaactccgtggccaaggacggatgggccgtcaagtcgttcatcaacgtgttagaactgattgagcctgtggtggagaacaaggaggtgacccagaaacacgttttcccggcagtttctattcccgagactctggccgagtccacttccacagactacatttaccccagaatcttcttccgagcctacatgcccattgacgtggaaggcgaggccatgaacacggttccagaccccaagtcatacgacgctgtgctgtggagagacatgctgtcagacaccatccagaatctcgactttaaccgaaaagagtgcgccaagcagctgttcacccttgatcttttcctcaacaagggcaccttcacgggacccggaatctcggtagacaagctaagtggcaagtttttggatgccaaggccgacgacagacccatctccactctcaaggtggaagacgtggcgtctgaagccatcctggcagagctttttcggctcgccacacctcctctacagcctgcgtactttcattctctgttcatcgaggcatgtatcatggcccctcaggccattgcccctgttttcggccgagcggtgcggttcctgtttgccaacctgcggtcgtttgacacagagctaatccaccggttcctggactggttttcgcaccatctgtccaactttggattcacctggaagtggcaggagtgggtcgagtacgtcgatctggaacctctggaccctcggctcgtctttatcaagcagctcatcaagaaggagctccgtctgtcattcgagtcgcgaatcaaggagactctccccgacgaacttgtggtgtttgtgcctactgacggcgagttgatgccaacctacgagtacattgagtctgagaaccagtacagagaagtcgccgaccagttgttggacgtgttcaaggacaagtacgaccagggtgtctccgagacatacctcgaggtgattgattccatcaaggaggctgtccccgacaacagagagctcctactggacattgtcatcggagccgccatctttgttggctctcgatcactgtctctgtcccaggactggattaaccgtcttgcccagcagctccagcacgtgattgagtctgctgaagatgagtctgctgccgtgacaaccgtcatgcagttttaccgaaaccagccccatgtaggaaccgttgttctgcactttttgctgcttgaaaacgtcatttcgcctgctgctattatcacctggctgtttgagtcgccgggcgatgttgttttcaccgagaaccacggttgggagtgtctgattcgaactctagatgaggtggcccaggagggagaggtgcaggatcacgttggacccttcaagagtgttttcgagtacctggccgtcaaggactccgactcggagcagctcggatggtggaagcgacaggtcaccaagtcgctcattcgaaagtacgttgattacattaagaacgagcagattctcgaagtggttcccaccaatgtcaaggacattgtcggccagtatcttgctgttcgacccattgtgccccggaagaaggtgatcatcgccgagcccaaggttgaagaggatcagcccatggctgacgctgctgccaagggtgtcaccgaggccacctcggctgtcgaatcaaaggagaccaaggaggctgaaaccgctgccgagtccaaggaggctgaggtcgcagagtccaaggaggctgaatccgctgccgagcccaaggatgctgaggtcgcagagtccaaggaggctgaatccgctgccgagcccaaggatgctgaacccgctgccgagtccaacgacaaggacgagacaatgcaggaataa

SEQ ID NO: 12356 - protein, 867 aa, Yarrowia lipolytica CLIB122
MSYNKRGRDDDDGYDGGRRQRHTQTTHQIFDRLYFDIVEIGDPSRMSLTNRVAQAGFGFAQDLDNLAIRNGVLETFIATIMEQPHKTPLVAAIVLVANSSNSLAGQLAVEHLHSKIEGWLKQGNYNHVKIAVRLLACLEGAIEEGRGVLVFLDRLLDRAIERDQAKGSESRDPLVEELYATIFLTLPYIGSTLVSLGKSVEACDQLLEKANGHFGIEKFLSNPIVEPYTGDDKPYECDLFLANLYEGVNSVAKDGWAVKSFINVLELIEPVVENKEVTQKHVFPAVSIPETLAESTSTDYIYPRIFFRAYMPIDVEGEAMNTVPDPKSYDAVLWRDMLSDTIQNLDFNRKECAKQLFTLDLFLNKGTFTGPGISVDKLSGKFLDAKADDRPISTLKVEDVASEAILAELFRLATPPLQPAYFHSLFIEACIMAPQAIAPVFGRAVRFLFANLRSFDTELIHRFLDWFSHHLSNFGFTWKWQEWVEYVDLEPLDPRLVFIKQLIKKELRLSFESRIKETLPDELVVFVPTDGELMPTYEYIESENQYREVADQLLDVFKDKYDQGVSETYLEVIDSIKEAVPDNRELLLDIVIGAAIFVGSRSLSLSQDWINRLAQQLQHVIESAEDESAAVTTVMQFYRNQPHVGTVVLHFLLLENVISPAAIITWLFESPGDVVFTENHGWECLIRTLDEVAQEGEVQDHVGPFKSVFEYLAVKDSDSEQLGWWKRQVTKSLIRKYVDYIKNEQILEVVPTNVKDIVGQYLAVRPIVPRKKVIIAEPKVEEDQPMADAAAKGVTEATSAVESKETKEAETAAESKEAEVAESKEAESAAEPKDAEVAESKEAESAAEPKDAEPAAESNDKDETMQE

SEQ ID NO: 12357 - DNA, 2661 bp, Candida albicans SC5314
  CDS (1)..(2661): transl_table=12
atggagttttcaaataaaagatcaagagacgactttgaacaagatgaaggtcaattccacgatggtcctagccatgatagttttgaccataaacgacaccatattgacccagcacaggaattgataaataatatatgtaaagacattcgaagattgggtgaagcaggtgatatcgagaacttgattgctgacacaaactatatttccaaccctatagttgctgaatttgagaaaattgacaacttgagaaactccatcttgtcaactatttatgcattaataactgaacaacctcataaaatcagtgctattgcaaacttgatattgatttgtaacgccaagaactttgtcattgccaaatatgtgattgaatatttacattcaaagatgcaaaccatgttggattctcaagaaggctcagtgtttaatgatattaagaatatattgaaatttttgagcacattgacaccaattatcgaagataacggaattatccaaatcttcaaacaatttttaaattttgcaatcgaattacaagagcaaactgaagttagaaatggtttagcccaagagatatactataatgttttgattgccataccatacgtacttagtaatgataattctgacgatttgaaaaaaagtatcaatgagttgattgaattggctagaaattttaaaatcgttgcagagtctgccactgttttacttccatttgatacaagaatggggaatttcgagttgccatatattccaaagcaaatggtagatttaattttgccagcactcataaagttacagaataatgactggaattttagattgtttcttgatttcaagactcatttggatccagtaattcaatctgctttagaaaacaactcgatttctagtgagttagtcaaacacaaattgcctcagttatcgtttccaagtgttgagaatgccagtttcaagtcaacgtcaattgataaattatggaatgataatccacgctacttgtttcaagtgtataacaacactacagagtatgaaactgttcctccaatcgaaacatatttaggattgtttttcaaagatatcgcttttgatattttgaccaatctctccttcaacaaaaatgaaactgcaattgaacttagtattttggatatgtttttcgataataaattgtttgctccaccgggtacgagcattgatcaattgaatgccatatatgaggacaacaaactgggaactaatgatccgtcattatcaacttggaaaattgaagatgttgccgtcgaaagtattcttactatgattttccaattacccaacccattggaagtagaaatttactattacaccgttttgatttcgtgttgtcgtgaatcaccagaatcaattgcccctgtgtttggtcgtgccattagatatttctacaatcacttggagacattagattacgaacttaaaatacgatttttagactggatgagtattcagttgtcgaattttgagttttcttggaaatgggaagaatgggttagtgactctaagaaattaaaagatcttaaataccaccccaaaaagaatttcatcaaaaatttaattgccaaagagattagattatcaaataagaaaagaataaaggatagttttattgatatagtagacggtgaagttgtgaatttagacgaattttatcaatacttggatatcagtatggttccagatgtgaaatcttatatcatctcatacgacacagaattatatggtgaaagtctgcgtgacacattaatccagttgtatgaacagaaacaggaacagcttaattccaaatcgaatattggtgctcaaaacgaaatatttttcaactttactaattcagaactaccatttcatgaaacagcatctaaagtttatgatttcattcttacgcattggaagtcaaacactgatttcaatgagttgtacaaatcagttcttgagtcaataactgcccctaacaatgaaaggtttgccatcaacttgattatacaaacgtatgcctatattggatcaagatccatttattctgtggtcagtattttgagtagagatatcaacaagttgaaattcttgagtggcgctccaattgattatgttggcgacgaggcacgttttgaagatttgcattttaccgaagaagaaaaacaaaatagacagaattggatcattgaagctgttttcagaatttggattcatcaaccccaagtggtgtttttgatcttggagtatttaatcgagtttggaatcattgatccaaaatatatattggtaaaggcattggaatctaacttgattatcgataatgtatcatgtatggagtcgattaatagaatattgagcaaggctgaactgaaagagttgatcatacaattattcactgccattattgataatttgaacaaattagagttggacaaagagaaacgtgtcgaaatcgaggaagtcaccgaatcaaacgctacagaagtcgataaacaatggttgttttatgaatacttgggtttattgaaatcgtattacagaaagtatatcattggtgatgtagagtgtcacgataaagttaaagaaattgtcggacaattggaaaatgcactggctaaagacgaaattcttaaatggtttggctaa

SEQ ID NO: 12358 - protein, 886 aa, Candida albicans SC5314
MEFSNKRSRDDFEQDEGQFHDGPSHDSFDHKRHHIDPAQELINNICKDIRRLGEAGDIENLIADTNYISNPIVAEFEKIDNLRNSILSTIYALITEQPHKISAIANLILICNAKNFVIAKYVIEYLHSKMQTMLDSQEGSVFNDIKNILKFLSTLTPIIEDNGIIQIFKQFLNFAIELQEQTEVRNGLAQEIYYNVLIAIPYVLSNDNSDDLKKSINELIELARNFKIVAESATVLLPFDTRMGNFELPYIPKQMVDLILPALIKLQNNDWNFRLFLDFKTHLDPVIQSALENNSISSELVKHKLPQLSFPSVENASFKSTSIDKLWNDNPRYLFQVYNNTTEYETVPPIETYLGLFFKDIAFDILTNLSFNKNETAIELSILDMFFDNKLFAPPGTSIDQLNAIYEDNKSGTNDPSLSTWKIEDVAVESILTMIFQLPNPLEVEIYYYTVLISCCRESPESIAPVFGRAIRYFYNHLETLDYELKIRFLDWMSIQLSNFEFSWKWEEWVSDSKKLKDLKYHPKKNFIKNLIAKEIRLSNKKRIKDSFIDIVDGEVVNLDEFYQYLDISMVPDVKSYIISYDTELYGESSRDTLIQLYEQKQEQLNSKSNIGAQNEIFFNFTNSELPFHETASKVYDFILTHWKSNTDFNELYKSVLESITAPNNERFAINLIIQTYAYIGSRSIYSVVSILSRDINKLKFLSGAPIDYVGDEARFEDLHFTEEEKQNRQNWIIEAVFRIWIHQPQVVFLILEYLIEFGIIDPKYILVKALESNLIIDNVSCMESINRILSKAESKELIIQLFTAIIDNLNKLELDKEKRVEIEEVTESNATEVDKQWLFYEYLGLLKSYYRKYIIGDVECHDKVKEIVGQLENASAKDEILKWFG

SEQ ID NO: 12359 - DNA, 2487 bp, Aspergillus oryzae
  CDS (1)..(2487)
atggttgactacgaacgccgtcatcacgggcctaagggtggccgcaaaaggcgctatagagaagacgatgactatgatcgacgccagagacgcaaatacgaagaacctttggtggcgaaggtccgaagacagctattaaccattgcggaatctgccgccagaagagccgaagacgatgttgtaaacattgcaaaaagcgtcgccgataattatgaggatgaggagctgagacagacttttgttgctatctcagttgaccttgccctagagcagccgctgaaaatcccttttatcgcagcgacggtcttgtctgccaatctctacagatcagagcttgtgtccgatgtccttacaaaagcgagcgaatacttacaacactacatcaacaatggggcgtggcgtgaagtcaagcttcttctccgacttcttggatgcttacagatattgtatgaaggagatggcatcttcccaatcctggaagagctttttgagcgtgccgttgttctgcagacagcctcttctgaagatttgctaggactggaactcgtgaagataattctcttcaccattccatacataatggcttctccgataacaggttttgaggctcaggcaaatgcccttcttgaaaagacagacatcattgcatcgaccccgcatgcgttggtggaattggttaatccgtttagccccgaacatgacacttcatctgctgcacaaagcgttattagcctgcttcaaagtcaactccagcaggaagccagccggaattgggaactcgcatgtcttcctcgaccgtggaaaggtggacgcgacaatgaagaagagcagaaacccttggattccggcgcaaagcatgcattccctcaaataactgtgcccgaccctgtacaaaatggatccagggcgattttccctgaagtttacatgtccgtgtattccaaccaagaggtagaaactgtccctccaacgtcggacattgcatcatctctgctgcgggacgctcttgttgacacgatcaacatcctcgacttcaatcgtattgccactgccaagtatctcattgacattgactgttactttacgccgcatactttcgtgaagcgtgcaacccccttcgacagattacgcgatatctccggagaccgcccgacgtggaagcccgaagacgtggccgtggatgcagttttctctcaattattccaacttccttccccgcagcacaagcttgtgtactatcactcagttctcaccgagtgctgtaagattgcaccggctgccattgctccgagcttggggcgtgcgattcgttttctctatcgcagcttggaaacgattgatctggatttaagccatcgattcttggattggtttgctcaccatctaagcaattttgggttcacatggaaatggagtgaatggatcgatgaccttgaactttcctcagttcatccaaagatggcctttataatcggcgcgctggacaaggagatcaggttaagctttgcccagcgtattagaggtactcttccagacccttatcaagatttgattacagaaggcaaggagaaggatacccccgacttcaaatactcattggataccacaccctatgccaacgaaggcaccgaaatcatgcagctcatccgtaaaaaagcaactgatgacgatatcctcccaataattaatgctattgaagagcaagctagggcgatgggagttgaagaccctatgctaccttcaacagatgcgttcgtcacggcaatttgcttcgttgggtcaaaatcactttctcacgtactgtcttgcattgagcgaaacaaagaacggcttctggctattggccccaagtccactcgtgcacgtcgccagattataacctctgtcatggaatattggaccgatcagccaggaatcggtatcaacatcatcgacaagttactgaattacacaatcctaacgccactatccgtcattgagtgggcactggtagacaagctcgaggccgggacgattttggcaagaacacatgtttttgagatgatatcagccactgtgggaaaggtcaccaaccgtctgcgccaaatcgttgcggcacgaactcagccaggtctgtatgagccacagttgagtgttctagatgaaaccttaaaccgtgagaaggcagatatgcaggcgctcttcaaggtaattgaagattcgattatgtcagtcgccgaaggtcacaacgatgaattgatggaaaggggtgacggaagtggtgagctaccagaggatgaaatcatcagacaatggggatgtcgatggctgagagcgttcaggcgaaaagccggcgttgaggaatcatttatcgctgaagccatggccactgcaacccctatcggaacaacggcgcctccgccccaggaaggtaccacggctatagatggtccagcagatggagatctagacgtcgcggatgcagatggggctgtggatgtctcatga

SEQ ID NO: 12360 - protein, 828 aa, Aspergillus oryzae
MVDYERRHHGPKGGRKRRYREDDDYDRRQRRKYEEPLVAKVRRQLLTIAESAARRAEDDVVNIAKSVADNYEDEELRQTFVAISVDLALEQPLKIPFIAATVLSANLYRSELVSDVLTKASEYLQHYINNGAWREVKLLLRLLGCLQILYEGDGIFPILEELFERAVVLQTASSEDLLGLELVKIILFTIPYIMASPITGFEAQANALLEKTDIIASTPHALVELVNPFSPEHDTSSAAQSVISLLQSQLQQEASRNWELACLPRPWKGGRDNEEEQKPLDSGAKHAFPQITVPDPVQNGSRAIFPEVYMSVYSNQEVETVPPTSDIASSLLRDALVDTINILDFNRIATAKYLIDIDCYFTPHTFVKRATPFDRLRDISGDRPTWKPEDVAVDAVFSQLFQLPSPQHKLVYYHSVLTECCKIAPAAIAPSLGRAIRFLYRSLETIDLDLSHRFLDWFAHHLSNFGFTWKWSEWIDDLELSSVHPKMAFIIGALDKEIRLSFAQRIRGTLPDPYQDLITEGKEKDTPDFKYSLDTTPYANEGTEIMQLIRKKATDDDILPIINAIEEQARAMGVEDPMLPSTDAFVTAICFVGSKSLSHVLSCIERNKERLLAIGPKSTRARRQIITSVMEYWTDQPGIGINIIDKLLNYTILTPLSVIEWALVDKLEAGTILARTHVFEMISATVGKVTNRLRQIVAARTQPGLYEPQLSVLDETLNREKADMQALFKVIEDSIMSVAEGHNDELMERGDGSGELPEDEIIRQWGCRWLRAFRRKAGVEESFIAEAMATATPIGTTAPPPQEGTTAIDGPADGDLDVADADGAVDVS

SEQ ID NO: 12361 - DNA, 2733 bp, Oryza sativa subsp
  CDS (1)..(2733)
  misc_feature (324)..(324): n is a, g, c or t
atgagcgcgggctggaggacgctgctgctgcggatcggcgacaggtgcccggagtacgggggctccgtcgaccacaaggagcacatcgaaacttgttatggtgtgctttgtcgagaatacgaacactccaaagatgcaatgtttgagtttctcctccaatgtgcagatcaattgcctcacaagattcctttctttggagtattgataggtttgataaacttggaaaatgaagatttttccaagggtattgtcgatacaacacatgccaatttacaggatgccttgcataatgaaaatcgtgacagaatcaggatattgctgcgntttctctgtggcctgatgtgcagcaaagttgtcctgccaaattctattattgaaacatttgaggcactattatcatctgctgcaacaatattagatgaggaaaccggaaatccttcgtggcaaccacgtgctgatttctatgtttattgtatcttggcttcccttccatggggtggctcagaattgtttgagcaagttccagatgaatttgagagagttctggttggtatacagtcttatataagcattagaaggcattttgatgatattgctttctcagtctttgaaacagatgaaggcaactctcccaacaaaaaggatttcatcgaagatttatgggagcgtattcaagttctttctcgcaatgggtggaaggttaagagtgttccaaaacctcacctgtcgtttgaagctcagctggtagctggagtttctcaccgtttctccccaattagttgcccccacctactatctcgcaatgcatcctctgaaatagtaaaaggtcaagaaaagcatgaagctgatctgaagtatcctcaaaggcttcgtaggcttcacatatttccaacaaataaagctgagaacatgcaacctgtagatcgttttgttgttgaagaatgcatattggatgtgctacttttcttcaatggatgtcgcaaagaatgtgcattttatctggtcagcttacctgtgcctttccgttatgaatacctgatggctgagaccatattttcacagctactgttattgccgaatccccctttcaggccaatttactataccttggttattatcgacctttgcaaggcattgccaggtgcatttccttcagttgtggtaggagcagtacatgctctttttgacagaattagcaacatggatatggagtgccgcacccgacttatcctatggttttcacatcacttgtcaaattttcagttcatttggccttggcaggagtgggcttacgtcaaggaccttccaaaatgggctccacagcgtgtttttgtccaagaagtattagaaagggaaattcgcttgtcctactttgacaaaattaagcagagcatagaggatgctgttgaattggaagaactgttacccccaaaagctgggcctaacttcagatatcatagtgatgaaggcaaagaaagcactgatggccacagactctccaaggaacttgttgccatggttagaggaaggaagacacaaggtgatattatttcatgggtagacgaaaaaataattcctgtaaatggtgccaaatttgcacttgatgtagttagccagacacttctggacattggctcaaaaagtttcacccatcttatcactgttttggagagatatggtcaaataatatcaaagctgtgcccgaatgaagaaatgcagttattgttgatggatgaagtcagtgcttattggaagaacagtacccagatgattgccatagctattgataggatgatgggttatcgcctactttccaatctggctatagtcaaatgggttttttctcctgctaatgttgatcaatttcatgtttcagatcgtccatgggagattcttagaaatgctgttagtaaaacatacaatcggatttttgacctccggaaagaaattcagacactcaggaaaggtcttcaagctgctaaagaggccagtgaaaaggccgccagagagttggaggaggctaaatctattattgagattgtagatggccaacctgtgccatctgaaaatccaggaaggctaagacgacttcaagcgcgtgctgacaaagcgaaagaaggagaagtaaccactgaagaatctttagaagcaaaggaggccctccttgctcgagggcttgaagaaagcaaggaattgcttaggttactattcaagagctttgttgaagtgctaactgaacgtttgccacctatttctgctgatggagatgttcctaatttacgtgctggagacccgaatgtaaattcttcagcccgtgaccctgaagcaacaaccatggaaatagacaatgaaaatggaggagataacgatagtcagctgaatggtcaaaacaagaaaatcagtcacaatgttggagagcttgagcaatggtgtctctgcacattgggctatctcaagtcgttttctcgtcaatatgctactgagatctggtcccatattgccatgttggatcaggagattttcgttgggaatattcaccctcttatccggaaagctgcttctccggtttgtgcagacctaccagtgaagggtctcacctttgattttgacccttccagtgagttggagtttacctgtattatacgcgacaaatttttcatcatgctatcactaactggacatgcccaaaagtactctgatgtgtactcaggaactccatcgattctcctgtaa

SEQ ID NO: 12362 - protein, 910 aa, Oryza sativa subsp
MSAGWRTLLLRIGDRCPEYGGSVDHKEHIETCYGVLCREYEHSKDAMFEFLLQCADQLPHKIPFFGVLIGLINLENEDFSKGIVDTTHANLQDALHNENRDRIRILLRFLCGLMCSKVVLPNSIIETFEALLSSAATILDEETGNPSWQPRADFYVYCILASLPWGGSELFEQVPDEFERVLVGIQSYISIRRHFDDIAFSVFETDEGNSPNKKDFIEDLWERIQVLSRNGWKVKSVPKPHLSFEAQLVAGVSHRFSPISCPHLLSRNASSEIVKGQEKHEADLKYPQRLRRLHIFPTNKAENMQPVDRFVVEECILDVLLFFNGCRKECAFYLVSLPVPFRYEYLMAETIFSQLLLLPNPPFRPIYYTLVIIDLCKALPGAFPSVVVGAVHALFDRISNMDMECRTRLILWFSHHLSNFQFIWPWQEWAYVKDLPKWAPQRVFVQEVLEREIRLSYFDKIKQSIEDAVELEELLPPKAGPNFRYHSDEGKESTDGHRLSKELVAMVRGRKTQGDIISWVDEKIIPVNGAKFALDVVSQTLLDIGSKSFTHLITVLERYGQIISKLCPNEEMQLLLMDEVSAYWKNSTQMIAIAIDRMMGYRLLSNLAIVKWVFSPANVDQFHVSDRPWEILRNAVSKTYNRIFDLRKEIQTLRKGLQAAKEASEKAARELEEAKSIIEIVDGQPVPSENPGRLRRLQARADKAKEGEVTTEESLEAKEALLARGLEESKELLRLLFKSFVEVLTERLPPISADGDVPNLRAGDPNVNSSARDPEATTMEIDNENGGDNDSQLNGQNKKISHNVGELEQWCLCTLGYLKSFSRQYATEIWSHIAMLDQEIFVGNIHPLIRKAASPVCADLPVKGLTFDFDPSSELEFTCIIRDKFFIMLSLTGHAQKYSDVYSGTPSILL

SEQ ID NO: 12363 - DNA, 2661 bp, Candida albicans
  CDS (1)..(2661): transl_table=12
atggagttttcaaataaaagatcaagagacgactttgaacaagatgaaggtcaattccacgatggtcctagccatgatagttttgaccataaacgacaccatattgacccagcacaggaattgataaataatatatgtaaagacattcgaagattgggtgaagcaggtgatatcgagaacttgattgctgacacaaactatatttccaaccctatagttgctgaatttgagaaaattgacaacttgagaaactccatcttgtcaactatttatgcattgataactgaacaacctcataaaatcagtgctattgcaaacttgatattgatttgtaacgccaagaactttgtcattgccaaatatgtgattgaatatttacattcaaagatgcaaaccatgttggattctcaagaaggctcagtgtttaatgatattaagaatatattgaaatttttgagcacattgacaccaattatcgaagataacggaattatccaaatcttcaaacaatttttaaattttgcaatcgaattacaagagcaaactgaagttagaaatggtttagcccaagagatatactataatgttttgattgccataccatacgtacttagtaatgataattctgacgatttgaaaaaaagtatcaatgagttgattgaattggctagaaattttaaaatcgttgcagagtctgccactgttttacttccatttgatacaagaatggggaatttcgagttgccatatattccaaagcaaatggtagatttaattttgccagcactcataaagttacagaatgatgactggaattttagattgtttcttgatttcaagactcatttggatccagtaattcaatctgctttagaaaacaactcgatttctagtgagttagtcaaacacaaattgcctcagttatcgtttccaagtgttgagaatgccagtttcaagtcaacgtcaattgataaattatggaatgataatccacgctacttgttccaagtgtataacaacactacagagtatgaaactgttcctccaatcgaaacatatttaggattgtttttcaaagatatcgcttttgatattttgaccaatctctccttcaacaaaaatgaaactgcaattgaacttagtattttggatatgtttttcgataataaattgtttgctccaccgggtacgagcattgatcaattgaatgccatatatgaggacaacaaactgggaactaatgatccgtcattatcaacttggaaaattgaagatgttgccgttgaaagtattcttactatgattttccaattacccaacccattggaagtagaaatttactattacaccgttttgatttcgtgttgtcgtgaatcaccagaatcaattgcccctgtgtttggtcgtgccattagatatttctacaatcacttggagacattagattacgaacttaaaatacgatttttagactggatgagtattcagttgtcgaattttgagttttcttggaaatgggaagaatgggttagtgactctaagaaattaaaagatcttaaataccaccccaaaaagaatttcatcaaaaatttaattgccaaagagattagattatcaaataagaaaagaataaaggatagttttattgatatagtagacggtgaagttgtgaatttagacgaattttatcaatacttggatatcagtatggttccagatgtgaaatcttatatcatctcatacgacacagaattatatggtgaaagtctgcgtgacacattaatccagttgtatgaacagaaacaggaacagcttaattccaaatcgaatattggtgctcaaaacgaaatatttttcaactttactaattcagaactaccatttcatgaaacagcatctaaagtttatgatttcattcttacgcattggaagtcaaacactgatttcaatgagttgtacaaatcagttcttgagtcaataactgcccctaacaatgaaaggtttgccatcaacttgattatacaaacgtatgcctatattggatcaagatccatttattctgtggtcagtattttgagtagagatatcaacaagttgaaattcttgagtggcgctccaattgattatgttggcgacgaggcacgttttgaagatttgcattttaccgaagaagaaaaacaaaatagacagaattggatcattgaagctgttttcagaatttggattcatcaaccccaagtggtgtttttgatcttggagtatttaatcgagtttggaatcattgatccaaaatatatattggtaaaggcattggaatctaacttgattatcgataatgtatcatgtatggagtcgattaatagaatattgagcaaggctgaactgaaagagttgatcatacaattattcactgccattattgataatttgaacaaattagagttagacaaagagaaacgtgtcgaaatcgaggaagtcaccgaatcaaacgctacagaagtcgataaacaatggttgttttatgaatacttgggtttattgaaatcgtattacagaaagtatatcattggtgatgtagagtgtcacgataaagttaaagaaattgtcggacaattggaaaatgcactggctaaagacgaaattcttaaatggtttggctaa

SEQ ID NO: 12364 - protein, 886 aa, Candida albicans
MEFSNKRSRDDFEQDEGQFHDGPSHDSFDHKRHHIDPAQELINNICKDIRRLGEAGDIENLIADTNYISNPIVAEFEKIDNLRNSILSTIYALITEQPHKISAIANLILICNAKNFVIAKYVIEYLHSKMQTMLDSQEGSVFNDIKNILKFLSTLTPIIEDNGIIQIFKQFLNFAIELQEQTEVRNGLAQEIYYNVLIAIPYVLSNDNSDDLKKSINELIELARNFKIVAESATVLLPFDTRMGNFELPYIPKQMVDLILPALIKLQNDDWNFRLFLDFKTHLDPVIQSALENNSISSELVKHKLPQLSFPSVENASFKSTSIDKLWNDNPRYLFQVYNNTTEYETVPPIETYLGLFFKDIAFDILTNLSFNKNETAIELSILDMFFDNKLFAPPGTSIDQLNAIYEDNKSGTNDPSLSTWKIEDVAVESILTMIFQLPNPLEVEIYYYTVLISCCRESPESIAPVFGRAIRYFYNHLETLDYELKIRFLDWMSIQLSNFEFSWKWEEWVSDSKKLKDLKYHPKKNFIKNLIAKEIRLSNKKRIKDSFIDIVDGEVVNLDEFYQYLDISMVPDVKSYIISYDTELYGESSRDTLIQLYEQKQEQLNSKSNIGAQNEIFFNFTNSELPFHETASKVYDFILTHWKSNTDFNELYKSVLESITAPNNERFAINLIIQTYAYIGSRSIYSVVSILSRDINKLKFLSGAPIDYVGDEARFEDLHFTEEEKQNRQNWIIEAVFRIWIHQPQVVFLILEYLIEFGIIDPKYILVKALESNLIIDNVSCMESINRILSKAESKELIIQLFTAIIDNLNKLELDKEKRVEIEEVTESNATEVDKQWLFYEYLGLLKSYYRKYIIGDVECHDKVKEIVGQLENASAKDEILKWFG

SEQ ID NO: 12365 - DNA, 2583 bp, Ashbya gossypii
  CDS (1)..(2583)
atgtccggcatgaagcgaagatatgactacgaagaagaagatggctaccgtgactttctgtcacgctactcgaagcggcaaaagactgccacctgtggtccagcttgcaaagatatgctacccgacatcagaacgatcggtgagtcggtcaaggccttcgaggaggatattaaatttctaagcgaagctattatcaacgaattcggcaacgacgaatacttcaacaacgctcttctgtccacattcaacgcgctaatcttagagcagccccataaacagccagcgattgcgcttttgaccatagtggtcaactcaggtaacccagctgccgggaaaagcgtgataaactacttttatgaaaagctacaacacttgctcgatatgactgttgtagatgacttcgaggtcacatcaaatgaaacagggccatggaacaagataaaactaacactaagatttctttccttgttatccccagtgattacgttaacggagcttaccaacgtatatcagcggttattcgaactagctgtgcagttgaacaggagcagcgatgctaacacaaggaacccgctttcagaagctatttataccaacactttgttgaatattccttatttgtttttcttcaacaaggaagatgaaacgttgagaacaaatgtggaagatttgattcaatatgccgagtcaaactatgaggtgaagaccgttgacctatctctcaccaaagaatacaacaaaaacttaccctatgagcctgttcaatgggttcagattgtcttatccaacgtcaagaacgctttggccaacgatatggaggagctaaagaacttattcccagactatcaaaatttacttcctacgtccatagaacagcaaatgttcaacgatcctttaactattcctgagttcgagaaattattgccattcagcggtttagataagggattgggatcggtggacagtatgtggaagaccccaagaacagcattccaagtatatttacccaatgttgttggtgatttctccactgttgttccgattaccacctatacaggaatgttattcgatgatattattgttgacatcgttgaaagcttggaattcaacagacatgaagttgcacggcaggtggtaacattggatttatacttcaaacccggtatcttcacggaaccagggttatccattgcgcaattgttagtacaacacaatgaaatgcccgaactgtcaacctacaaaatcgaagatttggctattgaaaatattttggggttgattttcaagttacccaccgttacgcaatccttcgcgtacttttacacgctattggtggaaatctgccaaaactcaccaaaagcaattgctccagtattcgggagagctttcagattattctataacaatttggacaacatggatcatgaattgaaaatgagatacttggattggttctctattcaaatgagtaatttcaatttctcatggaagtggaatgaatgggagcaggattcaatcgccttttctaaatctttctacaacccgaagattacatttgccaaaaacttgatcagaaaggaactacggttgacatctaaccggcctgatgttgaagatagtttgacccctgaattcaaacaatatttggatgcttcctatatttctaaagaccagttagcatcgtactatcaatctttctttgagggtttcagctttgatcctgaggtcataaaggataatgatttgttgtttaagaacgaggttttccccttccacgagaaggtacaacttattttggattatattcacaaacaaccgttagaaaagaatatatcagaattagaatcattattggaggatatcaaatctgctcatggcgataagattcccgactttaatagatttacggtgacgctattgatccaggctttggtttactctggtaacaggtccttgtcgcatgcgaataagtatatctcagacgcgaaatccgatctagttactatcttggagaaaatggaagtccctccagaagttaaagagcagtggattatcgaagccgttatcagatactggaactgtaactctcagaatggtttcttaattgttgactcttttaaacatagcgaattggtcactgcaaagtccattttgaccttctcgttgaccgacctgaatgggcagaatttggggttggtggatgcaacttcgatagaatccacatttaggacattaacagagctagccctacaacaagccagtgatatcagtgtgtttgaatttgtattcgagcgtttgttggagattataaacgacactgtttcccaactaggtacgaatgaggagatagtggcaccaagtgttgataatgagacaatgctcgatgtggatgaattggctcgcctagacctaatttggaagtatgaaagcgcagttggcttcatcaagagtatcctaagaaagtactctgatgagtattctgtacttttggacaaattcagcgcaggtcttgagcaggctgtgccgcatgaaccaaccagaaagcaattggatcagtggtttaatgaaattcgcgagttatga

SEQ ID NO: 12366 - protein, 860 aa, Ashbya gossypii
MSGMKRRYDYEEEDGYRDFLSRYSKRQKTATCGPACKDMLPDIRTIGESVKAFEEDIKFLSEAIINEFGNDEYFNNALLSTFNALILEQPHKQPAIALLTIVVNSGNPAAGKSVINYFYEKLQHLLDMTVVDDFEVTSNETGPWNKIKLTLRFLSLLSPVITLTELTNVYQRLFELAVQLNRSSDANTRNPLSEAIYTNTLLNIPYLFFFNKEDETLRTNVEDLIQYAESNYEVKTVDLSLTKEYNKNLPYEPVQWVQIVLSNVKNALANDMEELKNLFPDYQNLLPTSIEQQMFNDPLTIPEFEKLLPFSGLDKGLGSVDSMWKTPRTAFQVYLPNVVGDFSTVVPITTYTGMLFDDIIVDIVESLEFNRHEVARQVVTLDLYFKPGIFTEPGLSIAQLLVQHNEMPELSTYKIEDLAIENILGLIFKLPTVTQSFAYFYTLLVEICQNSPKAIAPVFGRAFRLFYNNLDNMDHELKMRYLDWFSIQMSNFNFSWKWNEWEQDSIAFSKSFYNPKITFAKNLIRKELRLTSNRPDVEDSLTPEFKQYLDASYISKDQLASYYQSFFEGFSFDPEVIKDNDLLFKNEVFPFHEKVQLILDYIHKQPLEKNISELESLLEDIKSAHGDKIPDFNRFTVTLLIQALVYSGNRSLSHANKYISDAKSDLVTILEKMEVPPEVKEQWIIEAVIRYWNCNSQNGFLIVDSFKHSELVTAKSILTFSLTDLNGQNLGLVDATSIESTFRTLTELALQQASDISVFEFVFERLLEIINDTVSQLGTNEEIVAPSVDNETMLDVDELARLDLIWKYESAVGFIKSILRKYSDEYSVLLDKFSAGLEQAVPHEPTRKQLDQWFNEIREL

SEQ ID NO: 12367 - DNA, 25 bp, Artificial sequence
  primer
atgattttaccgttagacttcgatg

SEQ ID NO: 12368 - DNA, 26 bp, Artificial sequence
  primer
ttaaacttcctttgtttcttgaatcc

SEQ ID NO: 12369 - protein, 966 aa, Artificial sequence
  consensus sequence
  Variant (2)..(8): Xaa in position 2 to 8 is any amino acid
  Variant (9)..(11): Xaa in position 9 to 11 is any or no amino acid
  Variant (13)..(42): Xaa in position 13 to 42 is any amino acid
  Variant (43)..(43): Xaa in position 43 is any or no amino acid
  Variant (47)..(47): Xaa in position 47 is any amino acid
  Variant (49)..(59): Xaa in position 49 to 59 is any amino acid
  Variant (61)..(78): Xaa in position 61 to 78 is any amino acid
  Variant (80)..(90): Xaa in position 80 to 90 is any amino acid
  Variant (91)..(134): Xaa in position 91 to 134 is any or no amino acid
  Variant (136)..(137): Xaa in position 136 to 137 is any amino acid
  Variant (139)..(139): Xaa in position 139 is any amino acid
  Variant (142)..(166): Xaa in position 142 to 166 is any amino acid
  Variant (167)..(168): Xaa in position 167 to 168 is any or no amino acid
  Variant (170)..(186): Xaa in position 170 to 186 is any amino acid
  Variant (187)..(190): Xaa in position 187 to 190 is any or no amino acid
  Variant (192)..(194): Xaa in position 192 to 194 is any amino acid
  Variant (197)..(211): Xaa in position 197 to 211 is any amino acid
  Variant (212)..(214): Xaa in position 212 to 214 is any or no amino acid
  Variant (216)..(268): Xaa in position 216 to 268 is any amino acid
  Variant (269)..(279): Xaa in position 269 to 279 is any or no amino acid
  Variant (281)..(318): Xaa in position 281 to 318 is any amino acid
  Variant (319)..(340): Xaa in position 319 to 340 is any or no amino acid
  Variant (342)..(347): Xaa in position 342 to 347 is any amino acid
  Variant (349)..(353): Xaa in position 349 to 353 is any amino acid
  Variant (354)..(359): Xaa in position 354 to 359 is any or no amino acid
  Variant (362)..(373): Xaa in position 362 to 373 is any amino acid
  Variant (375)..(377): Xaa in position 375 to 377 is any amino acid
  Variant (379)..(382): Xaa in position 379 to 382 is any amino acid
  Variant (384)..(385): Xaa in position 384 to 385 is any amino acid
  Variant (387)..(390): Xaa in position 387 to 390 is any amino acid
  Variant (392)..(393): Xaa in position 392 to 393 is any amino acid
  Variant (395)..(397): Xaa in position 395 to 397 is any amino acid
  Variant (399)..(400): Xaa in position 399 to 400 is any amino acid
  Variant (402)..(402): Xaa in position 402 is any amino acid
  Variant (403)..(405): Xaa in position 403 to 405 is any or no amino acid
  Variant (407)..(415): Xaa in position 407 to 415 is any amino acid
  Variant (417)..(424): Xaa in position 417 to 424 is any amino acid
  Variant (425)..(433): Xaa in position 425 to 433 is any or no amino acid
  Variant (435)..(435): Xaa in position 435 is any amino acid
  Variant (437)..(437): Xaa in position 437 is any amino acid
  Variant (440)..(440): Xaa in position 440 is any amino acid
  Variant (442)..(451): Xaa in position 442 to 451 is any amino acid
  Variant (454)..(460): Xaa in position 454 to 460 is any amino acid
  Variant (462)..(465): Xaa in position 462 to 465 is any amino acid
  Variant (467)..(469): Xaa in position 467 to 469 is any amino acid
  Variant (471)..(473): Xaa in position 471 to 473 is any amino acid
  Variant (475)..(476): Xaa in position 475 to 476 is any amino acid
  Variant (480)..(481): Xaa in position 480 to 481 is any amino acid
  Variant (485)..(485): Xaa in position 485 is any amino acid
  Variant (487)..(488): Xaa in position 487 to 488 is any amino acid
  Variant (490)..(495): Xaa in position 490 to 495 is any amino acid
  Variant (497)..(498): Xaa in position 497 to 498 is any amino acid
  Variant (500)..(501): Xaa in position 500 to 501 is any amino acid
  Variant (503)..(503): Xaa in position 503 is any amino acid
  Variant (507)..(511): Xaa in position 507 to 511 is any amino acid
  Variant (515)..(515): Xaa in position 515 is any amino acid
  Variant (517)..(517): Xaa in position 517 is any amino acid
  Variant (521)..(521): Xaa in position 521 is any amino acid
  Variant (524)..(525): Xaa in position 524 to 525 is any amino acid
  Variant (527)..(533): Xaa in position 527 to 533 is any amino acid
  Variant (534)..(536): Xaa in position 534 to 536 is any or no amino acid
  Variant (538)..(540): Xaa in position 538 to 540 is any amino acid
  Variant (542)..(547): Xaa in position 542 to 547 is any amino acid
  Variant (550)..(550): Xaa in position 550 is any amino acid
  Variant (553)..(641): Xaa in position 553 to 641 is any amino acid
  Variant (642)..(756): Xaa in position 642 to 756 is any or no amino acid
  Variant (759)..(759): Xaa in position 759 is any amino acid
  Variant (761)..(774): Xaa in position 761 to 774 is any amino acid
  Variant (776)..(791): Xaa in position 776 to 791 is any amino acid
  Variant (792)..(820): Xaa in position 792 to 820 is any or no amino acid
  Variant (822)..(824): Xaa in position 822 to 824 is any amino acid
  Variant (826)..(935): Xaa in position 826 to 935 is any amino acid
  Variant (936)..(965): Xaa in position 936 to 965 is any or no amino acid
EXXXXXXXXXXDXXXXXXXXXXXXXXXXXXXXXXXXXXXXXXXEQPXKXXXXXXXXXXXNXXXXXXXXXXXXXXXXXXQXXXXXXXXXXXXXXXXXXXXXXXXXXXXXXXXXXXXXXXXXXXXXXXXXXXXXXXKXXLXFLXXXXXXXXXXXXXXXXXXXXXXXXXXXLXXXXXXXXXXXXXXXXXXXXXLXXXPYXXXXXXXXXXXXXXXXXXLXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXPXXXXXXYXXXXXXXXXXXTVXXXXXXXXXXXXDXXXDXXXXLXXNXXXXAXXLXXXDXXFXXXXFXXXXXXXXXLXXXXXXXXXXXXXXXXXTXKXEDXAXXXXXXXXXXLPXXXXXXXYXXXXLXXXCXXXPXXIAPXXGRAXRXXYXXXXXXDXXLXXRXLDWXXXXXSNFXFXWKWXEWXXDXXXXXXXXXXPXXXFXXXXXXKEXRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSXSXXXXXXXXXXXXXXLXXXXXXXXXXXXXXXXXXXXXXXXXXXXXXXXXXXXXXXXXXXXXVXXXWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 12370 - protein, 61 aa, Artificial sequence
  protein pattern
  Variant (2)..(4): Xaa in position 2 to 4 is any amino acid
  Variant (5)..(5): Xaa in position 5 is any or no amino acid
  Variant (7)..(8): Xaa in position 7 to 8 is any amino acid
  Variant (9)..(9): Xaa in position 9 is any or no amino acid
  Variant (11)..(13): Xaa in position 11 to 13 is any amino acid
  Variant (14)..(14): Xaa in position 14 is any or no amino acid
  Variant (16)..(16): Xaa in position 16 is any amino acid
  Variant (17)..(17): Xaa in position 17 is Ala or Ser
  Variant (18)..(18): Xaa in position 18 is Ile or Met
  Variant (21)..(21): Xaa in position 21 is Ser or Val
  Variant (22)..(22): Xaa in position 22 is Phe or Leu
  Variant (26)..(26): Xaa in position 26 is Phe or Ile
  Variant (28)..(28): Xaa in position 28 is any amino acid
  Variant (29)..(29): Xaa in position 29 is Phe, Ile or Leu
  Variant (31)..(32): Xaa in position 31 to 32 is any amino acid
  Variant (33)..(33): Xaa in position 33 is Ile, Leu or Val
  Variant (34)..(36): Xaa in position 34 to 36 is any amino acid
  Variant (38)..(38): Xaa in position 38 is any amino acid
  Variant (39)..(39): Xaa in position 39 is Ala, Asp or Glu
  Variant (40)..(40): Xaa in position 40 is Leu or Pro
  Variant (41)..(42): Xaa in position 41 to 42 is any amino acid
  Variant (44)..(44): Xaa in position 44 is Phe or Tyr
  Variant (45)..(45): Xaa in position 45 is Ile or Leu
  Variant (48)..(48): Xaa in position 48 is Phe or Met
  Variant (49)..(49): Xaa in position 49 is Ala, Ser or Thr
  Variant (50)..(51): Xaa in position 50 to 51 is any amino acid
  Variant (52)..(52): Xaa in position 52 is Ile, Leu or Met
  Variant (56)..(56): Xaa in position 56 is Glu, Gly or Asn
  Variant (58)..(58): Xaa in position 58 is Ser or Thr
YXXXXLXXXCXXXXPXXXAPXXGRAXRXXYXXXXXXDXXXXXRXXDWXXXXXSNFXFXWKW

SEQ ID NO: 12371 - protein, 57 aa, Artificial sequence
  protein pattern
  Variant (3)..(3): Xaa in position 3 is Ile, Pro or Val
  Variant (4)..(6): Xaa in position 4 to 6 is any amino acid
  Variant (7)..(7): Xaa in position 7 is Asp, Ser or Thr
  Variant (8)..(9): Xaa in position 8 to 9 is any amino acid
  Variant (10)..(10): Xaa in position 10 is Ala, Gly or Ser
  Variant (11)..(11): Xaa in position 11 is any amino acid
  Variant (12)..(12): Xaa in position 12 is Phe, Ile or Leu
  Variant (13)..(14): Xaa in position 13 to 14 is any amino acid
  Variant (15)..(15): Xaa in position 15 is Asp or Glu
  Variant (16)..(18): Xaa in position 16 to 18 is any amino acid
  Variant (20)..(20): Xaa in position 20 is any amino acid
  Variant (21)..(21): Xaa in position 21 is Ile, Leu or Val
  Variant (22)..(22): Xaa in position 22 is Glu, Asn, Gln or Thr
  Variant (23)..(23): Xaa in position 23 is any amino acid
  Variant (24)..(24): Xaa in position 24 is Leu or Met
  Variant (25)..(25): Xaa in position 25 is Asp, Glu or Ser
  Variant (26)..(26): Xaa in position 26 is Phe or Tyr
  Variant (28)..(28): Xaa in position 28 is Lys or Arg
  Variant (29)..(29): Xaa in position 29 is any amino acid
  Variant (30)..(30): Xaa in position 30 is Ala or Glu
  Variant (31)..(31): Xaa in position 31 is Ala, Cys, Thr or Val
  Variant (32)..(32): Xaa in position 32 is Ala or Ser
  Variant (33)..(34): Xaa in position 33 to 34 is any amino acid
  Variant (35)..(35): Xaa in position 35 is Leu or Val
  Variant (36)..(37): Xaa in position 36 to 37 is any amino acid
  Variant (38)..(38): Xaa in position 38 is Ile, Leu or Val
  Variant (40)..(40): Xaa in position 40 is any amino acid
  Variant (41)..(41): Xaa in position 41 is Phe or Tyr
  Variant (42)..(42): Xaa in position 42 is Phe or Leu
  Variant (43)..(46): Xaa in position 43 to 46 is any amino acid
  Variant (48)..(50): Xaa in position 48 to 50 is any amino acid
  Variant (51)..(51): Xaa in position 51 is Ala or Gly
  Variant (52)..(52): Xaa in position 52 is any amino acid
  Variant (53)..(53): Xaa in position 53 is Pro or Ser
  Variant (54)..(54): Xaa in position 54 is Phe, Ile or Val
  Variant (55)..(55): Xaa in position 55 is Ala or Asp
  Variant (56)..(56): Xaa in position 56 is any amino acid
TVXXXXXXXXXXXXXXXXDXXXXXXXNXXXXXXXXXXXDXXXXXXXFXXXXXXXXXL

SEQ ID NO: 12372 - protein, 27 aa, Artificial sequence
  protein pattern
  Variant (2)..(3): Xaa in position 2 to 3 is any amino acid
  Variant (4)..(4): Xaa in position 4 is Ala, Asn, Thr or Val
  Variant (6)..(6): Xaa in position 6 is Ala or Ile
  Variant (7)..(7): Xaa in position 7 is any amino acid
  Variant (8)..(8): Xaa in position 8 is Gly, Asn or Gln
  Variant (9)..(9): Xaa in position 9 is Ala or Leu
  Variant (10)..(10): Xaa in position 10 is Ile or Leu
  Variant (11)..(11): Xaa in position 11 is any amino acid
  Variant (14)..(14): Xaa in position 14 is Ile, Leu or Val
  Variant (17)..(17): Xaa in position 17 is any or no amino acid
  Variant (19)..(21): Xaa in position 19 to 21 is any amino acid
  Variant (22)..(22): Xaa in position 22 is Asp, Glu or Arg
  Variant (23)..(23): Xaa in position 23 is Ile or Val
  Variant (24)..(24): Xaa in position 24 is Glu, Lys or Arg
  Variant (25)..(25): Xaa in position 25 is Asp, Glu, Gly or Asn
  Variant (26)..(26): Xaa in position 26 is Ser or Thr
  Variant (27)..(27): Xaa in position 27 is Phe, Ile, Leu or Val
PXXXFXXXXXXKEXRLXSXXXXXXXXX

SEQ ID NO: 12373 - protein, 31 aa, Artificial sequence
  protein pattern
  Variant (2)..(4): Xaa in position 2 to 4 is any or no amino acid
  Variant (6)..(8): Xaa in position 6 to 8 is any amino acid
  Variant (9)..(9): Xaa in position 9 is Pro, Gln, Ser or Thr
  Variant (10)..(10): Xaa in position 10 is Gly or Gln
  Variant (11)..(11): Xaa in position 11 is any amino acid
  Variant (12)..(12): Xaa in position 12 is Ala, Gly, Ile or Val
  Variant (13)..(14): Xaa in position 13 to 14 is any amino acid
  Variant (15)..(15): Xaa in position 15 is Ala, Ile or Val
  Variant (16)..(16): Xaa in position 16 is Ala, Ile, Leu or Val
  Variant (17)..(17): Xaa in position 17 is Asp or Glu
  Variant (18)..(18): Xaa in position 18 is any amino acid
  Variant (19)..(19): Xaa in position 19 is Phe, Leu or Met
  Variant (20)..(23): Xaa in position 20 to 23 is any amino acid
  Variant (24)..(24): Xaa in position 24 is Ile or Leu
  Variant (25)..(25): Xaa in position 25 is Ile, Leu or Val
  Variant (26)..(26): Xaa in position 26 is any amino acid
  Variant (27)..(27): Xaa in position 27 is Ala, Asn, Pro or Ser
  Variant (28)..(29): Xaa in position 28 to 29 is any amino acid
  Variant (30)..(30): Xaa in position 30 is Ile, Leu or Val
  Variant (31)..(31): Xaa in position 31 is Phe, Ile, Leu or Val
VXXXWXXXXXXXXXXXXXXXXXXXXXXXXXX

SEQ ID NO: 12374 - protein, 22 aa, Artificial sequence
  protein pattern
  Variant (2)..(2): Xaa in position 2 is any amino acid
  Variant (3)..(4): Xaa in position 3 to 4 is any or no amino acid
  Variant (7)..(7): Xaa in position 7 is Ile, Leu or Val
  Variant (8)..(8): Xaa in position 8 is Ala or Val
  Variant (9)..(9): Xaa in position 9 is any amino acid
  Variant (10)..(10): Xaa in position 10 is Asp, Glu or Gly
  Variant (11)..(11): Xaa in position 11 is Ala, Asn, Ser or Thr
  Variant (12)..(12): Xaa in position 12 is Ile or Val
  Variant (13)..(13): Xaa in position 13 is Phe, Ile or Leu
  Variant (14)..(14): Xaa in position 14 is Ala, Glu, Gly, Ser or Thr
  Variant (15)..(16): Xaa in position 15 to 16 is any amino acid
  Variant (17)..(17): Xaa in position 17 is Phe or Leu
  Variant (18)..(18): Xaa in position 18 is any amino acid
  Variant (20)..(20): Xaa in position 20 is Ala or Pro
  Variant (21)..(21): Xaa in position 21 is any amino acid
  Variant (22)..(22): Xaa in position 22 is Pro, Thr or Val
TXXXEDXXXXXXXXXXXXLXXX

SEQ ID NO: 12375 - protein, 27 aa, Artificial sequence
  protein pattern
  Variant (2)..(8): Xaa in position 2 to 8 is any amino acid
  Variant (9)..(13): Xaa in position 9 to 13 is any or no amino acid
  Variant (16)..(16): Xaa in position 16 is Lys or Arg
  Variant (18)..(18): Xaa in position 18 is Phe, Ile or Leu
  Variant (19)..(20): Xaa in position 19 to 20 is any amino acid
  Variant (21)..(21): Xaa in position 21 is Ala, Leu or Val
  Variant (22)..(24): Xaa in position 22 to 24 is any amino acid
  Variant (25)..(25): Xaa in position 25 is Ile or Leu
  Variant (26)..(26): Xaa in position 26 is Asp, Glu, Asn or Ser
  Variant (27)..(27): Xaa in position 27 is Asp or Arg
FXXXXXXXXXXXXGSXSXXXXXXXXXX

SEQ ID NO: 12376 - protein, 26 aa, Artificial sequence
  protein pattern
  Variant (4)..(4): Xaa in position 4 is any amino acid
  Variant (6)..(7): Xaa in position 6 to 7 is any amino acid
  Variant (8)..(9): Xaa in position 8 to 9 is any or no amino acid
  Variant (11)..(16): Xaa in position 11 to 16 is any amino acid
  Variant (17)..(18): Xaa in position 17 to 18 is any or no amino acid
  Variant (20)..(24): Xaa in position 20 to 24 is any amino acid
  Variant (25)..(25): Xaa in position 25 is Ala, Ile, Leu or Val
  Variant (26)..(26): Xaa in position 26 is Ala, Gly or Val
EQPXKXXXXAXXXXXXXXNXXXXXXX

SEQ ID NO: 12377 - protein, 18 aa, Artificial sequence
  protein pattern
  Variant (2)..(6): Xaa in position 2 to 6 is any amino acid
  Variant (7)..(7): Xaa in position 7 is any or no amino acid
  Variant (9)..(10): Xaa in position 9 to 10 is any or no amino acid
  Variant (12)..(12): Xaa in position 12 is Lys or Arg
  Variant (13)..(13): Xaa in position 13 is Phe or Leu
  Variant (14)..(14): Xaa in position 14 is Ile or Leu
  Variant (15)..(15): Xaa in position 15 is Ala, Gly or Ser
  Variant (16)..(16): Xaa in position 16 is any amino acid
  Variant (17)..(17): Xaa in position 17 is Ile or Leu
  Variant (18)..(18): Xaa in position 18 is Ala, Gln, Ser or Thr
GXXXXXXKXXLXXXXXXX

SEQ ID NO: 12378 - DNA, 1029 bp, Saccharomyces cerevisiae
  CDS (1)..(1029)
atgtccggattcgcaaaactcaagtcgtggttatacaaagcttcccttttcgtttctttgatacttttgattgggttttcagttgttttacccatagattccattgcacaagcttctaaatcagaaaacaatgcctttaatacgttcattgttgtaggcgctttagttgtctttggcgttttttgtatctttattattattggaagaatgctatttcataagagttgtttaaaagatataccaagaagatatattccgatcacacctgctgatctcccgcatcgttctagtagggaagcagtactgcagaacatggaaagatctaaagaattaacaattcttctcaaaaaacctaaagaccctgttattcacgacggacttgagcccccgaggagatgtgactacccattagatgaaaagttatttccagaatacctaaactatgctgattgtataaaaagtttaacagatagactgaaataccatggattgtttctgaacaatttagatgttagaatgaatctagaagatacgtttgccgacgtggtgaactcacaatttgttaatcacaacgccaataaaattcagttagaaaaggcgaaggagtttatcgatttatatgaaacaattagattttcagggaaggacgttactagagaccagttcataaagtttgttaagttttgtctctatttcggtgaagtgtcattaacaagagacacttcatttgcaaatttacataattttagattaaatggcagttcaaataacattggaagaactgaatcaaaatattcaataaacccatttgatgaaaacgaatacgcgcaggatgatatgcattactttcccgaaccgcctacacatttggttagagaaagtagcataagtactgtcgcaaggcatgtttcatcaggtgtagatctgactaattctgaagaacatcctttggatacggattctgattgtaacgcccttcgtctcaaactttccaaagcggatagttatagaagtgtaattcgtcattag

SEQ ID NO: 12379 - protein, 342 aa, Saccharomyces cerevisiae
MSGFAKLKSWLYKASLFVSLILLIGFSVVLPIDSIAQASKSENNAFNTFIVVGALVVFGVFCIFIIIGRMLFHKSCLKDIPRRYIPITPADLPHRSSREAVLQNMERSKELTILLKKPKDPVIHDGLEPPRRCDYPLDEKLFPEYLNYADCIKSLTDRLKYHGLFLNNLDVRMNLEDTFADVVNSQFVNHNANKIQLEKAKEFIDLYETIRFSGKDVTRDQFIKFVKFCLYFGEVSLTRDTSFANLHNFRLNGSSNNIGRTESKYSINPFDENEYAQDDMHYFPEPPTHLVRESSISTVARHVSSGVDLTNSEEHPLDTDSDCNALRLKLSKADSYRSVIRH

SEQ ID NO: 12380 - DNA, 1029 bp, Fungi/Metazoa group
  CDS (1)..(1029)
atgtctgggctagcgaaactgaagtcgtggctgtataagggttccctctttatatcattgatacttttgattgggttttcagtagtattgcctatagattccattgcacaggcttctaaatcagagaacaatgctttcaacacatttattgttgttggtgccttagttgtttttggtgttgtttgtatcgttattattattggaagagtgctatttcacaaaagctgtctaaaggatattccaagaagatatattccaatcacaccagctgatcttccgcatcttgcgagtcgagaagcagtattgaaaaacatggaaaggtctaaggaattaactattctgctaaaaaaaccaaaggatcctgttatccatgatggactggaacctccaaagcgatgtgattttccatcaaatgaaaaattatttccagaatacctaaattatgctgattgtataaaaagtctaacggatagattgaaataccatgggttgtttctgaacaacctagatgttaggatgaaactggaggacacttttgctgatgtggtgaattctcagtttgttaaccgcaatactaacaaggttcaattgcaaaaggctaaagattttattgacttgtatgaaacgataagattttcaggcaaagatgtcacaagagaccaatttatactgtttgttgagctgtgtctttattttggggaggtgtcactaacaagggatacgtcatttgcaaatttccagaattttaaatataatgccagttcaaataatggcggaacaaatgaatcgaaatattcaataaaccggttcgatgaaaacgaatacgctcaggaagatatgcattactttcctgaaccgcctacccatttggttagagagagtagcagaagcacagtggcacggcatatttcatctggtggagatttacctaattctgaagagcatcctttagaagacgattctgattgtaatgggcttaatgacaaacttgcagaagttcacagttatagaagcgtaattcgtcattaa

SEQ ID NO: 12381 - protein, 342 aa, Fungi/Metazoa group
MSGLAKLKSWLYKGSLFISLILLIGFSVVLPIDSIAQASKSENNAFNTFIVVGALVVFGVVCIVIIIGRVLFHKSCLKDIPRRYIPITPADLPHLASREAVLKNMERSKELTILLKKPKDPVIHDGLEPPKRCDFPSNEKLFPEYLNYADCIKSLTDRLKYHGLFLNNLDVRMKLEDTFADVVNSQFVNRNTNKVQLQKAKDFIDLYETIRFSGKDVTRDQFILFVELCLYFGEVSLTRDTSFANFQNFKYNASSNNGGTNESKYSINRFDENEYAQEDMHYFPEPPTHLVRESSRSTVARHISSGGDLPNSEEHPLEDDSDCNGLNDKLAEVHSYRSVIRH

SEQ ID NO: 12382 - DNA, 1170 bp, Candida glabrata CBS 138
  CDS (1)..(1170)
atgattcttcaagagcaacgacgactccgattgtggttgtacaaaagttcattattcatatcagttctgtttttgattggtttttccattgtacttcctgtagactcaatcgtccaagctatacaatcagaaaataatggattcaatacgatcatcgttattgggtctttagcagtattctttgtggccgctgtcactattctaatcggaaggatgcttttacataaaagctgtttgaaggatattccaaggcgttatattccagttacgaatgccgatctcccgcataaatccagtagaaaaatggttatacacaatatggaaagatcaaaaaaattatccggacttttcaagacgcctaaggatccggtaatccatccgggtcttgaacctccagccagatgcgacgatccaaataccccaaaaattctaccagaatatttaaattataagatttgcataaaaagtgcaacagatagactcaaatattatggcctttttctaaacagcgcatctgatgatgtgaaaagctcacaaacatttactgatctcgtgaagtcacagtttatcaagggaaaccataataagagacaagtgcaaagagcaaaagacttcatagaactttatgagcgaataagattttcaggtgatgaggtttctagaagtgaattcatacagtttgcggaaaattgtatttatttcagcgatttgatgataacaatggatattaccaaagttggtttaggaaatattagcaccagatctcaattatcatttaatatcgcaggtagttctgttgacagaaagttacgtaaactcaacactgccaggtccaatcagatatcaagactatcttccggtcaatatcctgatattacagccttcagatacgatacatccaactcagactaccacaggcaggaaaccgacgaagatgactttgcactagatgatatggattactttccctctgttccaccttacatgatcagaagaaacagtacaaatacggtttcaatgaggataccaacaagtaatagcgacgaccagtataatttgggattcaatgaaataggcgatgaagacatacagaacaatgaccaaataagaagatatatgtctaacacctctaaaacagacagttttaaaacagttattcataacggataa

SEQ ID NO: 12383 - protein, 389 aa, Candida glabrata CBS 138
MILQEQRRLRLWLYKSSLFISVLFLIGFSIVLPVDSIVQAIQSENNGFNTIIVIGSLAVFFVAAVTILIGRMLLHKSCLKDIPRRYIPVTNADLPHKSSRKMVIHNMERSKKLSGLFKTPKDPVIHPGLEPPARCDDPNTPKILPEYLNYKICIKSATDRLKYYGLFLNSASDDVKSSQTFTDLVKSQFIKGNHNKRQVQRAKDFIELYERIRFSGDEVSRSEFIQFAENCIYFSDLMITMDITKVGLGNISTRSQLSFNIAGSSVDRKLRKLNTARSNQISRLSSGQYPDITAFRYDTSNSDYHRQETDEDDFALDDMDYFPSVPPYMIRRNSTNTVSMRIPTSNSDDQYNLGFNEIGDEDIQNNDQIRRYMSNTSKTDSFKTVIHNG

SEQ ID NO: 12384 - DNA, 981 bp, Kluyveromyces lactis NRRL Y-1140
  CDS (1)..(981)
atggtaacaagttggtataaaatatggtatcataccacgcaggtgatattcatccttttatttgttggtttttctgttgttgttcctttagattgtattgtgcaagcgtcagactctagcaacgatgcagttaatacctttattgtggtcggtgcagctgttgtattagtggtatttgggatttctattagttttgctcgtgtattgatctttcgaagatcattacaagatataccgaagaaatacattccagtaactgcgcaggatatgcgtcataaaccttcaagggaatatgtgattgaaaatatgaagagagctggagaattggcggaaaagtttaaagtaccgaaagagcctgtcttacatgctggcatggaaccaaaagacagtgatatgtttcctgaacacttgaaatatgcggaaattgttaaatttatctctgataggtttagattcgacggggctttgctgttgaattttgtcactgaatcggatctcagtacaactttcaaaacagcacttcataaacttttcgagaatgaaaaacacccttataagcagtatttggatgagtttatctcgctttatgagaaattccgatttagtggacaagatattgaacgaaacgatttcgtaaaattcttaagactctacaaatatctcgctgatttatcgaataatttggatttaacaagaatcgagtctgtcccatcccaatttcttcacgttcctactgaagattatgacactgatgccagatctagaacggactccgaattctcaactccatatttacgaccttacccgtctgacgccttcatgcataatacaacccctgcatcacatgtgggctctcgctccagtaacttcagttacgatatagatgagtctgcagaaccaccagaatctgtggaagaccaacaaagatatcatgacatgctcactagagtagacacttacaataccgtcatacatagatga

SEQ ID NO: 12385 - protein, 326 aa, Kluyveromyces lactis NRRL Y-1140
MVTSWYKIWYHTTQVIFILLFVGFSVVVPLDCIVQASDSSNDAVNTFIVVGAAVVLVVFGISISFARVLIFRRSLQDIPKKYIPVTAQDMRHKPSREYVIENMKRAGELAEKFKVPKEPVLHAGMEPKDSDMFPEHLKYAEIVKFISDRFRFDGALLLNFVTESDLSTTFKTALHKLFENEKHPYKQYLDEFISLYEKFRFSGQDIERNDFVKFLRLYKYLADLSNNLDLTRIESVPSQFLHVPTEDYDTDARSRTDSEFSTPYLRPYPSDAFMHNTTPASHVGSRSSNFSYDIDESAEPPESVEDQQRYHDMLTRVDTYNTVIHR

SEQ ID NO: 12386 - DNA, 24 bp, Artificial sequence
  primer
atgtccggattcgcaaaactcaag

SEQ ID NO: 12387 - DNA, 26 bp, Artificial sequence
  primer
ctaatgacgaattacacttctataac

SEQ ID NO: 12388 - protein, 373 aa, Artificial sequence
  consensus sequence
  Variant (2)..(13): Xaa in position 2 to 13 is any amino acid
  Variant (17)..(17): Xaa in position 17 is any amino acid
  Variant (19)..(19): Xaa in position 19 is any amino acid
  Variant (21)..(21): Xaa in position 21 is any amino acid
  Variant (23)..(23): Xaa in position 23 is any amino acid
  Variant (25)..(25): Xaa in position 25 is any amino acid
  Variant (28)..(29): Xaa in position 28 to 29 is any amino acid
  Variant (31)..(31): Xaa in position 31 is any amino acid
  Variant (33)..(35): Xaa in position 33 to 35 is any amino acid
  Variant (38)..(38): Xaa in position 38 is any amino acid
  Variant (41)..(41): Xaa in position 41 is any amino acid
  Variant (43)..(45): Xaa in position 43 to 45 is any amino acid
  Variant (47)..(48): Xaa in position 47 to 48 is any amino acid
  Variant (50)..(53): Xaa in position 50 to 53 is any amino acid
  Variant (55)..(57): Xaa in position 55 to 57 is any amino acid
  Variant (59)..(59): Xaa in position 59 is any amino acid
  Variant (61)..(65): Xaa in position 61 to 65 is any amino acid
  Variant (67)..(67): Xaa in position 67 is any amino acid
  Variant (71)..(72): Xaa in position 71 to 72 is any amino acid
  Variant (76)..(76): Xaa in position 76 is any amino acid
  Variant (78)..(79): Xaa in position 78 to 79 is any amino acid
  Variant (81)..(82): Xaa in position 81 to 82 is any amino acid
  Variant (84)..(85): Xaa in position 84 to 85 is any amino acid
  Variant (88)..(89): Xaa in position 88 to 89 is any amino acid
  Variant (91)..(92): Xaa in position 91 to 92 is any amino acid
  Variant (95)..(95): Xaa in position 95 is any amino acid
  Variant (97)..(99): Xaa in position 97 to 99 is any amino acid
  Variant (101)..(104): Xaa in position 101 to 104 is any amino acid
  Variant (106)..(106): Xaa in position 106 is any amino acid
  Variant (109)..(109): Xaa in position 109 is any amino acid
  Variant (112)..(112): Xaa in position 112 is any amino acid
  Variant (114)..(114): Xaa in position 114 is any amino acid
  Variant (116)..(116): Xaa in position 116 is any amino acid
  Variant (119)..(124): Xaa in position 119 to 124 is any amino acid
  Variant (125)..(131): Xaa in position 125 to 131 is any or no amino acid
  Variant (134)..(134): Xaa in position 134 is any amino acid
  Variant (136)..(136): Xaa in position 136 is any amino acid
  Variant (138)..(141): Xaa in position 138 to 141 is any amino acid
  Variant (143)..(145): Xaa in position 143 to 145 is any amino acid
  Variant (148)..(151): Xaa in position 148 to 151 is any amino acid
  Variant (153)..(154): Xaa in position 153 to 154 is any amino acid
  Variant (156)..(166): Xaa in position 156 to 166 is any amino acid
  Variant (169)..(175): Xaa in position 169 to 175 is any amino acid
  Variant (177)..(189): Xaa in position 177 to 189 is any amino acid
  Variant (190)..(191): Xaa in position 190 to 191 is any or no amino acid
  Variant (194)..(194): Xaa in position 194 is any amino acid
  Variant (198)..(199): Xaa in position 198 to 199 is any amino acid
  Variant (204)..(207): Xaa in position 204 to 207 is any amino acid
  Variant (209)..(210): Xaa in position 209 to 210 is any amino acid
  Variant (212)..(213): Xaa in position 212 to 213 is any amino acid
  Variant (215)..(219): Xaa in position 215 to 219 is any amino acid
  Variant (221)..(228): Xaa in position 221 to 228 is any amino acid
  Variant (230)..(237): Xaa in position 230 to 237 is any amino acid
  Variant (238)..(264): Xaa in position 238 to 264 is any or no amino acid
  Variant (266)..(293): Xaa in position 266 to 293 is any amino acid
  Variant (294)..(309): Xaa in position 294 to 309 is any or no amino acid
  Variant (311)..(363): Xaa in position 311 to 363 is any amino acid
  Variant (364)..(371): Xaa in position 364 to 371 is any or no amino acid
YXXXXXXXXXXXXGFSXVXPXDXIXQAXXSXNXXXNTXIVXGXXXVXXVXXXXIXXXRXLXXXXXLXDIPXXYIPXTXXDXXHXXSRXXVXXNMXRXXXLXXXXKXPKXPVXHXGXEPXXXXXXXXXXXXXPEXLXYXXXXKXXXDRXXXXGXXLXXXXXXXXXXXTFXXXXXXXFXXXXXXXXXXXXXXXFIXLYEXXRFSGXXXXRXXFXXFXXXXXYXXXXXXXXDXXXXXXXXXXXXXXXXXXXXXXXXXXXXXXXXXXXSXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXVI

SEQ ID NO: 12389 - protein, 58 aa, Artificial sequence
  protein pattern
  Variant (2)..(2): Xaa in position 2 is any amino acid
  Variant (6)..(7): Xaa in position 6 to 7 is Lys or Arg
  Variant (11)..(11): Xaa in position 11 is Ile or Val
  Variant (13)..(13): Xaa in position 13 is any or no amino acid
  Variant (15)..(15): Xaa in position 15 is any or no amino acid
  Variant (17)..(17): Xaa in position 17 is Leu or Met
  Variant (18)..(18): Xaa in position 18 is any amino acid
  Variant (20)..(20): Xaa in position 20 is any amino acid
  Variant (21)..(21): Xaa in position 21 is Ala, Pro or Ser
  Variant (24)..(24): Xaa in position 24 is Glu or Lys
  Variant (25)..(25): Xaa in position 25 is any amino acid
  Variant (27)..(27): Xaa in position 27 is Ile or Leu
  Variant (28)..(28): Xaa in position 28 is any amino acid
  Variant (31)..(31): Xaa in position 31 is Glu or Lys
  Variant (33)..(33): Xaa in position 33 is Ala or Ser
  Variant (34)..(34): Xaa in position 34 is any amino acid
  Variant (35)..(35): Xaa in position 35 is Glu or Lys
  Variant (37)..(37): Xaa in position 37 is Ala, Ser or Thr
  Variant (38)..(39): Xaa in position 38 to 39 is any amino acid
  Variant (40)..(40): Xaa in position 40 is Phe or Leu
  Variant (42)..(42): Xaa in position 42 is any amino acid
  Variant (45)..(45): Xaa in position 45 is Asp or Glu
  Variant (48)..(48): Xaa in position 48 is Ile or Leu
  Variant (50)..(50): Xaa in position 50 is Ala, Asp or Pro
  Variant (52)..(52): Xaa in position 52 is Leu or Met
  Variant (55)..(56): Xaa in position 55 to 56 is any amino acid
  Variant (57)..(57): Xaa in position 57 is Arg or Ser
  Variant (58)..(58): Xaa in position 58 is Cys or Asp
LXDIPXXYIPXTXAXDXXHXXSRXXVXXNMXRXXXLXXXXKXPKXPVXHXGXEPXXXX

SEQ ID NO: 12390 - protein, 59 aa, Artificial sequence
  protein pattern
  Variant (2)..(8): Xaa in position 2 to 8 is any amino acid
  Variant (9)..(9): Xaa in position 9 is any or no amino acid
  Variant (11)..(11): Xaa in position 11 is any or no amino acid
  Variant (13)..(13): Xaa in position 13 is any amino acid
  Variant (14)..(14): Xaa in position 14 is any or no amino acid
  Variant (18)..(18): Xaa in position 18 is Ile or Val
  Variant (20)..(20): Xaa in position 20 is Leu or Val
  Variant (22)..(22): Xaa in position 22 is Ile, Leu or Val
  Variant (24)..(24): Xaa in position 24 is Cys or Ser
  Variant (26)..(26): Xaa in position 26 is Ala or Val
  Variant (29)..(30): Xaa in position 29 to 30 is any amino acid
  Variant (32)..(32): Xaa in position 32 is Glu or Ser
  Variant (34)..(34): Xaa in position 34 is Asp or Asn
  Variant (35)..(35): Xaa in position 35 is Ala or Gly
  Variant (36)..(36): Xaa in position 36 is Phe or Val
  Variant (39)..(39): Xaa in position 39 is Phe or Ile
  Variant (42)..(42): Xaa in position 42 is Ile or Val
  Variant (44)..(44): Xaa in position 44 is Ala or Ser
  Variant (45)..(45): Xaa in position 45 is Ala or Leu
  Variant (46)..(46): Xaa in position 46 is Ala or Val
  Variant (48)..(48): Xaa in position 48 is Phe or Leu
  Variant (49)..(49): Xaa in position 49 is any amino acid
  Variant (51)..(51): Xaa in position 51 is any amino acid
  Variant (52)..(52): Xaa in position 52 is Ala, Cys or Gly
  Variant (53)..(53): Xaa in position 53 is Ile or Val
  Variant (54)..(54): Xaa in position 54 is any amino acid
  Variant (56)..(56): Xaa in position 56 is any amino acid
  Variant (57)..(57): Xaa in position 57 is Phe or Ile
  Variant (58)..(58): Xaa in position 58 is Ala or Gly
YXXXXXXXXLXLXXGFSXVXPXDXIXQAXXSXNXXXNTXIVXGXXXVXXVXXXXIXXXR

SEQ ID NO: 12391 - protein, 60 aa, Artificial sequence
  protein pattern
  Variant (3)..(3): Xaa in position 3 is His or Tyr
  Variant (5)..(5): Xaa in position 5 is any amino acid
  Variant (7)..(9): Xaa in position 7 to 9 is any amino acid
  Variant (10)..(10): Xaa in position 10 is Ile or Val
  Variant (12)..(13): Xaa in position 12 to 13 is any or no amino acid
  Variant (15)..(16): Xaa in position 15 to 16 is any or no amino acid
  Variant (19)..(19): Xaa in position 19 is Phe or Leu
  Variant (20)..(20): Xaa in position 20 is Lys or Arg
  Variant (21)..(21): Xaa in position 21 is Phe or Tyr
  Variant (22)..(22): Xaa in position 22 is any amino acid
  Variant (24)..(24): Xaa in position 24 is Ala or Leu
  Variant (25)..(25): Xaa in position 25 is Phe or Leu
  Variant (27)..(27): Xaa in position 27 is any amino acid
  Variant (28)..(28): Xaa in position 28 is Asn or Ser
  Variant (29)..(29): Xaa in position 29 is any amino acid
  Variant (30)..(30): Xaa in position 30 is Asp, Ser or Val
  Variant (31)..(31): Xaa in position 31 is Asp, Thr or Val
  Variant (32)..(32): Xaa in position 32 is Asp, Glu or Arg
  Variant (33)..(35): Xaa in position 33 to 35 is any amino acid
  Variant (36)..(36): Xaa in position 36 is Glu or Ser
  Variant (37)..(37): Xaa in position 37 is Asp, Gln or Thr
  Variant (40)..(40): Xaa in position 40 is any amino acid
  Variant (41)..(41): Xaa in position 41 is Asp or Thr
  Variant (42)..(42): Xaa in position 42 is Ala, Leu or Val
  Variant (43)..(43): Xaa in position 43 is Leu or Val
  Variant (44)..(46): Xaa in position 44 to 46 is any amino acid
  Variant (48)..(52): Xaa in position 48 to 52 is any amino acid
  Variant (53)..(53): Xaa in position 53 is Asn or Pro
  Variant (54)..(55): Xaa in position 54 to 55 is any amino acid
  Variant (57)..(58): Xaa in position 57 to 58 is any amino acid
  Variant (59)..(59): Xaa in position 59 is Asp, Lys or Arg
  Variant (60)..(60): Xaa in position 60 is Ala or Glu
PEXLXYXXXXKXXSXXDRXXXXGXXLXXXXXXXXXXXTFXXXXXXXFXXXXXXXXQXXXX

SEQ ID NO: 12392 - protein, 40 aa, Artificial sequence
  protein pattern
  Variant (2)..(2): Xaa in position 2 is Asp, Glu or Ser
  Variant (6)..(6): Xaa in position 6 is any amino acid
  Variant (7)..(7): Xaa in position 7 is Phe or Ile
  Variant (12)..(12): Xaa in position 12 is any or no amino acid
  Variant (14)..(15): Xaa in position 14 to 15 is any amino acid
  Variant (16)..(16): Xaa in position 16 is any or no amino acid
  Variant (18)..(18): Xaa in position 18 is Asp, Asn or Ser
  Variant (19)..(19): Xaa in position 19 is Asp, Glu or Gln
  Variant (21)..(21): Xaa in position 21 is Ile or Val
  Variant (22)..(22): Xaa in position 22 is any amino acid
  Variant (24)..(24): Xaa in position 24 is Ala, Leu or Val
  Variant (25)..(25): Xaa in position 25 is Glu, Lys or Arg
  Variant (26)..(28): Xaa in position 26 to 28 is any amino acid
  Variant (30)..(30): Xaa in position 30 is Phe or Leu
  Variant (31)..(31): Xaa in position 31 is Ala, Gly or Ser
  Variant (32)..(32): Xaa in position 32 is Asp or Glu
  Variant (33)..(33): Xaa in position 33 is Leu or Val
  Variant (34)..(35): Xaa in position 34 to 35 is any amino acid
  Variant (36)..(36): Xaa in position 36 is Asn or Thr
  Variant (37)..(37): Xaa in position 37 is any amino acid
  Variant (39)..(39): Xaa in position 39 is any or no amino acid
IXLYEXXRFSGXDXXXRXXFXXFXXXXXYXXXXXXXXDXT

SEQ ID NO: 12393 - protein, 31 aa, Artificial sequence
  protein pattern
  Variant (3)..(3): Xaa in position 3 is any amino acid
  Variant (4)..(5): Xaa in position 4 to 5 is any or no amino acid
  Variant (7)..(21): Xaa in position 7 to 21 is any amino acid
  Variant (22)..(23): Xaa in position 22 to 23 is any or no amino acid
  Variant (25)..(25): Xaa in position 25 is any amino acid
  Variant (26)..(26): Xaa in position 26 is Asp, Asn or Ser
  Variant (27)..(27): Xaa in position 27 is Ser or Thr
  Variant (28)..(28): Xaa in position 28 is any amino acid
  Variant (29)..(29): Xaa in position 29 is Asn or Ser
DEXXXAXXXXXXXXXXXXXXXXXRXXXXXTV

SEQ ID NO: 12394 - DNA, 1029 bp, Saccharomyces cerevisiae
  CDS (1)..(1029)
atggaagaaaataaacttagtggaaataaaccgattcaacttgctacctggtcgaaccagatggggtcaccagaaaacaatggaaataatgcaaataatggtagtgatgtacagaatgttattcagaaagctttaggcttgattcgacagttgaacaataatgggctaatgagtccgatggaagaagagcattcgcaaccttcatcttcacaagagacacttagtgtcgatagagagattaatgaacagggccgtttgcgtcttcttatgcaagcaaaagatgataatacgcggaaggaagtaggcacatattctagtccgatggattctgcgtacgccagggaaaatatgttaaacgttttgcaatcattagttacgcatctgaaccaagctgtcagccaaatacaacaattaaaattcaagaacatgattcttacttcaaatgaaaataatattcagtcgaggcatgaagtggaagataatctccagaaacagcaatttgaaaggatgaagtgtcagtttctattggaacgtcaaagtttgaaggatcaattgcgaaagcgagagaataaaattgttaaatataagcagaaaattattgaaaagaacaagaaattaaacaatctagcaaaagtacttaatcaacatgcaatatctgatacctctcaaatagatagtttcagtagctcggtaaagaaaacgccttcgtcgactacaacgccccaagaaatgaagtcggacatgttgaacaccttgggaatattggccacacatgtcttgaaagatgaaattgacgatgattctggaaatcaaacgattctgcaactggctgcagggagtataagcaacgattgtaacactacggagttggaaattacgtgcagtcctgaaatgggaaggactattacacacaatcgaccaaatactaaagatgagtcaattcaggattcacatgggaataggaccctccaattgcccaaaatgaaaagtttcagtaccatagacggaagcattaaggatattaagtga

SEQ ID NO: 12395 - protein, 342 aa, Saccharomyces cerevisiae
MEENKLSGNKPIQLATWSNQMGSPENNGNNANNGSDVQNVIQKALGLIRQLNNNGLMSPMEEEHSQPSSSQETLSVDREINEQGRLRLLMQAKDDNTRKEVGTYSSPMDSAYARENMLNVLQSLVTHLNQAVSQIQQLKFKNMILTSNENNIQSRHEVEDNLQKQQFERMKCQFLLERQSLKDQLRKRENKIVKYKQKIIEKNKKLNNLAKVLNQHAISDTSQIDSFSSSVKKTPSSTTTPQEMKSDMLNTLGILATHVLKDEIDDDSGNQTILQLAAGSISNDCNTTELEITCSPEMGRTITHNRPNTKDESIQDSHGNRTLQLPKMKSFSTIDGSIKDIK

SEQ ID NO: 12396 - DNA, 957 bp, Candida glabrata CBS 138
  CDS (1)..(957)
atgagcaatattcagtctgtcataaatcctatggaggatagctctaccagcagaacaaagcaagatgaagcttacagcgaaagatcgatgcaaactacattgaagcgtgccaatgagatagtaactcaattggagagcatggacactgtagaccatggatttgtgaagaaagatgttcttgatatactcagaactttggcggataggctgaatgaatctacaaagcaggtgcaacaactcaagtataagaatctattgttgtcgaataagacatctaatgaaaatcagatgagacatgaagtagaggaaaacttgaaaacacagcaatttgagaaactcaagagtcagttgtatgttgaaaatgttcacctgaatgagcagctccatattaaagagaacaaagttacaaaatacaagaagaaaatcattgccaagaacaaacacattaatcaactgatgaggttactgaatcaaacaccccagctattggattcatcccaatcagaaagttcgatgatttcaaatgcaagagaagatactgaagaagctgataccaccataccaataacagattccgggcgaaaggccaaaccagttaaaactgaaacacatatgttaaatgccttaggtatgctggcctctcatgttctaaaagatgaaaacaaggccgatgatacttccggaaatggtgatgaaactagaatagaggaagacgactctgtaaatagaactattttacagagtgaagtcaaatcctctaatcaagaaataatggatagaagtccgacatttgctagaagtttagcaccgatactaccactaaacaaaaaagaggaattgcatagtttaagagtagttcttccaaatattcccagaccagagatgaaactagatgttaaacttccggtaatgaaaagatttaatacattagatggttctgtgaaagatatttcataa

SEQ ID NO: 12397 - protein, 318 aa, Candida glabrata CBS 138
MSNIQSVINPMEDSSTSRTKQDEAYSERSMQTTLKRANEIVTQLESMDTVDHGFVKKDVLDILRTLADRLNESTKQVQQLKYKNLLLSNKTSNENQMRHEVEENLKTQQFEKLKSQLYVENVHLNEQLHIKENKVTKYKKKIIAKNKHINQLMRLLNQTPQLLDSSQSESSMISNAREDTEEADTTIPITDSGRKAKPVKTETHMLNALGMLASHVLKDENKADDTSGNGDETRIEEDDSVNRTILQSEVKSSNQEIMDRSPTFARSLAPILPLNKKEELHSLRVVLPNIPRPEMKLDVKLPVMKRFNTLDGSVKDIS

SEQ ID NO: 12398 - DNA, 1161 bp, Kluyveromyces lactis NRRL Y-1140
  CDS (1)..(1161)
atgacagaaactcaattaaagactgagggagaggtaaataatgttcattcaccgtccgtgatatttacgcctaacgatttggagagaaagagttcgaccatttcgaatacttcgtcaatatcgacgcaggaggattcattgaacgaccaagtaagtttagctatagaaaatgctcagagaaccttgaataccttaaatgcgttacaatctacagcggagatacctgcttcgaatcacaaaggggatacgggttctgatgatacgaaaaatggtaccgcagatgagaaagacaaagatgtaaacaatgacattattacctcattacggcatttaatgacagcgttaaccaaatcacaagaacgggccaaacaattgacgttgaagaatatgtttctagtacaaaatctcaacgaacttcagagcgggttccaagtggaacaaaatctcgccaagcaacaatttgaaagtatgaaatacaatttgatggtacaaaagacagacctacagagacagttagagggtacttcggtcaagatcacaaaatacagagaaacgatcatgtcgaaaaacaaagaaatcaacagactttccagattattgaaccaaagccaagtctataatcctcgcctctctagaccaacttccgtgccatctgcatcggtcaggaagccatttatttcaagacagttacactcgtcggattccaacatgttaaacacattaggaatacttgctacaaaggttcttaaagaggaacaaaatccggaaaatggaagcattcatgggtcgacactccaacattctccaattgaagacaagccagagaatcttgataataccgaatctgacatctctcatgatagtactcagcttgtgaatcatagccagcagtttaataatggacttagtccctcaacagcaaacatggtgactccagccgcatcagttccagcagcgcagcatttaccaagtctgagtacggtatcagaggtgacacctgattcacatttgattaggatcaacagcagttcaaatcagaaaatagagcgtcctgaactgcctatattgcatctcaataggccatcgcttccgaaaggtgcggcactaccaaaattacggagttttaatacagcagatgggactgtaaaggatgtcttgtaa

SEQ ID NO: 12399 - protein, 386 aa, Kluyveromyces lactis NRRL Y-1140
MTETQLKTEGEVNNVHSPSVIFTPNDLERKSSTISNTSSISTQEDSLNDQVSLAIENAQRTLNTLNALQSTAEIPASNHKGDTGSDDTKNGTADEKDKDVNNDIITSLRHLMTALTKSQERAKQLTLKNMFLVQNLNELQSGFQVEQNLAKQQFESMKYNLMVQKTDLQRQLEGTSVKITKYRETIMSKNKEINRLSRLLNQSQVYNPRLSRPTSVPSASVRKPFISRQLHSSDSNMLNTLGILATKVLKEEQNPENGSIHGSTLQHSPIEDKPENLDNTESDISHDSTQLVNHSQQFNNGLSPSTANMVTPAASVPAAQHLPSLSTVSEVTPDSHLIRINSSSNQKIERPELPILHLNRPSLPKGAALPKLRSFNTADGTVKDVL

SEQ ID NO: 12400 - DNA, 27 bp, Artificial sequence
  primer
atggaagaaaataaacttagtggaaat

SEQ ID NO: 12401 - DNA, 25 bp, Artificial sequence
  primer
tcacttaatatccttaatgcttccg

SEQ ID NO: 12402 - protein, 290 aa, Artificial sequence
  consensus sequence
  Variant (2)..(3): Xaa in position 2 to 3 is any amino acid
  Variant (5)..(7): Xaa in position 5 to 7 is any amino acid
  Variant (9)..(16): Xaa in position 9 to 16 is any amino acid
  Variant (19)..(20): Xaa in position 19 to 20 is any amino acid
  Variant (23)..(24): Xaa in position 23 to 24 is any amino acid
  Variant (26)..(32): Xaa in position 26 to 32 is any amino acid
  Variant (33)..(33): Xaa in position 33 is any or no amino acid
  Variant (35)..(38): Xaa in position 35 to 38 is any amino acid
  Variant (41)..(41): Xaa in position 41 is any amino acid
  Variant (44)..(45): Xaa in position 44 to 45 is any amino acid
  Variant (50)..(51): Xaa in position 50 to 51 is any amino acid
  Variant (53)..(61): Xaa in position 53 to 61 is any amino acid
  Variant (63)..(64): Xaa in position 63 to 64 is any amino acid
  Variant (67)..(71): Xaa in position 67 to 71 is any amino acid
  Variant (73)..(74): Xaa in position 73 to 74 is any amino acid
  Variant (77)..(79): Xaa in position 77 to 79 is any amino acid
  Variant (81)..(82): Xaa in position 81 to 82 is any amino acid
  Variant (86)..(87): Xaa in position 86 to 87 is any amino acid
  Variant (89)..(89): Xaa in position 89 is any amino acid
  Variant (91)..(93): Xaa in position 91 to 93 is any amino acid
  Variant (97)..(102): Xaa in position 97 to 102 is any amino acid
  Variant (103)..(108): Xaa in position 103 to 108 is any or no amino acid
  Variant (110)..(134): Xaa in position 110 to 134 is any amino acid
  Variant (135)..(142): Xaa in position 135 to 142 is any or no amino acid
  Variant (146)..(146): Xaa in position 146 is any amino acid
  Variant (149)..(149): Xaa in position 149 is any amino acid
  Variant (152)..(153): Xaa in position 152 to 153 is any amino acid
  Variant (157)..(162): Xaa in position 157 to 162 is any amino acid
  Variant (163)..(164): Xaa in position 163 to 164 is any or no amino acid
  Variant (166)..(179): Xaa in position 166 to 179 is any amino acid
  Variant (180)..(181): Xaa in position 180 to 181 is any or no amino acid
  Variant (183)..(193): Xaa in position 183 to 193 is any amino acid
  Variant (194)..(200): Xaa in position 194 to 200 is any or no amino acid
  Variant (202)..(230): Xaa in position 202 to 230 is any amino acid
  Variant (231)..(274): Xaa in position 231 to 274 is any or no amino acid
  Variant (277)..(280): Xaa in position 277 to 280 is any amino acid
  Variant (282)..(282): Xaa in position 282 is any amino acid
  Variant (284)..(284): Xaa in position 284 is any amino acid
  Variant (287)..(288): Xaa in position 287 to 288 is any amino acid
LXXLXXXLXXXXXXXXQLXXKNXXLXXXXXXXXQXXXXVEXNLXXQQFEXXKXXXXXXXXXLXXQLXXXXXKXXKYXXXIXXKNKXXNXLXXXLNQXXXXXXXXXXXXSXXXXXXXXXXXXXXXXXXXXXXXXXXXXXXXXXMLNXLGXLAXXVLKXXXXXXXXSXXXXXXXXXXXXXXXXNXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXLPXXXXFXTXDGXXKD

SEQ ID NO: 12403 - protein, 53 aa, Artificial sequence
  protein pattern
  Variant (2)..(2): Xaa in position 2 is any or no amino acid
  Variant (7)..(7): Xaa in position 7 is any amino acid
  Variant (8)..(8): Xaa in position 8 is Leu or Met
  Variant (10)..(10): Xaa in position 10 is any amino acid
  Variant (11)..(11): Xaa in position 11 is Asn or Gln
  Variant (12)..(12): Xaa in position 12 is Phe or Leu
  Variant (13)..(13): Xaa in position 13 is any amino acid
  Variant (14)..(14): Xaa in position 14 is Leu or Val
  Variant (15)..(15): Xaa in position 15 is Glu or Gln
  Variant (16)..(18): Xaa in position 16 to 18 is any amino acid
  Variant (20)..(20): Xaa in position 20 is any amino acid
  Variant (21)..(21): Xaa in position 21 is Asp, Glu or Arg
  Variant (24)..(24): Xaa in position 24 is Glu, His or Arg
  Variant (25)..(26): Xaa in position 25 to 26 is any amino acid
  Variant (27)..(27): Xaa in position 27 is Glu or Ser
  Variant (28)..(28): Xaa in position 28 is Asn or Val
  Variant (30)..(30): Xaa in position 30 is Ile or Val
  Variant (31)..(31): Xaa in position 31 is Thr or Val
  Variant (34)..(34): Xaa in position 34 is Lys or Arg
  Variant (35)..(36): Xaa in position 35 to 36 is any amino acid
  Variant (38)..(38): Xaa in position 38 is Ile or Met
  Variant (39)..(39): Xaa in position 39 is Ala, Glu or Ser
  Variant (43)..(43): Xaa in position 43 is Glu, His or Lys
  Variant (44)..(44): Xaa in position 44 is Ile or Leu
  Variant (46)..(46): Xaa in position 46 is Asn, Gln or Arg
  Variant (48)..(48): Xaa in position 48 is any amino acid
  Variant (49)..(49): Xaa in position 49 is Lys or Arg
  Variant (50)..(50): Xaa in position 50 is Leu or Val
KXQQFEXXKXXXXXXXXXLXXQLXXXXXKXXKYXXXIXXKNKXXNXLXXXLNQ

SEQ ID NO: 12404 - protein, 16 aa, Artificial sequence
  protein pattern
  Variant (4)..(4): Xaa in position 4 is Ala or Thr
  Variant (7)..(7): Xaa in position 7 is Ile or Met
  Variant (10)..(10): Xaa in position 10 is Ser or Thr
  Variant (11)..(11): Xaa in position 11 is His or Lys
  Variant (15)..(15): Xaa in position 15 is Asp or Glu
MLNXLGXLAXXVLKXE

SEQ ID NO: 12405 - protein, 19 aa, Artificial sequence
  protein pattern
  Variant (3)..(4): Xaa in position 3 to 4 is any or no amino acid
  Variant (6)..(6): Xaa in position 6 is any amino acid
  Variant (7)..(8): Xaa in position 7 to 8 is any or no amino acid
  Variant (10)..(10): Xaa in position 10 is Asn or Ser
  Variant (12)..(12): Xaa in position 12 is Ala, Ile or Leu
  Variant (15)..(15): Xaa in position 15 is Ser or Thr
  Variant (16)..(16): Xaa in position 16 is Ile or Val
  Variant (19)..(19): Xaa in position 19 is Ile or Val
LPXXKXXXFXTXDGXXKDX

SEQ ID NO: 12406 - DNA, 2451 bp, Saccharomyces cerevisiae
  CDS (1)..(2451)
atggatgttgtgcagcagaaacaggataaacagttgcagcatcaaacacaagagcagcagcagatacgagaggaccagcaggaagtcccaccccaacgtccacgacaacaaaacagatggaaaccctggtggaattccactgccgacgatgagccaaacacgggaagaattgcagaatatcctaatggacaaggaaggagtagtccgacaacggattttcaagatagcgtgaactcgaataatgacaataaagggatatggtctaaaatcgcttcttttgcaacatccagatatagaagtgccccaattgttgttgatgataatacccgctactctcaactaaacactgaacaaatcaacttcttggaaaatgaggctaaggatataatttcaaaaaagtcgaaatcatggtgttggtacgaagcaattccacatatatcaaattcatcaaacataattgattccatagataccccaggaataatcagtgtctctggtacaggatcagccaaatgcccattgccattaaacaaatatcctggggagggaggtaaccctgggtataatgtatttattaatgattctttaatcctaccatcagataaccctttgaattttctgcacgtccaaccactaagaactaaggtattgaatactatcaaaaattactataacttccctaatgagcaacatctctatttaagacaaaaaaaaaccgcattactgaaggataagagaattattataatatccgtcgtgggggatttaccagaaaagtatgagcagcgctcattagaatcacaaagatcggcttattatctttctagaaaattgtcacaaaatctagcgcaagaacaacctcaaagagtcttgaccctatcgttccagtgcccactgcataatcaagatttaatacctacatataaagaatgtgtagagttactgaaccactgggctcatcttttcaaagaggtagattcaattttttttgtgggcgtttatcacagcgttcccttaactttgctattagcgaaatatatcgtgcaaaataatgaagttctagagtttgatgaaaacactacagtgagtgtattgagtttccagtcatgtttacaaggctatcgattttgggaccacagcactgactttactagcaatagttataataacttgggttccaattccagtactaacgaaaatgatagtaatgatcatgattcaaataatgatttcacaacgaagagccaacaaatcaaagaaaaacagttatttcagggcattgacaaaaagcaacaagacacattatctaaaatcaaaaattataggcggatagattctagtgaatctaaactagttcaggatgcattggattggctcttgttcaattgggatacgtttcgactgacattttttggtaagctttatgataattttatgacaatttcagaaaaacttgctatagattataatcaccctaaaatcttgagaaatttatggtgcaatgggaagtacatgggcattgatttaaagaatgctaataatttaaaccttgataccgatgatgaagcaactagtaacattaatgacgtccatgtaaggacccctaattttgaatcgagattgaagattcccaccaacagacttttcgaaataaccttatgggatattttgatgataacggagaatttaggatataaacaatttattcccataattaatttactaagtcctttttttatttcaaggtcatttaatgattacacattgcctccaaatattaggaaacagtaccagaacagcaacaaaatctggcttcaagaaatggacagtaagtggaaaatgaatggtcatcaactcaattacgaccaaagggagggtgaaagtctcggttcatcatcggaatcattattgccagagaatatttctacggtaaaggattttttgcagtttgtgcagtatcaaaacgaaaaatcttcggatttcgtaaggatatattcagacatttatgatgacgataaagtctataaatgctttctgtacaatacaatattcacgaaaaacccattaagtcgtaagcatttacgtttaaacatcgacctcgacactcctacaagcatattgaatactgtcaatcaatatgatttggtatggaaaattcatgattccttctccaaattgattcaattgaaaaatttaccgcagcgagagataccacatgcgttgaggctctccatctcattaaactgcttcttggatagtaccacgagtacttctggccctgtttttcagagggacaccgtggaagctttgagaagattaacagagatttggcgaacttaccaggattggtctccaccaacaaggggtttgaaacacctacgtgatatcctgagcgttttagccatgtatgacaaccccaaaaacttgattaatgatgttcgacgtacatag

SEQ ID NO: 12407 - protein, 816 aa, Saccharomyces cerevisiae
MDVVQQKQDKQLQHQTQEQQQIREDQQEVPPQRPRQQNRWKPWWNSTADDEPNTGRIAEYPNGQGRSSPTTDFQDSVNSNNDNKGIWSKIASFATSRYRSAPIVVDDNTRYSQLNTEQINFLENEAKDIISKKSKSWCWYEAIPHISNSSNIIDSIDTPGIISVSGTGSAKCPLPLNKYPGEGGNPGYNVFINDSLILPSDNPLNFLHVQPLRTKVLNTIKNYYNFPNEQHLYLRQKKTALLKDKRIIIISVVGDLPEKYEQRSLESQRSAYYLSRKLSQNLAQEQPQRVLTLSFQCPLHNQDLIPTYKECVELLNHWAHLFKEVDSIFFVGVYHSVPLTLLLAKYIVQNNEVLEFDENTTVSVLSFQSCLQGYRFWDHSTDFTSNSYNNLGSNSSTNENDSNDHDSNNDFTTKSQQIKEKQLFQGIDKKQQDTLSKIKNYRRIDSSESKLVQDALDWLLFNWDTFRLTFFGKLYDNFMTISEKLAIDYNHPKILRNLWCNGKYMGIDLKNANNLNLDTDDEATSNINDVHVRTPNFESRLKIPTNRLFEITLWDILMITENLGYKQFIPIINLLSPFFISRSFNDYTLPPNIRKQYQNSNKIWLQEMDSKWKMNGHQLNYDQREGESLGSSSESLLPENISTVKDFLQFVQYQNEKSSDFVRIYSDIYDDDKVYKCFLYNTIFTKNPLSRKHLRLNIDLDTPTSILNTVNQYDLVWKIHDSFSKLIQLKNLPQREIPHALRLSISLNCFLDSTTSTSGPVFQRDTVEALRRLTEIWRTYQDWSPPTRGLKHLRDILSVLAMYDNPKNLINDVRRT

SEQ ID NO: 12408 - DNA, 2127 bp, Candida glabrata CBS 138
  CDS (1)..(2127)
atgaatggtgagaacagttggtggtccaggaacggggagaatcgggttagtgacggtggagatcaggttggcgatgagcgatggtatcaaagcgtctggaacaagttaccgcagttaagacggcctaatatggaggttaacattaccgcagcaactcagtactctcatttgaacgcagagcagattcagtatttggagaacgatgcgttggagaagatcagggctcggtccaatacgtggtgctggtttcaggatatgaatgcactggcaagcgcaggcgctgctggtgtagtgagtgttgctggtacgggctctagcatattgcctcttccactgccggcatatcctggtgatactttccctgggcatcagctttacgtcaagaactcgctgttactccctgagtcaccattggagatatatcacagggagccattaaggacacagataagtaatgcattcaaggagcattataattttcccaatgagaagcatttatacttgaggagacctgaacaaactggaattgtcgaccaaaaagttgtagtgatctctattgttggtcatttacctgataagtacgagaagattacgctgggaaaacaaccttccgcttactacttaacgcaaaggtttctcaagactttagaacatgtcaaccccggtactgttgtgacattttccattgaagctgatatagatacccagcccatggagacggcatttcaatccctagtgaaggtattcaacaattggaaattcagattaaaagacgctagcgcaatatacatccaaagtgtgtatcacagcgttccaatagctatcaaactggcaaaacacttgatgttgaatcatattgactatggtttcacagataagaccagcattggtttgcttgggctagagtcatgcattgagggttacagattttgggaccatagtatagacatcagtagcagcactgagcaagagatagacaagctgcaacaagccaaggaaaaacaactatatcagggttgtacgaaacaacaacaaacgatattggcgcaaatcaaagaatactgtgatcttgaatcggaggagtcccagaatatgcagaatgatctggattgggtcttatacaattggggacccgcgagagttacattagtgggcaaactatatgataatttcatgacgctgtctcaaaagctggccattgactacaggcattccaaaataatgagatcgctttggtgtaacggtagttacttgggattagatcccaaattacctgagaaaataagtgttccgaatagccacttgaagaccatcaagtttgattgcaatgttcaaattcctgaagaaaggttatttgaagtatctttgttgatgattgttgtcctagctctgaatctgggttacacaagtggcacgtctctggcgaaattgattggtccctattttatctctaggtcttacaactccaatactgtacccccaaatatacgtaagcaacaaacctatgataacaagatatggttacaggagatggaagagaaatggaaggatttaaacatccgagagagctacatggacgagttaccaaagcatgtttcatcgacacattccttcttagagttttcatatttccaagcacaaaggtcccctgaccttctacagatcaagtccgatatatatgacgatgattcggtttacaagttgtttcttgagaacactatgctaaccagaaaccctcggtacaagaagcatttacaattgcacaaggatgagtacatgccctcgagtatatttgaccgggccaaccaatacgatctggtgtggaaattccacgagtttctctctaacttcgtcactgctagaaacttgcctcgccagaacttcccaccgttgatctccttctccatatccttagactactcgttttggaagtacatgtacccagagagcaattctttcaaccgagacaccactgaatcccgaaagaagctagtccaattatgggagtgttacaacagttgggacccaccgactagaggcttacagaagctgagaaacattctgagcgtgttgtccatctacaaggaaccttccaagttcatcgaggatatccaaagaactctgtaa

SEQ ID NO: 12409 - protein, 708 aa, Candida glabrata CBS 138
MNGENSWWSRNGENRVSDGGDQVGDERWYQSVWNKLPQLRRPNMEVNITAATQYSHLNAEQIQYLENDALEKIRARSNTWCWFQDMNALASAGAAGVVSVAGTGSSILPLPLPAYPGDTFPGHQLYVKNSLLLPESPLEIYHREPLRTQISNAFKEHYNFPNEKHLYLRRPEQTGIVDQKVVVISIVGHLPDKYEKITLGKQPSAYYLTQRFLKTLEHVNPGTVVTFSIEADIDTQPMETAFQSLVKVFNNWKFRLKDASAIYIQSVYHSVPIAIKLAKHLMLNHIDYGFTDKTSIGLLGLESCIEGYRFWDHSIDISSSTEQEIDKLQQAKEKQLYQGCTKQQQTILAQIKEYCDLESEESQNMQNDLDWVLYNWGPARVTLVGKLYDNFMTLSQKLAIDYRHSKIMRSLWCNGSYLGLDPKLPEKISVPNSHLKTIKFDCNVQIPEERLFEVSLLMIVVLALNLGYTSGTSLAKLIGPYFISRSYNSNTVPPNIRKQQTYDNKIWLQEMEEKWKDLNIRESYMDELPKHVSSTHSFLEFSYFQAQRSPDLLQIKSDIYDDDSVYKLFLENTMLTRNPRYKKHLQLHKDEYMPSSIFDRANQYDLVWKFHEFLSNFVTARNLPRQNFPPLISFSISLDYSFWKYMYPESNSFNRDTTESRKKLVQLWECYNSWDPPTRGLQKLRNILSVLSIYKEPSKFIEDIQRTL

SEQ ID NO: 12410 - DNA, 2151 bp, Kluyveromyces lactis NRRL Y-1140
  CDS (1)..(2151)
atgtccgaacccatcaattcaacgggagaagataataatccattttggagaagatggatcccaggaactaatgcttcagaagaaaacagtcaagatactcctactaattcgtcttctgaacaccaggacgaaggatggctgaaaaggtatataccagcttggttctccaatcaagaaagtttagaaatcagcgacagtacatcataccatcagcttaccaaaaaacaaattaaaatattggaaaatgaagcagagcaaggaatacttaaaggacatgatacatgttgctggtttaatgaaactttgaataataaattactcgattctgatggggttttatccgtttacaacactggcagcgcgacttgtcccttgccattgtccaaatatccattattaccacagcgaaaatctactatcataaatgccaaaaattcaactatcataccaggtgtttctccaactgagtacatgcatgaactgccacttaaaacgaaattagcccatgccataaaaaaccattacaattttatcagtgagaaacatctttacttaaaacagcattccactcttaatttcaatgaagacaccataatagtcatatcattacacggatctttgcccgaaaagtatgaacgtgtttcgaccggaaagcttccaacagcactggagcttaacgatcaaatgctcaagaagctactaaactttgatcctcatagagcgctcaccttttcgttcgaatgcccgcttgatgtcaaaccaactccaatggttttgcaagaaaccatatcactacttaaaaattggatgcatctattccaggatgcaactcgaatatttgttattgggacctaccatagcgttcctctatcaattctgttgacagacgcaatactcgataatttcacgattaccaaattaaagtctattgggattcttggttttgaatcttgtttacaaggatatcaattttggaaccatacagctgaaattacaccccagagtatggaaaacccaaccttccaggtgaataaagaaaaagcactcttcgagggttcatccaagttacaacaagaagttttatctacttataggaattatcggaatcccgacgggcctgaaagaaaagagcttatgaatgtacttgataaactcttatttcatcatccgaatttgaggatatctttggtcggcaaactctatgataattttttgactgtgtctcaaaagttagctatggattatattcatccaatgatccagaggaggttatggtgtgatggtaataatatgaacttgaactatattaatgttgctaaggctataccagacgaaacaatgattaatttggaacaaagtttcaaaattcctatacctgaggaacgagaattcgaagttagtataatgaataatatgctattagcaataaatctaggacatagacaattcattccttttcttaacgaattaagccctttttacatttcaagatccttcaactcgtcgacctgcccagctctcttaaagaagcagcttcagacagaatctaaagcttggcagcaagaaaaggatgccagcttcaaggaaatggttacagacagtgaaaaaatcctaccaaaagatattactacctatcgtgtagcatttgattatcttcactataaatctcatagaagtcctgacgatattgaactaaagacgtctattttcaatgatatatcaattctcgaaggttttatctacgataacattttcacagcaaatcttcaagcccccgttcatctcatgatgcaccactcgtctgacaacagtaaagtgctaaacagcgtcaacgaatacaaccttgtgtggaattttcatgaagtaatgagcagttttattagaatcaggaacttccccacattacctggaccaccggtaataacagcttgcatggaaactccaaattctcagagccaacgaatcgaaataacaaaggcaatctttgataatactaacttggaatcatgcaaaaggatggaacaactctggaggacttaccaaacatggaacccaaatacgacgggcttaaagaaactacataatatattaagtgttctccggctttatgactctggagagcaattgcaaaaggatgtatcaattgtttaa

SEQ ID NO: 12411 - protein, 716 aa, Kluyveromyces lactis NRRL Y-1140
MSEPINSTGEDNNPFWRRWIPGTNASEENSQDTPTNSSSEHQDEGWLKRYIPAWFSNQESLEISDSTSYHQLTKKQIKILENEAEQGILKGHDTCCWFNETLNNKLLDSDGVLSVYNTGSATCPLPLSKYPLLPQRKSTIINAKNSTIIPGVSPTEYMHELPLKTKLAHAIKNHYNFISEKHLYLKQHSTLNFNEDTIIVISLHGSLPEKYERVSTGKLPTALELNDQMLKKLLNFDPHRALTFSFECPLDVKPTPMVLQETISLLKNWMHLFQDATRIFVIGTYHSVPLSILLTDAILDNFTITKLKSIGILGFESCLQGYQFWNHTAEITPQSMENPTFQVNKEKALFEGSSKLQQEVLSTYRNYRNPDGPERKELMNVLDKLLFHHPNLRISLVGKLYDNFLTVSQKLAMDYIHPMIQRRLWCDGNNMNLNYINVAKAIPDETMINLEQSFKIPIPEEREFEVSIMNNMLLAINLGHRQFIPFLNELSPFYISRSFNSSTCPALLKKQLQTESKAWQQEKDASFKEMVTDSEKILPKDITTYRVAFDYLHYKSHRSPDDIELKTSIFNDISILEGFIYDNIFTANLQAPVHLMMHHSSDNSKVLNSVNEYNLVWNFHEVMSSFIRIRNFPTLPGPPVITACMETPNSQSQRIEITKAIFDNTNLESCKRMEQLWRTYQTWNPNTTGLKKLHNILSVLRLYDSGEQLQKDVSIV

SEQ ID NO: 12412 - DNA, 24 bp, Artificial sequence
  primer
atggatgttgtgcagcagaaacag

SEQ ID NO: 12413 - DNA, 25 bp, Artificial sequence
  primer
ctatgtacgtcgaacatcattaatc

SEQ ID NO: 12414 - DNA, 1377 bp, Saccharomyces cerevisiae
  CDS (1)..(1377)
atgatcacccagcctgctaagtgccctctattgatccgtatatcagcttttagatcaggctcgagtttcttgttatatgtgcattgcaaaagcataaacaaatcctggcagccgaagccgggcaatccacttcgaaacgcacggctgaactatataaatataaaggacatgtggagagaagcttctcttccttcacatttcgcatttcatgatctaaagtggttctttcacaatagaagagcaccaacacgaaatatggctgtcggtggtaataactggagcatgtggctgcgaatgtcacgggtccacctcaggcagatcacgaagtctctggaccgaacgctgatcagtttgagccatgggaatttttcccaccaatataatcgcaatatttttgtcacttggtggaagagcctatttgaggcttctacagcttttaggagggcaagtggtttaacggtatctcctctcacgaggagaggaatcgcaaggtttgaccatttcagacctgttcccaatgtcagtaaatttgcttcttttcccagagtgcccaaaggagccccaaggggcctttttaccaactggaatatgactacatcaaagagattattagggcagagagcttattcgacttccagtatcaaatttacccaagaagccgtgaataacatgactatatctttgaggtgttttttcaactcactaggcggattaaatcagtgctcccactctaattcctgcaaagcttatcagaatgcgtctaatgttacctctaaacaggatcacgtccaaccagttgcccttaagaagttatctcaaaaggatatcaatttcattcgtaatttagaactatttaagataatgaagacccagaatgaagtcgttgatgaaacaagcgcatattacatggaaaaaccaggttcctatattgaatttaccatttcagaatttaacgttaatgggacattctccgcacctttgtcatttttagatccttctttgttagcggatttggatgaaatgattagaaattacaaatacgaattaaaatcaatatacagtagtgttgacatgatcttgcagaattatggatcattgccgataacttttcatcgaaataagattcgaatacattttccaaactcaactgtggtggaaacagaaaaactaattgcaggtctgaatattgctacgggtgttatttacgcagatacgtctcccgatatcagtctagaaggtacaaatttgaatgctctggttaatgttgacaattcaggaagcgtatggtcttttgttaaggagccctcgtttccctctaggagcgctttttcacctattttatcagatgcatcctatgatacttatgaattggtctag

SEQ ID NO: 12415 - protein, 458 aa, Saccharomyces cerevisiae
MITQPAKCPLLIRISAFRSGSSFLLYVHCKSINKSWQPKPGNPLRNARLNYINIKDMWREASLPSHFAFHDLKWFFHNRRAPTRNMAVGGNNWSMWLRMSRVHLRQITKSLDRTLISLSHGNFSHQYNRNIFVTWWKSLFEASTAFRRASGLTVSPLTRRGIARFDHFRPVPNVSKFASFPRVPKGAPRGLFTNWNMTTSKRLLGQRAYSTSSIKFTQEAVNNMTISLRCFFNSLGGLNQCSHSNSCKAYQNASNVTSKQDHVQPVALKKLSQKDINFIRNLELFKIMKTQNEVVDETSAYYMEKPGSYIEFTISEFNVNGTFSAPLSFLDPSLLADLDEMIRNYKYELKSIYSSVDMILQNYGSLPITFHRNKIRIHFPNSTVVETEKLIAGLNIATGVIYADTSPDISLEGTNLNALVNVDNSGSVWSFVKEPSFPSRSAFSPILSDASYDTYELV

SEQ ID NO: 12416 - DNA, 1122 bp, Saccharomyces cerevisiae
  CDS (1)..(1122)
atggctgtcggtggtaataactggagcatgtggctgcgaatgtcacgggtccacctcaggcagatcacgaagtctctggaccgaacgctgatcagtttgagccatgggaatttttcccaccaatataatcgcaatatttttgtcacttggtggaagagcctatttgaggcttctacagcttttaggagggcaagtggtttaacggtatctcctctcacgaggagaggaatcgcaaggtttgaccatttcagacctgttcccaatgtcagtaaatttgcttcttttcccagagtgcccaaaggagccccaaggggcctttttaccaactggaatatgactacatcaaagagattattagggcagagagcttattcgacttccagtatcaaatttacccaagaagccgtgaataacatgactatatctttgaggtgttttttcaactcactaggcggattaaatcagtgctcccactctaattcctgcaaagcttatcagaatgcgtctaatgttacctctaaacaggatcacgtccaaccagttgcccttaagaagttatctcaaaaggatatcaatttcattcgtaatttagaactatttaagataatgaagacccagaatgaagtcgttgatgaaacaagcgcatattacatggaaaaaccaggttcctatattgaatttaccatttcagaatttaacgttaatgggacattctccgcacctttgtcatttttagatccttctttgttagcggatttggatgaaatgattagaaattacaaatacgaattaaaatcaatatacagtagtgttgacatgatcttgcagaattatggatcattgccgataacttttcatcgaaataagattcgaatacattttccaaactcaactgtggtggaaacagaaaaactaattgcaggtctgaatattgctacgggtgttatttacgcagatacgtctcccgatatcagtctagaaggtacaaatttgaatgctctggttaatgttgacaattcaggaagcgtatggtcttttgttaaggagccctcgtttccctctaggagcgctttttcacctattttatcagatgcatcctatgatacttatgaattggtctag

SEQ ID NO: 12417 - protein, 373 aa, Saccharomyces cerevisiae
MAVGGNNWSMWLRMSRVHLRQITKSLDRTLISLSHGNFSHQYNRNIFVTWWKSLFEASTAFRRASGLTVSPLTRRGIARFDHFRPVPNVSKFASFPRVPKGAPRGLFTNWNMTTSKRLLGQRAYSTSSIKFTQEAVNNMTISLRCFFNSLGGLNQCSHSNSCKAYQNASNVTSKQDHVQPVALKKLSQKDINFIRNLELFKIMKTQNEVVDETSAYYMEKPGSYIEFTISEFNVNGTFSAPLSFLDPSLLADLDEMIRNYKYELKSIYSSVDMILQNYGSLPITFHRNKIRIHFPNSTVVETEKLIAGLNIATGVIYADTSPDISLEGTNLNALVNVDNSGSVWSFVKEPSFPSRSAFSPILSDASYDTYELV

SEQ ID NO: 12418 - DNA, 23 bp, Artificial sequence
  primer
atgatcacccagcctgctaagtg

SEQ ID NO: 12419 - DNA, 26 bp, Artificial sequence
  primer
ctagaccaattcataagtatcatagg

SEQ ID NO: 12420 - DNA, 1374 bp, Saccharomyces cerevisiae
  CDS (1)..(1374)
atggttagctcactggcatcaaatataattctagcccttgtggtagtcctgatgacactgctaaggcaaaataagccgttgcagaggtggtttgtatcatatgttgaaaagctattatcaagaaaatcaaatctggcccaaaaagtcagcgttttatcgccctccttaaaattggttgatgttgagaaatcaatatctgccgatcaatcgaatctttctaaaattaattatcagattcccactcttcctgatcttacggggaatttaatccgtttacatgagtatcgagcaagaggagaaggctataatggccttttatttcggagagcaagacaattaaatggaatttcagaagatcagttgcaaaaattaggctacttcaccaaattaatgaaaaataatgagggtatccgagaaaacgcaagagttattgacaagataattgagttcactttagggaaattgattcattccaacgaacacgatgaagaatttacagaggaaattgaaaagatatgcgcggaacacggctataagattaaagatggtcaccttattcaattgaatcctgacttcgtatttccaatagtttcgtctcgaggcagccaaagtgtggtccatgaagcattagcacatttgtgtcgtgatttcagctcttactatagtgtggaaagagatcctttacaaaattttatcattagtagaatcaaccatcatgtgattagtgccggggacatgaaagagaaaattcttatcgtgaccccaggggctggtgtgggtggcctatcccatactcttgccaccactttccccaaaatacaggtggactccatcgaattatcagccttgatgtacatatgtaacctatttgcactcgaatataagcatgacgttaagatacgtccttttgtacaacaatattcatgccagacagtgtttgataatcagttgagaagtttatcggcagatttgagcaaagttggccaccgcagtaatctggacccactatggggggacttcacacgatattctcccatttccaaagactatgataaaattatcatttgtagcgcatatttcatagataccgcggaaaatatgtttgaatatctatccagtattgaagcactaaagaaatactgtaaagagctgcattgggtcaatgtaggtccattaaagtatggcaccaaacccttggtccaatttacaggagatgaattaagtcggctgcgtaaaattcgcgggtggaaggaccttgtggaggaatatgaagttgatagctcaaagggattgaatggctatttaactgattatgagtcaatgtatcaaggatactatggtctgcttaaatttcattctgtcttcgaaagctga

SEQ ID NO: 12421 - protein, 457 aa, Saccharomyces cerevisiae
MVSSLASNIILALVVVLMTLLRQNKPLQRWFVSYVEKLLSRKSNLAQKVSVLSPSLKLVDVEKSISADQSNLSKINYQIPTLPDLTGNLIRLHEYRARGEGYNGLLFRRARQLNGISEDQLQKLGYFTKLMKNNEGIRENARVIDKIIEFTLGKLIHSNEHDEEFTEEIEKICAEHGYKIKDGHLIQLNPDFVFPIVSSRGSQSVVHEALAHLCRDFSSYYSVERDPLQNFIISRINHHVISAGDMKEKILIVTPGAGVGGLSHTLATTFPKIQVDSIELSALMYICNLFALEYKHDVKIRPFVQQYSCQTVFDNQLRSLSADLSKVGHRSNLDPLWGDFTRYSPISKDYDKIIICSAYFIDTAENMFEYLSSIEALKKYCKELHWVNVGPLKYGTKPLVQFTGDELSRLRKIRGWKDLVEEYEVDSSKGLNGYLTDYESMYQGYYGLLKFHSVFES

SEQ ID NO: 12422 - DNA, 1323 bp, Candida glabrata CBS 138
  CDS (1)..(1323)
atgggtgatggtactgccactattgtagttacaatagccgttatctgcatgtcattattgagaaggtacaagccatttagagaatgggtagccaaagcagctgagagatcattaagggttataaagaacaaggatgagctatatttgactacaccagagctgacactccacaaatcaagaccttctgcttctgctaggccctttgaagaatatgtcaacgccctggaatcgatgaaaggctacttaaagtcatctcaaaagattactagtatggttaataatagagctaaagagttatctagaaaagagttatctcagctaaaggatattggatatttcagcaagttagactacataacaagcgctactattaagaatagtgcggttatcgaggatatcataaaatgtaccctaaaggagctggcattgaaaaatcataataacgttgatctaaaggctgatctagaattagcttgcaataagttgggctataaacttgactcagaaggtaatatttctaagctaaatactatcaagctactgagctctgcaacgagcagatcaaactcggttacagaatctctgaatcatctgtgcagagactggagtgactattataaatgtgaacgtgatccccttactgaatacatcattgagagaataaattctataaatattaaaggaaaagatatcttaatagtggttccgggttctggtgtaggtaacattgcatacaatttatctcagaagtttccagaggcaaaagtagattccatcgaattgtcttcctatatgttcatatgcaacagatatgcactaactagcagtaacgatattagtattagtccatttgcattgtattactctggccagacaagtgcaaaaaaccaaactcgagaattgaatgtaaacctatccaatgtatctgagagagaaaatctttacccatattgggctgattttagactatatccctctactctagaaaagaaatatgactacattattgtttgtactgcatacttcatcgatactgctgagaatttatttgaatatttcaactccattgaaaatctgtcagagcactgtaacaaagaccttcattggataaatattggacctttaaaatatggtactcgaccaaaggtacagttgactgtagaggaattaaccaaattacgtaagttacgtaattggaaggatcttcatacacaaacagttttggactatgatgaaaaactaaatggatacttaaccgattacgagggcctgtaccaaggctattatggattgacaaaattccatactgtctgcaggaagtga

SEQ ID NO: 12423 - protein, 440 aa, Candida glabrata CBS 138
MGDGTATIVVTIAVICMSLLRRYKPFREWVAKAAERSLRVIKNKDELYLTTPELTLHKSRPSASARPFEEYVNALESMKGYLKSSQKITSMVNNRAKELSRKELSQLKDIGYFSKLDYITSATIKNSAVIEDIIKCTLKELALKNHNNVDLKADLELACNKLGYKLDSEGNISKLNTIKLLSSATSRSNSVTESLNHLCRDWSDYYKCERDPLTEYIIERINSINIKGKDILIVVPGSGVGNIAYNLSQKFPEAKVDSIELSSYMFICNRYALTSSNDISISPFALYYSGQTSAKNQTRELNVNLSNVSERENLYPYWADFRLYPSTLEKKYDYIIVCTAYFIDTAENLFEYFNSIENLSEHCNKDLHWINIGPLKYGTRPKVQLTVEELTKLRKLRNWKDLHTQTVLDYDEKLNGYLTDYEGLYQGYYGLTKFHTVCRK

SEQ ID NO: 12424 - DNA, 1287 bp, Kluyveromyces lactis NRRL Y-1140
  CDS (1)..(1287)
atgaattcggtgtttaatagtattctgattattattttatcgttgggaatggcatcttttaccagaaataaagcatttaagaactggcttgtgtcaaagttggaaaaatcattaacaacattacagtcttatccaccggtctctgctaacttcaaactagtcgattcgccttattttacgaagcagcaatcacttaaagatattgctgcatcattatcacaattgtgtgagtacaagatcagagctctaagacaaaacgggatagtttatcaacgaacaagcaacgtaactcccagtgatatagaacagcttaaccagatcggttatttcgataaaatagttgccgtgaacaaatcaattgatgtaaattatgacaccttgagcaaaattatagaatatactctaaaggaaatacttgttaacaatgattttaactcagcaattgaatcagtactgagagacgctggttatacatgggacaaagaaaatgacacattggttcgcgattcaataaattccattcgattttctaaaaagagtaaccaaagccgtgtgaatgaagccatgtgtcacattgtcagagattggtgtgatgtttatgatttggaaagaaagcctcttgtagatttcattgaggagtctttcggaaattgtgacatcgatgaagacacattaattgttgtaccaggatctggatgtggaaggctagcttatgaggcagccaatcgatttccaaaagcaaaggttacatctattgaatactcgtctttgatgtatttgtgtaacgaatatgtcctcggaactacggacaatatcaccgttgatcccttctatcaaatttatagtggtcaacaaagtatggaagcgcaaaccaggcactttaggatggacttggataagttccaaaagccagagaacttaacagtacttttcggtgacttttgctgctataaaccagagaaaaaatacaaaaatataatagtatgttctgcattctttattgacacagcagcaaacatgtttgattacttcaatgctattgagatgctttctaacaattgtacaggacgtttacactgggttaatgttggaccgttgaaatacggaactagaccactagtacaattcacatacgatgagctagcaagactacgtaaattacgtggatgggaagatcattccaaccaggttgatgttaaaaatttgaatggttacctaacagactacgaatccttattccaagggttttatggtctagccaaattccattcggaactaaaaagataa

SEQ ID NO: 12425 - protein, 428 aa, Kluyveromyces lactis NRRL Y-1140
MNSVFNSILIIILSLGMASFTRNKAFKNWLVSKLEKSLTTLQSYPPVSANFKLVDSPYFTKQQSLKDIAASLSQLCEYKIRALRQNGIVYQRTSNVTPSDIEQLNQIGYFDKIVAVNKSIDVNYDTLSKIIEYTLKEILVNNDFNSAIESVLRDAGYTWDKENDTLVRDSINSIRFSKKSNQSRVNEAMCHIVRDWCDVYDLERKPLVDFIEESFGNCDIDEDTLIVVPGSGCGRLAYEAANRFPKAKVTSIEYSSLMYLCNEYVLGTTDNITVDPFYQIYSGQQSMEAQTRHFRMDLDKFQKPENLTVLFGDFCCYKPEKKYKNIIVCSAFFIDTAANMFDYFNAIEMLSNNCTGRLHWVNVGPLKYGTRPLVQFTYDELARLRKLRGWEDHSNQVDVKNLNGYLTDYESLFQGFYGLAKFHSELKR

SEQ ID NO: 12426 - DNA, 1245 bp, Debaryomyces hansenii CBS767
  CDS (1)..(1245)
atgttatcacgtactggggtctttaagaatttcatatcaaaactagacgtgtccaaggctatcggtcatcactctattccaagaattcctagtgtagagaacccaattggccatgatcttttccagtctataagtgagcattcaagaattgaaatattgtcggctataaaatcgttacaagcgtattctgacaacacaaagaatgtaaatgaccgaagaaggaggttattcaagatgatgacgtggagacaacagaagctatgtgaagacgttggttatttgaagaaattgacaaaaatcgatcagtcgatagcttataatcagaaaatattatcagccattgcggatggagctgttaagtcatttggtatatcgtacaaggattttaatttattgagaggatccaacaatagcaatacttcatccaccaattaccgagtgattgaagcattgggacattacatacgagattggagtcctgatggagatgcggagttgaagccgatgatggattatattactgagcaattgaatcgtgtaatcccggtacaggaaagactgaagacttgtgtcattatacctggtctggggctcgggagaattgcacatgaaattgcaagtattggcactgatattgggtccagctttggtgcggttcacgcgatagaatatagcggattgatgcatttatgcaatcaatttatttattcctctgaaaatgaagtaaagaattatgatatatttccgtatgtccattcttgttcgaacttcattgacagttcatctcaatttagatcgtctgttgtacatagtggccaatctaagcccgaaaatttagaattaaaccatgaagacttccgttattttgagattcctaataaatcgcagtatgaaaattttgtggttgtttcagcttttttcattgacaccgctgaaaacttagttagttatttggatacgattcaagaattaactacaccaaatagaagaaatggcatcaagaagggctattggataaatataggtcctttaaaatatggcacagctgctcaagttgagttaaattctgacgaattaaaggagattcgtaaagcaatgggttggaaagatctaagttctcttaatagtcttaatagttctgataatcagctagttggatatatgaccgataagcagagtatgtggcaaggatattatggtttaaccatgtggaatacggagaggaaggaaaattccagaaagtaa

SEQ ID NO: 12427 - protein, 414 aa, Debaryomyces hansenii CBS767
MLSRTGVFKNFISKLDVSKAIGHHSIPRIPSVENPIGHDLFQSISEHSRIEILSAIKSLQAYSDNTKNVNDRRRRLFKMMTWRQQKLCEDVGYLKKLTKIDQSIAYNQKILSAIADGAVKSFGISYKDFNLLRGSNNSNTSSTNYRVIEALGHYIRDWSPDGDAELKPMMDYITEQLNRVIPVQERLKTCVIIPGLGLGRIAHEIASIGTDIGSSFGAVHAIEYSGLMHLCNQFIYSSENEVKNYDIFPYVHSCSNFIDSSSQFRSSVVHSGQSKPENLELNHEDFRYFEIPNKSQYENFVVVSAFFIDTAENLVSYLDTIQELTTPNRRNGIKKGYWINIGPLKYGTAAQVELNSDELKEIRKAMGWKDLSSLNSLNSSDNQLVGYMTDKQSMWQGYYGLTMWNTERKENSRK

SEQ ID NO: 12428 - DNA, 1350 bp, Candida albicans SC5314
  CDS (1)..(1350): transl_table=12
atgttactggatgttcaacttatatcaacaacagtccctctttgtataattgtctactacctactatctttggtctatcagaaatcacaagtccctatattagtttcaacatttattttcacaaacatgatttctcgtacaagcatgttcagatcaatcgttgaaaatgctcaactgacattgaaacaacaaatcaccaatatccctaaatccgcgggcaccaattatcaaaatttcgtcaacttgaatgatgttcaaaaacgtgaggttttaacggcaattcaatctttgaaaagctatgaaaccagttccaaagctcaaaacgaccggagaagaaaactattccaacgcatgtcatacaaacagcagaaagcatgtaaagatattggatatttgaaaaaattggataaaatcgataatgctatcagtgccaattacaaatttgttgatgatgttgctgaccatgctatcgctaaatatggaatttcgttaaaagatttcgatttattaaattcagaaaagaaaaatgcaagtacaacatctgcttccaattatcgagtaattgaagctttaggtcattatactcgtgattggcatccagaaaatattggattggaattattacccatgtacgaatatgttgccctgcaactctcggcgttgatcccttatgatgccaaaaaagatacttgtttggttttcccaggatctggattaggtagattagcccacgcatttgctaaatgggattttggtgctgttcattcgattgaatattccgggttgatgaatgcttttgttgatttcaactataccaaatcagacaaaaattatacattgtacccgtttgttcatacttgttctgatttttacagcaccgaatctcaattgagaacttttgaatttaaacctctaggtgaaatcccagaaacgttgcatatacataatcaagattttagacatttcaaaatccccaatagagattcatataagaacattgtggtggtaaccgcatttttcattgacacggctgagaatttgttggattatttggatgttataaagaatttgacattaccatcaggtaacgtagaacgtggttattggataaatgttggtccattgaaatacggtactgcagctcaagtggaattaaacgctgatgaattgaaagaccttcgcaagaatttaggatggaaagattataactcagtgtacacaatttacgacaaattgtcggcaggtgacaagaccggacttgttgggtatttgacagataaagaaagtatgtggcaaggttactatggacttaacatgtttgccagtggtagagaggaaaataagttttaa

SEQ ID NO: 12429 - protein, 449 aa, Candida albicans SC5314
MLSDVQLISTTVPLCIIVYYLLSLVYQKSQVPILVSTFIFTNMISRTSMFRSIVENAQSTLKQQITNIPKSAGTNYQNFVNLNDVQKREVLTAIQSLKSYETSSKAQNDRRRKLFQRMSYKQQKACKDIGYLKKLDKIDNAISANYKFVDDVADHAIAKYGISLKDFDLLNSEKKNASTTSASNYRVIEALGHYTRDWHPENIGLELLPMYEYVASQLSALIPYDAKKDTCLVFPGSGLGRLAHAFAKWDFGAVHSIEYSGLMNAFVDFNYTKSDKNYTLYPFVHTCSDFYSTESQLRTFEFKPLGEIPETLHIHNQDFRHFKIPNRDSYKNIVVVTAFFIDTAENLLDYLDVIKNLTLPSGNVERGYWINVGPLKYGTAAQVELNADELKDLRKNLGWKDYNSVYTIYDKLSAGDKTGLVGYLTDKESMWQGYYGLNMFASGREENKF

SEQ ID NO: 12430 - DNA, 25 bp, Artificial sequence
  primer
atggttagctcactggcatcaaata

SEQ ID NO: 12431 - DNA, 25 bp, Artificial sequence
  primer
tcagctttcgaagacagaatgaaat

SEQ ID NO: 12432 - protein, 415 aa, Artificial sequence
  consensus sequence
  Variant (2)..(19): Xaa in position 2 to 19 is any amino acid
  Variant (20)..(34): Xaa in position 20 to 34 is any or no amino acid
  Variant (36)..(37): Xaa in position 36 to 37 is any amino acid
  Variant (39)..(45): Xaa in position 39 to 45 is any amino acid
  Variant (47)..(67): Xaa in position 47 to 67 is any amino acid
  Variant (70)..(71): Xaa in position 70 to 71 is any amino acid
  Variant (74)..(79): Xaa in position 74 to 79 is any amino acid
  Variant (81)..(82): Xaa in position 81 to 82 is any amino acid
  Variant (84)..(89): Xaa in position 84 to 89 is any amino acid
  Variant (91)..(122): Xaa in position 91 to 122 is any amino acid
  Variant (123)..(148): Xaa in position 123 to 148 is any or no amino acid
  Variant (150)..(150): Xaa in position 150 is any amino acid
  Variant (154)..(154): Xaa in position 154 is any amino acid
  Variant (156)..(157): Xaa in position 156 to 157 is any amino acid
  Variant (161)..(166): Xaa in position 161 to 166 is any amino acid
  Variant (167)..(167): Xaa in position 167 is any or no amino acid
  Variant (169)..(170): Xaa in position 169 to 170 is any amino acid
  Variant (172)..(175): Xaa in position 172 to 175 is any amino acid
  Variant (177)..(191): Xaa in position 177 to 191 is any amino acid
  Variant (192)..(196): Xaa in position 192 to 196 is any or no amino acid
  Variant (198)..(198): Xaa in position 198 is any amino acid
  Variant (201)..(201): Xaa in position 201 is any amino acid
  Variant (203)..(203): Xaa in position 203 is any amino acid
  Variant (205)..(206): Xaa in position 205 to 206 is any amino acid
  Variant (208)..(210): Xaa in position 208 to 210 is any amino acid
  Variant (212)..(217): Xaa in position 212 to 217 is any amino acid
  Variant (218)..(223): Xaa in position 218 to 223 is any or no amino acid
  Variant (225)..(225): Xaa in position 225 is any amino acid
  Variant (229)..(229): Xaa in position 229 is any amino acid
  Variant (231)..(231): Xaa in position 231 is any amino acid
  Variant (234)..(235): Xaa in position 234 to 235 is any amino acid
  Variant (238)..(250): Xaa in position 238 to 250 is any amino acid
  Variant (251)..(253): Xaa in position 251 to 253 is any or no amino acid
  Variant (256)..(259): Xaa in position 256 to 259 is any amino acid
  Variant (261)..(267): Xaa in position 261 to 267 is any amino acid
  Variant (269)..(269): Xaa in position 269 is any amino acid
  Variant (271)..(281): Xaa in position 271 to 281 is any amino acid
  Variant (282)..(282): Xaa in position 282 is any or no amino acid
  Variant (286)..(290): Xaa in position 286 to 290 is any amino acid
  Variant (293)..(300): Xaa in position 293 to 300 is any amino acid
  Variant (301)..(302): Xaa in position 301 to 302 is any or no amino acid
  Variant (304)..(305): Xaa in position 304 to 305 is any amino acid
  Variant (307)..(307): Xaa in position 307 is any amino acid
  Variant (309)..(310): Xaa in position 309 to 310 is any amino acid
  Variant (312)..(312): Xaa in position 312 is any amino acid
  Variant (320)..(322): Xaa in position 320 to 322 is any amino acid
  Variant (324)..(326): Xaa in position 324 to 326 is any amino acid
  Variant (328)..(329): Xaa in position 328 to 329 is any amino acid
  Variant (331)..(338): Xaa in position 331 to 338 is any amino acid
  Variant (339)..(343): Xaa in position 339 to 343 is any or no amino acid
  Variant (345)..(345): Xaa in position 345 is any amino acid
  Variant (347)..(347): Xaa in position 347 is any amino acid
  Variant (355)..(357): Xaa in position 355 to 357 is any amino acid
  Variant (359)..(362): Xaa in position 359 to 362 is any amino acid
  Variant (366)..(367): Xaa in position 366 to 367 is any amino acid
  Variant (371)..(372): Xaa in position 371 to 372 is any amino acid
  Variant (377)..(385): Xaa in position 377 to 385 is any amino acid
  Variant (386)..(394): Xaa in position 386 to 394 is any or no amino acid
  Variant (396)..(396): Xaa in position 396 is any amino acid
  Variant (402)..(402): Xaa in position 402 is any amino acid
  Variant (405)..(406): Xaa in position 405 to 406 is any amino acid
  Variant (413)..(414): Xaa in position 413 to 414 is any amino acid
LXXXXXXXXXXXXXXXXXXXXXXXXXXXXXXXXXLXXYXXXXXXXNXXXXXXXXXXXXXXXXXXXXXGYXXKLXXXXXXIXXNXXXXXXIXXXXXXXXXXXXXXXXXXXXXXXXXXXXXXXXXXXXXXXXXXXXXXXXXXXXXXXXXXVXEALXHXXRDWXXXXXXXEXXPXXXXIXXXXXXXXXXXXXXXXXXXXVXPGXGXGXXAXXXAXXXXXXXXXXXXVXSIEXSXLMXXCNXXXXXXXXXXXXXXXXPFXXXXSXXXXXXXQXRXXXXXXXXXXXXENLXXXXXDFXXXXXXXXXXYXXIXVXXAXFIDTAENXXXYXXXIXXLXXXXXXXXXXXXXWXNXGPLKYGTXXXVXXXXDELXXLRKXXGWKDXXXXXXXXXXXXXXXXXXLXGYLTDXESXXQGYYGLXXF

SEQ ID NO: 12433 - protein, 31 aa, Artificial sequence
  protein pattern
  Variant (8)..(8): Xaa in position 8 is any amino acid
  Variant (9)..(9): Xaa in position 9 is Ala or Pro
  Variant (10)..(10): Xaa in position 10 is any amino acid
  Variant (12)..(12): Xaa in position 12 is Glu or Gln
  Variant (13)..(13): Xaa in position 13 is Phe or Leu
  Variant (14)..(14): Xaa in position 14 is Asn or Thr
  Variant (15)..(15): Xaa in position 15 is any amino acid
  Variant (19)..(19): Xaa in position 19 is any amino acid
  Variant (20)..(21): Xaa in position 20 to 21 is any or no amino acid
  Variant (23)..(24): Xaa in position 23 to 24 is any or no amino acid
  Variant (26)..(27): Xaa in position 26 to 27 is any amino acid
  Variant (30)..(30): Xaa in position 30 is Glu or Lys
GPLKYGTXXXVXXXXDELXXXRXXKXXGWXD

SEQ ID NO: 12434 - protein, 21 aa, Artificial sequence
  protein pattern
  Variant (3)..(3): Xaa in position 3 is Leu or Met
  Variant (6)..(6): Xaa in position 6 is any amino acid
  Variant (7)..(7): Xaa in position 7 is Glu or Gln
  Variant (8)..(8): Xaa in position 8 is Gly or Ser
  Variant (9)..(9): Xaa in position 9 is Leu or Met
  Variant (10)..(10): Xaa in position 10 is Trp or Tyr
  Variant (17)..(18): Xaa in position 17 to 18 is any amino acid
  Variant (19)..(19): Xaa in position 19 is Phe or Trp
  Variant (20)..(20): Xaa in position 20 is any amino acid
  Variant (21)..(21): Xaa in position 21 is Ser or Thr
GYXTDXXXXXQGYYGLXXXXX

SEQ ID NO: 12435 - protein, 28 aa, Artificial sequence
  protein pattern
  Variant (2)..(3): Xaa in position 2 to 3 is any or no amino acid
  Variant (5)..(6): Xaa in position 5 to 6 is Ile or Val
  Variant (7)..(7): Xaa in position 7 is Cys or Val
  Variant (8)..(8): Xaa in position 8 is Ser or Thr
  Variant (10)..(10): Xaa in position 10 is Phe or Tyr
  Variant (16)..(16): Xaa in position 16 is Ala or Glu
  Variant (18)..(18): Xaa in position 18 is Leu or Met
  Variant (19)..(19): Xaa in position 19 is Phe or Leu
  Variant (20)..(20): Xaa in position 20 is Asp or Glu
  Variant (22)..(22): Xaa in position 22 is Phe or Leu
  Variant (23)..(23): Xaa in position 23 is Asp, Asn or Ser
  Variant (24)..(24): Xaa in position 24 is Ala, Ser or Val
  Variant (26)..(26): Xaa in position 26 is Glu or Lys
  Variant (27)..(27): Xaa in position 27 is any amino acid
YXXIXXXXAXFIDTAXNXXXYXXXIXXL

SEQ ID NO: 12436 - protein, 14 aa, Artificial sequence
  protein pattern
  Variant (2)..(2): Xaa in position 2 is any amino acid
  Variant (5)..(5): Xaa in position 5 is Leu or Met
  Variant (6)..(6): Xaa in position 6 is Ala, Cys or Gly
  Variant (8)..(9): Xaa in position 8 to 9 is any amino acid
  Variant (12)..(12): Xaa in position 12 is Phe or Trp
  Variant (13)..(13): Xaa in position 13 is any amino acid
  Variant (14)..(14): Xaa in position 14 is Asp, Pro or Ser
VXEAXXHXXRDXXX

SEQ ID NO: 12437 - protein, 14 aa, Artificial sequence
  protein pattern
  Variant (2)..(2): Xaa in position 2 is any or no amino acid
  Variant (4)..(4): Xaa in position 4 is any amino acid
  Variant (7)..(7): Xaa in position 7 is Ala or Ser
  Variant (9)..(9): Xaa in position 9 is any amino acid
  Variant (11)..(11): Xaa in position 11 is any amino acid
  Variant (12)..(12): Xaa in position 12 is Ile or Leu
  Variant (13)..(13): Xaa in position 13 is Ala or Ser
  Variant (14)..(14): Xaa in position 14 is His or Tyr
LXVXPGXGXGXXXX

SEQ ID NO: 12438 - protein, 36 aa, Artificial sequence
  protein pattern
  Variant (2)..(2): Xaa in position 2 is any or no amino acid
  Variant (4)..(4): Xaa in position 4 is any amino acid
  Variant (5)..(8): Xaa in position 5 to 8 is any or no amino acid
  Variant (11)..(11): Xaa in position 11 is Phe or Leu
  Variant (12)..(12): Xaa in position 12 is any amino acid
  Variant (15)..(17): Xaa in position 15 to 17 is any amino acid
  Variant (18)..(18): Xaa in position 18 is Asp, Asn or Thr
  Variant (19)..(19): Xaa in position 19 is Glu, Asn, Gln or Ser
  Variant (20)..(20): Xaa in position 20 is Ala, Gly or Ser
  Variant (21)..(23): Xaa in position 21 to 23 is any amino acid
  Variant (25)..(26): Xaa in position 25 to 26 is any amino acid
  Variant (27)..(27): Xaa in position 27 is Phe, Ile or Val
  Variant (28)..(28): Xaa in position 28 is Ile, Leu or Val
  Variant (29)..(29): Xaa in position 29 is Asp, Glu or Ser
  Variant (30)..(30): Xaa in position 30 is any amino acid
  Variant (31)..(31): Xaa in position 31 is Ile or Val
  Variant (32)..(32): Xaa in position 32 is Ala or Ile
  Variant (33)..(33): Xaa in position 33 is Asp, Glu or Lys
  Variant (34)..(34): Xaa in position 34 is any amino acid
  Variant (35)..(35): Xaa in position 35 is Ala or Thr
  Variant (36)..(36): Xaa in position 36 is Ile, Leu or Val
QXKXXXXXGYXXKLXXXXXXXXXNXXXXXXXXXXXX

SEQ ID NO: 12439 - protein, 12 aa, Artificial sequence
  protein pattern
  Variant (3)..(3): Xaa in position 3 is any amino acid
  Variant (4)..(4): Xaa in position 4 is Leu, Pro or Val
  Variant (5)..(5): Xaa in position 5 is any amino acid
  Variant (6)..(6): Xaa in position 6 is Phe, His or Trp
  Variant (7)..(7): Xaa in position 7 is Ala, Glu or Gly
  Variant (10)..(10): Xaa in position 10 is any amino acid
  Variant (11)..(11): Xaa in position 11 is any or no amino acid
NLXXXXXDFXXY

SEQ ID NO: 12440 - DNA, 681 bp, Saccharomyces cerevisiae
  CDS (1)..(681)
atggccgacatcaataaatatattccgatggttgacgctattttgagcgtatccaaccccgatgaaataagcccaaaaagggtgaggaaagccctgcaaattctctattcagttaatttggattcacaaagaaagttaattaatgaattgattcttgagaggttcggcgatatacaagaaaacccaagagtcttaattccgaagaacgacctcattagtcgggatcaagaactatctttgaggttacagaaggaagaagaaagacccttgaggtctacgaggaaaaggaaaggtaaaagtgaaagtaaatctaaaaggaagaagaaaaagaatgatagtcctgattccaacagcatttccgtccgcaaagttctgttgtcagctcctttacaaaagtttctaggatctgaagaactgccacgaacgcaagtagtgaagatgatatggcagtatatcaaagagcatgatcttcaaaacccaaaagatcgtagagaaattctatgcgatgagaagatggaaccaatttttggcaaaaaaatgacgatgttttcaatgaataaactcttaactaagcacttgtttaatcccgatgaaattgtgaaacatgaagaggaacaaaagcaaacacccgaaaaagaaatcaaattggaaaacgaatctcttcccaatttaagcggttga

SEQ ID NO: 12441 - protein, 226 aa, Saccharomyces cerevisiae
MADINKYIPMVDAILSVSNPDEISPKRVRKALQILYSVNLDSQRKLINELILERFGDIQENPRVLIPKNDLISRDQELSLRLQKEEERPLRSTRKRKGKSESKSKRKKKKNDSPDSNSISVRKVLLSAPLQKFLGSEELPRTQVVKMIWQYIKEHDLQNPKDRREILCDEKMEPIFGKKMTMFSMNKLLTKHLFNPDEIVKHEEEQKQTPEKEIKLENESLPNLSG

SEQ ID NO: 12442 - DNA, 1185 bp, Oryza sativa
  CDS (1)..(999)
atggtgtcggactcggagctggtggagcggctgcgggaggtgctgcggtcgtccgacctcaacaccaccaccaccgccatcctgcgccgccgcctcgaggaggacttcggcgtcgacctctccgacaagaagctcttcatccgcgagcaggtcgacctcctcctctccgaggtcgccggcaaggccgagcaggaggaggcggaggtgcccaaggaggaggagcccgagaccggggcggaggcagcgggtggagagccagggggcgctgaaggggagggggaagaagaggaggaggaagaggaagaggaggaggaggaggaggaggaggaagacagtagcggcagccggaagaagcggcgatcagatggagccaatactgatggcaagagaaaaggtggtggcttcaccaaattatgtagcatttccccaacgcttcaagagtttgttggtgcctctgagttagctaggacagaggtagtcaagaagctttgggcatatatccgagaaaataacttgcaagacccaagcaataagaggaagattctgataaaatttctgatcactgatgaatacactacaacacagaattgtgcgcgggcactgcagtacataataaggtttttgaaatctgagcatggaggtcctgtgacctctgcctcacctgagagatcaacacccaaagagaagcctcaaaagagagaaagaaatgaagggaagaagcaaaaaggtggttcttctgggtctggatctggttttcttgtgccccttcaactttcggatgatttagtgaaattcattggcactggtgagagtatgctttcgcgatctgatgttgtgaaaagaatgtgggactatataaaagagaataaattacaggatccttctgaccggaggaaaataatatgtgacgagaagctgaaggatctattgcaagttgaatcattcaatggctttactgtttcgaagctgcttgctccccatttcaccaagacaaagtagtgacttgcaccatccagatctgccaaacccagaaggatgggtaattttgttttgcagaatgtgtaacatgaaactgttagggaactatgtgagaaatgtggaattttaacttgtgggtgggatctccttccgaaatcaacagtaggttcctaaaaatctaatgaagtttgcatctgttgactaacc

SEQ ID NO: 12443 - protein, 332 aa, Oryza sativa
MVSDSELVERLREVLRSSDLNTTTTAILRRRLEEDFGVDLSDKKLFIREQVDLLLSEVAGKAEQEEAEVPKEEEPETGAEAAGGEPGGAEGEGEEEEEEEEEEEEEEEEEDSSGSRKKRRSDGANTDGKRKGGGFTKLCSISPTLQEFVGASELARTEVVKKLWAYIRENNLQDPSNKRKILIKFLITDEYTTTQNCARALQYIIRFLKSEHGGPVTSASPERSTPKEKPQKRERNEGKKQKGGSSGSGSGFLVPLQLSDDLVKFIGTGESMLSRSDVVKRMWDYIKENKLQDPSDRRKIICDEKLKDLLQVESFNGFTVSKLLAPHFTKTK

SEQ ID NO: 12444 - DNA, 1389 bp, Arabidopsis thaliana
  CDS (1)..(1389)
atggtttccgacttggacctcgtgacccgactccgtgagattctcggtagctccgacctgaacacggcgactccggcaagcgtccgtcgtcagttggaggcggatttcggtgtggacttgacagataaaaaagcgtatattagggatcaaatcgatacttttctcgagagcaatggcgcggtagaagacaaacctgagagtcccaaggtagaagaatacattaatgccgacgaaatcaaggcggaaattgaaggaggcgatggagaagacctcgacggagatggaagtggaagtgaggaagagaaggaagaacggccagtaaaggccaagaagcgaggtggtggcattaccaaagtatctcagttatctccacaacttgagaaagttgttggagcatctcagttaggtcgaaccgaggttgtgaagaaaatgtgggcatatatccgagagaaggatttgcaagacccaaaggataggaggaagatagtgtgtgacgagttgttgcattccttgttccgtgttaagaccattaatatgtttcaaatgaacaaggcattaaccaagcatatttggcccttaggtgatggagatgggtgtgctaacgatgtgaaagaagaagatgaagatgaggcatcagagggaacagataagaaaggggagcagagcgaagaagtggaagagaataaggaagaagaaagtgaagagcaggaagttaggagtttgcggaaacgcaagagaaaaaagccagccaagtcggtagagaagcccaagagaaaaggaggaggcggctttgctaaagtttgcagcctctcgccagagcttcaggcgtttactggggtgacagaattagccaggacagaggttgtgaaattgctttggaagtacataaaggagaacaatttacaagatccgaatgataaacgctctataatatgcgacgaatcatttcgatctctgttccctgtcgagtccatcaatatgtttcaaatgaataaacagctaacaaagcacatatggcctttagaggataatgcaggagaatcagttagctctaagtctccaaagaatggaaagcaaaaaatggaatcagatggagatagtgaggaaccaaatgagaaagataaaaagcagaagaaagaagttcttgctccccttccactttcagatgctcttgtcaagttcttgggtgatggagaaaactcgctgtcgagggcggatgtggtaaagagattgtgggagtacataaatcataatgatcttcaggatccttctgacaagaggagagtcatatgcgatgagaagctgaaagaactctttgaagttgattcattcgaagacacatcagtctcaaaacttctgaccaaccacttcatcaaggccgaacaatga

SEQ ID NO: 12445 - protein, 462 aa, Arabidopsis thaliana
MVSDLDLVTRLREILGSSDLNTATPASVRRQLEADFGVDLTDKKAYIRDQIDTFLESNGAVEDKPESPKVEEYINADEIKAEIEGGDGEDLDGDGSGSEEEKEERPVKAKKRGGGITKVSQLSPQLEKVVGASQLGRTEVVKKMWAYIREKDLQDPKDRRKIVCDELLHSLFRVKTINMFQMNKALTKHIWPLGDGDGCANDVKEEDEDEASEGTDKKGEQSEEVEENKEEESEEQEVRSLRKRKRKKPAKSVEKPKRKGGGGFAKVCSLSPELQAFTGVTELARTEVVKLLWKYIKENNLQDPNDKRSIICDESFRSLFPVESINMFQMNKQLTKHIWPLEDNAGESVSSKSPKNGKQKMESDGDSEEPNEKDKKQKKEVLAPLPLSDALVKFLGDGENSLSRADVVKRLWEYINHNDLQDPSDKRRVICDEKLKELFEVDSFEDTSVSKLLTNHFIKAEQ

SEQ ID NO: 12446 - DNA, 3366 bp, Gibberella zeae PH-1
  CDS (1)..(3366)
atgggtacccctctgacttctgaagagctcaagcgctataccgccatcatcgatgatatcctcgaaacgtccgatttggaaacaatctcgcgaaagaagattagacagggtctggagaatgccctcggtggccaggatttgagcgagcaaaagaacgccataaagcggctgatcgaggctcgctttgatgccgtctctggagctgataccggcattactcctccaacaacttcggactcgctcgccgccaacgggacctccgatgtgggcgatacagaacaatctgcgactcctgaaccttcgcgaaagaaggtcaagagatcatcatcggccgaagatgcggatgctcgactcgctgctcaactccaagcgcaggaaaacagcctagctagagggcgcaagactcgaggaggtgacaagccgaccaagaaaaaggcagcaccacgcaagaagagcgcaaagaaggtcaaagccgatgacgacagcgatctggaaccagccgatggcgagactggcaagaagagaaaggctggcggtggtttccaaaagccatttaacctgagcgagaccctctcggagctggttggcgagacacaactatcccgacctcaagtggtcaagaagctctgggaacacatcaaagccaacgatctccaggacccaaaggacaagcgacagatcatatgcgacgacaagatgcatgcagtcttcaagcaagctagggtagacatgttcaagatgaacaaggatatcggcagccacctttaccccgtcgaagagctcagtagaatctctgatcatggtgaacctgcatttattctggccggtgactctaaacttcaaatgacagccaaacgagaaccaatcaaagttgtcaattcatgcatcccttgttcggcgagtccttacaaagattactcagacaccgccacagactctgactccatcccctatcaagctaccacatctcaacaattcgacacttctcgtgcggccgagcgacataagcagagctctatcttcgatcttcaccctacccacgaccaaatttcaccttctgggagctcaaagcttctagccatgtctccaccagagggagacaacaacactggagtgtcagcctccgattcccaaccccaaggtgacggccagcgcaacagaggacgaggccgaggcaaaggaaaccaaaatcgacgaggcggccaacggcgaggtcgtggtggtaacaacgccaacgtcccaaatgtccctgccaacccagctgcacaagacgttgccgccgcggcttcacgcgcacatgccttagctgctagtaaagctgccgaagctgccgaggacgacgatgatgccgaagtgtgctttatttgcgccaacccggttgctcatcattctattgcaccttgcaaccacacgacatgccatatttgcggcctgcgcatgagggctctttataagacaaaggactgtgctcactgccgtacccctgctccctatgtcatattcaccgacgaccccgagaagcgtttcgaggagtactcagaaaaagatatcactactaccgacagcaacatcggtatcaagtatacgcaagaggatattgtcggcgacaccgtacttcttctgcgatacaactgtcccgaaccgtcatgcgattttgctggtcttggctggcctgatttgcaccgccatgttaaatccgcccacaaaaagcgcatgtgtgatctatgcactcgtaataagagagttttcacacatgagcatgagttgtttgcagacaaggaactagaaaggcatatgcgtcatggagacgacaagcctggcgcggcggaccagacgggcttcaagggacatccactttgtgggttctgtggagagcgtttctacgatgacgataagctgcgagattcgagacatccccactactacctcgactacaacgctttggaagaacatttcaagaaggaccactacctctgcggcgatcgagaatgtatggaaaagaagtttgtcgtcttcgagtccgagctggacttgcaggctcatcagttgagcgatcacggcggtaaagcgacaagtagagacgcgcgagtcgtcaacatttcgggtttcgacatccgaacaccatatcaacaggagagaggaagcggtggtgccggtggaagagatgaaggaagacgtggtggcagagatgggcgaagaggaggaaacagaggccgggaccctaatgcggaaccggttcctgtcagctcagcccagcctctacgacgtgacgaaattgctttccagcgacaaatggccatccattctgcacagtcagtttcgaaccgtacttttggcggagctttgtctactcctacaccagcgcaagcctcatcacaatctcgtggtggcagctcatcgaacacgcctcgcgccagtcagaccaaccttgctaatcccatagagtccgctactgtcgacccggccaacctcagccccgaagagcgtgctcgtcttgtgcgccatggtgctgttgtcgagcgagcctcaaacctcctcggcaacgacacccaacgaatggccacattccgaagccacatctcctcataccgacaaggcagtcttactgctcctcagcttattgatgccttcttcaccctctttgccgacacttcctcaaacgctctcggtactatggtacgagaagttgcggatctttatgaagacaagagcaaggctgaaaaccttcgcaaagcctggcaggattggcgagctatcaacgaggattaccccagcttgcctggcctgagtggcatgcatggcgcaacctcgagttcaagtggttgggctggcgcggcatcggccaacccagctgttcccaatgccaaggtcacccaaaagtactcgaaccgtgttctcaagctcaagaatagtacaagacttggaggcccggctcccgtatcttcaagtggtgcgtcatcatcatgggctggtcgtcccgccgtcagcgccccgccagcatcctccaacgcattcccatctctcccctcctccagcaagaagtcatctgcatctagctccaactggacgactcccactccctcatcgtcatcacaatccacgactctcaaccgccctcgccctgctccccgtcctaccggcgaagacgctttcccagctcttcccgcggcgccaaagcccacaaccacaatctttggttacggcaacggccgcgccgtacgacgtgactacggaaaccgcgagacaaacttccaatggggcagcggtccgagcacgccagctgatgaggagcccgccgatgaagaagcgggcggtaagaagaagggtggcaagaagggcaagaaggttcttgtccagtggggttaa

SEQ ID NO: 12447 - protein, 1121 aa, Gibberella zeae PH-1
MGTPLTSEELKRYTAIIDDILETSDLETISRKKIRQGLENALGGQDLSEQKNAIKRLIEARFDAVSGADTGITPPTTSDSLAANGTSDVGDTEQSATPEPSRKKVKRSSSAEDADARLAAQLQAQENSLARGRKTRGGDKPTKKKAAPRKKSAKKVKADDDSDLEPADGETGKKRKAGGGFQKPFNLSETLSELVGETQLSRPQVVKKLWEHIKANDLQDPKDKRQIICDDKMHAVFKQARVDMFKMNKDIGSHLYPVEELSRISDHGEPAFILAGDSKLQMTAKREPIKVVNSCIPCSASPYKDYSDTATDSDSIPYQATTSQQFDTSRAAERHKQSSIFDLHPTHDQISPSGSSKLLAMSPPEGDNNTGVSASDSQPQGDGQRNRGRGRGKGNQNRRGGQRRGRGGNNANVPNVPANPAAQDVAAAASRAHALAASKAAEAAEDDDDAEVCFICANPVAHHSIAPCNHTTCHICGLRMRALYKTKDCAHCRTPAPYVIFTDDPEKRFEEYSEKDITTTDSNIGIKYTQEDIVGDTVLLLRYNCPEPSCDFAGLGWPDLHRHVKSAHKKRMCDLCTRNKRVFTHEHELFADKELERHMRHGDDKPGAADQTGFKGHPLCGFCGERFYDDDKLRDSRHPHYYLDYNALEEHFKKDHYLCGDRECMEKKFVVFESELDLQAHQLSDHGGKATSRDARVVNISGFDIRTPYQQERGSGGAGGRDEGRRGGRDGRRGGNRGRDPNAEPVPVSSAQPLRRDEIAFQRQMAIHSAQSVSNRTFGGALSTPTPAQASSQSRGGSSSNTPRASQTNLANPIESATVDPANLSPEERARLVRHGAVVERASNLLGNDTQRMATFRSHISSYRQGSLTAPQLIDAFFTLFADTSSNALGTMVREVADLYEDKSKAENLRKAWQDWRAINEDYPSLPGLSGMHGATSSSSGWAGAASANPAVPNAKVTQKYSNRVLKLKNSTRLGGPAPVSSSGASSSWAGRPAVSAPPASSNAFPSLPSSSKKSSASSSNWTTPTPSSSSQSTTLNRPRPAPRPTGEDAFPALPAAPKPTTTIFGYGNGRAVRRDYGNRETNFQWGSGPSTPADEEPADEEAGGKKKGGKKGKKVLVQWG

SEQ ID NO: 12448 - DNA, 726 bp, Candida glabrata CBS 138
  CDS (1)..(726)
atggctccacaatacattagtgaagagtacgaatcgatgattgatgcggtcttgacgtactgcgatgaagaagtatctctaaactccctgagagctcaactaaacgaagtgtttagcctcaacatcaagtcatttgacctgaaccttcgaactttggtagacaagaaattggaagccttcaagaatgtaacagagaagcccaaggtgaaggacatcagtaccgataaagttatgacagagaatcgaaggtatataaatgtgataaaacagactctgaaggaagcagagttaaagaaagaaggcataacagtcacgaaagtacagaagcccaagctgaaactaaaagttaccaacagtaaaaagagtatgattcacatcaagatgacagtgacgccagagctccaagctgtaatcggaacacattatcaatcgagaacagagatagttcgaaatttatggaaatatattaaagaacataacttacaaaatccggatgacaagaggcaaatcatatcagatgcaatgttggaacctgtgctgggcaaaacgtcggatatattcatgatgcaccgggctctcaaacaccacatattgggaccagcaccgatagaggcagaagtaatacgcactgaccaagaaagtactccatctctagcttcagagtccagtgagcaagaacatgcagatagcactgataccagcgactcagtttactactctacatga

SEQ ID NO: 12449 - protein, 241 aa, Candida glabrata CBS 138
MAPQYISEEYESMIDAVLTYCDEEVSLNSLRAQLNEVFSLNIKSFDLNLRTLVDKKLEAFKNVTEKPKVKDISTDKVMTENRRYINVIKQTLKEAELKKEGITVTKVQKPKLKLKVTNSKKSMIHIKMTVTPELQAVIGTHYQSRTEIVRNLWKYIKEHNLQNPDDKRQIISDAMLEPVLGKTSDIFMMHRALKHHILGPAPIEAEVIRTDQESTPSLASESSEQEHADSTDTSDSVYYST

SEQ ID NO: 12450 - DNA, 702 bp, Candida glabrata CBS 138
  CDS (1)..(702)
atggaccaaaatatcgatttgaataactatgtgtcgatgttagacgctataattagtgtatctgatcctgataaggttagtcccaaaaaaatacgtaaggctttggaacaactgttctctgtatcattagagaataaaaagaaagaagtcaatgagcttattgtggcgaggttccagattttgcaagctgaccctcatatattggtaagtaatgaagaatttcaaaacctaaagatgataaggggaaactatgatgcacttctgtcatccaagtcaatggaaaagaagcacaagttaactgaatcttcgaaaaagacacgtatacaagttaagaagaaaaaaagcaagaaaagctctaaggatggtgagaaaaaagtagccaatcctaattcaaatgccatcaattctatgaaattgagattatcagatgatctctacaaattcttaggagaacgggaactcccaagaactcaggttgtcaagcaagtttgggattatattaaggaacataaccttcaaagccccgaagaccgtagagaaataatatgtgatgataggatgaggcctatattcggtgacaagatgacgatgttcgcgctgaataagatactgtcaaagcatctgacaaaaatagagcctaagagtgaggaagctgataatagtagactatcagtaaagctagaggatggtactcaagcatga

SEQ ID NO: 12451 - protein, 233 aa, Candida glabrata CBS 138
MDQNIDLNNYVSMLDAIISVSDPDKVSPKKIRKALEQLFSVSLENKKKEVNELIVARFQILQADPHILVSNEEFQNLKMIRGNYDALLSSKSMEKKHKLTESSKKTRIQVKKKKSKKSSKDGEKKVANPNSNAINSMKLRLSDDLYKFLGERELPRTQVVKQVWDYIKEHNLQSPEDRREIICDDRMRPIFGDKMTMFALNKILSKHLTKIEPKSEEADNSRLSVKLEDGTQA

SEQ ID NO: 12452 - DNA, 840 bp, Aspergillus nidulans FGSC A4
  CDS (1)..(840)
atgtcgctttccccaggcgcccgcgatcaatatatcccaatcatcgattcaattttatctgcgagcgacctaaatacgatctcagagaagcgcattcgcaaaggtctccaagatgaaattggctatgatcttaccccgcaaaaggctgcggtgaagcagctcattatggagaggttcgacatctttgctgagaaaaaaggcataggtgctccgcctacaccaaacggccaaaacggccacgaacaacagcataatacggcaacgcctgtggaaccttcctcaccctcccagtcctcgacagcgcagaaacgtcaggcagatagtgctgactcggatgatcgctcaagcaagacgcccccgcccaagaaacagaaggcgaaccatgatatagatgcggatgcactctatgctgcaaagctacaggccgaggagaatatgcgagctcgtcctacacgaggcgcaagcacgcgaaaagcggcgccggtcaagaagaagaagtctacagcgaaaacggcgaagaaagtaaaggcagaggacgattcagatatcgggtcgggctcagagtcagggaagaaagtgaaccgttctggaggattccacaaaccgcttaacctctcaccggcgctctcagcattgctggggggcgcggcgacgctttcacggccacaaacagtcaaaaagctctgggagtacattcacgagcatgatcttcaggacccaagcgatagacgtcaaatccgctgtgatgatcctatgcgcgctgtgttcaaacaggaccgcatacacatgttcaccatgactaaaattctcagtcaaaatctgtacagccctgacgaatag

SEQ ID NO: 12453 - protein, 279 aa, Aspergillus nidulans FGSC A4
MSLSPGARDQYIPIIDSILSASDLNTISEKRIRKGLQDEIGYDLTPQKAAVKQLIMERFDIFAEKKGIGAPPTPNGQNGHEQQHNTATPVEPSSPSQSSTAQKRQADSADSDDRSSKTPPPKKQKANHDIDADALYAAKLQAEENMRARPTRGASTRKAAPVKKKKSTAKTAKKVKAEDDSDIGSGSESGKKVNRSGGFHKPLNLSPALSALLGGAATLSRPQTVKKLWEYIHEHDLQDPSDRRQIRCDDPMRAVFKQDRIHMFTMTKILSQNLYSPDE

SEQ ID NO: 12454 - DNA, 858 bp, Phaeosphaeria nodorum
  CDS (1)..(858)
atggcggagtctctagcccccgatgtcgaggcgtcgtactccgccatcatcgacgagatcctgcgagccagcgatcttaacaccatctccgcgaagcgcatacgaaagggcctccaagagcgggtcgaacacgacaccacacaccagaaggatgccatcaccgacctgatcatgaagcgcttcgacgccttcaactcctccaatcccagccctccctcgccctcagaccccatccccaccgtcgaaaacggcacatctacctcctccgccaagcgctcgcccgcctcggaatccgccctctctgacctcgaagacgccgcgccacccaagaagaagactaagaagacgcgccccaaggaagacgacgacgctgcatacgctaggagactgcagcaggaagagaacagccgcatgcgcagtacgcgcggggggaacacgaagaagcgcgcgcccttgccgaagaagaagacgaaaaagaagagcagcaacaaagtcaaggacgaggatgacagtgacatcgcgagcgggagtggtgcggagaagaagagtccaagtaaaaaggggggatttcataaaccaatggccctctcccccgccctctcctccttactcaacgaaacacagctctcccgcccccaaaccgtcaagaaaatctgggaatacgtcaagcagcgcgacctccaggaccccgccgacaagcgccagatccgctgcgacgacgccatgcgcgccgtcttcaagcaggatcgcgtccacatgttcaccatgaacaagatcctcaatcagaatctgtatgccgtcgatgaaatcaccgcgccgccggcaacggtgggcgtggatgtcgatgtcgaggcgtag

SEQ ID NO: 12455 - protein, 285 aa, Phaeosphaeria nodorum
MAESLAPDVEASYSAIIDEILRASDLNTISAKRIRKGLQERVEHDTTHQKDAITDLIMKRFDAFNSSNPSPPSPSDPIPTVENGTSTSSAKRSPASESALSDLEDAAPPKKKTKKTRPKEDDDAAYARRLQQEENSRMRSTRGGNTKKRAPLPKKKTKKKSSNKVKDEDDSDIASGSGAEKKSPSKKGGFHKPMALSPALSSLLNETQLSRPQTVKKIWEYVKQRDLQDPADKRQIRCDDAMRAVFKQDRVHMFTMNKILNQNLYAVDEITAPPATVGVDVDVEA

SEQ ID NO: 12456 - DNA, 813 bp, Aspergillus oryzae
  CDS (1)..(813)
atgttcccggaagcccgcgaccaatatgtaccaatcattgactcgatcctggcgaagagcgaccttaatactatctccgagaagcgaatccgtaaagggcttcaggaagaggtcggctatgatcttactccgcagaagcttatcatggaacggttcgacatctttgccgagaatggtggtatagaagcttctcccgaggcggcggtcgctactgctcctgcgaccaatggccacagctctgcgacaccggtcgaggcttcgtcccctgcccaatcctccaagtcacagaaacgtcaggcggatagtgtggaacgcgaatcagacaaaactcctccgatgaagaggaaaaagcccgatcacgatgtggatgcggatgcccttttcgcggcaaagttgcaggcggaggagaacatgcgtgcccgtcccactcgcggtgctagcgcacgtaaagttcagccggcaaagaagaagacaaccaaggctaaaacgtcaaaaaaggtcaaggcggaggacgactcagatgtcgactccagttcggactccaagaaagtaaaccgctctggtggatttcataaaccgcttactctttcaccggcattgtcagcgctgctgggtggtgaagagtcgctttcgcgaccccagacggtaaagaaggtctgggcgtatatccgcgagcacgaacttcaagatcccaccgaccgacgtcaaatccgctgcgacgaaccgatgcgcgcggtctttaagcaggaccgcatacatatgtttacgatgacaaagatcctcagccaaaatttgtacagccccgatgaatag

SEQ ID NO: 12457 - protein, 270 aa, Aspergillus oryzae
MFPEARDQYVPIIDSILAKSDLNTISEKRIRKGLQEEVGYDLTPQKLIMERFDIFAENGGIEASPEAAVATAPATNGHSSATPVEASSPAQSSKSQKRQADSVERESDKTPPMKRKKPDHDVDADALFAAKLQAEENMRARPTRGASARKVQPAKKKTTKAKTSKKVKAEDDSDVDSSSDSKKVNRSGGFHKPLTLSPALSALLGGEESLSRPQTVKKVWAYIREHELQDPTDRRQIRCDEPMRAVFKQDRIHMFTMTKILSQNLYSPDE

SEQ ID NO: 12458 - DNA, 1161 bp, Arabidopsis thaliana
  CDS (1)..(1161)
atggtttcggactcggacctcgtgacccagctccgggaaattctccgtagctccgacctagaaactacgactccggcgagcgttcgccgtcagctggaggtgtatttcggcgtcgaattaaccgataagaaagctttcgtcagggaacaaatcgatgcttttcttgaaagcgatgctttgttagaaagcaaacccgagcaagaagaagaagactgtaatggcgatcaaaacgatgaagagggaagtgaaaacgatgatgataagaccgaactaccggtaaaggctaagaaacgtggaggtgggtttaacaaaatatgtcagctttcaccacaactagagaagtttttaggaacttctcaattggctcgaacagaggttgtgaagaaaatgtgggcgtatatccgagagcacgatttgcaagatccaacgaataggcggaatatattatgcgacgagtcgcttcattcgttatttcgtgtaaagacaattaatatgtttcaaatgaacaaggcattggcaaagcatatttgggcgctaaatgatggagatgggtgttttaagaatgtgaaagaggaagatgttgatgagacatcaggggaaagagacgagaaagatgtaaaaatcgaagaagcgttagagaataacgaagaagagagtagagaagaagaagatcgtagtgtccgaaaacgcaaacgcaagaaaagaaaaccagccaagtccgaggagaaaccgaagaaaaaaggaggtggttttaccaaagtttgcagtctttcaccagaacttcaggcttttactggaacgcctcagttagctagaacagaggttgtgaaaatgctttggaaatacataaaggagaacaatttgcaagatccatctgataaacgcacaataatatgcgacgaatcattgcggtctctgttccctgtggagtctatcaatatgtttcaaatgaacaaacaactagccaaacacatttggcctctagtacaggaggatgaagcaggaacaactaatgatccagagaagggaaagcagaaaatgaaaatggagacagacgaagtcaaggtgaatataaaatcatccaccttcttaaactatatagataatgatgaatcaaatgaagaaaaggctacttcatcaagaatcaaaactgaagaatga

SEQ ID NO: 12459 - protein, 386 aa, Arabidopsis thaliana
MVSDSDLVTQLREILRSSDLETTTPASVRRQLEVYFGVELTDKKAFVREQIDAFLESDALLESKPEQEEEDCNGDQNDEEGSENDDDKTELPVKAKKRGGGFNKICQLSPQLEKFLGTSQLARTEVVKKMWAYIREHDLQDPTNRRNILCDESLHSLFRVKTINMFQMNKALAKHIWALNDGDGCFKNVKEEDVDETSGERDEKDVKIEEALENNEEESREEEDRSVRKRKRKKRKPAKSEEKPKKKGGGFTKVCSLSPELQAFTGTPQLARTEVVKMLWKYIKENNLQDPSDKRTIICDESLRSLFPVESINMFQMNKQLAKHIWPLVQEDEAGTTNDPEKGKQKMKMETDEVKVNIKSSTFLNYIDNDESNEEKATSSRIKTEE

SEQ ID NO: 12460 - DNA, 702 bp, Schizosaccharomyces pombe
  CDS (1)..(702)
atggaagagtacgaaacagacattaagcaaattctcggtacagttgatcgccaaactgtatctgcgaagcaagttcgtcaacttttagaagaaagaagaaaggtagatttgagtgcgcataaaaaagacttgaatgcgctgattttgaaatgctttgatgaaaccgccgcaccttcagagaaggagagtttagaaaaacaagcacccgctcgcaaaaccaagggtaagagagcgacggaaaatggcactgaagaaggcaagaaaccagcaaagagaacccgaaaacgcaaggaagatggagaagagggtggaaaacgcaagaggaaccaagatcctgccaacaatcctctgaataagcctatgaagttgtcccctaagttggccgaatttttgggtcttgaacagttatctcgtccccaaactgtgaagaagttatgggagtatataaaagcacatgacttacaagatcccaacgacaagcgaacaattctttgtgatgacaaattgaaaagcgttttcgaagtcgacactttgcatatgtttaccatgaacaagtacttaacaaatctcatgacgaagattcctgatgatcaattgcccaaacctcagcctaaaaatgaagaaccagcggctccgaacgatcttcccaagcaggaggaaaaagagttggtcgagcctcctaccgccgaatccaccgcttga

SEQ ID NO: 12461 - protein, 233 aa, Schizosaccharomyces pombe
MEEYETDIKQILGTVDRQTVSAKQVRQLLEERRKVDLSAHKKDLNALILKCFDETAAPSEKESLEKQAPARKTKGKRATENGTEEGKKPAKRTRKRKEDGEEGGKRKRNQDPANNPLNKPMKLSPKLAEFLGLEQLSRPQTVKKLWEYIKAHDLQDPNDKRTILCDDKLKSVFEVDTLHMFTMNKYLTNLMTKIPDDQLPKPQPKNEEPAAPNDLPKQEEKELVEPPTAESTA

SEQ ID NO: 12462 - DNA, 687 bp, Saccharomyces cerevisiae
  CDS (1)..(687)
atggctgaattaaacgattatagtacgatgatcgatattcttctctctgatatggatttggaaacggtcacaactaaaaaggttaggatggctttgaaagaagtatatgcaatcgacgttgaatcacagggaaaagcaattaacaaattgattaggaaacatctagatcttgtaaaagaaaggccgcgcttcgaaagatctcttgaggatctgctaaaggaaaatgctactttggcgattgagctcaccaaggaaattaccgtaagcaaacgatcatctggagaggaaaagaacgatagcgaaaccaaaggtactcatgttgagaagaaaaaagggactgttagtaagtcacctatttcaacacgaaaagttacactatctaaatcattagcgagtttgctaggagagcatgaattgacgaggaccgaagtagtacgacgactctgggcatatattaaagcgcataatctgcagaatcctaacaacaagaaagaaatactgtgcgacgaaaaattagaattaatacttggcaagagtaccaatatgtttgagatgcacaaaattttggcaagtcatatgacagagcctaaaaaaataagcgactgtcctcctcttatccaagaagtccgtagaaaggaaaagcccatcgtttcagattccgagcaatcagatacaaagggcatttga

SEQ ID NO: 12463 - protein, 228 aa, Saccharomyces cerevisiae
MAELNDYSTMIDILLSDMDLETVTTKKVRMALKEVYAIDVESQGKAINKLIRKHLDLVKERPRFERSLEDLLKENATLAIELTKEITVSKRSSGEEKNDSETKGTHVEKKKGTVSKSPISTRKVTLSKSLASLLGEHELTRTEVVRRLWAYIKAHNLQNPNNKKEILCDEKLELILGKSTNMFEMHKILASHMTEPKKISDCPPLIQEVRRKEKPIVSDSEQSDTKGI

SEQ ID NO: 12464 - DNA, 1005 bp, Oryza sativa
  CDS (1)..(1005)
atggtgtcggactcggagctggtggagcggctgcgggaggtgctgcggtcgtccgacctcaacaccaccaccaccgccatcctgcgccgccgcctcgaggaggacttcggcgtcgacctctccgacaagaagctcttcatccgcgagcaggtcgacctcctcctctccgaggtcgccggcaaggccgagcaggaggaggcggaggtgcccaaggaggaggagcccgagaccggggcggaggcagcgggtggagagccagggggcgctgaaggggagggggaagaagaggaggaggaagaggaagaggaggaggaggaggaggaggaggaagacagtagcggcagccggaagaagcggcgatcagatggagccaatactgatggcaagagaaaaggtggtggcttcaccaaattatgtagcatttccccaacgcttcaagagtttgttggtgcctctgagttagctaggacagaggtagtcaagaagctttgggcatatatccgagaaaataacttgcaagacccaagcaataagaggaagattctgtgtgatgagagattgaagaagatcttcaatgtcaactccatcgatatgttccaaatgaataaagcattgacgaaacacatatggccattgaattctgatggtcctgtgacctctgcctcacctgagagatcaacacccaaagagaagcctcaaaagagagaaagaaatgaagggaagaagcaaaaaggtggttcttctgggtctggatctggttttcttgtgccccttcaactttcggatgatttagtgaaattcattggcactggtgagagtatgctttcgcgatctgatgttgtgaaaagaatgtgggactatataaaagagaataaattacaggatccttctgaccggaggaaaataatatgtgacgagaagctgaaggatctattgcaagttgaatcattcaatggctttactgtttcgaagctgcttgctccccatttcaccaagacaaagtag

SEQ ID NO: 12465 - protein, 334 aa, Oryza sativa
MVSDSELVERLREVLRSSDLNTTTTAILRRRLEEDFGVDLSDKKLFIREQVDLLLSEVAGKAEQEEAEVPKEEEPETGAEAAGGEPGGAEGEGEEEEEEEEEEEEEEEEEDSSGSRKKRRSDGANTDGKRKGGGFTKLCSISPTLQEFVGASELARTEVVKKLWAYIRENNLQDPSNKRKILCDERLKKIFNVNSIDMFQMNKALTKHIWPLNSDGPVTSASPERSTPKEKPQKRERNEGKKQKGGSSGSGSGFLVPLQLSDDLVKFIGTGESMLSRSDVVKRMWDYIKENKLQDPSDRRKIICDEKLKDLLQVESFNGFTVSKLLAPHFTKTK

SEQ ID NO: 12466 - DNA, 26 bp, Artificial sequence
  primer
atggccgacatcaataaatatattcc

SEQ ID NO: 12467 - DNA, 25 bp, Artificial sequence
  primer
tcaaccgcttaaattgggaagagat

SEQ ID NO: 12468 - protein, 322 aa, Artificial sequence
  consensus sequence
  Variant (2)..(4): Xaa in position 2 to 4 is any amino acid
  Variant (6)..(13): Xaa in position 6 to 13 is any amino acid
  Variant (14)..(14): Xaa in position 14 is any or no amino acid
  Variant (16)..(17): Xaa in position 16 to 17 is any amino acid
  Variant (19)..(111): Xaa in position 19 to 111 is any amino acid
  Variant (112)..(255): Xaa in position 112 to 255 is any or no amino acid
  Variant (258)..(259): Xaa in position 258 to 259 is any amino acid
  Variant (261)..(264): Xaa in position 261 to 264 is any amino acid
  Variant (266)..(268): Xaa in position 266 to 268 is any amino acid
  Variant (269)..(270): Xaa in position 269 to 270 is any or no amino acid
  Variant (272)..(272): Xaa in position 272 is any amino acid
  Variant (274)..(276): Xaa in position 274 to 276 is any amino acid
  Variant (279)..(280): Xaa in position 279 to 280 is any amino acid
  Variant (282)..(282): Xaa in position 282 is any amino acid
  Variant (286)..(288): Xaa in position 286 to 288 is any amino acid
  Variant (291)..(291): Xaa in position 291 is any amino acid
  Variant (293)..(293): Xaa in position 293 is any amino acid
  Variant (295)..(295): Xaa in position 295 is any amino acid
  Variant (297)..(297): Xaa in position 297 is any amino acid
  Variant (299)..(299): Xaa in position 299 is any amino acid
  Variant (302)..(314): Xaa in position 302 to 314 is any amino acid
  Variant (315)..(315): Xaa in position 315 is any or no amino acid
  Variant (317)..(319): Xaa in position 317 to 319 is any amino acid
  Variant (321)..(321): Xaa in position 321 is any amino acid
LXXXDXXXXXXXXXRXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSXXLXXXXGXXXXXLXRXXXVKXXWXYIKXXXLQXPXDXRXIXCDXXXXXXXXXXXXXXFXXXKXL

SEQ ID NO: 12469 - protein, 38 aa, Artificial sequence
  protein pattern
  Variant (2)..(2): Xaa in position 2 is any amino acid
  Variant (4)..(4): Xaa in position 4 is Pro, Ser or Thr
  Variant (5)..(5): Xaa in position 5 is Asp, Glu or Gln
  Variant (6)..(6): Xaa in position 6 is Thr or Val
  Variant (9)..(9): Xaa in position 9 is any amino acid
  Variant (10)..(10): Xaa in position 10 is Ile, Leu, Met or Val
  Variant (12)..(12): Xaa in position 12 is any amino acid
  Variant (13)..(13): Xaa in position 13 is His or Tyr
  Variant (14)..(14): Xaa in position 14 is Ile or Val
  Variant (15)..(15): Xaa in position 15 is His, Lys or Arg
  Variant (16)..(16): Xaa in position 16 is Ala, Glu or Gln
  Variant (17)..(18): Xaa in position 17 to 18 is any amino acid
  Variant (21)..(21): Xaa in position 21 is Asp, Asn or Ser
  Variant (23)..(23): Xaa in position 23 is any amino acid
  Variant (24)..(24): Xaa in position 24 is Asp or Asn
  Variant (25)..(25): Xaa in position 25 is Lys or Arg
  Variant (27)..(27): Xaa in position 27 is any amino acid
  Variant (29)..(29): Xaa in position 29 is any amino acid
  Variant (32)..(32): Xaa in position 32 is Asp or Glu
  Variant (33)..(33): Xaa in position 33 is any amino acid
  Variant (34)..(34): Xaa in position 34 is Phe, Leu or Met
  Variant (35)..(35): Xaa in position 35 is Glu, His, Lys or Arg
  Variant (36)..(36): Xaa in position 36 is any amino acid
  Variant (37)..(37): Xaa in position 37 is Ile, Leu or Val
  Variant (38)..(38): Xaa in position 38 is Phe or Leu
LXRXXXVKXXWXXXXXXXLQXPXXXRXIXCDXXXXXXX

SEQ ID NO: 12470 - DNA, 1869 bp, Saccharomyces cerevisiae
  CDS (1)..(1869)
atgttgcaaggaattttagaaaccgtaccatctgacttgaaagatccgatatcattatggtttaagcaagaccgcaacccaaaaactatagaagaggtcaccgctctctgcaaaaaatccgactggaatgagttacacaaaagatttgattctagaattcagtttggcactgctggtttaagatcgcaaatgcaagctggctttagcaggatgaatactttagtagtcatacaagcgtctcagggattggcaacttatgtaagacaacagtttccagacaatttggtagctgttgtgggacacgatcatagattccattctaaggagttcgctagagctactgctgctgcatttcttttaaaaggatttaaggtacattatttgaatcctgaccacgaatttgttcatacccctttagttccctttgcagtggataagctaaaggcctccgttggcgtaatgataacagcaagtcacaacccaaaaatggataatggatataaagtatactattccaatggatgccaaatcattccacctcacgatcatgccatctctgattccattgacgcaaatttagaaccatgggccaatgtgtgggatttcgacgatgttctaaataaggctctcaaacaagggaaattgatgtattccagagaagaaatgctgaagttatatttagaggaggtttctaaaaatctggtagaaatcaacccattaaagcttgaagtaaaagccaaaccttggttcgtttacactccaatgcatggggttggatttgacattttcagcaccatcgtaaaaaaaacactgtgcctggtagaaggtaaggattacctatgtgttcctgaacaacaaaatccagatccttctttcccaactgttggatttcctaaccctgaagaaaaaggtgctttagacattggtataaacttggctgaaaaacatgacattgacttacttgttgccaacgaccctgacgctgatagattctctgttgctgttaaagatatgcagtcaggcgaatggcgacaactaacaggtaacgaaatcggttttctttttgcattttatgaatatcagaaatataaaagtatggacaaagaatttcagcacgttcatccgttggctatgttaaattcaacagtgtcttcacaaatgataaaaaaaatggcagaaatagaagggttccattatgaggatacattaacaggatttaagtggatcggaaatcgtgccatactcttggaaaagaaaggctattacgttccttttggattcgaggaagcaataggctacatgtttccagcaatggagcatgataaggatggtatcagtgcatccattgtcttcttgcaagcctactgtaagtggaaaatagaccacaatttggacccgctaaatgtcttagaaaatggcttcaaaaaatatggcgtgttcaaagagtacaatggctattatgtcgttccaaatccaactgttacaaaagatatatttgactacatcaggaatgtctacactcctgagggcgcgtcatatccttcatctattggtgaagaaatcgaagtactttactatcgagatttaaccactggttaccaatcggataccataaatcataaacctactctacccgtcgatcctacatcacaaatgataacagtatctgctagaccaagtaacggtagtgagaatgagcatatccgcttcactattcgcgggtccggaacagaaccaaaacttaaagtatatattgaagcttgcgcaaatgaagaacaaagagcctctttcttggcgaaattgacttggaatgtgctgagacgtgaatggtttagaccagatgaaatgaatatagttacaaaattttga

SEQ ID NO: 12471 - protein, 622 aa, Saccharomyces cerevisiae
MLQGILETVPSDLKDPISLWFKQDRNPKTIEEVTALCKKSDWNELHKRFDSRIQFGTAGLRSQMQAGFSRMNTLVVIQASQGLATYVRQQFPDNLVAVVGHDHRFHSKEFARATAAAFLLKGFKVHYLNPDHEFVHTPLVPFAVDKLKASVGVMITASHNPKMDNGYKVYYSNGCQIIPPHDHAISDSIDANLEPWANVWDFDDVLNKALKQGKLMYSREEMLKLYLEEVSKNLVEINPLKLEVKAKPWFVYTPMHGVGFDIFSTIVKKTLCLVEGKDYLCVPEQQNPDPSFPTVGFPNPEEKGALDIGINLAEKHDIDLLVANDPDADRFSVAVKDMQSGEWRQLTGNEIGFLFAFYEYQKYKSMDKEFQHVHPLAMLNSTVSSQMIKKMAEIEGFHYEDTLTGFKWIGNRAILLEKKGYYVPFGFEEAIGYMFPAMEHDKDGISASIVFLQAYCKWKIDHNLDPLNVLENGFKKYGVFKEYNGYYVVPNPTVTKDIFDYIRNVYTPEGASYPSSIGEEIEVLYYRDLTTGYQSDTINHKPTLPVDPTSQMITVSARPSNGSENEHIRFTIRGSGTEPKLKVYIEACANEEQRASFLAKLTWNVLRREWFRPDEMNIVTKF

SEQ ID NO: 12472 - DNA, 1731 bp, Micromonospora sp. ATCC 39149
  CDS (1)..(1731): transl_table=11
atggcggcggacaccactgacctcgacgacacgcgcgatctggacgaccttcgcgaccgggcccggcggtggctcgacgacgaccccgacccggccacccgcgacgagctggaggccgtgctcgacgggctgccggcgagcgcggccgagctggccgaccggttcgccgggccactgaccttcggcaccgccgggctgcgcggcccgctgcgcgccggccccaacgggatgaacctcgccgtggtcacccaggccgccgccgggctcgtcgcctggctcgccgcccaggacgccaccgggccgctggtcatcgggtacgacgcccggcacggctcgcgggagttcgccgagcgcaccgcccaggtggccaccggcgcgggccgcccggcgctgctgctgccccgcccgctgcccacccccgtgctggcgtacgcggtgcggcagctcgacgcggcggccggcgtgatggtgaccgccagccacaacccgccccaggacaacggctacaaggtctacctcggcgcgcagctcggcggcgagctgggcgcgggggcgcagatcgtgccgccggccgacaccggcatcgaggccgccatccgggcggtcggcccgctggccgacgtaccgctgggcccggccgggcaggtcgtcggcgacgacgtggtcgtgtcgtacgtcgaccgggccgccgccgtggtcgacccggcggggccccggagcctgaaggtggcctacacgccgctgcacggcgtgggcgcggccgtgctgaccgccgccttcgcccgcgccggcttcggcatccccggcgtggtgcccgagcaggcggtgccggacccggacttccggaccgtcagcttccccaacccggaggagccgggggcggtggacctcctcgtcgcgctcgccgagcgcaccggggcggacctggcgatcgccaacgaccccgacgcggaccgctgcgcggtggccgtccgcgacggccgggcggcgggcccggcaccggtgagtgggggcgcctggcggatgctgcgcggggacgaggtgggggcgctgctcgccgaccatctcatgcgccgtggcgtccacggcctgtacgccaccaccatcgtgtcgtcgtccctgctacgggccatgtgcgccgcccgtggcctgccgtacgacgagacgctgaccggcttcaagtggatcgtccgggccggcggcggaccgctgggtgaggccggctccgacccgctggtcttcggctacgaggaggcgctgggctactgcgtcgccccggagcacgtccgcgacaaggacggcatcaccgccgcgctgaccgtcgccgagctggccgccgggctgaaggcgcaggggcgcaccctcaccgaccggctcgacgagctggccgccgagttcggcgtgcaccacaccgaccaactctcggtgcgggtggacgacctgcgcatcatcgccgacgcgatggcccgggtccgggcggccaccccgacgaccctgctcggccgcccggtgaccgaggcgcgggacctgctccccgaggcggacgtggtgatcctgcgtaccgacggggcacgggtggtgatccgcccgtcgggcaccgagccgaagctcaaggcgtacctggaggtggtggagccggtggcggacggcgacgtgccggcggcccggacgcgcgcggcggccacgctggcggcactccgcacggaaatcgccgccctggtgcagggatga

SEQ ID NO: 12473 - protein, 576 aa, Micromonospora sp. ATCC 39149
MAADTTDLDDTRDLDDLRDRARRWLDDDPDPATRDELEAVLDGLPASAAELADRFAGPLTFGTAGLRGPLRAGPNGMNLAVVTQAAAGLVAWLAAQDATGPLVIGYDARHGSREFAERTAQVATGAGRPALLLPRPLPTPVLAYAVRQLDAAAGVMVTASHNPPQDNGYKVYLGAQLGGELGAGAQIVPPADTGIEAAIRAVGPLADVPLGPAGQVVGDDVVVSYVDRAAAVVDPAGPRSLKVAYTPLHGVGAAVLTAAFARAGFGIPGVVPEQAVPDPDFRTVSFPNPEEPGAVDLLVALAERTGADLAIANDPDADRCAVAVRDGRAAGPAPVSGGAWRMLRGDEVGALLADHLMRRGVHGLYATTIVSSSLLRAMCAARGLPYDETLTGFKWIVRAGGGPLGEAGSDPLVFGYEEALGYCVAPEHVRDKDGITAALTVAELAAGLKAQGRTLTDRLDELAAEFGVHHTDQLSVRVDDLRIIADAMARVRAATPTTLLGRPVTEARDLLPEADVVILRTDGARVVIRPSGTEPKLKAYLEVVEPVADGDVPAARTRAAATLAALRTEIAALVQG

SEQ ID NO: 12474 - DNA, 1695 bp, Kineococcus radiotolerans SRS30216
  CDS (1)..(1695): transl_table=11
atgagcaccgccccgtcgccgaccccgcccgaggacctgcacgaccgcgtccggacctggatcgaggacgatcccgacccccgcgaccgcgccgagctgacggcgctgctgagcgccgcgcaggccggggacggccccgccggggccgagctcgccgaccggttcagcgggccgctggagttcggcaccgcggggttgcgcggcgtggtcgccgccggggagcaccggatgaaccgggccgtggtgcagcgcgccgccgcgggcctgggcgcgtggctgaccgggcggctggagcggccccgggtcgtcgtcgggctcgacgcccggcacggctcgcgggcgttcgccgacgactccgccgcggtcctgaccgcggccgggtgcgaggtgctgctgctgccccgcccgctgccgacgccgctgctggccttcgccgtgcgccgcttcgaggccgacgcgggggtcatggtgacggccagccacaacccggccgcggacaacggctacaaggtctacctggggggccgggccgccgggccggaggggcgcggggtgcagatcgtgcccccggccgacgcggggatcgccgccgccatcgccgccgtggggccgttgcgggacctgccgcgcgccaccggcggctggacggtgctgggcgaggaggtcgtggaggactacctcgccgcggtcaccggggccgtgcgccccgccccgggccgcgacccgcgggtcgtcgtcaccccgatgcacggcgtcggcgggccggtcctgctggaggctctgcgccgcagcgggttcgacgacgtccacgtggtcgccgagcaggccgacccggacccgggcttccccaccgtccccttcccgaacccggaggaggccggcgcgctggaccgcgcggtggccctggcggagcgggtcggcgccgacgtggtcctcgccgtcgaccccgacgcggaccgctgctgcgtggccgtccccgaccccgcctccggggggttcacgaccctgagcggggacgacctggggcgggtcctcggcgaggagctggccgcccccggggccgtgctggcgtgctcggtggtgagctcgcaggccctggccgcggtggcggcgcgccacggcgcgcggttcgccaccgccctcaccgggttcaagtggatcgcgcgcgtcccggagctgacgttcggctacgaggaggccatcgggtactgcgtcgccccggaggtggtgcgggacaaggacgggatctctgcctcgctgctggtggcggggatcgtgcgccgcgagctggccgccggccggaccctgcacgacgtgctggacgacctggaccgcgccgacggcgtccacctgaccgccccggtgacggtccgggtcgaggacctgtcgctcatcccggccgcgatgtcccggctgcgctcgcagcccccgcgggagctgggcggttcgcccgtcacctccgtcgaggacctcgccgacggcgtcgacggcctgccccccaccgacggcctgcgctggcgcaccgccgacggcacccgcgtggtggtccggcccagcgggaccgagcccaagctcaagagctactgcgaggtcgtcgccggcgccggggacgacctcgccgcggcgcgggccgcggcccgcgagcgcctggccgcggtgacccgggacgtgcgggcggccgtcgggatcggctga

SEQ ID NO: 12475 - protein, 564 aa, Kineococcus radiotolerans SRS30216
MSTAPSPTPPEDLHDRVRTWIEDDPDPRDRAELTALLSAAQAGDGPAGAELADRFSGPLEFGTAGLRGVVAAGEHRMNRAVVQRAAAGLGAWLTGRLERPRVVVGLDARHGSRAFADDSAAVLTAAGCEVLLLPRPLPTPLLAFAVRRFEADAGVMVTASHNPAADNGYKVYLGGRAAGPEGRGVQIVPPADAGIAAAIAAVGPLRDLPRATGGWTVLGEEVVEDYLAAVTGAVRPAPGRDPRVVVTPMHGVGGPVLLEALRRSGFDDVHVVAEQADPDPGFPTVPFPNPEEAGALDRAVALAERVGADVVLAVDPDADRCCVAVPDPASGGFTTLSGDDLGRVLGEELAAPGAVLACSVVSSQALAAVAARHGARFATALTGFKWIARVPELTFGYEEAIGYCVAPEVVRDKDGISASLLVAGIVRRELAAGRTLHDVLDDLDRADGVHLTAPVTVRVEDLSLIPAAMSRLRSQPPRELGGSPVTSVEDLADGVDGLPPTDGLRWRTADGTRVVVRPSGTEPKLKSYCEVVAGAGDDLAAARAAARERLAAVTRDVRAAVGIG

SEQ ID NO: 12476 - DNA, 1659 bp, Ureaplasma parvum serovar 3 str. ATCC 700970
  CDS (1)..(1659): transl_table=4
atggaaaatacaaataaaatttttaattgttgattaaattcaccaaaaattcctcaagtaattaaagaagaatataagaataaaactcaaaaagaaattgatcatatttttgatgaaaattatcgatttaaattcggtacatcaggtgtacgttgtatttatgaagaaggaactcgttatttaaatgcaataacttatactcaattgacattaggttttattgaatatttagaaacgaaaaagaattttaataaaattattgttattggccgagacaaccgctttggctcacgtgaaaatttgaaactagttgctgaaatttttagtagttttgattatactgtttatattaatgaagattatgggatgttatcaactccaattacttcatttttaattaatcaattacaagcaggagctggaattatgatcaccgcttctcataatcctaaaaattataatggttttaaagtttataatgctaatggtgctcagccattagttgatgatactaatctcattgaatctttaatgccatcatatacagaagcattggattttaactttgaatttaaacaagataatattagatttttaacaaaagaacaaattcaaagttattttgatgcagttaaagcacaactaattaatactgatcctaatattaaaaaacccttcaaaattgtttttagtggtcatcatggaacaacaacaaaggacatgattccttttttagaatcacttggttatgatatggttagcgttagcgaacaaaattttgaagatcctaattttaatgatgacccaagttctaatccagaagaacaatgttcatttgatttaagtgttgaatatgcagacaatacaaacgcagaaataatgattgcatctgatcctgatggagatcgaatggccattgctgtacgtcatgaaaattattgaaaatttttgactggtaatcaaacaggtgttttaattgcgcattatttattagaacataaaaaatttactaaacctacatatattatttcaacatttatttcaacacgctatccagaattatttgctaaaaattttgattgtgatgttttatatgtagatgtaggttttaaaaatcatggtaatttaattgccaatcgtaaaaaaacacataatttggttgttggttttgaagaagcaattggttcattaccatctgatattaataatgataaagattcatatcaaactgcgtctattttgttagaaatgattaattattattatgaacaaaaacttgatttatttaccgttttaaaaaaagagatttttgctaagtatgggaattgatatagtaaaactactcagtttgttattgatggtgataactgaaaacaaaaagcacttattattttaaataacttaagaaattttgaatttaaaacagtaacccaatacaccattcataacattatttttcatgaacaaggatcttatcttgaatgaaaattagacgaatactcaacaatcaaatttagattatctggaacagaacctaaatttaaagtatatattgatttatatgattttagcaaagatcaaaaacgagatttttatcaagaactaaaaattaaagctgaagatattttagattttttaaaaaattatttaggtctttaa

SEQ ID NO: 12477 - protein, 552 aa, Ureaplasma parvum serovar 3 str. ATCC 700970
MENTNKIFNCWLNSPKIPQVIKEEYKNKTQKEIDHIFDENYRFKFGTSGVRCIYEEGTRYLNAITYTQLTLGFIEYLETKKNFNKIIVIGRDNRFGSRENLKLVAEIFSSFDYTVYINEDYGMLSTPITSFLINQLQAGAGIMITASHNPKNYNGFKVYNANGAQPLVDDTNLIESLMPSYTEALDFNFEFKQDNIRFLTKEQIQSYFDAVKAQLINTDPNIKKPFKIVFSGHHGTTTKDMIPFLESLGYDMVSVSEQNFEDPNFNDDPSSNPEEQCSFDLSVEYADNTNAEIMIASDPDGDRMAIAVRHENYWKFLTGNQTGVLIAHYLLEHKKFTKPTYIISTFISTRYPELFAKNFDCDVLYVDVGFKNHGNLIANRKKTHNLVVGFEEAIGSLPSDINNDKDSYQTASILLEMINYYYEQKLDLFTVLKKEIFAKYGNWYSKTTQFVIDGDNWKQKALIILNNLRNFEFKTVTQYTIHNIIFHEQGSYLEWKLDEYSTIKFRLSGTEPKFKVYIDLYDFSKDQKRDFYQELKIKAEDILDFLKNYLGL

SEQ ID NO: 12478 - DNA, 1713 bp, Borrelia burgdorferi B31
  CDS (1)..(1713): transl_table=11
ttgatgctaaaaatcgaagctaaaagaaaattgaaaaattatattcttcttgaagaagatatgcattttaaagaagaagcaataaaaattcaaaaaacaaataattcaacagaaattttaaatagattttacaaagatctagaatttggcactgctggaataaggggaatcattggagctggaacatgttacatgaacacatataatataaaaaaaataagccaaggaatatgcaattacatacttaaaataaacaaaaaccctaaagttgcaataagctatgattcaagatatttttcaaaagaatttgcttacaatgctgctcaaatttttgcctcaaataattttgaaacatatatatataaaagtttaagaccttccccacaactatcttatacaataagaaaatttgactgtgatgctggcgttatgataacagcaagtcataattcaaaagaatataatggatataaagcatattggaaaggtggaatccaaataataccacctcatgacacactaataactaatgaaattaaaaatacaaaaaacataataaatacaattaccataaaagaaggcattgaaaaagggatcatcaaagaacttggcaatgaaatagacgaagagtatgtgaaagcaataaacaaagaattgcctgattttgaaaagaatagcaaagaaacaaacttaaaaatagcctacacagcattacatggcaccggtgggaccataataaaaaaactctttgcaaatagcaaaatacggctttttttagaaaaaaatcaaatactaccaaaccctgaatttccaacaataaattatcctaatccagaaaaacaaacatcaatgcttaaagtaatagagcttgcaaaaaaaaaagattgtgacattgcccttgcaacagatccagatgccgacagaatagggattgcatttaaagatcaaaacgaatggatattcttaaacggaaatcaaatatcatgcattttaatgaactatatactctcaaaagaaaaaaatcctaaaaatacatttgtaatatcatcgtttgtaacaacaccaatgctagaaaaaattgcaaaaaaatatggttctcaaatttttagaacttacacaggatttaaatggataggaagcttaattaatgaaatggaaaaaaatgaaccaaataaaaaatttgcttttgcatgcgaagaaagtcatggatatctaataggaagaaaggttagagataaggatgcattttcagccataaaaggaatttgttctttagcacttgacttaaaagccaaacaacaaacaattaaggattatcttgaaaagatatacaaagaatttggatattatgaagaatttaatatagaaaaaaactttgagggggccaatggagaaattcaaagagaaaagttaatgctaaaactaagaaaagaacaaaaagtacaatttgcaggaattaaaataattgaaaaattagactataaaactcttaaaaagattaactttaaaaatgaaatttcagaaattaaagaatataaataccccataaacgcaataaaatttatacttgaaaacgaaattgcaataattgtaagaccctctggaacagagccgaaaattaaattttacatatctgtaaaactagagtataaggaaaaacataaaatatttgatataataaatgcaataaagatggagataaaaaaatattaa

SEQ ID NO: 12479 - protein, 570 aa, Borrelia burgdorferi B31
MMLKIEAKRKLKNYILLEEDMHFKEEAIKIQKTNNSTEILNRFYKDLEFGTAGIRGIIGAGTCYMNTYNIKKISQGICNYILKINKNPKVAISYDSRYFSKEFAYNAAQIFASNNFETYIYKSLRPSPQLSYTIRKFDCDAGVMITASHNSKEYNGYKAYWKGGIQIIPPHDTLITNEIKNTKNIINTITIKEGIEKGIIKELGNEIDEEYVKAINKELPDFEKNSKETNLKIAYTALHGTGGTIIKKLFANSKIRLFLEKNQILPNPEFPTINYPNPEKQTSMLKVIELAKKKDCDIALATDPDADRIGIAFKDQNEWIFLNGNQISCILMNYILSKEKNPKNTFVISSFVTTPMLEKIAKKYGSQIFRTYTGFKWIGSLINEMEKNEPNKKFAFACEESHGYLIGRKVRDKDAFSAIKGICSLALDLKAKQQTIKDYLEKIYKEFGYYEEFNIEKNFEGANGEIQREKLMLKLRKEQKVQFAGIKIIEKLDYKTLKKINFKNEISEIKEYKYPINAIKFILENEIAIIVRPSGTEPKIKFYISVKLEYKEKHKIFDIINAIKMEIKKY

SEQ ID NO: 12480 - DNA, 1761 bp, Treponema pallidum subsp. pallidum str. Nichols
  CDS (1)..(1761): transl_table=11
atgcactccagtcaattgttcgaacgtgctcgtctttatcttgaagaagaaacagatcctttctttgcacagcaggtacgggatcttgttgcacagaataatatagcagagctcgaagagcgctttttgcaaactctttcgtttggcaccgccgggctgcggggtgttgtcggcggaggaacaaacagaatgaaccccttcatgatcaaaaagatcacgcacgcgattgcgctctatttactaaaaacttttcctgaaaaggcagcgcgcggcgcgctccgtgccgttatagcctacgactcgcgtgtacattctcgtctgttcgcacacactgctgcgcacgtgtttcttgcacatgacattaccgcctacctcttttcggatccacgcccgactccagaactttcctacgcagtacagtatcttacctgtgacgtgggcatcgtggtcaccgcatcgcacaacccaccgcagtataacggatacaaagtgtactggaacgacggggcacagatagcgcatcctcacgaaaaaaatatcaccgaagaaatgaacgctatcacgagtgtcgtgaaccttgaggaaaaggtacctgtcaaacgcagtgcacccacgatcattgatgcagaaattgatgaaccgtactgcacctctataaaggaaaagctttttcgccccggtcttacgaaagagaccgtccagtcgatgcgtattgcatacaccccattacacggaacgggtgcactccacgtcgagcgcatactgggggatatggggttctccattatgaccgtgcctgagcaacggttgccagatgggaacttccctacggtgtcgtctcctaatccagaagatccggccgcgttggtgcatgcgtgtgcatatgctgatcgcgtacatgctgaggttcttatggcgactgatcctgacgcagaccgctttgcatgtgcagtaagaaacacccgcggtgtgttgcagttgctcacgggcaatcaaatgggagcgctcttcactgactacattctgctaaccctgcaggaacaaaacaatatgcccgcgcgtcctgcaattgtacgctccgttgttacgtccccacttagcgaccgtatagcacgcacatatggcgcaacgtgtgtagagtgccttaccggattcaaatggatatgtggtactgcagaaaagatttcacagtcaggagcgtactcctacgtatatggatttgaagaaagttacggacacaattttggtattcaggtgagagacaaagacggtatcaacgccgcagcgctctgtgcagaaatgggtgtgtactggaagttgcgcggaatgagcctgatcgatcgccttcaccagttattcaggacgcatggcctgttttgtgaaaagacgctgaacaaaacctatgcgggcgtcgcgggtgtaagcaccatgaatgcaataatgaatacgctcaggagacagccgctaacccaaattgcgcgcaagcgggtaatgaaggtgagggatatatatcttggtgttgagtttagtccagaaaatcctgcgcagacatctgccctttcttttcctcagagtaacgtgctgcagtattttgtacaggatggcagtattgtaagtatacgaccgagtggaacagaacaaaaaataaagtgttatatcatccaccctctgaccgtcagtacctcgatagaagaagcagaacaggcgggcaacatgtttatcaccgcagttgaacaagagatgggtacatatctgcaatga

SEQ ID NO: 12481 - protein, 586 aa, Treponema pallidum subsp. pallidum str. Nichols
MHSSQLFERARLYLEEETDPFFAQQVRDLVAQNNIAELEERFLQTLSFGTAGLRGVVGGGTNRMNPFMIKKITHAIALYLLKTFPEKAARGALRAVIAYDSRVHSRLFAHTAAHVFLAHDITAYLFSDPRPTPELSYAVQYLTCDVGIVVTASHNPPQYNGYKVYWNDGAQIAHPHEKNITEEMNAITSVVNLEEKVPVKRSAPTIIDAEIDEPYCTSIKEKLFRPGLTKETVQSMRIAYTPLHGTGALHVERILGDMGFSIMTVPEQRLPDGNFPTVSSPNPEDPAALVHACAYADRVHAEVLMATDPDADRFACAVRNTRGVLQLLTGNQMGALFTDYILLTLQEQNNMPARPAIVRSVVTSPLSDRIARTYGATCVECLTGFKWICGTAEKISQSGAYSYVYGFEESYGHNFGIQVRDKDGINAAALCAEMGVYWKLRGMSLIDRLHQLFRTHGLFCEKTLNKTYAGVAGVSTMNAIMNTLRRQPLTQIARKRVMKVRDIYLGVEFSPENPAQTSALSFPQSNVLQYFVQDGSIVSIRPSGTEQKIKCYIIHPLTVSTSIEEAEQAGNMFITAVEQEMGTYLQ

SEQ ID NO: 12482 - DNA, 1797 bp, Chlamydophila pneumoniae CWL029
  CDS (1)..(1797): transl_table=11
atgaaagaagtagaacaacgtatccggtcattatacgatgcagtaacagctgaaaatatttgtagatggttgtccaatgattgtacccaacaagatgcaaagactatcctaggatggttagatacagatcctgcacagcttgaagatctattcggagcgactcttacctttggtaccggaggactccgtagtcttatgggtatcggaacaaataggatcaacctgtttactatacgtcgaacgacgcaagggctggttcaggtgctccgcgctcatcttccccatcccggagatcctatgcgtgtagttgtcggttgtgatacccgccataactctatagaatttgctcaagaaactgcaaaagtcctcgcaggtaatggctgcgaagttttcttgtttcagtatcccgaacctttggctttagtctcctttacggtgagatacgaaagggccatcggcggagtgatgatcaccgcctctcataatcctcccaattacaatgggtataaagtttatatggcttcgggaggccaagttctccctcccttagatcaagagattgttgccgcctgtagtgcagtgaacgaaattttatcagtgccctcgatagatcatcccaatattcacctcattggaaaagaatacgaagccctttacagagacactttgaagcaactgcaactctatcccgaagcaaaccggatttcaggaaggtctttatctatttcctattcgccattgcatggaacaggaatttctctcgttcctcatgttctcaaagactggggatttttatccgtacatcttgtggaaaaacaggccataggtgacggcgatttcccaaccgtgcagctgccaaatcctgaggatccagaggctctgactctgggcattgagcaaatgctcgctaatgacgatgatctttttatagctaccgacccagatgccgatcgcgtgggcgtggtttgtctagaagacggccaaccctaccgatttaacggaaatcaaatggcgagccttttagcagaccacatcttaggagcttggagcaaaacaagacacttaggagaacatgataaattggtcaagagcttggtgactacagaaatgctctctgctatcgcaaagcactatcatgtggatcttattaatgtcggaacaggatttaaatacatcggagagaaaattgaatcctggcgcaattccacaaacaaattcgtatttggagccgaggaatcttacggttgtctctacggcactcacgtagaagataaagacgctattattgcgtcagcattgattgcagaagccgcactacaacaaaaattacaaggaaaaactctatgcgacgcactcctttctctttacgaaacatacggatactttgctaacaaaacggagtctgtggttttttccgcaaaaactgacgaacaagaaataagaaaaaaactttcacaccttgaggaaatcagttctgcgaattttttctcagggaaataccaagtagagaaatttgaaaactataagcaagggataggtttcaatcttctatcgaaggattcctacgccctcaccctgcctaaaacatctatgctctgttattattttagtgggggaggtcgggtaatcatacgaccctcaggaacagaacctaaaatcaagttctacttcgaaatgtcaactcattatccagagcgcgttaccgataaagaaatacaaaaacaacgtgaagcagagagttttcaacatttagacgattttatttttgattttaaagagaaattttccaatttgtga

SEQ ID NO: 12483 - protein, 598 aa, Chlamydophila pneumoniae CWL029
MKEVEQRIRSLYDAVTAENICRWLSNDCTQQDAKTILGWLDTDPAQLEDLFGATLTFGTGGLRSLMGIGTNRINLFTIRRTTQGLVQVLRAHLPHPGDPMRVVVGCDTRHNSIEFAQETAKVLAGNGCEVFLFQYPEPLALVSFTVRYERAIGGVMITASHNPPNYNGYKVYMASGGQVLPPLDQEIVAACSAVNEILSVPSIDHPNIHLIGKEYEALYRDTLKQLQLYPEANRISGRSLSISYSPLHGTGISLVPHVLKDWGFLSVHLVEKQAIGDGDFPTVQLPNPEDPEALTLGIEQMLANDDDLFIATDPDADRVGVVCLEDGQPYRFNGNQMASLLADHILGAWSKTRHLGEHDKLVKSLVTTEMLSAIAKHYHVDLINVGTGFKYIGEKIESWRNSTNKFVFGAEESYGCLYGTHVEDKDAIIASALIAEAALQQKLQGKTLCDALLSLYETYGYFANKTESVVFSAKTDEQEIRKKLSHLEEISSANFFSGKYQVEKFENYKQGIGFNLLSKDSYALTLPKTSMLCYYFSGGGRVIIRPSGTEPKIKFYFEMSTHYPERVTDKEIQKQREAESFQHLDDFIFDFKEKFSNL

SEQ ID NO: 12484 - DNA, 1416 bp, Thermotoga maritima MSB8
  CDS (1)..(1416): transl_table=11
atgattctgtttggaacgggtggaattcgaggcgtgatgaggaaaggggaattcgacgaagaaacggtgaaaagagcctctctgagcaccgccctctggctgaaagagaaaggtcagaaaagcgtggtgatcgcttacgacacgagaaagaactccaaggagttcgcagagctcgctggcagagttttcgccggtgaaggtatagaagcctacgtttttcctgaacctaccccgacaccggttctttccttcgctgtaagatacatgaaaacgggtggaggtgtggtcatcaccgcgagccacaatcccccggaatacaacggctacaaggtctacacctgggatggtgtacaagcgatacccgaatacaccaatgagatcaccgagatatacaaaaaagtcgatctttcccatgtgaaagagggagaaatcaagtttgtaccccctgaagtgaaagagagctacataaaagctgtactcgaaatcgtctcaaatctcccgatgaagaccgatctcgatatcgcctactctccgcttcacggaacaggagcaaactacgtgcctgaggtcctgaaaagactcggattcaaagtcagactcgtagaagaacagatgaaacctgatccaaacttctcaaccgttcccacaccgaatcccgaggaagacgaagcactcgttctcctgaataaaaaaggagctactctgggactcgccacagacccggactgcgatagagtgggagtggtcttcaaagggcgaagactcacaggaaaccaggtaggtgtccttctcacagactttctcctggatcatgtgaaagtggaaaatcccctcgtgataaagacgatcgttacaacggacatggtgagaccgatctgcgaagagaaaggtgccttcctggaagaaacgccgactggattcaagttcataggacacctgatagaggaacacaccaaaaaaggtgacaggaacttcgtcttcggtttcgaagaaagctgtgggtaccttgcgggaaaccacgcgagggacaaagacggtgtggtgggcagtgtgctctccgctgttgccttcagcaactacgatccttacgagaagctcgaagaactctaccagaagtacgggtactacatggaaaagctcatcaatttcaaatttgaagatgttgacagagcggttgaaatatacagatccctgaagaactacgatggtatcatagattattcaaagggttacggaaacgttattccgaacgagaccatagccttcgtctttgaaaaatcaaggatcttcgtgagaccttcgggaacagaaccgaaactcaaggtttacatccacgtgagaggagacacgagagaagaagcggaggaattgatgaaagaaagcgaaagcaagataaaggagatcctgaagctgtga

SEQ ID NO: 12485 - protein, 471 aa, Thermotoga maritima MSB8
MILFGTGGIRGVMRKGEFDEETVKRASLSTALWLKEKGQKSVVIAYDTRKNSKEFAELAGRVFAGEGIEAYVFPEPTPTPVLSFAVRYMKTGGGVVITASHNPPEYNGYKVYTWDGVQAIPEYTNEITEIYKKVDLSHVKEGEIKFVPPEVKESYIKAVLEIVSNLPMKTDLDIAYSPLHGTGANYVPEVLKRLGFKVRLVEEQMKPDPNFSTVPTPNPEEDEALVLLNKKGATLGLATDPDCDRVGVVFKGRRLTGNQVGVLLTDFLLDHVKVENPLVIKTIVTTDMVRPICEEKGAFLEETPTGFKFIGHLIEEHTKKGDRNFVFGFEESCGYLAGNHARDKDGVVGSVLSAVAFSNYDPYEKLEELYQKYGYYMEKLINFKFEDVDRAVEIYRSLKNYDGIIDYSKGYGNVIPNETIAFVFEKSRIFVRPSGTEPKLKVYIHVRGDTREEAEELMKESESKIKEILKL

SEQ ID NO: 12486 - DNA, 1704 bp, Vibrio cholerae O1 biovar eltor str. N16961
  CDS (1)..(1704): transl_table=11
atgaattcacaagtcacacactggttggccagagatccggatcctaagactcgtcaagaactgcaacagttgatcgatactcagcaagacgcgcagattgccgagcgctttcaatcacgccttgaatttggtactgcgggtttgcgtggcaaagtcggctgtggccctaaccgaatgaaccgtttagtgatccaagaaacggcggcgggtctggggcattacttgattgctcaattacccgatgccaaaagccgcggcgtagtgattggttacgatggccgcccagattcaaagcagtttgctcacgataccgcaagcgtgctgacttcactcggcatcaaaacctatttgacctaccaagtcgcggcgacccctatcgtggctttcggcgtacgccatttcaatgcggccgccgcagttgtagtaaccgcaagccacaacccgccggaatacaacggatttaaagtgtattgggaaaacggcgcgcaaattattccgccgcatgatgcaggtattgcggcttgtattgaccaagcggcgcagcaagcgatcccttacctcgcccttgaacaggctgagcaacaaggcctgctgcattggctgcgtgatgagtattaccaaacttaccgtaaaacgattggtgcaagcccactcttgcagcatcacactaagccgcaagcgctaagcttggcttacaccgcgatgcatggcgtgggtgccaatatggcagaaaccttactcgccgatgtcggttttactcacgtcagcagcgtgaaggaacagcgcgagccggatggcacattcccaaccgtcaacttcccgaaccctgaagaagcgggcgcgatggatatggtgatggcactggccaaaaaagtcggcgctcagcttgcttgtgcgaatgatcccgatgcggatcgctttgcggttgccgcgcgtaaagccgatggcgaatatcaaatgctgaccggcgatcaagtcggctcactgtttggtcactatctgctctcgcaaaccgatgctcatcgtcaactggtcggcaacactatcgtctcttccagcttgctcagcaaaatcgccgcagctcatggcgcgcgttattaccaaaccctcactggtttcaaatggttgaccaacgtggcgatgcaagagcaaaccgagcagcaccaattcctgttcgcttatgaagaagccttgggatacaccattggtagcacagtgtgggataaggatggcttgtctgctctggttgcgtttgctcaactggcggcagagctgaatgcgcaaggcaaaacggtatgggatcagcttgaagccctgtatcgccagcatggcctgcacgtgaatgcgcagcgcagcattgcgctggatccgaactcgccaccggtgggtgataaattgcgtgccacgccaccaaaggacattgcaggacgtaaagtgctcatcgtggaagattttaaactggcacgccgcacctttgccgatgacaaaaccgaaacgattaccctgccaaccagtgatgtgctcatttaccatctggacggtggcgctcgcgtgattgtgcgcccatcgggtactgaacctaagctcaagtgctactacgaggtagtgacgccgtttgcggctggggaagattttgtgagcgcgcaagagcgggccgatgagcagatgtcgctgctgattgcagagcatcaaaccagcttgtaa

SEQ ID NO: 12487 - protein, 567 aa, Vibrio cholerae O1 biovar eltor str. N16961
MNSQVTHWLARDPDPKTRQELQQLIDTQQDAQIAERFQSRLEFGTAGLRGKVGCGPNRMNRLVIQETAAGLGHYLIAQLPDAKSRGVVIGYDGRPDSKQFAHDTASVLTSLGIKTYLTYQVAATPIVAFGVRHFNAAAAVVVTASHNPPEYNGFKVYWENGAQIIPPHDAGIAACIDQAAQQAIPYLALEQAEQQGLLHWLRDEYYQTYRKTIGASPLLQHHTKPQALSLAYTAMHGVGANMAETLLADVGFTHVSSVKEQREPDGTFPTVNFPNPEEAGAMDMVMALAKKVGAQLACANDPDADRFAVAARKADGEYQMLTGDQVGSLFGHYLLSQTDAHRQLVGNTIVSSSLLSKIAAAHGARYYQTLTGFKWLTNVAMQEQTEQHQFLFAYEEALGYTIGSTVWDKDGLSALVAFAQLAAELNAQGKTVWDQLEALYRQHGLHVNAQRSIALDPNSPPVGDKLRATPPKDIAGRKVLIVEDFKLARRTFADDKTETITLPTSDVLIYHLDGGARVIVRPSGTEPKLKCYYEVVTPFAAGEDFVSAQERADEQMSLLIAEHQTSL

SEQ ID NO: 12488 - DNA, 1737 bp, Bacillus halodurans C-125
  CDS (1)..(1737): transl_table=11
atgagttggagacagcgttatgaaaaatggaaaggctttaatgagcttgaattagagctaaaacaatcgttggaagccattggtggggacgaacagcagcttgaagactgcttttataaaaacttagagttcgggacaggtggaatgcgcggagaaattggaccaggtccgaaccgaatgaatacatatacaattcgtaaagcttctgaaggctttgcccgttacttgcttgagcaaggggaacatgtaaaagcgcagggggtcgtcattgcctatgattcccggcataaatcacctgagttcgcacgtgaagcggcattgacgattgggaagcacggaattaaagcatacttatttgaagaattacgtccaacacctgaactatcgtttgctgttagaaagctaggagcagcaggtggtattgtgatcacagcaagtcataatccacccgagtataacggctttaaagtatatggttcagatggatgtcagcttccacctgagccggctaatcgactcgtcaaatttgttaacgaaatagaagacgagcttgtgattcctgttggggatgaacgcgagctaaaggaaaatggaacgctggaaatgatcggtgaagaggtggacgtagcttatcacgaggctttaaagacgattattgtcaatccagagctgcttgaagcatcagctaaagatgttcgtattgtgttcactccactacacggaacagctaatctcccagttcgacgtgtgctggaagcggtcggctttgaaaatgtaacggttgttaaagagcaggagctacctgatccacagttttcaacggttaaagcgccaaatccagaggagcatgcagcgtttgccttggcgattgagtacggcaaaaagacagaagcagatgtgttgatcgcaaccgatcctgatgcggatcgcgtcggtgtagcagtacaaaatcaagccggtgaatacattgttctgacggggaaccaaacagggggattgatgcttcattaccttctttcacaaaagaaggaaaaagggcaactcccagttaacggcatcgcgttaaagacgattgtgacatctgagtttggccgcgccattgcggaggatttcggtatccctatggtagatacattaactggtttcaaatttattggtgaaaagataaaggaatacgagcaatctggcgagcatcaatttttattcggttatgaagaaagctatggctacttaattggggactttgtacgtgataaagatgcagtacaagcgtgcttattagcggccgaaatgacagcttactacaagtcgcgtgggatgaccctttatgatggtttattagagctgtttgatcgttatgggtattaccgtgaaggattgacatctatcacattgaaaggaaaagtcggcgttgaaaaaattcaacacgtgttaagccaattccgtcaatcgcccccgaaacaagtgaatgaccaacaagtggtcgtgattgaagactatcaaacaaaagaaaaagtgtcggtcaaagaacgaactgtagaagcaatcacgttaccaacatcaaacgttttaaaatatatgcttgaagatggctcgtggttttgtctccgtccatcaggaacagagccaaagcttaaaatttattacggtgtaaaaacggaagctttagagaaaagcgaagccgcattagatgcggtaaagcgcgacgtagaagagatcgtgcactcgtatttgtaa

SEQ ID NO: 12489 - protein, 578 aa, Bacillus halodurans C-125
MSWRQRYEKWKGFNELELELKQSLEAIGGDEQQLEDCFYKNLEFGTGGMRGEIGPGPNRMNTYTIRKASEGFARYLLEQGEHVKAQGVVIAYDSRHKSPEFAREAALTIGKHGIKAYLFEELRPTPELSFAVRKLGAAGGIVITASHNPPEYNGFKVYGSDGCQLPPEPANRLVKFVNEIEDELVIPVGDERELKENGTLEMIGEEVDVAYHEALKTIIVNPELLEASAKDVRIVFTPLHGTANLPVRRVLEAVGFENVTVVKEQELPDPQFSTVKAPNPEEHAAFALAIEYGKKTEADVLIATDPDADRVGVAVQNQAGEYIVLTGNQTGGLMLHYLLSQKKEKGQLPVNGIALKTIVTSEFGRAIAEDFGIPMVDTLTGFKFIGEKIKEYEQSGEHQFLFGYEESYGYLIGDFVRDKDAVQACLLAAEMTAYYKSRGMTLYDGLLELFDRYGYYREGLTSITLKGKVGVEKIQHVLSQFRQSPPKQVNDQQVVVIEDYQTKEKVSVKERTVEAITLPTSNVLKYMLEDGSWFCLRPSGTEPKLKIYYGVKTEALEKSEAALDAVKRDVEEIVHSYL

SEQ ID NO: 12490 - DNA, 1656 bp, Pasteurella multocida subsp. multocida str. Pm70
  CDS (1)..(1656): transl_table=11
atgtcaatctttacccttgctcaacattggttagcacaagatcctgatcctgaaacacatgcagaacttaccgcacttcttgacgcggcaaaaacgggggatgcgaaagcaagcacagaattaaatgcacgctttgatggtcgtttacagtttggtactgcaggcttgcgtggtcgtttacaagccggaccaatggggatgaaccgcgtgttagttgcacaagcagcggggggcttagccgattatttaaaagactatgataaaaccccttccattgtcattggctatgacgggcgtaaaaattcagatgtatttgcacgcgatactgccgaaattatggcaggcgcaggcatcaaagcctacttattaccacgtaaattgccaaccccagtccttgcttatgcgatcaaatattttgataccacagcgggggtcatggtgaccgcaagtcataacccaccagaagataatggctataaagtctatttaggtaaagccaatggtggcggtcaaattgtttctccagcagaccaagacatcgctaaactgattgataaagtggcggctggctccattaaagatttaccacgtagccaagattttatcgtactggatgacgaagtcgttgatgcctacattgcgaaaacagctagccttgccaaagaaccccaaacagacattaattatgtctataccgcaatgcacggtgtcggctatgaagtattgagcaaaacgttagctaaagcaggtttaccacaaccacatttagtggcggagcaagtgtggccagatggcacgttcccaacagtaaacttcccgaatccagaagaaaaaggcgcattagacttagccattaaagtggcgaaagagaaaaatgccgaatttatcattgcgaatgacccagatgctgaccgcttagccgtcgcggtaccagatgcagaaggcaactggaaaccgttgcatggtaatgtggtcggttgtttcttaggttggtacttagcgaaacaatatcatgcacaaggacaaaaaggcattcttgcttgttcattagtttcttcgccagcactggctgagattgcgaaaaaatacggtttccaatcagaagaaacactcactggctttaaatatattggtaaagtcgatgggttattattcggctttgaggaagcattaggttatttagttgacccagacaaagtccgtgataaagacggtatttctgccgctatttcgtttttagatttagtacgttacttgaaaaaacaaggcaaaacactcgccgactatgccgatgaattcactcaagaatttggtgcttatgtaagtggacaaatctcgattcgtgttgatgacttatctgaaattggcaaattaatgagtgcactgcgtcaaaatccaccaagcgatatcggcggtttcaaagtcgcacaattcttggatcacaccaaaaccgatcgccaaagtgatattttagttttcgttcttgaaaatggtagtcgtttgatcgtacgcccatctggtacagaaccaaaaatcaagttctacctcgatgcgaaagggaaagatccaaaagatgctgagcaagtgttagcccaatttgatgaaagtgttcgtcacattttacgtcaagatgaatttggtaagcaggattgctaa

SEQ ID NO: 12491 - protein, 551 aa, Pasteurella multocida subsp. multocida str. Pm70
MSIFTLAQHWLAQDPDPETHAELTALLDAAKTGDAKASTELNARFDGRLQFGTAGLRGRLQAGPMGMNRVLVAQAAGGLADYLKDYDKTPSIVIGYDGRKNSDVFARDTAEIMAGAGIKAYLLPRKLPTPVLAYAIKYFDTTAGVMVTASHNPPEDNGYKVYLGKANGGGQIVSPADQDIAKLIDKVAAGSIKDLPRSQDFIVLDDEVVDAYIAKTASLAKEPQTDINYVYTAMHGVGYEVLSKTLAKAGLPQPHLVAEQVWPDGTFPTVNFPNPEEKGALDLAIKVAKEKNAEFIIANDPDADRLAVAVPDAEGNWKPLHGNVVGCFLGWYLAKQYHAQGQKGILACSLVSSPALAEIAKKYGFQSEETLTGFKYIGKVDGLLFGFEEALGYLVDPDKVRDKDGISAAISFLDLVRYLKKQGKTLADYADEFTQEFGAYVSGQISIRVDDLSEIGKLMSALRQNPPSDIGGFKVAQFLDHTKTDRQSDILVFVLENGSRLIVRPSGTEPKIKFYLDAKGKDPKDAEQVLAQFDESVRHILRQDEFGKQDC

SEQ ID NO: 12492 - DNA, 1719 bp, Streptococcus pyogenes M1 GAS
  CDS (1)..(1719): transl_table=11
atgacttacacagaaaattttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattagcaaaattaatcgaaactaagggagaggaagctaaaaaacgtggtgtagctatcgcttatgattcgcgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgcgctattgaaaatccatttgcagttgaacttgctgatttagatgaaaacaaatcatcaggtcttattcaagttatcggtgaagatgttgatatggaataccttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtcgaatcacaagctaaggcagatccagacttttctactgttaaatcgcctaaccctgaaagccaagctgcctttgctcttgctgaagaactcggacgagaagttgaggcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttatggcgctacaatgtttaacgttttaactggattcaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggctattttgctgaaaaaacgatttcagtaacactttcaggtgtggatggagctgctgaaattaagaagattatggacaaattccgtgaaaatggtccaaaacaatttaacaatactgatattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacaataggtgatactcttgacatcgctcaagaaaaaattgctaacattgaaacagaaatcaatacctttgttggctaa

SEQ ID NO: 12493 - protein, 572 aa, Streptococcus pyogenes M1 GAS
MTYTENFQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDENKSSGLIQVIGEDVDMEYLREVKDVNINQDLINNFGKDMKIVYTPLHGTGEMLTRRALAQAGFESVVVVESQAKADPDFSTVKSPNPESQAAFALAEELGREVEADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATIGDTLDIAQEKIANIETEINTFVG

SEQ ID NO: 12494 - DNA, 1695 bp, Streptococcus pyogenes M1 GAS
  CDS (1)..(1695): transl_table=11
atgacttacaacgaggtatatcaagaatggttgcacaataatgatcttagtgatgatattaaagcagatttagcagccataaaagacaatgaggctgagattcaagatcgtttttacaaaacacttgaatttggaacagcagggctaagaggaaaacttggagcaggcaccaatcgcatgaatacctatatggttggtaaggcagcacaagctttagctaatactattattgatcatggacctgaagcggttaaaaagggcattgcggttagttatgatgttcgctatcaatctagaacatttgcagaattaacatgctctattatggcagctaacggtattaaggcgtacctttataaagggattcggccaacaccaatgtgttcgtacgctattcgtgctttgggatgtatttctggtgttatgattacggctagtcacaatccccaagcttacaatggttacaaagcttattggcaagaaggttctcaaattttggatgacattgcggatcaaattgcacaacacatggctgcactaactcagtatcaggaaatcaaacaaatgccttttgaaaaggctctggacagtggacttgttacttatattgatgagagtattgaagaagcatataaaaaagaagtgcttggtttaacgattaatgatactgacattgataagtcagtccgagtagtctatacccctttaaatggtgttgggaatctaccagtgcgtgaggttttaagacgccgcggttttgaaaatgtttatgtggtacctgagcaggaaatgcccgatcctgattttacaacagttggctatcctaatcccgaagtccctaaaacttttgcatattcagaaaaattaggtaaggcagttgatgctgatattttgattgcaactgatccagattgtgaccgtgtggctttagaagttaaaaatgcagtcggtgactatgtttttctcaatggcaataaaatcggagcgcttttatcttactatatcttttcacaacgatttgacttaggcaatttaccggctaatcctgttttagtgaaatccattgtaacaggagacttgtcacgggctattgctagccattatggtattgaaaccgttgaaacattgactggttttaagaatatttgtggcaaggcaaacgaatatgatgtgacgaaacaaaaaaactacctgtttggttatgaagaaagtattggtttttgctatggcacttttgttcgtgacaaagacgctgttagcgcctctatgatgattgtagaaatggcagcttactacaagaaaaaagggcagaatttactagatgttttgcagactatttatgcgacatttgggtattataatgaacgtcaaattgccttggagcttgaggggatagaaggacaaaaacgcattgcgaggataatggaagatttcagacagacaccaatagctagtgttgcagagatggcgttagacaagacaattgattttattgatggctatcaagattttccaaagcaaaactgtctcaaattttatttggatgatggttcttggtatgcacttagaccatcaggaacagagcctaaaataaaattttatttatatactattggccaaacacaagaaaatagtgcaacaaaattagatgctattgaagcagcgtgtcgcacaaaaataaatcaggttaattaa

SEQ ID NO: 12495 - protein, 564 aa, Streptococcus pyogenes M1 GAS
MTYNEVYQEWLHNNDLSDDIKADLAAIKDNEAEIQDRFYKTLEFGTAGLRGKLGAGTNRMNTYMVGKAAQALANTIIDHGPEAVKKGIAVSYDVRYQSRTFAELTCSIMAANGIKAYLYKGIRPTPMCSYAIRALGCISGVMITASHNPQAYNGYKAYWQEGSQILDDIADQIAQHMAALTQYQEIKQMPFEKALDSGLVTYIDESIEEAYKKEVLGLTINDTDIDKSVRVVYTPLNGVGNLPVREVLRRRGFENVYVVPEQEMPDPDFTTVGYPNPEVPKTFAYSEKLGKAVDADILIATDPDCDRVALEVKNAVGDYVFLNGNKIGALLSYYIFSQRFDLGNLPANPVLVKSIVTGDLSRAIASHYGIETVETLTGFKNICGKANEYDVTKQKNYLFGYEESIGFCYGTFVRDKDAVSASMMIVEMAAYYKKKGQNLLDVLQTIYATFGYYNERQIALELEGIEGQKRIARIMEDFRQTPIASVAEMALDKTIDFIDGYQDFPKQNCLKFYLDDGSWYALRPSGTEPKIKFYLYTIGQTQENSATKLDAIEAACRTKINQVN

SEQ ID NO: 12496 - DNA, 1782 bp, Chlamydia muridarum Nigg
  CDS (1)..(1782): transl_table=11
atggaaattccaaaaaagaaaattgaggaaatgtttgatcctcaaactgccaaaaatattttatcttggttgcaggataatgcatgtgataacaccttgattttagatttactggataaggaccctgaaaaattaaaagaacggttcggagatattttaacttttgggacagccggattgcgcagtcttatgggagtgggcacaaatcggttaaatgtgtttaccgtccgcagagccacgcaaagtttagctcaggtactaaagcaacgatatcctgatgaggatatcagtgttgtggttggatatgatacacgacaccattctttagagtttggacaagagacagcgaaagttttggccgggaatggtattcttacttacttgtttcaggtgcctgagcccttagcgcttgtttcttattcagttcgagaatttcaagctaaagctggagttatgatcacagcatcacataatcctcctgcttacaacggctacaaagtatacatgtcgacaggagggcaggttttgcccccaatggatcaggaaatcgtgaaagaatttcaaatgattgatcaagtattgtcagtggatactttagatcacccttgtattcgtttgattcaagaggaaatagaagctgattacgagaaagccttacatcaactgcagttatgtagggaagacaatcgtcagcacggttctttactacggatgagttactctccattacacggcactggagtgtcaatggtcccaaggattttgaaagactggggattctcttcggtctgtttagttgaaaagcagatgattcctgatggggatttccctactatagttcttcctaatcctgaagatccggaagcgttggttctgggtattcagcagatgctagatcagaaggatgatttgttcattgcaacagatcctgatgcagacaggataggcattgtttctttggaaaaagatggtccttatcggtttaatggtaaccagatagcatgtttgttagcagctcatattctcagtagagaatctcaaaaagctcctttaggggttgaagataaggtagtcaaaagcattgtaacaacagaacttttgacggccattactgagtcgtatggaggtagtgttgttaatgttggagctggatttaaatatataggcgagaaaatagaattatggcggtctggtatggaacgctttattttcggagccgaggagtcttatgggtatttgtatggttctcatgtagaagataaagatgcaatgatatctgcagctctcattgctgaaacagctttacagcagaaactgcgcggatatacgttgcgagatgctttgttagaactgtatgagatccatggatattatgctaatttaacagagtctattgatctccctgtggatcaacctaatcaaaagcaggagttattagagcgttgggagactcaggatcctctttatatgtctttacctggtcgcaaactggttgcctttgaaaattataaaactggagaagggtgtgatctagttacaggaattacatacaaattagccttacccaaaatgtcgatgctttgtttctactatgaaggatcgggtagagtgattgtgcgtccctccggaacagagccaaaaataaagttatactttgaattaaaacaccatttttcagaattttctaaagagcgtacggttcgagaatctcgagagaaagaaagttttgaggcgttagagaattttgttaaagaaacaaaaatgcgtctttttcgtacctag

SEQ ID NO: 12497 - protein, 593 aa, Chlamydia muridarum Nigg
MEIPKKKIEEMFDPQTAKNILSWLQDNACDNTLILDLLDKDPEKLKERFGDILTFGTAGLRSLMGVGTNRLNVFTVRRATQSLAQVLKQRYPDEDISVVVGYDTRHHSLEFGQETAKVLAGNGILTYLFQVPEPLALVSYSVREFQAKAGVMITASHNPPAYNGYKVYMSTGGQVLPPMDQEIVKEFQMIDQVLSVDTLDHPCIRLIQEEIEADYEKALHQLQLCREDNRQHGSLLRMSYSPLHGTGVSMVPRILKDWGFSSVCLVEKQMIPDGDFPTIVLPNPEDPEALVLGIQQMLDQKDDLFIATDPDADRIGIVSLEKDGPYRFNGNQIACLLAAHILSRESQKAPLGVEDKVVKSIVTTELLTAITESYGGSVVNVGAGFKYIGEKIELWRSGMERFIFGAEESYGYLYGSHVEDKDAMISAALIAETALQQKLRGYTLRDALLELYEIHGYYANLTESIDLPVDQPNQKQELLERWETQDPLYMSLPGRKLVAFENYKTGEGCDLVTGITYKLALPKMSMLCFYYEGSGRVIVRPSGTEPKIKLYFELKHHFSEFSKERTVRESREKESFEALENFVKETKMRLFRT

SEQ ID NO: 12498 - DNA, 1797 bp, Chlamydophila pneumoniae J138
  CDS (1)..(1797): transl_table=11
atgaaagaagtagaacaacgtatccggtcattatacgatgcagtaacagctgaaaatatttgtagatggttgtccaatgattgtacccaacaagatgcaaagactatcctaggatggttagatacagatcctgcacagcttgaagatctattcggagcgactcttacctttggtaccggaggactccgtagtcttatgggtatcggaacaaataggatcaacctgtttactatacgtcgaacgacgcaagggctggttcaggtgctccgcgctcatcttccccatcccggagatcctatgcgtgtagttgtcggttgtgatacccgccataactctatagaatttgctcaagaaactgcaaaagtcctcgcaggtaatggctgcgaagttttcttgtttcagtatcccgaacctttggctttagtctcctttacggtgagatacgaaagggccatcggcggagtgatgatcaccgcctctcataatcctcccaattacaatgggtataaagtttatatggcttcgggaggccaagttctccctcccttagatcaagagattgttgccgcctgtagtgcagtgaacgaaattttatcagtgccctcgatagatcatcccaatattcacctcattggaaaagaatacgaagccctttacagagacactttgaagcaactgcaactctatcccgaagcaaaccggatttcaggaaggtctttatctatttcctattcgccattgcatggaacaggaatttctctcgttcctcatgttctcaaagactggggatttttatccgtacatcttgtggaaaaacaggccataggtgacggcgatttcccaaccgtgcagctgccaaatcctgaggatccagaggctctgactctgggcactgagcaaatgctcgctaatgacgatgatctttttatagctaccgacccagatgccgatcgcgtgggcgtggtttgtctagaagacggccaaccctaccgatttaacggaaatcaaatggcgagccttttagcagaccacatcttaggagcttggagcaaaacaagacacttaggagaacatgataaattggtcaagagcttggtgactacagaaatgctctctgctatcgcaaagcactatcatgtggatcttattaatgtcggaacaggatttaaatacatcggagagaaaattgaatcctggcgcaattccacaaacaaattcgtatttggagccgaggaatcttacggttgtctctacggcactcacgtagaagataaagacgctattattgcgtcagcattgattgcagaagccgcactacaacaaaaattacaaggaaaaactctatgcgacgcactcctttctctttacgaaacatacggatactttgctaacaaaacggagtctgtggttttttccgcaaaaactgacgaacaagaaataagaaaaaaactttcacaccttgaggaaatcagttctgcgaattttttctcagggaaataccaagtagagaaatttgaaaactataagcaagggataggtttcaatcttctatcgaaggattcctacgccctcaccctgcctaaaacatctatgctctgttattattttagtgggggaggtcgggtaatcatacgaccctcaggaacagaacctaaaatcaagttctacttcgaaatgtcaactcattatccagagcgcgttaccgataaagaaatacaaaaacaacgtgaagcagagagttttcaacatttagacgattttatttttgattttaaagagaaattttccaatttgtga

SEQ ID NO: 12499 - protein, 598 aa, Chlamydophila pneumoniae J138
MKEVEQRIRSLYDAVTAENICRWLSNDCTQQDAKTILGWLDTDPAQLEDLFGATLTFGTGGLRSLMGIGTNRINLFTIRRTTQGLVQVLRAHLPHPGDPMRVVVGCDTRHNSIEFAQETAKVLAGNGCEVFLFQYPEPLALVSFTVRYERAIGGVMITASHNPPNYNGYKVYMASGGQVLPPLDQEIVAACSAVNEILSVPSIDHPNIHLIGKEYEALYRDTLKQLQLYPEANRISGRSLSISYSPLHGTGISLVPHVLKDWGFLSVHLVEKQAIGDGDFPTVQLPNPEDPEALTLGTEQMLANDDDLFIATDPDADRVGVVCLEDGQPYRFNGNQMASLLADHILGAWSKTRHLGEHDKLVKSLVTTEMLSAIAKHYHVDLINVGTGFKYIGEKIESWRNSTNKFVFGAEESYGCLYGTHVEDKDAIIASALIAEAALQQKLQGKTLCDALLSLYETYGYFANKTESVVFSAKTDEQEIRKKLSHLEEISSANFFSGKYQVEKFENYKQGIGFNLLSKDSYALTLPKTSMLCYYFSGGGRVIIRPSGTEPKIKFYFEMSTHYPERVTDKEIQKQREAESFQHLDDFIFDFKEKFSNL

SEQ ID NO: 12500 - DNA, 1617 bp, Mycobacterium leprae TN
  CDS (1)..(1617): transl_table=11
ttgaaggctgccgtgacacccgaagagtggatcacgcacgatcccgacccacagacagccgccgagctggccgcgtgcgaccccgatgaacttgcggcgcggttcacccgtgcactgcgcttcggcacgtcgggcttgcgcggaccagtgcgcggcggccccgacgccatgaacctagcggtggtgttgcgagcgacctgggccgtggcacaggtgctcctgcaacgagcgggctcgcggcctgcaaccgtaatcgtcgggcgcgactctcggcacggctcggcggcattcgtcgctgcgaccgctgaggtgcttgccgctgaaggtttttccgttctgctgctacccaatccggcacccacgccggtggtggcgtttgcggtgcgcaataccggcgccgcggccgggatccagatcacagcatcgcacaacccgccgaccgataacgggtacaaggtgtatttcgacggcggcatccagatcatctctcccattgaccaccaaatcgaaaacgcgatggccgctgctcccctggccgaccagatcaccaggaaacccgtaaaccccagtgaaaacagcgcctccgatctggttgaccattatattcagcgagcggccgcggtacggcgctccaacggttcagttcgggttgcccttacaccgatgcacggagtgggcggtgcggtagccgtcgagacgctgcggcgcaccggctttgacgacgtgcacaccgtagcggcgcagttcgagcccgaccccgactttccaaccgtcgcgttcccaaacccggaggagcccggcgccaccgacgcattgctggccctggccgcccatgtcggggccgacgtcgcgatagcactggaccccgacgccgaccgctgcgccgttggtatacccaccaactcgggatggcggatgctgtccggagacgaaaccggttggctgctaggcgattacattttgtcgcaaaccgacaagccggaaaccgccgtggtagccagtaccgtggtgtcgtcgcgtatgttgccagcaatcgccacacactacaacgcggtccacgtcgagaccctcaccggcttcaagtggctggcgcgcgccgacgcaaacctgccgggcactcttgtgtacgcctatgaggaagctatcgggcattgtgtcgaccccactgccgtacgcgacaaagacggcatcagcgccgcggtgttagtgtgcgatctggttgccgcactgcacaagcagggccgctcggtgcccgacatgcttgaccaactcgccctacgccacggcgtgcacgacgttacagcaatatcacgtcgcattggccccaaacaaacgggagttgacgaggctgtcgacctgattcagcggctacgcgcagccccgccgagtcagctggccgggttcaccgcgaccactaccgatatcaccgacgcgctaatcttcaccggcggtgatgatgacacgtgggtccgggtagtggtgcggctatcaggaaccgaaccgaagttaaagtgctacttggaagttcgctgctcggtggctggcaacctaccatccacccgacaacgggccagggtgctgcgcgacgagctagtcaccttggtgcagcagtggtga

SEQ ID NO: 12501 - protein, 538 aa, Mycobacterium leprae TN
MKAAVTPEEWITHDPDPQTAAELAACDPDELAARFTRALRFGTSGLRGPVRGGPDAMNLAVVLRATWAVAQVLLQRAGSRPATVIVGRDSRHGSAAFVAATAEVLAAEGFSVLLLPNPAPTPVVAFAVRNTGAAAGIQITASHNPPTDNGYKVYFDGGIQIISPIDHQIENAMAAAPLADQITRKPVNPSENSASDLVDHYIQRAAAVRRSNGSVRVALTPMHGVGGAVAVETLRRTGFDDVHTVAAQFEPDPDFPTVAFPNPEEPGATDALLALAAHVGADVAIALDPDADRCAVGIPTNSGWRMLSGDETGWLLGDYILSQTDKPETAVVASTVVSSRMLPAIATHYNAVHVETLTGFKWLARADANLPGTLVYAYEEAIGHCVDPTAVRDKDGISAAVLVCDLVAALHKQGRSVPDMLDQLALRHGVHDVTAISRRIGPKQTGVDEAVDLIQRLRAAPPSQLAGFTATTTDITDALIFTGGDDDTWVRVVVRLSGTEPKLKCYLEVRCSVAGNLPSTRQRARVLRDELVTLVQQW

SEQ ID NO: 12502 - DNA, 1719 bp, Streptococcus pneumoniae TIGR4
  CDS (1)..(1719): transl_table=11
atgtcttaccaagaaaattaccagaaatgggttgattttgtggagcttcctgactaccttcgtcaagatttggaaaatatggacgaaaaaactaaggaagatgccttctatacaaatcttgaatttggtactgcaggtatgcgtggcttggttggtgctggtacaaaccgtatcaacatctacgttgttcgccaagctactgaaggattggctcgtttgattgagtcaaaaggtggaaacgagaaagaacgcggtgtagcaattgcctacgatagccgtcacttctcacctgagtttgcctttgaatctgcggcagttcttgctaaacacggcatcaaatcttacgtatttgaaagccttcgtccgactccagaactatcatttgcagttcgtcatctcaactgtttcgcaggtatcatggtcacagccagccacaaccctgctccatttaacggttacaaggtttacggtgaagacggtggacaaatgcctccacacgatgcggacgctttgactacttatatccgtgcaatcgaaaacccatttgcagttgaagttgctgatgtggaaactgaaaaagcttctggcttgattgaagttatcggcgaagctgttgacatagaataccttaaagaggttaaggacataaacatcaacccagccttgattgaagaatttggtaaagacatgaagattgtctacacaccacttcatggtactggtgaaatgttggctcgtcgtgctcttgcccaagcaggatttgactctgttcaagttgttgaagcgcaagcaactgctgacccagacttttcaactgtaacatctccaaacccagaaagccaagcagcctttgcccttgctgaagaacttggtcgtcaagttggtgcagatgttcttgtcgcaactgacccagacgctgaccgtgttggtgttgaagttcttcaaaaagatggtagctacctcaacctttcaggtaaccaaatcggtgctatcatggctaaatacatcttggaagctcacaaaaacgctggaactcttcctgaaaatgccgctctctgcaaatctatcgtttcaactgacttggtaacgaagattgctgaaagctacggcgcaactatgttcaacgtcttgacaggtttcaaatttatcgctgaaaaaatccaagaattcgaagaaaaacacaaccacacttacatgatgggatttgaagaaagcttcggttacttgattaaaccatttgtacgtgataaagatgccatccaagccgttcttgtagttgctgaacttgctgcctactaccgttctcgtggtttgacacttgctgacggtatcgaagaaatctataaagaatatggctactacgcagaaaaaacaatctctgttactctttcaggtgtcgatggtgctgaacaaatcaaagcgattatggctaaattccgcaacaatgctccaacagaatggaacgcaacagctatcactgtcgtagaagacttcaaggcacaaactgctactgttgctgacggtactgttacaaacttgacaactcctccaagtgatgtgttgaaatacacacttgctgacggttcatggattgccgttcgcccttcaggtacagaaccaaaaatcaagttctacattgcagttgtaggggaaaccaacgaagaatcacaagctaagattgctaacatcgaagcagaaatcaatgcatttgtaaaataa

SEQ ID NO: 12503 - protein, 572 aa, Streptococcus pneumoniae TIGR4
MSYQENYQKWVDFVELPDYLRQDLENMDEKTKEDAFYTNLEFGTAGMRGLVGAGTNRINIYVVRQATEGLARLIESKGGNEKERGVAIAYDSRHFSPEFAFESAAVLAKHGIKSYVFESLRPTPELSFAVRHLNCFAGIMVTASHNPAPFNGYKVYGEDGGQMPPHDADALTTYIRAIENPFAVEVADVETEKASGLIEVIGEAVDIEYLKEVKDININPALIEEFGKDMKIVYTPLHGTGEMLARRALAQAGFDSVQVVEAQATADPDFSTVTSPNPESQAAFALAEELGRQVGADVLVATDPDADRVGVEVLQKDGSYLNLSGNQIGAIMAKYILEAHKNAGTLPENAALCKSIVSTDLVTKIAESYGATMFNVLTGFKFIAEKIQEFEEKHNHTYMMGFEESFGYLIKPFVRDKDAIQAVLVVAELAAYYRSRGLTLADGIEEIYKEYGYYAEKTISVTLSGVDGAEQIKAIMAKFRNNAPTEWNATAITVVEDFKAQTATVADGTVTNLTTPPSDVLKYTLADGSWIAVRPSGTEPKIKFYIAVVGETNEESQAKIANIEAEINAFVK

SEQ ID NO: 12504 - DNA, 1728 bp, Clostridium acetobutylicum ATCC 824
  CDS (1)..(1728): transl_table=11
atgtcatacaaagaaaaatttaaagcatggttagattctgaatatgttgatgttgaaactaagaaggaattagaagcaataaaggatgaaaaggaaatagaagatagattttataaggacctggaatttggaacgggtggacttagaggagtgattgcagcaggaagtaatagaataaatatatacactgttggcaaagccactcaagggcttgcagattaccttaataaaaactataataatgcgtctatagccatagcacatgattctagaataatgtctagagagttcgcagaaagagcagcaagtgttttatgtgcaaatggtataaaaacttatttatttgattcacttagacctacacctatgctttcttttactgtaagacatttaaattgcaaagcaggaatagtaataactgcgtctcacaatccaaaacaatataatggatataaggtttataacgaggacggaaatcagcttacagataatgctgcagctgaggttttagattttatagaaaaaacagaagatttttcaggtgtaaagcttatagatataaagaaagctgagaaggatggaattcttgatatcatcggagaagaagtggataaggtttacatagataaggttaaagatttaacaataagaaaagatatggttaaggaaagcgcaaaagatttaaaaataatatatacacctattcatggttctggaaatattccagtaagaagagtgttaaaggaattaggctacgaaaacctaacagtggttaaggaacaggaaaagccagatggtaatttcccaacagctccatatcctaacccagagcagccttcagtatttaatatagctcttgagttagcaaaaaaagtagatccagatgttatatttggaactgatcctgattgcgataggataggtgttttagttaagaataagagtggagaatataaagtgcttacgggaaatcaaacaggagttcttttaactcactatataatctcatctcttaaagatactggtaagctaccagctaatggtgcagtaataaaaactatagtaacctctgaaatgacacgtaagattacagaggattatgacatgaagcttatagatgttttaactggctttaaatatataggagaaaaaattaaggaatttgaagaaactaattcaaatacttatttgtttggtttcgaggaaagctatggatgccttgcaggtacttttgtaagggataaagatgctgttgttgcagctacattggtatgtgaaatggcattgtactataagaataaaggactaagtctcgatgatgctcttaatgaattatatgagaaatacggtttctataaggagaaattagtatctatagagcttcaaggtaaagagggtcaggaaaaaatacaaaaagccttaaattacttaagagagaatatgtcagataacgtagcaggagtaaaaatagtcaaaaagtttgattataagagtagtgtagagaaggatatacctaaaaatgaagaaaagaagattgagctccctaagtctaacgtacttagatttattttagaagatggttcttggtttgttgtaaggccatctggaactgagcctaagatgaaagtttatctagcagtagcaggtacaaataaagaggattctgaagctagaatgaataaatttaacaatgatgttatggatatcattaaccaggcttgcaaataa

SEQ ID NO: 12505 - protein, 575 aa, Clostridium acetobutylicum ATCC 824
MSYKEKFKAWLDSEYVDVETKKELEAIKDEKEIEDRFYKDLEFGTGGLRGVIAAGSNRINIYTVGKATQGLADYLNKNYNNASIAIAHDSRIMSREFAERAASVLCANGIKTYLFDSLRPTPMLSFTVRHLNCKAGIVITASHNPKQYNGYKVYNEDGNQLTDNAAAEVLDFIEKTEDFSGVKLIDIKKAEKDGILDIIGEEVDKVYIDKVKDLTIRKDMVKESAKDLKIIYTPIHGSGNIPVRRVLKELGYENLTVVKEQEKPDGNFPTAPYPNPEQPSVFNIALELAKKVDPDVIFGTDPDCDRIGVLVKNKSGEYKVLTGNQTGVLLTHYIISSLKDTGKLPANGAVIKTIVTSEMTRKITEDYDMKLIDVLTGFKYIGEKIKEFEETNSNTYLFGFEESYGCLAGTFVRDKDAVVAATLVCEMALYYKNKGLSLDDALNELYEKYGFYKEKLVSIELQGKEGQEKIQKALNYLRENMSDNVAGVKIVKKFDYKSSVEKDIPKNEEKKIELPKSNVLRFILEDGSWFVVRPSGTEPKMKVYLAVAGTNKEDSEARMNKFNNDVMDIINQACK

SEQ ID NO: 12506 - DNA, 1653 bp, Haemophilus influenzae Rd KW20
  CDS (1)..(1653): transl_table=11
atgacaacacttttggaggttgcacaacattggttaaaccaagatcctgacgcagaaactcgtgcagaattaaccgcacttttagatgccgcaaaaggcggagataaagcggcagaagcagaattacatgcgcgttttgatggtcgcttacaatttggtacggcaggtttacgtggtcgtttacaagctggctcaatggggatgaaccgagttttagtttctcaagctgctggtggtttagcggaatatttaaaaggttacgataaagaaccctcaatcgtcattggttacgatggtcgtaaaaactctgatgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggcttaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgctaatgacccagatgcagaccgtttagccgttgctgtgcctgatgcgcaaggcaactggaaatcactacacggtaacgtggttggctgtttcttaggttggtacttagcaaaacaatatcaaggtaaacaaggcacattggcttgctcacttgtttcttctcctgcgctcgctgaaattgcgaaaaaatacagtttccaatcagaagaaaccttaactggtttcaaatacatcggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaattggaaaattaatgaccgcacttcgtaacaatccaccagcagaaatcgctggcgtgaaagtggcacaatttatcgaccacattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagatcgcgtactagcagaatttgatgaaggtgttcgtcacattcttcgccaagatgcttatggcaaacaagactgctaa

SEQ ID NO: 12507 - protein, 550 aa, Haemophilus influenzae Rd KW20
MTTLLEVAQHWLNQDPDAETRAELTALLDAAKGGDKAAEAELHARFDGRLQFGTAGLRGRLQAGSMGMNRVLVSQAAGGLAEYLKGYDKEPSIVIGYDGRKNSDVFARDTAEIMAGAGVKAYLLPRKLPTPVLAYAIQYFDTTAGVMVTASHNPPEDNGYKVYLGKANGGGQIVSPADKDIAALIDKVAAGNIQDLPRSDNYVVLNDEVVDAYITKTASLAKEPACDINYVYTAMHGVGYEVLSKTLAKAGLPQPHVVADQVWPDGTFPTVNFPNPEEKGALDLAIKVAKEKNAEFIIANDPDADRLAVAVPDAQGNWKSLHGNVVGCFLGWYLAKQYQGKQGTLACSLVSSPALAEIAKKYSFQSEETLTGFKYIGKVSGLLFGFEEALGYLVDPDKVRDKDGISAAIVFLDLVRNLKKQGKTLADYADEFTKEFGAYVSGQISIRVSDLSEIGKLMTALRNNPPAEIAGVKVAQFIDHIKTDRQSDILVFNLENGGRLIARPSGTEPKIKFYLDARGKDPKDADRVLAEFDEGVRHILRQDAYGKQDC

SEQ ID NO: 12508 - DNA, 1674 bp, Listeria monocytogenes EGD-e
  CDS (1)..(1674): transl_table=11
atgacttggaaacactatttgagtgcttggcaaaatgccgatttatcaaatgagtggcgccgtgaattacaacgagtggaagaagagcaggaacgttttgatggttacttaacatttggaactggcgggatgcgcggtaaaatgggtattggaacaaagcgcatcaatctttttaccattagacgagtagcgaaaggtttgggagattatgttgtcgcaaacgaaggagccgaaatgggcgttgcaattgcgtttgactctagacatcattcgggtgcttttgcgcaggaaacggcaaaggtcctagcggcgcagggtatcaacgtttatttatccgattcgattcgaccaacaccagctttatcattttgcgttcgagaaaagggggcattcgcgggcgtggtgattaccgcaagccataatccttctatctataatggtttcaaagtatatgataaaaatggctgtcaaatcacattgggtgtagcgcaggaaattgctggctatttagaaaaaataacggatatctttactataccagtgcgcgaattacccaatccactcgtgacacctctaggaaaagaaatggatgatgcttatttaaacgctttaacagcagtcgtttctcgccctgacttgcttgctgactacgggaatgaactacggatttgttacacgccgcttcatggtgccggaaaagaactcgttatgcgtggacttttggaaaatggattttcggaaacgaccattattgcagaacaaagcgaaccggatggggattttccgacagtgatttcgcctaatccggaagaagaaaatagtttcgacctagccaaaaagctggcaaaagaaatacaagccgatattattttggcaacagatcctgatgctgatagactgggagtggctgttttaaacaagcaagctacataccaaattttaacagggaatcagctaggagcgttacttttaaattatattttagaagcaaaaacaccggtaactggggcggatacgatgatcaacacgatagttactggggatttaggtgggaaaatcgcgtatgactttggaattaaccatatccaaacgctcactggttttaaattcatcggtgagaaaatagctgaaatggaaggcacggaaaaaaatttcctatttggatatgaggaaagttatggttatttaatcgcaccctttgttcgcgataaagatgcagtgcaggcagcattacttacagcagaaatggcgcttttctataaaaaagaaggaacaacacttcttggaaagctaaccaatttatttgaaaaatttggctaccataaagaatatttgcacacgataacattagacgatagcgatggaataactaaaatgattcaagtgatagacgctttgcgcaaagagccaattttcatgccggaaattactgtggtagaagactttcttactagtaaacggaccaactttgtgacaatggaagtaaccaatatagagctcccaaaagaaaacgttttaaaattctacttaatggatagctcatggtttgcaatacgtccttctggaacggaaccgaaatgcaaaatctattttcaaacaagcggtgaaacggaagaaattgcgacaaaagccatgaatgagttgagaaaacgcgtattagctgtatgggactaa

SEQ ID NO: 12509 - protein, 557 aa, Listeria monocytogenes EGD-e
MTWKHYLSAWQNADLSNEWRRELQRVEEEQERFDGYLTFGTGGMRGKMGIGTKRINLFTIRRVAKGLGDYVVANEGAEMGVAIAFDSRHHSGAFAQETAKVLAAQGINVYLSDSIRPTPALSFCVREKGAFAGVVITASHNPSIYNGFKVYDKNGCQITLGVAQEIAGYLEKITDIFTIPVRELPNPLVTPLGKEMDDAYLNALTAVVSRPDLLADYGNELRICYTPLHGAGKELVMRGLLENGFSETTIIAEQSEPDGDFPTVISPNPEEENSFDLAKKLAKEIQADIILATDPDADRLGVAVLNKQATYQILTGNQLGALLLNYILEAKTPVTGADTMINTIVTGDLGGKIAYDFGINHIQTLTGFKFIGEKIAEMEGTEKNFLFGYEESYGYLIAPFVRDKDAVQAALLTAEMALFYKKEGTTLLGKLTNLFEKFGYHKEYLHTITLDDSDGITKMIQVIDALRKEPIFMPEITVVEDFLTSKRTNFVTMEVTNIELPKENVLKFYLMDSSWFAIRPSGTEPKCKIYFQTSGETEEIATKAMNELRKRVLAVWD

SEQ ID NO: 12510 - DNA, 1731 bp, Listeria monocytogenes EGD-e
  CDS (1)..(1731): transl_table=11
atgaattggcaagaagaatatcaaaaatgggttgctaatgacaaattagatagcacattaagaaaacaattaacgaatatggagacaaatgaaaaagaacttgaagatagtttttatcgtaatatggaatttggaactgctgggatgcgtggcgtactaggtgctggaacaaaccgtatgaatatctatactattcgtaaggcttctctaggtttggcgcaatttgtggcggagaacggggaagaggctaaaaaacgtgggatagttattgcgtatgatcctcgtcatatgtcgcgtgaatttgcttttgaatcggcggcagtattagggcatcatggtgtgaaaagttatgtttttgatgcgcttcgaccaacaccggaactttcttttgcagtgcgtcatttaaatgcgtttggtggaattgttatcacagctagccataatccgccagaatacaatggctacaagatttatggtgaagatggcggacaaatgcctccaacaggcgcaagtgctgtaattgaatacataaacgcggtagaggatattttttctgtagaagtagcgaaccaagagctattaattgaaaatggtttacttgaggtaatcagtgaaaaagtagaccgtccatatttggaaaaattaaaagaggttattgtcaataaagagcttgttcaagaacgaggggaggatttgaaaattgttttcacgccccttcatggtactggcggaattcttggcgttcctgcgcttgaaagtgttggctttacgaatattgttaaggttgacgagcaatttgtgaatgatcccgattttggaacggtaaaatcgcctaacccggaaaaccgcgaagcctttttacttgcgattgaatatggtaagaagtttggcggggatattttagtaggaaccgacccggatgctgaccgtttaggcgtggctgttcgtaatgcggacggagaatacgaagttttatctggaaaccaaattggtgcgattattttacattatttattaaaacaaaagaaagcgcaaagtgagttgccggctaatgcagcggtattaaaatctatcgtaacaagtaatcttggaacagaaatcgcgaaacattacggcgctgaaatgattgaagtattaactggtttcaaatttattgcagaacaaattaagcactttgaagaaactggcaagcatacgtttgaatttggttatgaagaaagcaatggttatatggttaagccatttacgcgtgataaagatgcgattcaagcggttcttgcgattgctgaagtggcgctcgttagcaaagtagcaggtagaactttattagaagatttagatcaaatttatgatgaatttggttattataatgaggatctcgtttcacttacgttaagtggaaaagatggttctgagcgcatcaaagaaattacaagtagcttccgtgaacaactgccaacaagtatgggtgggttcgtagtagaacgtgcggaagattatttgagaagtgaaacgacttggattgctactggaaaaactgaagcgatacatttaccaacagcagatgtcattaaatgttattttgaagatggttcatggttctgtttacgtccatcgggcacagaaccgaaaatcaaattctactttagtattcgtggtgaaagtaaagaagaaagtacggcaaaattagaaaaagtgaaagctgatttgatgcaacatatcgaagcttaa

SEQ ID NO: 12511 - protein, 576 aa, Listeria monocytogenes EGD-e
MNWQEEYQKWVANDKLDSTLRKQLTNMETNEKELEDSFYRNMEFGTAGMRGVLGAGTNRMNIYTIRKASLGLAQFVAENGEEAKKRGIVIAYDPRHMSREFAFESAAVLGHHGVKSYVFDALRPTPELSFAVRHLNAFGGIVITASHNPPEYNGYKIYGEDGGQMPPTGASAVIEYINAVEDIFSVEVANQELLIENGLLEVISEKVDRPYLEKLKEVIVNKELVQERGEDLKIVFTPLHGTGGILGVPALESVGFTNIVKVDEQFVNDPDFGTVKSPNPENREAFLLAIEYGKKFGGDILVGTDPDADRLGVAVRNADGEYEVLSGNQIGAIILHYLLKQKKAQSELPANAAVLKSIVTSNLGTEIAKHYGAEMIEVLTGFKFIAEQIKHFEETGKHTFEFGYEESNGYMVKPFTRDKDAIQAVLAIAEVALVSKVAGRTLLEDLDQIYDEFGYYNEDLVSLTLSGKDGSERIKEITSSFREQLPTSMGGFVVERAEDYLRSETTWIATGKTEAIHLPTADVIKCYFEDGSWFCLRPSGTEPKIKFYFSIRGESKEESTAKLEKVKADLMQHIEA

SEQ ID NO: 12512 - DNA, 1674 bp, Listeria innocua Clip11262
  CDS (1)..(1674): transl_table=11
atgacttggcaaaactatttgaatgcttggaaaaatgccgatttatctgatgagtggcgcagtgaattaaaacgagtggaacatgaacaggagcgttttgaaggatacttaacatttggaacaggcggaatgcgtggcaaaatggggcttggctcgaatcgcattaacctttttacaatcagacgggtggcaagtggattaggcgagtatgtggcagcaaatggaggcaaagagaagggcgtcgcaattttttacgattctagaaataattcagacgtttttgcagctgaaacagcaaaagtattatcagcactgggcattcgagtttatttatcagatacgattcgcccaacaccagcactttctttttgcgttagagaaacgaaatcctttgccggagtagtgattaccgcgagccataatccttctatttataatggatttaaagtgtatgatgaaaatggatgccaaatcacattaggtgcggcacaggaaattaccagctatttaaataaaataacggatatttttcgtataccagttcgagaattaccaaatttgctcgttactaccattggaaaagaaatggacgacgcctatttacaggctttaacaaaagtaatttctcgtccggaattggttgctgattatggaaatgaattagggatttgctatacaccacttcacggagctggtaaagaactagttatgcgaggcttagcggaaaatggcttttcaaatacgctacttgttcaagaacaaagtgagccagacggagatttcccaacggttgtttcacctaatccagaagaagaaaatagttttgaattagccaaactgcaagcgcaaaaaatgcaagcggatataattttggcaactgatcccgatgctgacagactcggagtagcagttttaaccaatcaaaacgagtatcaaattttaacaggaaatcagcttggtgctttgttattagactatattttgtcggcgaaagagtttgtaacgaaagaggatacgatgattaatacgattgtcaccggagatttaggtggcaaaatagcaagtcgatttggtattcttcatgtccaaacgctcacaggtttcaaatttattggtgaaaaaatagccgaaatggaagggacgcaagctaattttatttttggctacgaggagagttacggttacttaatagcgccttttgtacgcgataaagatgcggtacaagcagcattacttacagcagaaatggctcttttctataaaaaagaaggaactaccctgcttggaaaactaacttctttatatgaacaatttggctatcataaagaatatttgcacactattaccctcgaaaacaacgatggcgctgcaaaaatgaatcaaatgatagacactttacgaaaagaaccccattttttaccagaaatagtagctgttgaagattttctcactagcgagcgaacaaatcttctcacaaaagaaataacaaacatcgagctacctcaagaaaatgtattaaaattttacttaaaagacaaatcatggttcgctgtccgaccttctgggactgaaccaaaatgtaaaatctatttccaaaccattgctgaaacagaagaaaacgcagaaaaagcaatgaatgacttaaaagaacgcgtattagctgtatgggactaa

SEQ ID NO: 12513 - protein, 557 aa, Listeria innocua Clip11262
MTWQNYLNAWKNADLSDEWRSELKRVEHEQERFEGYLTFGTGGMRGKMGLGSNRINLFTIRRVASGLGEYVAANGGKEKGVAIFYDSRNNSDVFAAETAKVLSALGIRVYLSDTIRPTPALSFCVRETKSFAGVVITASHNPSIYNGFKVYDENGCQITLGAAQEITSYLNKITDIFRIPVRELPNLLVTTIGKEMDDAYLQALTKVISRPELVADYGNELGICYTPLHGAGKELVMRGLAENGFSNTLLVQEQSEPDGDFPTVVSPNPEEENSFELAKLQAQKMQADIILATDPDADRLGVAVLTNQNEYQILTGNQLGALLLDYILSAKEFVTKEDTMINTIVTGDLGGKIASRFGILHVQTLTGFKFIGEKIAEMEGTQANFIFGYEESYGYLIAPFVRDKDAVQAALLTAEMALFYKKEGTTLLGKLTSLYEQFGYHKEYLHTITLENNDGAAKMNQMIDTLRKEPHFLPEIVAVEDFLTSERTNLLTKEITNIELPQENVLKFYLKDKSWFAVRPSGTEPKCKIYFQTIAETEENAEKAMNDLKERVLAVWD

SEQ ID NO: 12514 - DNA, 1731 bp, Listeria innocua Clip11262
  CDS (1)..(1731): transl_table=11
atgaactggcaagaggaataccaaaaatggattacaaataaagaactagatgagtcgctaaaaaaacaattggtagatatagaaaagaatgaaaaagaattagaagatagtttttatcgtaatatggaatttggtacggcggggatgcgtggcgttctaggtgctggaacaaatcggatgaatatctatactattcgaaaagcatcacttggtttggcacaatttgtagctgaaaacggtgaagaggctaagaaacgcggaattgttattgcttacgatcctcgtcatatgtcgcgtgaatttgcctttgagtcagcggcggttttagggcaccatggtgttaaaagttatgtgttcgatgcgcttagaccaacaccggaactttcttttgcagttcgatttttaaatgcatttggtgggatagtaataacggcaagccataatccaccagaatataatggctataaaatttacggagaagacggtggccaaatgccgccaactggtgcaagtgccgtaatagattacataagtgccgtggaagatattttttctgtagaagtagcagaccaagacgaattaattgaaaaaggtttacttgaaataattagtgaaaaagtagaccgtccttatttggaaaagttaaaagaagtaattgttaataatgagttggtgcaagaacgtggtaaggatttgaaaattgttttcacgccattacatggtacaggtgggattttaggggttcctgcgcttgaaagtgtcggcttcacgaatatcgttaaagtagaggagcaatttgtgaacgaccctgattttggtactgtaaaatcacctaatccagaaaacaaagaagcattttcgctcgcaattgaatatggcaaaaaacatgatggcgatatattagtaggaactgatccggatgctgaccgtttaggagttgcagtacggaataatgacggggaatatgagattttatccggtaatcaaattggtgcgataattttacattacttgttaaaacaaaagaaagcgcaaaatgaactaccagaaaatgcggctgttttaaaatcgattgtcacaagtaatcttgggacggaaatcgcgaaacactttggtgtacagatgattgaagttttaacagggttcaaatttatcgcggaacaaatcaagcattttgaggaaacagggaagcatacatttgaatttggttatgaagaaagtaatggttatatggttaagtcgtttactcgtgataaagatgctattcaggcagttctcgcgatttctgaagtggcacttgtgagcaaaacggaagggcggactttgctagaagagttagaacaaatttatgctgaatttggttattataaagaagatttagtttcgctcactttaagtggaaaagatggatcagagcgcattaaagaaattacaagtggctttagagagcaacttcctacaagcatgggcggtttccgaattgagcgcgcggaagattatttaagaagcgaaactacttggattgaaacaggtaaaactgaagagattcaattaccgaccgcagatgtaattaaatgttattttgaagatggttcatggttctgcttgcgtccatcaggcaccgaaccgaaaatcaaattctattttagcattcgcggtgaaaatgaagcagaaagcacgcaaaaacttgaaaaagtaaaagctgatttgatgcaatatatcgaagcttaa

SEQ ID NO: 12515 - protein, 576 aa, Listeria innocua Clip11262
MNWQEEYQKWITNKELDESLKKQLVDIEKNEKELEDSFYRNMEFGTAGMRGVLGAGTNRMNIYTIRKASLGLAQFVAENGEEAKKRGIVIAYDPRHMSREFAFESAAVLGHHGVKSYVFDALRPTPELSFAVRFLNAFGGIVITASHNPPEYNGYKIYGEDGGQMPPTGASAVIDYISAVEDIFSVEVADQDELIEKGLLEIISEKVDRPYLEKLKEVIVNNELVQERGKDLKIVFTPLHGTGGILGVPALESVGFTNIVKVEEQFVNDPDFGTVKSPNPENKEAFSLAIEYGKKHDGDILVGTDPDADRLGVAVRNNDGEYEILSGNQIGAIILHYLLKQKKAQNELPENAAVLKSIVTSNLGTEIAKHFGVQMIEVLTGFKFIAEQIKHFEETGKHTFEFGYEESNGYMVKSFTRDKDAIQAVLAISEVALVSKTEGRTLLEELEQIYAEFGYYKEDLVSLTLSGKDGSERIKEITSGFREQLPTSMGGFRIERAEDYLRSETTWIETGKTEEIQLPTADVIKCYFEDGSWFCLRPSGTEPKIKFYFSIRGENEAESTQKLEKVKADLMQYIEA

SEQ ID NO: 12516 - DNA, 1728 bp, Clostridium perfringens str. 13
  CDS (1)..(1728): transl_table=11
gtgtatagagaaaaatatgaagaatggctaaattctgatattatttctgaggaaataaaggcggaattaagagacgtaaaagaagataaggaaatagaagatagattttataaggaattagattttggtactggtggattaagaggtgttattggtgctgggactaatagaatgaatatctatactgtaggaaaagctactcaaggatttgcagattatttaaatgataattatgcgggggaaaaatctgttgcaatagcttatgactcaagaaatatgtctaaggagtttgcaaaagcggctgctttaactctttgtgcaaatggaataaaggttaatctttttgaatctttaagaccaactccaatgttatcctttgcagtaagagaattaaattgtaagggtggtattgttataacagcatcacataatccaaaacaatataatggatataaagtttatggagatgatggatgtcaattaacagatgctcctgcaaaagctgttattggatatgttaacaaagttacagattacgcaaacataaagacaatgagtgaagaaaaggctttagaagaaggtcttttagtttatattggtgaagaaatagataaaaaatatatagatgatttaaaaactttaactataagagaagatttagttaagaagcatgctaaagatttaaaaataatttatactccaattcatggttcaggaaatgttcctgtaagaagaatattaaaagagttaggatatgagaatgtatttgttgttaaagaacaagaaatgccagatggaaatttcccaacagctccatatccaaatccagaagatccaaaggtatttaaattagctttagacatggctaaagaaattcaacctgatataatatttggaacagatccagactgtgatagaataggtgttgttgttaaagacaataatggagagtaccaagtattaagtggtaaccaaacaggaatgttactaactaactatatattaagttcattaaaggaaatgaataaattacctgaaaatggtgcagttataaaaactatagttactacagagtcagtaagaaaaatgactgaggaatatggggtaactttaatagatacattaacaggatttaaatatataggtgaaaagataagagaatttgaagaatcaggttcaaatgaatatttatttggttttgaagaaagctatggttacttagctggaacttttgctagagataaggatgctgttgtagcttcaatgttaatagctgaaatgactttatattataaagaacaaggaaaaactctttatgatggtttaatagaactttataataaatatggttacttcaaagaaagcttagtatcaatagagcttgcaggaaaagaaggacaagaacaaatagctaagtgtatagatggcttaagaaatgatgctttaaaagaaatgaacggagttaaagttattacatctttcgattataagttaagcaaagaattaaataacttaactggagaagaaaaagaaatcaaacttccaaaatcaaatgttttaaaatatgttttagaagatgattcttggtttgttgtaagaccatcaggtacagagcctaagatgaaaatctacttatcagtaaaaggttcaagtttagaagattcaaaagaaaaaactgaaaactttaaaaatgcaataatggaagtaattaatgctaaattaaaatag

SEQ ID NO: 12517 - protein, 575 aa, Clostridium perfringens str. 13
MYREKYEEWLNSDIISEEIKAELRDVKEDKEIEDRFYKELDFGTGGLRGVIGAGTNRMNIYTVGKATQGFADYLNDNYAGEKSVAIAYDSRNMSKEFAKAAALTLCANGIKVNLFESLRPTPMLSFAVRELNCKGGIVITASHNPKQYNGYKVYGDDGCQLTDAPAKAVIGYVNKVTDYANIKTMSEEKALEEGLLVYIGEEIDKKYIDDLKTLTIREDLVKKHAKDLKIIYTPIHGSGNVPVRRILKELGYENVFVVKEQEMPDGNFPTAPYPNPEDPKVFKLALDMAKEIQPDIIFGTDPDCDRIGVVVKDNNGEYQVLSGNQTGMLLTNYILSSLKEMNKLPENGAVIKTIVTTESVRKMTEEYGVTLIDTLTGFKYIGEKIREFEESGSNEYLFGFEESYGYLAGTFARDKDAVVASMLIAEMTLYYKEQGKTLYDGLIELYNKYGYFKESLVSIELAGKEGQEQIAKCIDGLRNDALKEMNGVKVITSFDYKLSKELNNLTGEEKEIKLPKSNVLKYVLEDDSWFVVRPSGTEPKMKIYLSVKGSSLEDSKEKTENFKNAIMEVINAKLK

SEQ ID NO: 12518 - DNA, 1764 bp, Schizosaccharomyces pombe 972h-
  CDS (1)..(1764)
atggatccgattttgcaagaattagtagatgagtggttcaaattagatcaagatgaaactacgaggaatgaagtttcacaattgattaaggctgaagattatgccaccctcaagcaaattatgcatccaaggattggatttggtacatctggtttgagagctgaaattggtgctggcttcgctcgcatgaactgtttgaccgtgattcaagcctcacaaggcttcgctgagtatttgcttcaaaccgtaccatcagctgcaaagctgggtgtggtaattggacacgatcataggcataagtctaatacttttgctcgacttactgctgcagtgttcttgcaaaaaggattcaaaacgtatttcttcgatcatcttgtccatacccctttagtcccttttgccgttaaaaccctagggactgcagctggtgttatgattactgcttcccataatcccgcagcttataacggatacaaggtctattggggaaacggttgtgctatcattcctccccatgacaagggaattgctgcatgtatagaaaaaaacttaacgcccattacttgggacaaaaatttggttgaaaatcataaactagcagatcgggattttgcagttggtcttttaaaaaactattggtctcagctccacgaattccattccgaaaacaacttttccttggaaatgaaatctttgaaatttgtttacactcctattcatggcgttggattaccatttgttacttcagcattacacttatttggcgaacaaggcgatatgatttctgtacctcttcaagattctccaaaccctgactttccgactgtgaaatttccaaatccagaagaggagggggcattggatttggcttacgagcaagctgatgctaatggtatttcgtatgtccttgcaactgatcctgacgcagatcgtttcgcctttgcagaaaaaattaatggtgcttggagaagatttaccggagatgaagttggttgtatccttgcctattttatatttcaagaatacaaaaacgttggaaagccaattgatgatttttacgttttgtcaactactgtctctagtgctatggtaaagtccatggccaaagtagaaggattccatcatgttgaaacacttactggatttaagtggttaggcaataaagcattagaattggaaaaacaagggaaatttattggattggcatatgaagaagctcttggttatatggtaggtagtatagttagagacaaagacggggttaatgctttgattacgttccttcatcttttgaaacgccttcaacttcagaatctttcaattaccgaggtttttgagcaaatgtctaaaaaatatggttattacactacgcaaaactcatatttcctttcacgcgacactcccaagcttcgtgctttggttgatgccttgagacattatgacacaaaatcgggttatccggcaacccttggtagtaagaaaattacaaatgttcgcgaccttactacaggttacgactcaagctccacggatggtaaagctactttaccagtttcaaaaagttcagataacgtaacgtttgagcttgaaaatggagaggtaattatgactattcgcacaagtggtacagagccgaaacttaagttttatatctgtgctcgcggacattcgcttgaagattccataaagaatgctacagaagttaaacaggctatcaaatctgaatggtttcatccccaacagaacggactggaagagccatga

SEQ ID NO: 12519 - protein, 587 aa, Schizosaccharomyces pombe 972h-
MDPILQELVDEWFKLDQDETTRNEVSQLIKAEDYATLKQIMHPRIGFGTSGLRAEIGAGFARMNCLTVIQASQGFAEYLLQTVPSAAKLGVVIGHDHRHKSNTFARLTAAVFLQKGFKTYFFDHLVHTPLVPFAVKTLGTAAGVMITASHNPAAYNGYKVYWGNGCAIIPPHDKGIAACIEKNLTPITWDKNLVENHKLADRDFAVGLLKNYWSQLHEFHSENNFSLEMKSLKFVYTPIHGVGLPFVTSALHLFGEQGDMISVPLQDSPNPDFPTVKFPNPEEEGALDLAYEQADANGISYVLATDPDADRFAFAEKINGAWRRFTGDEVGCILAYFIFQEYKNVGKPIDDFYVLSTTVSSAMVKSMAKVEGFHHVETLTGFKWLGNKALELEKQGKFIGLAYEEALGYMVGSIVRDKDGVNALITFLHLLKRLQLQNLSITEVFEQMSKKYGYYTTQNSYFLSRDTPKLRALVDALRHYDTKSGYPATLGSKKITNVRDLTTGYDSSSTDGKATLPVSKSSDNVTFELENGEVIMTIRTSGTEPKLKFYICARGHSLEDSIKNATEVKQAIKSEWFHPQQNGLEEP

SEQ ID NO: 12520 - DNA, 1743 bp, Fusobacterium nucleatum subsp. nucleatum ATCC 25586
  CDS (1)..(1743): transl_table=11
ttggaggaatattctaaagataatctaaataaatatacgaatggagatgataatatgtttttagatgaatacaaaaaatggttagattctaatatgttatctgcaagcgaaaaagaagaattaaaaaatattgctaatgatgaaaaagaaattgaaagtagattttatacagatttaagttttggaactgctggtatgagaggtgtaagaggtattggtagaaacagaatgaataaatataatataagaaaagctacacaaggtttagctaactatattataaaagcaacaggagaagtaggaaaacaaaaaggtattgctattgcctacgattcaagattagattctgttgaaaatgctcttaatactgcaatgactttggcaggtaatggaataaaagtttatttgtttgatggagtgagatcaactcctgaactctcttttgcagttagagaattaaaggcacaagcaggtattatgataactgcttctcataatccaaaagaatacaatggatataaggtttattgggaagatggagctcaaatagttgatccacaagcaacaggtattgtaagttctgtcgaagctgttaatatattcaatgatattaaattgatggaagaaaaagaagcaatagataaaggacttcttgtttatgttggaaaaaaattagatgatagatacatagaagaagttaagaaaagtgctattaatccaaatgtagaaaataaagataaagtaaaatttgtgtactctcctttacatggagtagcagcaagacctgttgaaagagttttaaaagaaatgggttacacaaatgtttatcctgtaaaagagcaagaaaaaccagatggaaattttccaacttgtgattatgcaaacccagaggatacaactgtttttaaattgagtatagagcttgcagataaagttggagctaaaatttgtatagcaaatgatcctgatggagacagagttggtttggcagttcttgataatgatggaaaatggtttttcccaaatggaaatcaaataggaattttgtttgcagaatatattttaaattataaaaaagatattccaaaaaatggaactatgataacaactgttgtatcaactccacttcttgacactattgttaaaaagaatggtaaaaaggctttaagagttcttacaggttttaaatatattggtgaaaaaattagacaatttgaaaataaagaattagatgggactttcttatttggttttgaagaagcaatagggtatttagttggaactcacgttagagataaggatgcagttgttgcttctatgataattgcagaaatggctacaacatttgaaaataatggttctagtatctataatgaaattataaaaatttatgaaaagtatggttggcgtttagaaacaactgttcctataactaaaaaagggaaagatggacttgaagaaatacaaaaaattatgaagtctatgagagtaaaaagtcatacagaaatagctggtgtaaaggtaaaagaatatagagactatcaaaagggtgttgaaaatttaccaaaagcagatgttattcaaatggttttagaagatgaaacttatttaacagtaagaccttctggaacagaacctaagattaaattctatatttcagtggtagatagtgataaaaaagttgctgaagaaaaattggcaaaaataaaaaaagaatttataaattatgctgaaaatctataa

SEQ ID NO: 12521 - protein, 580 aa, Fusobacterium nucleatum subsp. nucleatum ATCC 25586
MEEYSKDNLNKYTNGDDNMFLDEYKKWLDSNMLSASEKEELKNIANDEKEIESRFYTDLSFGTAGMRGVRGIGRNRMNKYNIRKATQGLANYIIKATGEVGKQKGIAIAYDSRLDSVENALNTAMTLAGNGIKVYLFDGVRSTPELSFAVRELKAQAGIMITASHNPKEYNGYKVYWEDGAQIVDPQATGIVSSVEAVNIFNDIKLMEEKEAIDKGLLVYVGKKLDDRYIEEVKKSAINPNVENKDKVKFVYSPLHGVAARPVERVLKEMGYTNVYPVKEQEKPDGNFPTCDYANPEDTTVFKLSIELADKVGAKICIANDPDGDRVGLAVLDNDGKWFFPNGNQIGILFAEYILNYKKDIPKNGTMITTVVSTPLLDTIVKKNGKKALRVLTGFKYIGEKIRQFENKELDGTFLFGFEEAIGYLVGTHVRDKDAVVASMIIAEMATTFENNGSSIYNEIIKIYEKYGWRLETTVPITKKGKDGLEEIQKIMKSMRVKSHTEIAGVKVKEYRDYQKGVENLPKADVIQMVLEDETYLTVRPSGTEPKIKFYISVVDSDKKVAEEKLAKIKKEFINYAENL

SEQ ID NO: 12522 - DNA, 1719 bp, Streptococcus pyogenes MGAS8232
  CDS (1)..(1719): transl_table=11
atgacttacacagaaaattttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattagcaaaattaatcgaaactaagggagaggaagctaaaaaacgtggtgtagctatcgcttatgattcgcgccacttctctccagaatttgcttttgaatctgcacaggtcttggcacagcatggaattaaatcttacgtatttgaaactcttcgtccaacaccagaactttcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcagcaggtcttattcaagttatcggtgaagatgttgatatggaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgttaaatcgcctaaccctgaaagccaagctgcctttgctcttgctgaagaactcggacgagaagttgatgcagatgtcttagtagctaccgatcctgatgcagaccgcctaggcgttgaaattcgccaaccagatggttcttataaaaatctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttatggcgctacaatgtttaacgttttaactggattcaaattcatcgctgagaaaattcaagagtttgcagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggctattttgctgaaaaaacgatttcagtaacactttcaggtgtggatggagctgctgaaattaagaagattatgaacaaattccgtgaaaatggtccaaaacaatttaacaatactgatattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacaataggtgatactcttgacatcgctcaagaaaaaattgctaacattgaaacagaaatcaatacctttgttggctaa

SEQ ID NO: 12523 - protein, 572 aa, Streptococcus pyogenes MGAS8232
MTYTENFQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFETLRPTPELSFAVRHLNAYAGIMVTASHNPAPFNGYKVYGQDGGQLPPADADALTDFIRAIENPFAVELADLDESKSAGLIQVIGEDVDMEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFAEKHNHTYMFGFEESFGYLIKPFVRDKDAIQAVLLVAEIAAYYRSRGLTLADGIDEIYKEYGYFAEKTISVTLSGVDGAAEIKKIMNKFRENGPKQFNNTDIVLLEDFQKQTATKNDGTISNLTTPPSNVLKYTLADDSWIAVRPSGTEPKIKFYIATIGDTLDIAQEKIANIETEINTFVG

SEQ ID NO: 12524 - DNA, 1695 bp, Streptococcus pyogenes MGAS8232
  CDS (1)..(1695): transl_table=11
atgacttacaacgaggtatatcaagaatggttgcacaataatgatcttagtgatgatattaaagcagatttagcagccataaaagacaatgaggctgagattcaagatcgtttttacaaaacacttgaatttggaacagcagggctaagaggaaaacttggagcaggcaccaatcgcatgaatacctatatggttggtaaggcagcacaagctttagctaatactattattgatcatggacctgaagcggttaaaaagggcattgcggttagttatgatgttcgctatcaatctagaacatttgcagaattaacatgctctattatggcagctaacggtattaaggcgtacctttataaagggattcggccaacaccaatgtgttcgtacgctattcgtgctttgggatgtatctctggtgttatgattacggctagtcacaatccccaagcttacaatggttacaaagcttattggcaagaaggttctcaaattttggatgacattgcggatcaaattgcacaacacatggctgcactaactcagtatcaggaaatcaaacaaatgccttttgaaaaggctctggacagtggacttgttacttatattgatgagagtattgaagaagcatataaaaaagaagtgcttggtttaacgattaatgatactgacattgataagtcagtccgagtagtctatacccctttaaatggtgttgggaatctaccagtgcgtgaggttttaagacgccgcggttttgaaaatgtttatgtggtacctgagcaggaaatgcccgatcctgattttacaacagttggctatcctaatcccgaagtccctaaaacttttgcatattcagaaaaattaggtaaggcagttgatgctgatattttgattgcaactgatccagattgtgaccgtgtggctttagaagttaaaaacgcagtcggtgactatgtttttctcaatggcaataaaatcggagcgcttttatcttactatatcttttcacaacgatttgacttaggcaatttaccggctaatcctgttttagtgaaatccattgtaacaggagacttgtcacgggctattgctagccattatggtattgaaaccgttgaaacattgactggttttaagaatatttgtggcaaggcaaacgaatatgatgtgacgaaacagaaaaactatctgtttggttatgaagaaagtattggtttttgctatggcacttttgttcgtgacaaagacgctgttagcgcctctatgatgattgtagaaatggcagcttactacaagaaaaaggggcagaatttactagatgttttgcagactatttatgcgacatttgggtattataatgaacgtcaaattgccttggagcttgaggggatagaaggacaaaaacgcattgcgaggataatggaagatttcagacagacaccaatagctagtgttgcagagatggcgttagacaagacaattgattttattgatggctatcaagattttccaaaacaaaactgtctcaaattttatttggatgatggttcttggtatgcacttagaccatcaggaacagagcctaaaataaaattttatttatatactattggccaaacacaagaaaatagtgcaacaaaattagatgctattgaaacagcgtgtcgcacaaaaataaatcaggttaattaa

SEQ ID NO: 12525 - protein, 564 aa, Streptococcus pyogenes MGAS8232
MTYNEVYQEWLHNNDLSDDIKADLAAIKDNEAEIQDRFYKTLEFGTAGLRGKLGAGTNRMNTYMVGKAAQALANTIIDHGPEAVKKGIAVSYDVRYQSRTFAELTCSIMAANGIKAYLYKGIRPTPMCSYAIRALGCISGVMITASHNPQAYNGYKAYWQEGSQILDDIADQIAQHMAALTQYQEIKQMPFEKALDSGLVTYIDESIEEAYKKEVLGLTINDTDIDKSVRVVYTPLNGVGNLPVREVLRRRGFENVYVVPEQEMPDPDFTTVGYPNPEVPKTFAYSEKLGKAVDADILIATDPDCDRVALEVKNAVGDYVFLNGNKIGALLSYYIFSQRFDLGNLPANPVLVKSIVTGDLSRAIASHYGIETVETLTGFKNICGKANEYDVTKQKNYLFGYEESIGFCYGTFVRDKDAVSASMMIVEMAAYYKKKGQNLLDVLQTIYATFGYYNERQIALELEGIEGQKRIARIMEDFRQTPIASVAEMALDKTIDFIDGYQDFPKQNCLKFYLDDGSWYALRPSGTEPKIKFYLYTIGQTQENSATKLDAIETACRTKINQVN

SEQ ID NO: 12526 - DNA, 1671 bp, Thermoanaerobacter tengcongensis MB4
  CDS (1)..(1671): transl_table=11
gtggaaaaagagactttgaaaaggtatgaggcgtggctaaatgaccctgccatatcctatgaggataaagagaaattgaagaaaatgtctcctgaggagataaaagaggccttttttatggacttggaatttgggacagcgggattaaggggaattatggggcttggagccaatagaatgaatttttatacggtaggcagggcaacccaggctcttgctaattacataaacaagacggtagaggaagaaaaaagtgtggcagtttcttacgataccaggaaattttctaaagagtttgcagtggagtcagcgcagatactggccgcaaatggaataaaagtttatctttttgacgattttagacccacgccccttttgtcttttgctgtcaggtttttaaaggctacagctggtataatgataacagcgagtcacaatcctccggaatacaacggatacaaggtatattggtcaaatggcgctcagattattccaccccatgataaaggcattatagaggagtacgagaaactgtcttttgcggatgtaaaaagaatgtcctttgatgaggctaaagataagggctttgtggtcatggtggggaaagaggtggactctgcatattttgaaaaagccctttcttattcttttgggatttcttcaaaggatttaaagatagtgtatactcctctccatgggacaggtattaaaattgtcccgccactacttgagaaagttgggtttgatgtatatattcaaaaagagcagcagataccggatggaagctttcctacagtgagctatcctaatccagagtttgatgaggcctttgagcttgctttgaaagatgcaagaagtattgatgcggatatagttgtggcttcagacccggacgcagataggatgggagttttggtaaagcataaaggggattatgtgagaatagatggaaatcagatgggcattttgcttttgaattttcttcttacgatgtattttgaaaagggcatgccagaaaatccggctgttatagagtctattgtgtcttctaagctttttgctaaaattgcgagggcgcacggggttgaggtttctgaagtgcttacaggttttaagtggatatgcaatgaagctgataggttgagaaaagaaggcaaaacggtgttttttgcctatgaagaaagctatggatacaatgtgggagattttgtttacgacaaagactcaggcactcctataatggtaacctgtgaaatggctgcctactacaaaaagaagggcatgactttagttgatgctttagaagagatttataaaaaatacggttactaccttgaagaccagctttctcctgtatatgaaggggaaaaagggcttaagaaaataaaggggattatggaaaggctaagagaaaagccaattgaaagtttggcaggccacaggctcacgcgtgttgtagattatcttaaaggctatgacaggatatcgccttcagatgttttaaagatggaatttggggagaagctcatagtatacgttaggccctcaggcacagagcctaaaataaaattctattttatggcaatggagatggagaatatagaggaggctaaaaagcttttaaaaagagctaaggaagagcttgtaaaagtgctggatttggaagaataa

SEQ ID NO: 12527 - protein, 556 aa, Thermoanaerobacter tengcongensis MB4
MEKETLKRYEAWLNDPAISYEDKEKLKKMSPEEIKEAFFMDLEFGTAGLRGIMGLGANRMNFYTVGRATQALANYINKTVEEEKSVAVSYDTRKFSKEFAVESAQILAANGIKVYLFDDFRPTPLLSFAVRFLKATAGIMITASHNPPEYNGYKVYWSNGAQIIPPHDKGIIEEYEKLSFADVKRMSFDEAKDKGFVVMVGKEVDSAYFEKALSYSFGISSKDLKIVYTPLHGTGIKIVPPLLEKVGFDVYIQKEQQIPDGSFPTVSYPNPEFDEAFELALKDARSIDADIVVASDPDADRMGVLVKHKGDYVRIDGNQMGILLLNFLLTMYFEKGMPENPAVIESIVSSKLFAKIARAHGVEVSEVLTGFKWICNEADRLRKEGKTVFFAYEESYGYNVGDFVYDKDSGTPIMVTCEMAAYYKKKGMTLVDALEEIYKKYGYYLEDQLSPVYEGEKGLKKIKGIMERLREKPIESLAGHRLTRVVDYLKGYDRISPSDVLKMEFGEKLIVYVRPSGTEPKIKFYFMAMEMENIEEAKKLLKRAKEELVKVLDLEE

SEQ ID NO: 12528 - DNA, 1650 bp, Streptomyces coelicolor A3(2)
  CDS (1)..(1650): transl_table=11
gtgcaagacgtgcaagacgacctcctcgcacgagccagggcatggctggccgaggatcccgacgcggacacccgcgcggaactcgcccgcctcatcgacgccgaggaccacgccgagctcaccgcacgcttctccggcaccctccagttcggcaccgcgggcctgcgcggcgaactgggcgccggcccgatgcgcatgaaccgctcggtcgtcatccgcgccgccgccggcctcgcggcgtacctgaagaagcagggccacaccgacggcctcgtcgtcgtcggctacgacgcccgccacaagtccgccgacttcgcccgcgacaccgccgccgtcatgaccggcgccggcctgagggcggccgtactcccccgccccctccccacccccgtcctcgccttcgcgatccgccacctcggcgcggtcgccggagtggaggtcaccgccagccacaacccgccccgcgacaacggctacaaggtgtacctcggcgacggctcccagatcgtgccccccgccgacgccggcatcgccgccgggatcgacaccgtgcgcaccctccacgacgtcccccgccccgacgccggctggcagaccctcgacgacgacgtcctcgacgcctacctcacccgcacggacgccgtcctcgcccccggctccccccgcaccgcccgcaccgtctacacggcgatgcacggcgtgggcaaggacaccctcctcgccgccttcgcccgagccggcttcccgcgccccgccctcgtcaccgagcaggccgaccccgacccggacttccccaccgtcgccttccccaacccggaggagcccggcgcgatggacctcgccttcgcgaaggcgagggagacggcccccgacctgatcgtcgccaacgacccggacgcggaccgcctggcagtggccgtacccgacgccgcggaggccaccggctggcgcatgctccggggcgacgaggtaggcgccctgctcgcaacacacctggtcacccgcggagcgcacggcacgttcgcggagtcgatcgtctcgtcgtccctcctggcccgcatcgccgcgaaggcgaacctcccccacgtcgaaaccctcaccggcttcaagtggatcgcccgagtggagaacatccgctacggctacgaggaggccctcggctactgcgtcgacccggagggcgtccgcgacaaggacggcatcaccgcggccctcctgatcacggaactggcttccaccctcaagcaggccggccgcaccctcctcgacctcctcgacgacatcgccgtggaacacggcctgcacgccacggaccagctctcggtccgcgtggaggacctctccctcatcgccgcggcgatgcaccgcctgcgcgaacagcccccgtcgaccctcgcgggcctccccgtcaccaccgcggaggacctcacccggggcaccgacaccctcccgcccacggacggcctgcgctacacgctcgacggagccagggtcgtcgtccgcccgagcggcacggaacccaagctgaagtgctacctggaggtggtcgtcccggtcgccacgcccgccgacctcccgtcggcccggtcaaaggcgacggacctgctgacggcactgaagcgcgacctgtcgacggcggccggcatctga

SEQ ID NO: 12529 - protein, 549 aa, Streptomyces coelicolor A3(2)
MQDVQDDLLARARAWLAEDPDADTRAELARLIDAEDHAELTARFSGTLQFGTAGLRGELGAGPMRMNRSVVIRAAAGLAAYLKKQGHTDGLVVVGYDARHKSADFARDTAAVMTGAGLRAAVLPRPLPTPVLAFAIRHLGAVAGVEVTASHNPPRDNGYKVYLGDGSQIVPPADAGIAAGIDTVRTLHDVPRPDAGWQTLDDDVLDAYLTRTDAVLAPGSPRTARTVYTAMHGVGKDTLLAAFARAGFPRPALVTEQADPDPDFPTVAFPNPEEPGAMDLAFAKARETAPDLIVANDPDADRLAVAVPDAAEATGWRMLRGDEVGALLATHLVTRGAHGTFAESIVSSSLLARIAAKANLPHVETLTGFKWIARVENIRYGYEEALGYCVDPEGVRDKDGITAALLITELASTLKQAGRTLLDLLDDIAVEHGLHATDQLSVRVEDLSLIAAAMHRLREQPPSTLAGLPVTTAEDLTRGTDTLPPTDGLRYTLDGARVVVRPSGTEPKLKCYLEVVVPVATPADLPSARSKATDLLTALKRDLSTAAGI

SEQ ID NO: 12530 - DNA, 1695 bp, Streptococcus agalactiae 2603V/R
  CDS (1)..(1695): transl_table=11
atgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaataa

SEQ ID NO: 12531 - protein, 564 aa, Streptococcus agalactiae 2603V/R
MNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMITASHNPQAYNGYKAYWKEGSQILDDIADQIANHMDAITDYQQIKQIPFEEALASGSASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDKFGYYNERQFSLELEGAEGQERISRIMEDFRQDPILQVGEMTLENSIDFKDGYKDFPKQNCLKYYFNEGSWYALRPSGTEPKIKCYLYTIGCTEADSLSKLNAIESACRAKMNSTK

SEQ ID NO: 12532 - DNA, 1719 bp, Streptococcus agalactiae 2603V/R
  CDS (1)..(1719): transl_table=11
atgacttacacagaaaatcttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattggcaaaattaatcgaaactaagggagaggaagctaaaaaacgtggtgtagccattgcctatgattcacgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcatcgggccttattcaggttatcggtgaagatgttgatattgaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgtcaaatctcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttacggcgctacaatgtttaacgttttaactggatttaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggttattttgctgaaaaaacgatttcagtaacactttcaggtgtggatggagctgctgaaattaagaagattatggacaaattccgtgaaaatggtccaaaacaatttaacaatactgacattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacggtcggtaatgatttagcagatgcagaaacaaaaatcgccaatattgaaaaagagattacaacatttgtaaattaa

SEQ ID NO: 12533 - protein, 572 aa, Streptococcus agalactiae 2603V/R
MTYTENLQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDESKSSGLIQVIGEDVDIEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATVGNDLADAETKIANIEKEITTFVN

SEQ ID NO: 12534 - DNA, 1734 bp, Oceanobacillus iheyensis HTE831
  CDS (1)..(1734): transl_table=11
gtgcaaaactgggaaaaaatgtttgaaaagtggaatatgtttacagcgttagatgattctctgaaaataaatttaaataaactaaagaatgatagaagtgcgttggaagatgctttttatcaagaactatcttttggtacagcaggcatgcgagggattcttggagcaggaacaaatcggatgaacatttataccataagaaaagcagttaatggattggctgattatttgttaacgaactataatgatgcaaaaaatagagggattgtcattgcctatgattctcggtatatgtctaaagaatttgcaattgaatccgcgaaggtattaggatactacggtatacatacatatgtatttgaatcattgcgcccgactcctttgctatcatttgcagtccgacatctgaatactgtagcaggtattatgataaccgctagtcataatccgccagaatataatggatttaaagtttataatgaacatggagctcagattgtcccagctgaagcgaagttaattgtggaatccatacagcaaacaaaagacgaactaactgtaccgatattagaacaatcgcaagtcgaagaacaagagaagttaacctggttaaatgatgaagtagatcaagcttatttagaaagattatacgaaataactcaactttcattggaagataagcaaagtgaaaaggatatacagattgtatttacaccattacacggtactgctcttgatttagtaacaaaaggacttaagcaacttcaattctctaagattgcagtggtggaagaacaagctcaacccgatcctgagttttcaacagtagaatccccaaatccagaagaacatcaagcattttctaaagcaattaatttaggaaagcaaacaaatgcagatattttattaggtacagatccagatgcagatcgattaggtgtagcagtgaaaaattcagaaggtgaatatcaagtgctatctggaaatcaacttggtgtattgttatttgattatattgttaaacacatcgataagtctaaatctgtgaaacctcgtatgattaaaacagtggtaacgacagagttaggacgtgcgattgcagaagcaaatcaagtagagtcaattgatacgttaacgggctttaaatatattggagaaaaaataaatcattacgatacgacaggtgaaactttcttattcggatttgaagaaagctacggttatttaatcagtgattttgtacgtgataaagatgctgttcaggcggccatgatggccacggaaatggcatactattggaagcagcaaggaaaaacattatttgatgcattggatgtattatatgaaaaatatggctattatttagaaggaatgacttctttaaccttgaaagggcaagaaggttcacaacaaatggaggagatcttaacctctattagggagaaaccttttgctgagattggtggaatgaaggtaattgctatcgaggactattcttcttctgttcgtactttaacattagaggataagcaggaaactattattctgccaaaggaaaatatgattaagtatttgttagaagatgacggttgggtatgtttccgaccatctggtacagaaccgaaaatcaaatattattatggtgtacgtggaacaaacgcagaagatagtgagcagcgtttacttgggcttaaagaatcgttagaacagcgagttaatcgtattattgattaa

SEQ ID NO: 12535 - protein, 577 aa, Oceanobacillus iheyensis HTE831
MQNWEKMFEKWNMFTALDDSLKINLNKLKNDRSALEDAFYQELSFGTAGMRGILGAGTNRMNIYTIRKAVNGLADYLLTNYNDAKNRGIVIAYDSRYMSKEFAIESAKVLGYYGIHTYVFESLRPTPLLSFAVRHLNTVAGIMITASHNPPEYNGFKVYNEHGAQIVPAEAKLIVESIQQTKDELTVPILEQSQVEEQEKLTWLNDEVDQAYLERLYEITQLSLEDKQSEKDIQIVFTPLHGTALDLVTKGLKQLQFSKIAVVEEQAQPDPEFSTVESPNPEEHQAFSKAINLGKQTNADILLGTDPDADRLGVAVKNSEGEYQVLSGNQLGVLLFDYIVKHIDKSKSVKPRMIKTVVTTELGRAIAEANQVESIDTLTGFKYIGEKINHYDTTGETFLFGFEESYGYLISDFVRDKDAVQAAMMATEMAYYWKQQGKTLFDALDVLYEKYGYYLEGMTSLTLKGQEGSQQMEEILTSIREKPFAEIGGMKVIAIEDYSSSVRTLTLEDKQETIILPKENMIKYLLEDDGWVCFRPSGTEPKIKYYYGVRGTNAEDSEQRLLGLKESLEQRVNRIID

SEQ ID NO: 12536 - DNA, 1764 bp, Leptospira interrogans serovar Lai str. 56601
  CDS (1)..(1764): transl_table=11
atgaatcatctcgaatcttttattcttccttggactcaggagccttttccaaatacggttcgcaaagaagcaaatcttgcacttgaaaaattttctagaggagagtctggtccagaagtagaagcattttcaattcctctcgaatttggaaccggaggaatgcgtggaaagttaggcaacggaatcggaaggatgaacgaatttaccgttggtcgtgcagcacttggatttataagttatctttctaaaaaaaacaaaaaggcttctatcgtaatcgcctacgattctagaagaagatctaaagaatttgcggaagttaccgctgggattgcagcttacttaggagtcaaagttattctatttaaagaagtaactcccacaccgattctttcttatgcaattcgttattacaaagcaagcggaggtgtagtaattaccgcctctcacaatcctccagagtataacggttttaaggcgtatctttcagacggaggtcagcttgttcctccagacgatcaaaagatcatttcaaagatcgattcgattcaagattggaaacaaattccaattctttctacaaaagatccaatttacaaaaaaatggtaaaatttgccggaaaggattgttttacttcttacaaaaaagatctttctaaagctggaattctttctatttccctaaaaccaaaagatcgtactgctttgaaaatcgtttattctccgttacatggaactggtggaaaaagcatgcaagaactcttaaatagtttcggatataaaaacgtatttttagttccagaacaaaaagatccaaatggagaatttcctacggttaaatatccaaacccagaagaagcagaagcgatggaactttccaaaaaatttgcgatccaaaaaaacgcccacgcttttatcgcgaccgatccagacgcagatagacttggaatcggcgtcaaaaacgaaaacggagaatacgttttgtttaatggaaatcagatcggttccatcatggccgcttatttatgcgaagcttattccacgggtaaaaaaaagaaaaaggcagttttagtaaaaacgatcgttaccacagatttacaagagaacattgctaaaaaaaacaaggtaaaatataaaaacgtattaaccggattcaagttcattgcgcaagtgatggcaaaaattgataaaagtaaaaccgatttctttttattcggaggagaagaatcttttggttatcttccggtttcttttgtgagggataaggattcactttcttctgctttattacttttagaaattcttacagaaaaaaaagatcttttcaattatatggacgagatttatcttaaatacggtctttttcaagaaagtctcaaatcacttactttagaaggaagtgccggtaaagaaaaaatccgtaagtctttggaatctctacgaaccctagatttgttaggaaaaaaaattcatcatagaaaaattaccggaattctcgattataaaactcagatcgccaaaggaaacgcttccaaatccgcgttttctggttgtcctttatcggacgtgattcaagtcattttagaaggaaatgcaaaactcacaatccgaccttccggaacggaacctaagattaaaatttattcttcctttcaaagcctaaaagctcctaagtccaaagaagaaattaaaatacttaccaaagatcttctttctgaaatcaaaacttccgaagaaatatttttacaactggcggggctctcatga

SEQ ID NO: 12537 - protein, 587 aa, Leptospira interrogans serovar Lai str. 56601
MNHLESFILPWTQEPFPNTVRKEANLALEKFSRGESGPEVEAFSIPLEFGTGGMRGKLGNGIGRMNEFTVGRAALGFISYLSKKNKKASIVIAYDSRRRSKEFAEVTAGIAAYLGVKVILFKEVTPTPILSYAIRYYKASGGVVITASHNPPEYNGFKAYLSDGGQLVPPDDQKIISKIDSIQDWKQIPILSTKDPIYKKMVKFAGKDCFTSYKKDLSKAGILSISLKPKDRTALKIVYSPLHGTGGKSMQELLNSFGYKNVFLVPEQKDPNGEFPTVKYPNPEEAEAMELSKKFAIQKNAHAFIATDPDADRLGIGVKNENGEYVLFNGNQIGSIMAAYLCEAYSTGKKKKKAVLVKTIVTTDLQENIAKKNKVKYKNVLTGFKFIAQVMAKIDKSKTDFFLFGGEESFGYLPVSFVRDKDSLSSALLLLEILTEKKDLFNYMDEIYLKYGLFQESLKSLTLEGSAGKEKIRKSLESLRTLDLLGKKIHHRKITGILDYKTQIAKGNASKSAFSGCPLSDVIQVILEGNAKLTIRPSGTEPKIKIYSSFQSLKAPKSKEEIKILTKDLLSEIKTSEEIFLQLAGLS

SEQ ID NO: 12538 - DNA, 1722 bp, Shewanella oneidensis MR-1
  CDS (1)..(1722): transl_table=11
atgaatactcatctgcaattacaaattcagcattggcttaaaaatgatcccgatccaagtactcaagcccaattacaagcccttatcgacagcggtaatgaagccgaactcgcagcgcgttttgcgggacgtttagagtttggcaccgctgggttacgcggcgtggtgggcgcgggcccgatgggcatgaatcggctggtgatccgccaaacctcggctggacttggcgcctatctactggaacagatccatgatgtggccgaacgcggtgttgtgattggttacgatggtcgccatgactcatacacttttgcccatgataccgctagcgtactcaccgccatggggattaaggtgcgcttaaccgcaaaagtcgcaccaacgccgctggtggcatttggggtgaaacattttaatgctgctgcaggaattgtggtgaccgccagccataatccgcctcaatacaatggttataaagtgtattgggaaaatggcgcgcagattattccgccccatgactcaggcattgctgccaagattgagcaggcagcgactcaagctattccgtttatggaactggacgacgccatcaagcagggcaaactaatttggcttaatgatgattattatgaaacctaccgccgcggtgtaatgcatgccaaggtgctgcaaaatcataccgcgcctgaaaaagtcagccttgcctatactgccatgcacggcgttggcgccgatatggccgaaaccgtgctcaaggatgccggttttacccaagtgtattcggtggcggcgcagcgtgagcctgatggtgatttccctacggtgaatttccccaatccggaagaaaagggcgcgatggatttagtcattgccgaggcgaaaaagcatagcgctatgctggcttgtgccaatgaccccgatgccgatagatttgctgttgccgtgcgcaaggatgatggcgaatatcaaatgctaacgggtgaccaagtgggcgtactctttggccattatctcctgagtcatgcaagtgcagatcaacgcctcgtaggtacgaccattgtttcttccagcttgttatctaaaattgctaacggttttggtgtggagagttataccacgctcaccggttttaaatggttaatgaatgtggggattgcccaaagtcagccagataaccaattcctgtttgcctacgaagaagccctaggttacaccgtcggtaacatggtgtgggataaagacggtctatcggctttagtcgcttttgcccaattaacggcagaactcgcggccaaagggcaaacgatttgggataggcttgagcagatttaccgcgagcagggattccatctcaatgcgcaggcgagcatcgccttaaaacctgaaacgcccaatattggtgcctatttacgtgaacatccgccactgacaattggtgagcatgccgtggtgtcgaccgatgatctcaaggcgctatcgcgtcgctttgccgatggcaaagtagagaacatcaatctgcctgccagtgatgtgttaacttatcgcttatccaatggcgcgcgggtgattgtgcggccatccggcacagagcccaaaatcaagtgttactacgaggttgtagagcctatgacagcgcaagataccttagccacggcgcaagcgagagcgactcaggcgatggaggcgtttatctcagcccatcaggcgagtttgcctaagtaa

SEQ ID NO: 12539 - protein, 573 aa, Shewanella oneidensis MR-1
MNTHLQLQIQHWLKNDPDPSTQAQLQALIDSGNEAELAARFAGRLEFGTAGLRGVVGAGPMGMNRLVIRQTSAGLGAYLLEQIHDVAERGVVIGYDGRHDSYTFAHDTASVLTAMGIKVRLTAKVAPTPLVAFGVKHFNAAAGIVVTASHNPPQYNGYKVYWENGAQIIPPHDSGIAAKIEQAATQAIPFMELDDAIKQGKLIWLNDDYYETYRRGVMHAKVLQNHTAPEKVSLAYTAMHGVGADMAETVLKDAGFTQVYSVAAQREPDGDFPTVNFPNPEEKGAMDLVIAEAKKHSAMLACANDPDADRFAVAVRKDDGEYQMLTGDQVGVLFGHYLLSHASADQRLVGTTIVSSSLLSKIANGFGVESYTTLTGFKWLMNVGIAQSQPDNQFLFAYEEALGYTVGNMVWDKDGLSALVAFAQLTAELAAKGQTIWDRLEQIYREQGFHLNAQASIALKPETPNIGAYLREHPPLTIGEHAVVSTDDLKALSRRFADGKVENINLPASDVLTYRLSNGARVIVRPSGTEPKIKCYYEVVEPMTAQDTLATAQARATQAMEAFISAHQASLPK

SEQ ID NO: 12540 - DNA, 1716 bp, Streptococcus mutans UA159
  CDS (1)..(1716): transl_table=11
atggtatatcaagaaaattatcaaaaatggttagcttatgctaaacttcccgactatcttcatcaagaattattagcaatggatgaaaagaccaaggaagatgctttctatactaatcttgagtttggtacagcgggcatgcgtggttatattggcgctggaactaatcggatcaatatttacgtcgttcgtcaagcaactgaaggacttgcccaattgattgaaaccaaaggagacgacgtcaaaaaacgcggtgttgctattgcttacgattcccgtcatttctctcaagaattcgcctttgaatctgctcaggttttagcaaaacacggtattaaagcttatgtctttgaatctcttcgtccaactccagagttatcatttactgtacgccatttaggaacttttgcgggtattatggtaacagccagtcataaccctgcaccatttaatggttacaaagtttatggtgaagatgggggacaaatgcctccttttgatgcggatgctctaacagattttattcgtgccattaatgatccattttcaattgaattagctgatttagaagaaagcaaagcttctggattaattgaagttatcggtgaagctgttgatactgactacctcaaagaagttaaagatgtcaatatcaaccaaaaattgattgacgagtacggtaaagacatgaaaattgtctacaccccgcttcatggtactggtgaaatgctggctcgtcgtgctttggcacaagctggtttcgattctgttcaagtggttgaagctcaagcagtgccagaccctgatttttcaaccgttaaatcaccaaatccagaaaatcaagaggcttttcgtttggctgaagaattaggacgtcaggttgatgctgatgttctcgttgcaaccgatccagatgcggatcgtcttggcgttgaaattcgccaagctgatggatcttataagaatctttctggcaatcaaatcggtgctatcatcgctaagtacattcttgaagcgcacaaaacggctggaagtttacctactaatgctgctctttgtaaatcaattgtatcaactgaattagttagcaaaattgctgaaagttatggcgcaactatgtttaatgtcttgactggtttcaaattcattgctgaaaagattcaagaattcgaagaaaaacacaaccacacttacatgttcggctttgaagaaagctttggttaccttattaaaccttttgttcgtgataaagacgctattcaagctgtgttgattgttgctgaaatcgcagcctactatcgctcacgcggtttaacacttgctgatggcattgatgaaatttacaaagaatacggctacttcgctgaaaaaaccatttcagttactctgtcaggtgttgatggcgctacagagattaagaaaatcatggataaattccgtggtgatgctccgaaacaatttaacgcaacagatgtcgttaaattagaagacttccaagctcaaactgctacaactgctgatggtattgaaaaattaacgactcctccaagcaatgttcttaaatatatcctatcagatgcgtcttggattgctgtccgtccttcaggtaccgagccgaaaatcaaattctacatcgcaactgttggtaataattcagaagatgcgcaagttaaaattgctaatatcgaaaaagaaatcaatgatttcgtcggatag

SEQ ID NO: 12541 - protein, 571 aa, Streptococcus mutans UA159
MVYQENYQKWLAYAKLPDYLHQELLAMDEKTKEDAFYTNLEFGTAGMRGYIGAGTNRINIYVVRQATEGLAQLIETKGDDVKKRGVAIAYDSRHFSQEFAFESAQVLAKHGIKAYVFESLRPTPELSFTVRHLGTFAGIMVTASHNPAPFNGYKVYGEDGGQMPPFDADALTDFIRAINDPFSIELADLEESKASGLIEVIGEAVDTDYLKEVKDVNINQKLIDEYGKDMKIVYTPLHGTGEMLARRALAQAGFDSVQVVEAQAVPDPDFSTVKSPNPENQEAFRLAEELGRQVDADVLVATDPDADRLGVEIRQADGSYKNLSGNQIGAIIAKYILEAHKTAGSLPTNAALCKSIVSTELVSKIAESYGATMFNVLTGFKFIAEKIQEFEEKHNHTYMFGFEESFGYLIKPFVRDKDAIQAVLIVAEIAAYYRSRGLTLADGIDEIYKEYGYFAEKTISVTLSGVDGATEIKKIMDKFRGDAPKQFNATDVVKLEDFQAQTATTADGIEKLTTPPSNVLKYILSDASWIAVRPSGTEPKIKFYIATVGNNSEDAQVKIANIEKEINDFVG

SEQ ID NO: 12542 - DNA, 1695 bp, Streptococcus agalactiae NEM316
  CDS (1)..(1695): transl_table=11
atgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatggttactgctagtcataatcctcaagcttataatggttataaggcatattggaaagaaggatctcagattttagatgatattgctgatcaaattgccaatcatatggatgctataaccgattatcagcaaattaggcaaataccctttgaagaggctctggcaagtggtttggcaagttatattgatgagagtattgaagaagcatataaaaaagaagtgcttggtttaaccattaatgatactaacattgataagtcagtccgagtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaaccggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgatgaatttggctattacaacgagcgccaattttctcttgagttagagggtgctgaggggcaagaacgtattagtcgtattatggaggattttagacaggacccaatattacaagtaggtgagatgagattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaataa

SEQ ID NO: 12543 - protein, 564 aa, Streptococcus agalactiae NEM316
MNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMVTASHNPQAYNGYKAYWKEGSQILDDIADQIANHMDAITDYQQIRQIPFEEALASGLASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDEFGYYNERQFSLELEGAEGQERISRIMEDFRQDPILQVGEMRLENSIDFKDGYKDFPKQNCLKYYFNEGSWYALRPSGTEPKIKCYLYTIGCTEADSLSKLNAIESACRAKMNSTK

SEQ ID NO: 12544 - DNA, 1719 bp, Streptococcus agalactiae NEM316
  CDS (1)..(1719): transl_table=11
atgacttacacagaaaattttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattggcaaaattaatcgaaactaagggagaggaagctaaaaaacgtggtgtagctatcgcttatgattcgcgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctacggacaagacggaggtcaactaccaccagctgatgctgatgcactaacagactttatccgtgctattgaaaatccatttgcagttgaacttgctgatttagatgaaagcaaatcagcgggtcttattcaagttatcggtgaagatgttgatattgaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgtcaaatctcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttatggcgctacaatgtttaacgttttaactggatttaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagattgcagcttattaccgttcgcgtggtttaacacttgcagatggtattgatgaaatttacaaagaatatggttattttgctgaaaaaacgatttcagtaacactttcaggagtggatggagctgctgaaattaagaagattatggacaaattccgtgaaaatggtccaaaacaatttaacaatactgatattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgctacggtcggtaatgatttagcagatgcagaaacaaaaatcgccaatattgaaaaagagattacaacatttgtaaattaa

SEQ ID NO: 12545 - protein, 572 aa, Streptococcus agalactiae NEM316
MTYTENFQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDESKSAGLIQVIGEDVDIEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATVGNDLADAETKIANIEKEITTFVN

SEQ ID NO: 12546 - DNA, 1668 bp, Corynebacterium efficiens YS-314
  CDS (1)..(1668): transl_table=11
atgtcccgcaatacccgcatagcggtagagtcaagtctagtagcgaatccaaccctattgaggatcggggtgttcatggacgagtcccgtcagctctccttcggcacggcaggcatgcgggcgccggtgggtcccgctgcgcatcagatgaatgttctccaggtcacacgcaccaccgcgggtgtcgccagctggttggccgcacgggctgcggaacgtcgggtgccccacctcgtgcctgaggatgaggccggtatcgggcgtgccctgtacccgcaggacggtcccctgcgggtggtggtcggttatgacgcccgctatggttcccacaccttcgccgccaccaccgcggaggtgttcgccggtgccgggttcgaggtgatgctgctgcccaccccgggccccaccccgctgatcccctggttggtgcagaaccggcggatggatgccggtgtccagatcaccgcatcacacaatggtgccgcggacaacggttacaaggtgttcctggccaacgggcggcagctgtattcggagatggaggccgatctggagtcacatatccaggcggtggaggatccggtgcaggccccccgggtgaccgtgcgcccggccggggatcagctgcgccggtacatcgatgagatcgtctccctggtcacccccgggcaggcggatctgttgcgggtgaattcggaacgggcgaatctgcgcatcgtctacaccgccctgcacggggtgggtggtcgggcgatgtcgaatgccttccagttcgccgggttccccctggcccatccggtgcgtgaacaacagcacccggacccgaccttcccgacggtgccgtttcccaatccggaggaaccctcggcgattgaactgctgctggcccgggcggcggaggaggatgcggatatcctgttcgccctcgacccggacgccgaccggtgtgcggtgggtatccgcacccccgacggtggccaccggatgctgacaggtgatgagaccggcacgctgctggccacgcgcatcgtgcccgaatgggacgggcggggggctccaccggtcgtggcgaccacggtggtcagctcccagctgctgcgcgtgatcgctgaggacagggggtgggattaccaggagaccctgaccggtttcaaacacctctcccgcgcggcggatgaccgaccgggccgactggccttcgcctatgaggaggcggtgggcacgtgcccggcaccggatatcgtcccggacaaggacgggatcgccacggcgctgttcaccgcggcgtgggcagccgagctcaagtccgccggcgtcagtctgcaggaccggctcgacgagctctaccgtcgccacgggtacttcgcgtccacgcaggtcgcggtccgcaccaccagccccagggagcttgtcgacgcctggtgcaccacacccccgaccgaactgatcggtgtggcactggacagttccgccctcccggagaaccagggcgtggtgctcagggggtatctcggcggcacccagctgcgggtgattgtccgggtctccggcacggaggcgaaggcaaagatctacatcgagatcgcccaggccaactcccatgcggaggccacccagctgctggagaaactccaggacgaggtggaggactggggtcggagtctctaa

SEQ ID NO: 12547 - protein, 555 aa, Corynebacterium efficiens YS-314
MSRNTRIAVESSLVANPTLLRIGVFMDESRQLSFGTAGMRAPVGPAAHQMNVLQVTRTTAGVASWLAARAAERRVPHLVPEDEAGIGRALYPQDGPLRVVVGYDARYGSHTFAATTAEVFAGAGFEVMLLPTPGPTPLIPWLVQNRRMDAGVQITASHNGAADNGYKVFLANGRQLYSEMEADLESHIQAVEDPVQAPRVTVRPAGDQLRRYIDEIVSLVTPGQADLLRVNSERANLRIVYTALHGVGGRAMSNAFQFAGFPLAHPVREQQHPDPTFPTVPFPNPEEPSAIELLLARAAEEDADILFALDPDADRCAVGIRTPDGGHRMLTGDETGTLLATRIVPEWDGRGAPPVVATTVVSSQLLRVIAEDRGWDYQETLTGFKHLSRAADDRPGRLAFAYEEAVGTCPAPDIVPDKDGIATALFTAAWAAELKSAGVSLQDRLDELYRRHGYFASTQVAVRTTSPRELVDAWCTTPPTELIGVALDSSALPENQGVVLRGYLGGTQLRVIVRVSGTEAKAKIYIEIAQANSHAEATQLLEKLQDEVEDWGRSL

SEQ ID NO: 12548 - DNA, 1707 bp, Vibrio vulnificus CMCP6
  CDS (1)..(1707): transl_table=11
atgctaaaacaagtcactgactggttggccagagatccggatccacgcacccgtgaagaacttcagtacctcattgatgagaagatgacggaagaattgcaagaccgttttcgcggcaggcttgaatttggtaccgccggattacgtggaaaagtcggttcgggaccaaatcgcatgaacagacttgtaattcaagaaaccgcgacaggactcggacattatctcatcgagacgattcgtgatgccgctgctcgtggcgtggtgattggctatgatggccgaaccgattcgaagcaatttgctcacgacacggccgctgtactcaccgccttgggcattaaggtttacctcacccataaagtggccccaaccccagtggttgcgtttggtgtcaaacagtttaatgccgcagcagcggtagtggttaccgcaagccacaacccaccggaatacaacggctttaaagtgtattgggaaaatggcgcgcaaatcattccacctcatgatgcgggtattgccgccgagattgagcaagcgacgcacaaacctatccctctcatgtcattgagtgatgcggaaaaacacggccttttggtttggctcaaagaggattactaccaaacgtatcgccaagcgatgaacactcacccattgttaaaatctggccatgcggttgatatttccatcgcgtacaccgctatgcatggtgtcggcgctgagatggctgagacactgctggccgatgccggtttcactcacgtgctgagcgtacctgaacaacgggagcctgatggcacgttcccgacggtcaacttccctaacccagaagaagctggggcgatggatatggtgatgaatctagcaaaaaccgtcgatgcagagattgcctgtgccaatgaccctgatgccgaccgctttgccgttgctgttcgcaaaccggatggtaactaccaaatgctcacaggagatcaagtgggcgcgttattcgccaattatctcctcagcagcgtggatgccagcaagcagttggttggtaacaccattgtctcttcccgcttgttggctgacatcgccaaacagcacggagctcactactaccaaacgctcacgggctttaagtggctcaccaatgtagccatgactcagcaaagcgatgacaagcagttcttgtttgcgtatgaggaagcgctgggctacaccgtgggcaataaagtttgggataaagacggtttgtcagcactggtcgcgtttgcccagctcacggcacatcttaaagaaaatggcctgactttgtgggacaaattagagcaactttatcgccaacatggcttctattttaacgcgcagcgcagtattgccttatcgcctgattcgccacccatcggggaccagctgagagccaaaccgccgaaaaccattgcagggcagaaggtaacggtgattgaagatctcaaagcgtcgttgcgatacgtgaccaatggcgtgacagaagcgattaacctgccggccagcgatgttctgatctatcaccttgaagatcgctcacgcgttatcgttcgcccttcaggcactgagccgaaactaaagtgctactacgaggtgattagcgatttccctgctgagttggattaccaaaccgcacagtttaaggccgagagcaaaatgaacgcgcttattgctgcccatcaacaaagcttgtcatcgtaa

SEQ ID NO: 12549 - protein, 568 aa, Vibrio vulnificus CMCP6
MLKQVTDWLARDPDPRTREELQYLIDEKMTEELQDRFRGRLEFGTAGLRGKVGSGPNRMNRLVIQETATGLGHYLIETIRDAAARGVVIGYDGRTDSKQFAHDTAAVLTALGIKVYLTHKVAPTPVVAFGVKQFNAAAAVVVTASHNPPEYNGFKVYWENGAQIIPPHDAGIAAEIEQATHKPIPLMSLSDAEKHGLLVWLKEDYYQTYRQAMNTHPLLKSGHAVDISIAYTAMHGVGAEMAETLLADAGFTHVLSVPEQREPDGTFPTVNFPNPEEAGAMDMVMNLAKTVDAEIACANDPDADRFAVAVRKPDGNYQMLTGDQVGALFANYLLSSVDASKQLVGNTIVSSRLLADIAKQHGAHYYQTLTGFKWLTNVAMTQQSDDKQFLFAYEEALGYTVGNKVWDKDGLSALVAFAQLTAHLKENGLTLWDKLEQLYRQHGFYFNAQRSIALSPDSPPIGDQLRAKPPKTIAGQKVTVIEDLKASLRYVTNGVTEAINLPASDVLIYHLEDRSRVIVRPSGTEPKLKCYYEVISDFPAELDYQTAQFKAESKMNALIAAHQQSLSS

SEQ ID NO: 12550 - DNA, 1722 bp, Clostridium tetani E88
  CDS (1)..(1722): transl_table=11
atgaattatatgagaatttataatgagtggttaaataacgattactttgatgatgttacaaaagaagaattaaaaagtataaaagataatcctaaggaaatagaagatagattttataaaaatttagagtttggaacagcaggacttagaggtaaaattgcagctggtacaaatagaatgaataaatatataatagctaaagtaactcaaggacttgcaaattttatagcaaaacaaggtaaagaggtaatgaataggggggtagctatagcctatgattgtaggcattattcagatgtgtttgcaaaaactgcagcattagttttggctgcaaatggaattaaagcatatttatttgaagatttaagaccaacaccagagttatcctatacagtaaggagattaaatacaatatctggaatagtagtaacagctagtcataaccctaaagattataatggatataaagtgtactgggaagatggagcacaaatattagataagatagccaaacctgttacagaagagataaataacattaaaaattttaaagaaataaagtccatatctgaagaagaagctttagaaaaaggtcttttagagatattaggaaaagaaatagatgatgaatatatagaaaaagttaaggctttatctataagaaatgatatagataaggacataaaaatagtttacacaccattaaatggaacgggaaatattccagtaagaagagttctaagggaaagaagatttaccaatgtaatagttgtgccagaacaggaaaatccagatccagattttaccacagtaggttatccaaatccagaggatataaaagcctttgaatatgctaaaagattaggagagaaagaaagagcagatttattattagcaacagatcctgattgtgacagactagcagtaatggctagaaataatcgtggagaatttgtggcgttaaatggtaatcaaacaggagctgttttaataaaatatcttgtggaaagtaaagtagaaaagggaactttacctgagaaaccaatgatagtaaaatcagtagttactggtgacatgggtaaagttgtaggagaaaaatatggtgttactacctttgaatctcttacaggatttaaaaatatttgtggtaaagaaatggaaatgaataaaaaaggatataattttatttttggatatgaagaaagcataggctatacagctggggactttgttaaagataaagatggagttatttcagcaatgtttttatgtgaggcagcggcttattataaaacacaaggtaaaactttaatagatgtgttaaatgacatgtataatgaatttggatattatagggaaaatttaatttcacttatattagaaggtgttgaaggacaaagaagaataggaagaatgatggaagcatataggaatgaatttcctaaaattataggagataataaacttataaagtatatagacatagataaaggaaaagaaattgattttataactagggaagaaaaatcagtagaatttcctaaatcaaatgtacttaaatttatattagaagatggatcatggtatgctattagaccatcgggtacagaacccaaaataaaaatatacttatattctaaagggcatactttaaaagattcagaagataagttgaaaatcatggaaaagactattatggaaaaacttaattccgtagaataa

SEQ ID NO: 12551 - protein, 573 aa, Clostridium tetani E88
MNYMRIYNEWLNNDYFDDVTKEELKSIKDNPKEIEDRFYKNLEFGTAGLRGKIAAGTNRMNKYIIAKVTQGLANFIAKQGKEVMNRGVAIAYDCRHYSDVFAKTAALVLAANGIKAYLFEDLRPTPELSYTVRRLNTISGIVVTASHNPKDYNGYKVYWEDGAQILDKIAKPVTEEINNIKNFKEIKSISEEEALEKGLLEILGKEIDDEYIEKVKALSIRNDIDKDIKIVYTPLNGTGNIPVRRVLRERRFTNVIVVPEQENPDPDFTTVGYPNPEDIKAFEYAKRLGEKERADLLLATDPDCDRLAVMARNNRGEFVALNGNQTGAVLIKYLVESKVEKGTLPEKPMIVKSVVTGDMGKVVGEKYGVTTFESLTGFKNICGKEMEMNKKGYNFIFGYEESIGYTAGDFVKDKDGVISAMFLCEAAAYYKTQGKTLIDVLNDMYNEFGYYRENLISLILEGVEGQRRIGRMMEAYRNEFPKIIGDNKLIKYIDIDKGKEIDFITREEKSVEFPKSNVLKFILEDGSWYAIRPSGTEPKIKIYLYSKGHTLKDSEDKLKIMEKTIMEKLNSVE

SEQ ID NO: 12552 - DNA, 1728 bp, Lactobacillus plantarum WCFS1
  CDS (1)..(1728): transl_table=11
gtgagttggcaggatacttataatacctggaaaaaccaagcgacacttgaaactagtttaaaacaagaattgacgggcatggctggcgatgacgccgccttagaagacgccttttatgaaccaatggaattcggaaccgcggggatgcggggggtacttggacctggtatcaaccggatgaatatttatacggttcgtcaagcaacggaagggttagcacgcttcatggataccttgcctgctgaggttaaggaacgcggggtagcaatcagttttgattcccgccatcattcagaagattttgcgcatgaatctgcgcgagtattgggccaacatggtatcaagtcatacgtttttgaaagcttgcggccaaccccagaactttcatttaccgttcggcatctgcatacttacgcagggatcatgattacggcgagccataatccgaagcaatataatggctacaagatttatggcgaagatggtggtcaaatgccacctaaggaatctgatcttatcacatcatatattcgtaaagttgacgatgtctttgcgattgccgttgctgatgaacaacaattattagctgataagacggaaaccattattggggatgatgtcgatcaggactacttagctaaggtcaaagaagtgacgatcaatcaaaaactagtggatgaagtcggtaaggacatgaagttagtcttcacaccattacatgggactggccggatgcttggcgaaaaggctttgaagaatgccgggtttaaaaacttcagtgttgttaaggaacaagctgtggctgaccctgaattctcgacggttaaattccctaatcctgaatttcctgaagcctttaagatggccattgatttgggtaaaaaagaaggtgcggatgtcttgattgcggttgatcctgatgctgaccggttagggacagctgttcgtcaacctaatggtgagtatgttctgttgacgggtaatcaaattgccgctgtcttgttacactacatcttgcaagcaaacaaggatgccgggacgttaccgaccaatgcggccgcagttaagtcaattgtttcaagtgaatttgctactaaagtagcggcttcatatggtgtcacgatgatcaatgtcttgaccggtttcaagtatattgctgaacaaatcgaacattttgaagccactggcgaacatacctatatgtttggttttgaagaaagttacggttacttaatcaaaccatttgttcatgacaaggatgcgattcaaaccacagtgcttttagccgaagtagcggcttattataagcaacaaggtaagaacctttatgatggattacaagacttgtttaaggaatacggttacttccgcgagcaaaccacgtccgaagaatttgatggcgttggcggcagcgataagattgcggctctgatgactaagttccgaagcgaagcaccaactgcctttgccggctacgatgtcactgggactgaagacttccagagtcaaacggaaagctttgctgatggccacacggcaccaattgctttgccaaaggcgaatgtcttgaagtatcatttaaatgatggcacttggatcgccattcggccatctggtacggaaccaaagatcaagttctacattggaacgctaggtagtacgttagaagaagctaatgataagttagcgaaatttgaagatgccattcaagcgtttattaaagaataa

SEQ ID NO: 12553 - protein, 575 aa, Lactobacillus plantarum WCFS1
MSWQDTYNTWKNQATLETSLKQELTGMAGDDAALEDAFYEPMEFGTAGMRGVLGPGINRMNIYTVRQATEGLARFMDTLPAEVKERGVAISFDSRHHSEDFAHESARVLGQHGIKSYVFESLRPTPELSFTVRHLHTYAGIMITASHNPKQYNGYKIYGEDGGQMPPKESDLITSYIRKVDDVFAIAVADEQQLLADKTETIIGDDVDQDYLAKVKEVTINQKLVDEVGKDMKLVFTPLHGTGRMLGEKALKNAGFKNFSVVKEQAVADPEFSTVKFPNPEFPEAFKMAIDLGKKEGADVLIAVDPDADRLGTAVRQPNGEYVLLTGNQIAAVLLHYILQANKDAGTLPTNAAAVKSIVSSEFATKVAASYGVTMINVLTGFKYIAEQIEHFEATGEHTYMFGFEESYGYLIKPFVHDKDAIQTTVLLAEVAAYYKQQGKNLYDGLQDLFKEYGYFREQTTSEEFDGVGGSDKIAALMTKFRSEAPTAFAGYDVTGTEDFQSQTESFADGHTAPIALPKANVLKYHLNDGTWIAIRPSGTEPKIKFYIGTLGSTLEEANDKLAKFEDAIQAFIKE

SEQ ID NO: 12554 - DNA, 1653 bp, Tropheryma whipplei TW08/27
  CDS (1)..(1653): transl_table=11
atgaatattctgcggaaggcaagcttgtggattgagaatgatccggtggcgatcacacgcttggaaatgcgcagacttctggctgaaagtgaaaaaactggtgacgtgcgtgagctcgaagagaggctgtctaagacgctggagttcggaactgcaggactaagggcaccgcagggtgctggatttaatcgcgtgaatgccgtcgtgacggcgcaggctgcaaatgcactgtctcaatttcttttagaagaaaaccggggcagaacgctggttattggctatgacggaagatacaattcacagctctgggcaagaaatactgcgcggattgctagcagttacgatataacagctctgattatgccaagggctctaccaacaccccttttggcatttgcagtgcggcagcttggtgctgctgcgggggttatggtaaccgcctcccataatccccgcgaatacaacgggtacaaagtgtatctcggaggagaagacaagggtgcacaaatacctgatactgcagcggcaaaaattgccaaaaatttgagagatgaagtcgcgtatagcgatataccaatgaaagatagttacggaattcttgatgaggagattatcgaggcctacctgtcccgtacagcaaaagcaattaagcgacagtttggctcaccaaaggctgatctaaagatatgccacacagctatgcatggtgttggtcacgagatctttgtacgcctcatggaaaaattgggtttccacaacctggtgttcgttgaagagcaaaaaatgccagacccggcatttccaaccttgccgtttccaaacccagaagaaaagggtgcattggatttagcatttgaaacagcacggcttgcagagtgtgacataatcattgctaatgaccccgatgccgatcgggttgcagttgcacatccggatggaaaggtttttactggtaatgaaataggcgccctacttggtgttgaaattgcgcgcatgcaacgcggtcacggggtactgtcaaacagcatggtttcttcaccgataatgcgccgtatagctgagacctacggaatgcaacatgtggagacgccaaccggatttaaatgggttgcgcgtgtgccagatatctgttttggttttgaagaggccttggggtacatgattcatccagagcttgtaagggacaaagatggcctatcggccggcgccgccattgccaccatagctgcctctcaaaaggcccaaggtcgaagcctcagagattgtctagatgacctgcaaagcaagcttgggtattttaggagcacccagtatgccgttcgcatggcatcacttgatagtgtgcaggctgttatgcaaaaccttagagcagaatcgctgaacaaaattggtcgatttagagtaacaaaatatcgtgatctactgttcgggagcccgccggtggatctgcttgagtttaatctgggacaagatattgatgatctgtttgggcgactaatagttaggccaagtggaacggaattaaaactaaagtgttacatagacagtgttgctaagacgcccgatggcgccgagcagcttctgtcggagctaacttatgcctgcaaaaacctcttatgcgaaacaagccgccgtggtggcgcagaaaactag

SEQ ID NO: 12555 - protein, 550 aa, Tropheryma whipplei TW08/27
MNILRKASLWIENDPVAITRLEMRRLLAESEKTGDVRELEERLSKTLEFGTAGLRAPQGAGFNRVNAVVTAQAANALSQFLLEENRGRTLVIGYDGRYNSQLWARNTARIASSYDITALIMPRALPTPLLAFAVRQLGAAAGVMVTASHNPREYNGYKVYLGGEDKGAQIPDTAAAKIAKNLRDEVAYSDIPMKDSYGILDEEIIEAYLSRTAKAIKRQFGSPKADLKICHTAMHGVGHEIFVRLMEKLGFHNLVFVEEQKMPDPAFPTLPFPNPEEKGALDLAFETARLAECDIIIANDPDADRVAVAHPDGKVFTGNEIGALLGVEIARMQRGHGVLSNSMVSSPIMRRIAETYGMQHVETPTGFKWVARVPDICFGFEEALGYMIHPELVRDKDGLSAGAAIATIAASQKAQGRSLRDCLDDLQSKLGYFRSTQYAVRMASLDSVQAVMQNLRAESLNKIGRFRVTKYRDLLFGSPPVDLLEFNLGQDIDDLFGRLIVRPSGTELKLKCYIDSVAKTPDGAEQLLSELTYACKNLLCETSRRGGAEN

SEQ ID NO: 12556 - DNA, 1695 bp, Vibrio parahaemolyticus RIMD 2210633
  CDS (1)..(1695): transl_table=11
atgacagcactaattactcaatggctagcgcgagatcctgaccctaaaactcgtgaagagcttcagcacctcgttgatacgaataatgaacaagaactttctgaccgcttcggctcccgtcttgcctttggtaccgcgggtctacgtggcaaagtgggcgcaggtccaaaccgaatgaaccgtttggtgattcaagaaactgccacaggtctcggccactatttgcttgaacaagtgcaagatgcagcgagccgaggcgttgttattggttacgatggccgaccagattctaaacagttcgcgcacgatactgcttctgtcttaacagcactcggtatcaaggtttacctaacctaccaagttgcggcaacgcctattgttgcttttggtgtacgcacaatgaatgctgcagcggccgttgttgtaaccgctagccacaatccacccgaatacaacggcttcaaagtgtattgggaaaatggcgcgcaaatcattccacctcacgactcgggcatcgcggcaaaaattgatgaagcgaccacaaagcctctgccgttgatgtctttagacgatgctaaacaacaaggcttactggtttggttggaagatgactactaccaaacttaccgtaaaaccatgaacgaaaatgctctgctgactcctgatagcaacaccgatatttctatcgcttacactgcgatgcacggtgttggcgcagacatggcagaaacgttacttgctgacgctggctttaaaaaagtggccagtgttgcggagcagcgcgaacctgatggcacattccctacagttaacttcccaaatccagaagaagcaggggcaatggacatggtcatggcgctcggtaaatccgtagatgcggatatcgcctgtgcaaacgacccagatgcagaccgtttcgccgtcgccgtaaaacgcccagacggtgaataccaaatgttaactggcgaccaagttggttcattgtttggtgattacttgctagagcaacagccgaactcactggtcggtaacaccatcgtgtcatctcgcctcttgagcagcatcgcaaaagcgcatggcgcagagtattaccaaacgctaacaggctttaaatggctaaccaacgtcgcgatgagccaagaaaccgagcaacatccgttcttgtttgcttacgaagaggcgctcggctacaccgttggcaacaaggtgtgggataaagatggtttgtccgcgattgttgcgttttctcaattaaccggaaaactcaaagcacaaggcaaaacactgtgggacaagttggaagcgctttaccgtcaacacggtttttactttaacgctcagcgtagtattgcgttggacccaaactcaccaccaattggtgacaagctacgtgcaaatccaccgagcgaaattgcaggcaagaaagtatcagttactgaggacttgaaaacttccgttcgtacatttgaggatggctcagaagagacgattgatttaccagcaagtgatgtactgatttatcatcttgaagataaatctcgcgtaattgttcgtccttctggtactgagcctaagttgaaatgttactacgaagtcatcagtgacttccctgctgacatgagctacgagcaagcgcaacaagctgcggaagccaaaatgaacgcgctgatcgacgcacaccaaaaaagcttgtaa

SEQ ID NO: 12557 - protein, 564 aa, Vibrio parahaemolyticus RIMD 2210633
MTALITQWLARDPDPKTREELQHLVDTNNEQELSDRFGSRLAFGTAGLRGKVGAGPNRMNRLVIQETATGLGHYLLEQVQDAASRGVVIGYDGRPDSKQFAHDTASVLTALGIKVYLTYQVAATPIVAFGVRTMNAAAAVVVTASHNPPEYNGFKVYWENGAQIIPPHDSGIAAKIDEATTKPLPLMSLDDAKQQGLLVWLEDDYYQTYRKTMNENALLTPDSNTDISIAYTAMHGVGADMAETLLADAGFKKVASVAEQREPDGTFPTVNFPNPEEAGAMDMVMALGKSVDADIACANDPDADRFAVAVKRPDGEYQMLTGDQVGSLFGDYLLEQQPNSLVGNTIVSSRLLSSIAKAHGAEYYQTLTGFKWLTNVAMSQETEQHPFLFAYEEALGYTVGNKVWDKDGLSAIVAFSQLTGKLKAQGKTLWDKLEALYRQHGFYFNAQRSIALDPNSPPIGDKLRANPPSEIAGKKVSVTEDLKTSVRTFEDGSEETIDLPASDVLIYHLEDKSRVIVRPSGTEPKLKCYYEVISDFPADMSYEQAQQAAEAKMNALIDAHQKSL

SEQ ID NO: 12558 - DNA, 1695 bp, Streptococcus pyogenes SSI-1
  CDS (1)..(1695): transl_table=11
atgacttacaacgaggtatatcaagaatggttgcacaataatgatcttagtgatgatattaaagcagatttagcagccataaaagacaatgaggctgagattcaagatcgtttttacaaaacacttgaatttggaacagcagggctaagaggaaaacttggagcaggcaccaatcgcatgaatacctatatggttggtaaggcagcacaagctttagctaatactattattgatcatggacctgaagcggttaaaaagggcattgcggttagttatgatgttcgctatcaatctagaacatttgcagaattaacatgctctattatggcagctaacggtattaaggcgtacctttataaagggattcggccaacaccaatgtgttcgtacgctattcgtgctttgggatgtatctctggtgttatgattacggctagtcacaatccccaagcttacaatggttacaaagcttattggcaagaaggttctcaaattttggatgacattgcggatcaaattgcacaacacatggctgcactaactcagtatgaggaaatcaaacaaatgccttttgaaaaggctctggacagtggacttgttacttatattgatgagagtattgaagaagcatataaaaaagaagtgcttggtttaacgattaatgatactgacattgataagtcagtccgagtagtctatacccctttaaatggtgttgggaatctaccagtgcgtgaggttttaagacgccgcggttttgaaaatgtttatgtggtacctgagcaggaaatgcccgatcctgattttacaacagttggctatcctaatcccgaagtccctaaaacttttgcatattcagaaaaattaggtaaggcagttgatgctgatattttgattgcaactgatccagattgtgaccgtgtggctttagaagttaaaaatgcagtcggtgactatgtttttctcaatggcaataaaatcggagcgcttttatcttactatatcttttcgcaacgatttgacttaggcaatttaccggctaatcctgttttagtgaaatccattgtaacaggagacttgtcacgggctattgctagccattatggtattgaaaccgttgaaacattgactggttttaagaatatttgtggcaaggcaaacgaatatgatgtgacgaaacagaaaaactacctgtttggttatgaagaaagtattggtttttgctatggcacttttgttcgtgacaaagacgctgttagcgcctctatgatgattgtagaaatggcagcttactacaagaaaaagggacagaatttactagatgttttgcagactatttatgcgacatttgggtattataatgaacgtcaaattgccttggagcttgaggggatagaaggacaaaaacgcattgcgaggataatggaagatttcagacagacaccaatagctagtgttgcagagatggcgttagacaagacaattgattttattgatggctatcaagattttccaaagcaaaactgtctcaaattttatttggatgatggttcttggtatgcacttagaccatcaggaacagagcctaaaataaaattttatttatatactattggccaaacacaagaaaatagtgcaacaaaattagatgctattgaagcagcatgtcgcacaaaaataaatcaggttaattaa

SEQ ID NO: 12559 - protein, 564 aa, Streptococcus pyogenes SSI-1
MTYNEVYQEWLHNNDLSDDIKADLAAIKDNEAEIQDRFYKTLEFGTAGLRGKLGAGTNRMNTYMVGKAAQALANTIIDHGPEAVKKGIAVSYDVRYQSRTFAELTCSIMAANGIKAYLYKGIRPTPMCSYAIRALGCISGVMITASHNPQAYNGYKAYWQEGSQILDDIADQIAQHMAALTQYEEIKQMPFEKALDSGLVTYIDESIEEAYKKEVLGLTINDTDIDKSVRVVYTPLNGVGNLPVREVLRRRGFENVYVVPEQEMPDPDFTTVGYPNPEVPKTFAYSEKLGKAVDADILIATDPDCDRVALEVKNAVGDYVFLNGNKIGALLSYYIFSQRFDLGNLPANPVLVKSIVTGDLSRAIASHYGIETVETLTGFKNICGKANEYDVTKQKNYLFGYEESIGFCYGTFVRDKDAVSASMMIVEMAAYYKKKGQNLLDVLQTIYATFGYYNERQIALELEGIEGQKRIARIMEDFRQTPIASVAEMALDKTIDFIDGYQDFPKQNCLKFYLDDGSWYALRPSGTEPKIKFYLYTIGQTQENSATKLDAIEAACRTKINQVN

SEQ ID NO: 12560 - DNA, 1719 bp, Streptococcus pyogenes SSI-1
  CDS (1)..(1719): transl_table=11
atgacttacacagaaaattttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattagcaaaattaatcgaaactaagggagaggaagctaaaaaacgtggtgtagccatcgcttatgattcgcgccacttctctccagaatttgcttttgaatctgcacaggtcttggcacagcatggaattaaatcttacgtatttgaaactcttcgtccaacaccagaactttcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcagcaggtcttattcaagttatcggtgaagatgttgatatggaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtagaatcacaagctaaggcagatccagacttttctactgttaaatcgcctaaccctgaaagccaagctgcctttgctcttgctgaagaactcggacgagaagttgatgcagatgtcttagtagctaccgatcctgatgcagaccgcctaggcgttgaaattcgccaaccagatggttcttataaaaatctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttatggcgctacaatgtttaacgttttaactggattcaaattcatcgctgagaaaattcaagagtttgaagaaaaacataaccacacctatatgtttggttttgaagaaagcttcggatatcttattaaaccatttgtccgtgataaagacgctattcaagcagttcttttggttgctgagatcgcagcttattaccgttcgcgtggtttaacacttgcagatggtattgatgaaatttacaaagaatatggctattttgctgaaaaaacgatttcagtaacactttcaggtgtggatggagctgctgaaattaagaagattatgaacaaattccgtgaaaatggtccaaaacaatttaacaatactgatattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacaataggtgatactcttgacatcgctcaagaaaaaattgctaacattgaaacagaaatcaatacctttgttggctaa

SEQ ID NO: 12561 - protein, 572 aa, Streptococcus pyogenes SSI-1
MTYTENFQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFETLRPTPELSFAVRHLNAYAGIMVTASHNPAPFNGYKVYGQDGGQLPPADADALTDFIRAIENPFAVELADLDESKSAGLIQVIGEDVDMEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMNKFRENGPKQFNNTDIVLLEDFQKQTATKNDGTISNLTTPPSNVLKYTLADDSWIAVRPSGTEPKIKFYIATIGDTLDIAQEKIANIETEINTFVG

SEQ ID NO: 12562 - DNA, 1746 bp, Bacteroides thetaiotaomicron VPI-5482
  CDS (1)..(1746): transl_table=11
atggaaaatcaggaacttatcaagcaggtcactgagaaagccgaaaaatggctgaccccggcttatgatgccgaaactcaggctgaagtgaaacgcatgttggagaacgaagataaaaccgaattgatcgaagcattctacaaagatcttgaatttggaacgggtggtttgcgtggtatcatgggagtaggtagcaaccgcatgaatatctatacggtaggtgctgctacacagggcctttccaactatctgaagaagaacttcaaagatctgcctcagatttctgtagtggttggtcacgactgtcgtaacaacagccgtctgttcgctgaaacttcagccaacattttctcagctaatggcatcaaagtatatctgtttgatgatatgcgtccgactccggagatgtctttcgcaatccgtcacctcggttgccagagcggtattatcctgactgcttctcacaatccgaaagaatacaacggttacaaagcatactgggatgatggtgcgcaagtactggctccgcacgatgctggtatcattgatgaagtgaataatatcgcttccgctgctgatatcaagttcaaggggaacccggatctgattcagatcatcggtgaagatattgacaagatttacctcgatatggtgaagacagtttctattgatccggaagctatcgcccgtcataaggatatgaagatcgtttatactccgattcacggtacaggtatgatgttgattccgcgcgctttgaagatgtggggattcgaaaatgtatttactgttcccgaacagatgatcaaagacggtaacttcccgacagtaatatctccgaatccggaaaatgccgaagcgctttctatggctgtcaatctggctaaagaaattgatgccgatcttgtgatggcttccgatccggatgccgaccgtgtaggtatcgcctgcaaggacgacaagggagaatgggtactgatcaacggtaaccagacttgtatgatgtatctttactatattctgactcagtacaaacaattgggtaagatcaagggtaatgagttctgtgtgaagactatcgttactaccgaacttatcaagaagattgctgataagaataacatcgaaatgctcgactgctacaccggattcaagtggatcgcacgtgaaatccgtctgcgtgaaggcaaaaagaaatatatcggtggtggtgaagagagttacggcttccttgccgaagacttcgtacgtgataaagatgccgtatcagcttgctgtctgattgcagaagtagctgcatgggcaaaagataacggtaagtcattgtaccagttgttgctggatatctacgtagaatatggattctccaaagaattcacagtgaacgtagtgaaaccgggcaagagcggtgctgaagaaatcaaagctatgatggaaaacttccgtgctaatcctccgaaagaactgggtggctccaaggtgattttgagcaaagactataagacgctgaaacagacagatgcagaaggcaaggtgactgaccttgatatgccggaaacatctaatgtgctccaatacttcactgaagatggaagcaaagtttcagttcgcccgtcgggaacagaaccgaagatcaaattctatatggaagtacaaggagaaatgggttgtcgcaactgtttcgcttctgctgatgctgctgcaatggaaaagattgaagcagtgaagaagtcattaggtatttga

SEQ ID NO: 12563 - protein, 581 aa, Bacteroides thetaiotaomicron VPI-5482
MENQELIKQVTEKAEKWLTPAYDAETQAEVKRMLENEDKTELIEAFYKDLEFGTGGLRGIMGVGSNRMNIYTVGAATQGLSNYLKKNFKDLPQISVVVGHDCRNNSRLFAETSANIFSANGIKVYLFDDMRPTPEMSFAIRHLGCQSGIILTASHNPKEYNGYKAYWDDGAQVLAPHDAGIIDEVNNIASAADIKFKGNPDLIQIIGEDIDKIYLDMVKTVSIDPEAIARHKDMKIVYTPIHGTGMMLIPRALKMWGFENVFTVPEQMIKDGNFPTVISPNPENAEALSMAVNLAKEIDADLVMASDPDADRVGIACKDDKGEWVLINGNQTCMMYLYYILTQYKQLGKIKGNEFCVKTIVTTELIKKIADKNNIEMLDCYTGFKWIAREIRLREGKKKYIGGGEESYGFLAEDFVRDKDAVSACCLIAEVAAWAKDNGKSLYQLLLDIYVEYGFSKEFTVNVVKPGKSGAEEIKAMMENFRANPPKELGGSKVILSKDYKTLKQTDAEGKVTDLDMPETSNVLQYFTEDGSKVSVRPSGTEPKIKFYMEVQGEMGCRNCFASADAAAMEKIEAVKKSLGI

SEQ ID NO: 12564 - DNA, 1725 bp, Enterococcus faecalis V583
  CDS (1)..(1725): transl_table=11
atgtcttgggaacaagtttaccaacaatggttagatgaagaaaatattccagaaaatttaaaaaatgaattaaaggacttaaatacagaccctgaaaaatgtgaagatgcattttacgcaccattagaatttgggactgccgggatgcgtgggattttaggcgccggtattaatcggatgaatatctttacggttcgtcaagcaacagaaggacttgcacgttttatggatacgcaagatcctgaaacaaaacgtcgcggtgtagctattgcctatgattcacgtcatatgtctccagaatttgcaatggaagcagctaaaacattagctaaacatgatattccttcttttgtgtttgaaagcttacgaccaacaccagaattatcttttgcggtccgctactttaaagcttttgcgggaatcatgattacggcttctcacaatccagctgcctataatggctacaaagtctatggtgaagacggtggtcaaatgccgccagctgatgcagatgcattaactaaatatgttcgtagtatcgaaaatcctttgaaaattgatgtcttatcagatgaagaagttgcccacagcggtttaattaacattgttggtgaagaagtcgataacgcgtatttgaaagaaattaaaacagttacgattaatcaagaattaattaacgaaatgggtaaagaattaaaattagtttacactcccttacatggaactgggaaaatgttaggagaaaaggcattaaaacaagccggttttgaaaaatttgttttagtacctgagcaagccgttgctgatcctgactttactacagttaagtcaccaaaccctgaagaacattcagcttttgaatacgcgattcgtttaggggaaaaagaaggcgctgatttattgattgcaacagatccagatgctgatcgtttaggtgctgctgtgcggatgccaaacggagactaccaagtattaacaggaaatcaattaggttcaattatgattcattatattttagaagcccatcaacaagcaggcacgttacctcaaaatgctgcggttctaaaatcaatcgtttctagtgaacttgctacagcgattgctgagaaatgtaatacgaagatgtttaatgttttaacaggtttcaaatttattgctgaaaaaattcaacaatacgaagaagaccacagtcaaacgtttatgtttggttttgaagaaagttatggttacttagtgaaaccttttgttcgtgataaagatgcaattcaagcgttagttttattagcagaagtagcggctttctataaaaaacaaggaaaaacattatacgatggtttacaagatatctttgaagaatttggttactttgaagaaaaaactatttccgtaacaatgagcggaattgaaggcagcggtaaaatcaaagctttaatggcaaaatgtcgtgaacaagcgccaactgagtttgccgggattcaagttgctcaaacggaagattttaaagaattaacacgcacttttgcagatggtcaaacagaacaattacaaacgcctccttctgatgtgttgaaatatcatttagaagatggcagttggattgctatccgaccatcaggaacagaaccaaaaattaaattctatctagcgacaaaagcaacaagtagttcagaagcttctgaaaaaattgctgcgtttgaagcagtcgttaatgaattaacaaaataa

SEQ ID NO: 12565 - protein, 574 aa, Enterococcus faecalis V583
MSWEQVYQQWLDEENIPENLKNELKDLNTDPEKCEDAFYAPLEFGTAGMRGILGAGINRMNIFTVRQATEGLARFMDTQDPETKRRGVAIAYDSRHMSPEFAMEAAKTLAKHDIPSFVFESLRPTPELSFAVRYFKAFAGIMITASHNPAAYNGYKVYGEDGGQMPPADADALTKYVRSIENPLKIDVLSDEEVAHSGLINIVGEEVDNAYLKEIKTVTINQELINEMGKELKLVYTPLHGTGKMLGEKALKQAGFEKFVLVPEQAVADPDFTTVKSPNPEEHSAFEYAIRLGEKEGADLLIATDPDADRLGAAVRMPNGDYQVLTGNQLGSIMIHYILEAHQQAGTLPQNAAVLKSIVSSELATAIAEKCNTKMFNVLTGFKFIAEKIQQYEEDHSQTFMFGFEESYGYLVKPFVRDKDAIQALVLLAEVAAFYKKQGKTLYDGLQDIFEEFGYFEEKTISVTMSGIEGSGKIKALMAKCREQAPTEFAGIQVAQTEDFKELTRTFADGQTEQLQTPPSDVLKYHLEDGSWIAIRPSGTEPKIKFYLATKATSSSEASEKIAAFEAVVNELTK

SEQ ID NO: 12566 - DNA, 1632 bp, Streptomyces avermitilis MA-4680
  CDS (1)..(1632): transl_table=11
gtgcacgacgaactcatcgcacgggccaaggcgtggctggccgaggaccccgacgcggagacacgtgaggaactcgccaagctcatcgacgccgaggacgtcaccgagctcgccgcgcgcttcagcggcaccctccagttcggcaccgccgggctccgcggtgagctcggcgccggtcccatgcggatgaaccgcgccgtcgtgatccgtgccgccgccggcctcgccgcgtacctcaaggccaagggcgagcagggcggcctcgtcgtcatcggctacgacgcccgccacaagtccgccgacttcgcccgcgacaccgccgcggtcatgaccggcgcgggcctgcgcgcggcggtcctcccccgcccgctccccacgccggtcctcgcgtacgccataaggcacctgggcgccgtggccggcgtggaggtcaccgccagccacaacccgccgcgcgacaacggctacaaggtctacctcggcgacggctcccagatcgtccccccggcggacgcggagatcgccgcggagatcgacgccgtccgcgccctcgccgacgtcccccgcccggactccggctgggagacgctcgacgacagcgtcctgaacgcctacctggcgcgcaccgacgccgtactggccgagggctccccccgcaccgcccgcaccgtctacacggcgatgcacggcgtcggcaaggacgtcctcctcgccgccttcgcccgggccggcttcccggagcccgtcctcgtcgccgaacaggccgagccggatccggacttcccgaccgtcgccttccccaacccggaagagcccggcgcgatggatctcgccttcgcgaaggcccgtgagaccgaccccgacctgatcatcgccaacgacccggacgcggaccgctgcgccgtcgcggtcaagggcggcaccgactggcgcatgctccgcggcgacgaggtcggcgcgctgctcgcccagcacctggtcagccggggcgcgcgcgggacgttcgccgagtcgatcgtctcctcctccctgctcggccggatcgccgagaaggcgggcgtgccgtacgaggagaccctcaccggcttcaagtggatcgcccgcgtcgagggtctgcgctacggctacgaggaggcgctcggctactgcgtcgaccccgagggcgtacgcgacaaggacggcatcacggcggcgctcctgatcacggagctcgcctccgagctcaaggagcggggccgcacccttgtcgacttcctcgacgacatcgccgtggagcacggcctgcacgccacggaccagctctcggtccgggtggaggacctctccgtgatcgcgaacgcgatgcggcgcctgcgcgagcagccgccgacgcggctcgcgggcctggcgatcacccggtccgaggacctgaccaagggcacggaccggctgccgccgacggacggtctgcgctacacgctggacggcgcccgcgtcatcgtccgccccagcggtacggagccgaagctgaagtgctacctggaggtggtggtgccggtgggcacccgccaggacctccccgcggcccgcaccaaggccacgaacctcctggagacgatcaagcgggacctctccgaggcagcgggcatctga

SEQ ID NO: 12567 - protein, 543 aa, Streptomyces avermitilis MA-4680
MHDELIARAKAWLAEDPDAETREELAKLIDAEDVTELAARFSGTLQFGTAGLRGELGAGPMRMNRAVVIRAAAGLAAYLKAKGEQGGLVVIGYDARHKSADFARDTAAVMTGAGLRAAVLPRPLPTPVLAYAIRHLGAVAGVEVTASHNPPRDNGYKVYLGDGSQIVPPADAEIAAEIDAVRALADVPRPDSGWETLDDSVLNAYLARTDAVLAEGSPRTARTVYTAMHGVGKDVLLAAFARAGFPEPVLVAEQAEPDPDFPTVAFPNPEEPGAMDLAFAKARETDPDLIIANDPDADRCAVAVKGGTDWRMLRGDEVGALLAQHLVSRGARGTFAESIVSSSLLGRIAEKAGVPYEETLTGFKWIARVEGLRYGYEEALGYCVDPEGVRDKDGITAALLITELASELKERGRTLVDFLDDIAVEHGLHATDQLSVRVEDLSVIANAMRRLREQPPTRLAGLAITRSEDLTKGTDRLPPTDGLRYTLDGARVIVRPSGTEPKLKCYLEVVVPVGTRQDLPAARTKATNLLETIKRDLSEAAGI

SEQ ID NO: 12568 - DNA, 1803 bp, Chlamydophila caviae GPIC
  CDS (1)..(1803): transl_table=11
atgaagcatcttcaacagaaaatagaaactctttgtaaccctataacagcgaagaatatcttaacctggttgtctagtgattttggtcagaatgatcgggaaacgatagccgagcttctagaaaacaatccgcagcatctcgaagagctatttggaaaaactcttgcatttggtaccggaggattgcgtagtcctatgggattaggtaccaatagaatcaatgttttcacagtgcgacgtgctacgcagggcttggctcaagtattaaaaaaacacaatccgcatcccggagatcctattcgggtggtcattggttatgatactcgacactgttcttttgattttgctcaggaaactgccaaagttttcgcggggaataaaatccatgcacttatatttaaggatcccgaacctttagccctcgtttcttttactttacgatctcaagaggctttagccggggtgatgattacggcttcccataatcctccagagtataatggatataaagtctatatggcctcaggagggcaagtgctacctcctttagatcaggaaattattcaagcctcagcaaatgtcgaagaaattttagtcgttgattctttaaaagatccctatatccatctcataggggaggaatacgaggctttatacacagaaaccgtgcggcaactacagctctatcctgaagataatcgtatttccggacaggcaattcacgtaagctattctccactccatggaactggggtcaccatgatccctcgagttttaagagattggaatttccccatggtgaagcttgttgaaaaacaagcacttcccgatgggaatttccccacagtgcatttgcctaatcctgaagatccggaagccctgactttgggaattgagcaaatgataaagaatcaagacgatatttttatagctacagaccctgatgctgatcgtttgggtgtggtttgtttggatgagaatcaaccttatatatttaacggaaatcaaatcgcttgtttgcttgcagatcatattttacgtgcatggtcggctcaagcccctttagggaaggaagacaaggtggttaaaagtttggtaactacagaaatgctctcggcaatcacagagtcttatggtggtgatatcataaatgtagggacgggatttaagtacattggcgagaaaatagaagcttggagaggccaattagaaaggtatgtatttggtgcagaagagtcctacggttatctctacggtacacatgtagaagataaagatgcgattagcacatcagcattaattacagaggctgctttaaagcaaaaactccaagggaaaactcttcgagaggctattttagatttatatgagactcatggatatttcatgaataaaacgctttccctatcctttgagcctggtcaggaaagtttcatgaaatcacaaatagagaagttggcagttcttgatccctcgaccatgtccttaacagggtatcctgtggcagcatttgaaaattatcgccaggggataggcatcaatattgcttcgggaactacatataaactgcatcttccgaagatgttcatgttgtgctactactatcaaaatggaggaaagatcatcgtgcgtccttcaggaacagaacctaaaataaaattgtattttgagcttgtgaatcattacgatgtggtagcaaaaaagaaagaagagcgtatccaaagagaacaagaaagtcagaaaaaattagaggattttatttctgaatttaaagagaagttctcttctttaaagcctgaataa

SEQ ID NO: 12569 - protein, 600 aa, Chlamydophila caviae GPIC
MKHLQQKIETLCNPITAKNILTWLSSDFGQNDRETIAELLENNPQHLEELFGKTLAFGTGGLRSPMGLGTNRINVFTVRRATQGLAQVLKKHNPHPGDPIRVVIGYDTRHCSFDFAQETAKVFAGNKIHALIFKDPEPLALVSFTLRSQEALAGVMITASHNPPEYNGYKVYMASGGQVLPPLDQEIIQASANVEEILVVDSLKDPYIHLIGEEYEALYTETVRQLQLYPEDNRISGQAIHVSYSPLHGTGVTMIPRVLRDWNFPMVKLVEKQALPDGNFPTVHLPNPEDPEALTLGIEQMIKNQDDIFIATDPDADRLGVVCLDENQPYIFNGNQIACLLADHILRAWSAQAPLGKEDKVVKSLVTTEMLSAITESYGGDIINVGTGFKYIGEKIEAWRGQLERYVFGAEESYGYLYGTHVEDKDAISTSALITEAALKQKLQGKTLREAILDLYETHGYFMNKTLSLSFEPGQESFMKSQIEKLAVLDPSTMSLTGYPVAAFENYRQGIGINIASGTTYKLHLPKMFMLCYYYQNGGKIIVRPSGTEPKIKLYFELVNHYDVVAKKKEERIQREQESQKKLEDFISEFKEKFSSLKPE

SEQ ID NO: 12570 - DNA, 1725 bp, Bacillus cereus ATCC 14579
  CDS (1)..(1725): transl_table=11
atgaattggaaacaagaatttagtcgctggctttcttacgcacaattagatgcagaattaaaagaacagctagaaaatatgaagcaagatgagaagaaaatcgaggatagcttttataaaaatctagagtttggcacaggtggtatgcgtggtgaacttggtgctggtacgaaccgtttaaacgtatatacagttcgtaaagcaacaaaaggattagcaagctttattgaaaaattaggtgaggaagcgaaaaaacgcggtgttgttgtagcctatgattctcgtcataaatcacctgagtttgcaatggaagttgctgctacacttggggcacgcggtatcacaacatatgtgtttgaaagcttacgtccaacgccagtactttctttcgcagttcgtcatttacatacagtaagtggaatcgttcttacggcaagccataatccgcctgaatataacggatacaaagtatacggtgaagatggtggacagttacctccaaaagaggcagatgagttaattagctacgtaaatgcagtagaagatgaattaacagttgaagtcgctgatgtagagcaattaaaagctgacggtttattacatattattggacaagaagtagatgatgcatatgctgcagaattgaacaatgtcatcattaataaagaaatggtgcaaaaggtcggcaaagacttaaaaatcgtctttacaccattgcacggaacatcaaatatttctgtacgccgtggtttaaaagaagttggatttacagatgtaacagttgtaaaagagcaagagttaccagatccaaacttctctacagtaaaatcaccgaacccagaagagcacgcagcgtttgagtatgccattcgtgatggtgaaaaggtaggtgcagatgtattaatcgcaactgatcctgacgcagatcgtctaggtgtagcagtgcgtaatcataatggtgagttccaagtattaacaggaaaccaaacaggtgcattaatgcttgattacttactatctcaaaagaaagaaaacggaacgcttccagagaacggtgtcgtattaaaaacaatcgtaacgtctgaaattggtcgtacaattgcaaaagcatacggtttagatacaattgatacgttaactggatttaaatttatcggtgagaaaattagacagtatgaagaaagtggacaatatgaattccaattcggttatgaggaaagctatggttatttaatccgcccattctgccgtgataaagatgcagtacaatctgttctatttgcatgtgaagtagctgcatactataaatcacaagggaaaacgttatatgacggtctattagaagtatttgagaagtacggtttcttccgtgaagaccttgtatcgttaacgttaaaaggaaaagatggagctgaaaaaatccaagagatgatggcaacgttccgtgagaatccgccgaaagaagtagctggcttaacagtcgtagcagtggaagactataaagcaagcatcgttacatctttacaagatggacataaagaagagattcacttaccgaaatcaaatgtgttaaaatatcaattagaggatggttcatggttctgcctacgtccatctggaactgagccgaagattaagttttactttggtgtaaaagatagttctttacaaaatagtgaacaaaagttacttactattaaagaagacattatgaatcgtttataa

SEQ ID NO: 12571 - protein, 574 aa, Bacillus cereus ATCC 14579
MNWKQEFSRWLSYAQLDAELKEQLENMKQDEKKIEDSFYKNLEFGTGGMRGELGAGTNRLNVYTVRKATKGLASFIEKLGEEAKKRGVVVAYDSRHKSPEFAMEVAATLGARGITTYVFESLRPTPVLSFAVRHLHTVSGIVLTASHNPPEYNGYKVYGEDGGQLPPKEADELISYVNAVEDELTVEVADVEQLKADGLLHIIGQEVDDAYAAELNNVIINKEMVQKVGKDLKIVFTPLHGTSNISVRRGLKEVGFTDVTVVKEQELPDPNFSTVKSPNPEEHAAFEYAIRDGEKVGADVLIATDPDADRLGVAVRNHNGEFQVLTGNQTGALMLDYLLSQKKENGTLPENGVVLKTIVTSEIGRTIAKAYGLDTIDTLTGFKFIGEKIRQYEESGQYEFQFGYEESYGYLIRPFCRDKDAVQSVLFACEVAAYYKSQGKTLYDGLLEVFEKYGFFREDLVSLTLKGKDGAEKIQEMMATFRENPPKEVAGLTVVAVEDYKASIVTSLQDGHKEEIHLPKSNVLKYQLEDGSWFCLRPSGTEPKIKFYFGVKDSSLQNSEQKLLTIKEDIMNRL

SEQ ID NO: 12572 - DNA, 1605 bp, Mycobacterium bovis AF2122/97
  CDS (1)..(1605): transl_table=11
gtgacgccagagaattggatcgcccacgacccggacccgcagacggccgccgagctcgccgcctgcggccccgacgagctgaaagcgcggttcagccgcccactggcgttcggcaccgcggggttgcgcgggcacctgcggggcgggccggacgcgatgaacctggcggtggtgttgcgcgccacctgggcggtggcacgggtgctcacggatcgaggtctggctggttcgccggtgatcgtggggcgcgacgctcggcacggctcaccggcgtttgccgctgcggccgccgaagtgcttgccgccgcaggtttttccgtgctgcttctgcccgatcccgcacccaccccggtggtggcgttcgcggtgcggcacaccggcgccgccgctgggatacagatcacggcgtcacacaacccggcgaccgacaacggctacaaggtctatgtcgacggcggccttcagctcctcgcccctaccgaccggcagatcgaagccgcgatggccaccgcgcccccggccgatcagatcgccaggaagaccgtcaaccccagtgaaaaccgcgcctccgatctgatcgaccgttatatccagcgtgcggccggggtccgaaggtgcgccggttcggtccgggtggccctgacgccgctgcacggggttggcggggcgatggccgtcgagacccttcggcgagccggtttcaccgaggtgcataccgtggcgacgcaattcgcgccgaatcccgacttccccaccgtgacattgccgaaccccgaggagcccggagccaccgacgcactgctcaccctggctaccgacgtggacgccgacgtcgcgatcgcgctggatcccgatgcggatcgctgcgcggtcgggatacccacggtgtcgggatggcggatgctgtccggtgacgaaaccggttggctactaggtgattacatcttgtcgcaaaccgacgaccgggcgtcgccgccggaaaccagggtggtggccagcaccgtggtgtcgtcgcggatgctggcggcgatcgccgcgcatcacgctgccgtgcacgtggagaccctcaccggctttaagtggctggcgcgcgccgatgcgaacctgcccggcaccctggtgtacgcctacgaggaagcgatcgggcactgcgtcgaccccaccgcggtgcgtgacaaagacggcatcagcgccgcggtgttggtgtgcgatctggtggccgcgctcaaaggccagggtcgttcggtgaccgacgcgctcgacgagctcgcccgatgctacggcgtgcatgaggttgccgccctgtcacgccccgtgggcggcgccgtcgagaccaccgacctgatgcgacggctccgcgaggacccgccgcgtcggctggccggtttccccgccacggtcaccgatatcggcgacacgctgatcctcaccggcggcgacgacaacatgttggtcagggtggcggtgcggccttctggaacagaaccgaagctgaagtgctacttggagattcgctgcgcggtgaccggtgacctaccagctgcccgacagctggtgcgggcgaggatcgatgagctgtcggctagcgtgcggcggtggtggtga

SEQ ID NO: 12573 - protein, 534 aa, Mycobacterium bovis AF2122/97
MTPENWIAHDPDPQTAAELAACGPDELKARFSRPLAFGTAGLRGHLRGGPDAMNLAVVLRATWAVARVLTDRGLAGSPVIVGRDARHGSPAFAAAAAEVLAAAGFSVLLLPDPAPTPVVAFAVRHTGAAAGIQITASHNPATDNGYKVYVDGGLQLLAPTDRQIEAAMATAPPADQIARKTVNPSENRASDLIDRYIQRAAGVRRCAGSVRVALTPLHGVGGAMAVETLRRAGFTEVHTVATQFAPNPDFPTVTLPNPEEPGATDALLTLATDVDADVAIALDPDADRCAVGIPTVSGWRMLSGDETGWLLGDYILSQTDDRASPPETRVVASTVVSSRMLAAIAAHHAAVHVETLTGFKWLARADANLPGTLVYAYEEAIGHCVDPTAVRDKDGISAAVLVCDLVAALKGQGRSVTDALDELARCYGVHEVAALSRPVGGAVETTDLMRRLREDPPRRLAGFPATVTDIGDTLILTGGDDNMLVRVAVRPSGTEPKLKCYLEIRCAVTGDLPAARQLVRARIDELSASVRRWW

SEQ ID NO: 12574 - DNA, 1851 bp, Rhodopirellula baltica SH 1
  CDS (1)..(1851): transl_table=11
atgacttctggttccaaacctgtttcgtccccatccatgaccgtcgacgaagccttggccgcaatcgatcaagcttgccaagaaaagaaactgaccgctggagccgttgaaaacattcgatcttggttgaccgaagatcgttaccgcgattatcgcgaccaaaccattcaacacatcgccgatggcatgtggcaaaaattggatgacgttttttggacgattatccccttcggtaccggaggacgtcgcggccggatgtacgaaatcggatccaacgcgatcaatgaccgaacgatcggcgaaagtgcacaaggtttggcggactacgtggttcagtatcacggcggtgccaagcaactctcatgtgcgatcgcctacgacacgcgtcacaaatctcgtcacttcaccgagctgtgtgccggcatcatggtcgccgccggtttcaaggtttatctgctggatgattaccgcgcgacgccacagttgtcatttgccgtgcgtcatttgaactgcgattgcggaatcatggtgacggccagtcacaacccgccgagtgacaatgcggtgaaggtctattggtccacgggcggtcaagttttgcctccgcacgacaaagcaatcattgacggcgtgatgagctgccaagaaattcgtgcgactcctttcgcggaagcaatggccgatggacgtatcgaagtggtcactgaccaaatcgatgcggctttcattgacgccgcgtcacagtgtgcattcgaaggttcgcgtgatgtcaaagttctttactcgccactgcacggtgtcggcgaagaagccgttgttccgttgatgaagcgagacggttttacgcagctggacgtctacgaagggcaccgtgaaaaaagtggagacttcccgaatgttcccgggcatgtttccaaccccgagaacgcggctgttttcgaagctcccatcgaaacggcgcgtgcaggcggatatgacctggttttggcaaccgatcccgattgcgatcggttgggcgtggccgctccgctgacgaccgatcccagcggcgaatgggggacgttcaccggaaaccagatcgcagcattgctggccgcctatgtgctggagcaaacggtgaagtcaggcaaactgaccgaacgttcctacgtcatcaagaccttggtcaccaccgaattggttcgccggatcgccgagtcgcacggtgcacgctgcgttggtgatctgttggtcggatacaaatacatcgctgaggcgatggaccgcgaaggtcccgaagatttcgtgtatggatgtgaggaatcacacggctacctcgtcggcacgtacgcacgcgacaaagatggcgcggtcgcttgcatgttgatgggtgagctggcggcgaagttgaaagccgaaggcaagtcgatgcacgagtacatggcgggcttgtacagcaaacacggtttgcatcgtgagaatttgatcaacgtgttcatggaaggcagcgaagggatggctgcgatgcaaggcttgatgaaagctttccgagccgagccaccaaaatcgctgggcggaatcgcggtctctcaagtgcgagactacggcagtgcaacgatcctgaatgtggccgaaggatccacttcaccgctggaaggtccaagtggaaacttggtgatcatggatttggagatggacggcaactacgtcgctgttcgccccagtggcaccgagcccaaagtgaaattctatgtgttcacccgcttggaagccgccgagtcgcaggacgcgagtgcggcggacatcaaactgtccgatcgcttgcgtgccatcgaagaagacgtccgcgacttcgcccgcctgcactcgtga

SEQ ID NO: 12575 - protein, 616 aa, Rhodopirellula baltica SH 1
MTSGSKPVSSPSMTVDEALAAIDQACQEKKLTAGAVENIRSWLTEDRYRDYRDQTIQHIADGMWQKLDDVFWTIIPFGTGGRRGRMYEIGSNAINDRTIGESAQGLADYVVQYHGGAKQLSCAIAYDTRHKSRHFTELCAGIMVAAGFKVYLLDDYRATPQLSFAVRHLNCDCGIMVTASHNPPSDNAVKVYWSTGGQVLPPHDKAIIDGVMSCQEIRATPFAEAMADGRIEVVTDQIDAAFIDAASQCAFEGSRDVKVLYSPLHGVGEEAVVPLMKRDGFTQLDVYEGHREKSGDFPNVPGHVSNPENAAVFEAPIETARAGGYDLVLATDPDCDRLGVAAPLTTDPSGEWGTFTGNQIAALLAAYVLEQTVKSGKLTERSYVIKTLVTTELVRRIAESHGARCVGDLLVGYKYIAEAMDREGPEDFVYGCEESHGYLVGTYARDKDGAVACMLMGELAAKLKAEGKSMHEYMAGLYSKHGLHRENLINVFMEGSEGMAAMQGLMKAFRAEPPKSLGGIAVSQVRDYGSATILNVAEGSTSPLEGPSGNLVIMDLEMDGNYVAVRPSGTEPKVKFYVFTRLEAAESQDASAADIKLSDRLRAIEEDVRDFARLHS

SEQ ID NO: 12576 - DNA, 1662 bp, Haemophilus ducreyi 35000HP
  CDS (1)..(1662): transl_table=11
atgactaccatttttaccattgctcaacattggttagcacaagatccagatctagaaactcaaaacgaattatcccatttaatagataacgcaaaagcgggtggtaaacaagccttaaaagaattaaccgcgcgttttggaggacgcttgcaatttggtacagcaggattacgtggccctttacaagcaggaccaatgggaatgaaccgagtattagtggcacaagcggcagccggcttagcactatatctcaaaacctatgataaacagccatcaattgttattggatatgacgggcgcaaaaattcagatgtttttgcccgcgatactgcagaaattatggctggagtgggtattaaagcttatttattgccacgcaaattaccaacacccgtcttagcttacgcaattaaacatcttgacaccaccgcaggcgtaatggttacagcaagccataacccgccagaagataatggttataaagtttacttaggcaaagcaaatggcggtggacaaattgtttcgccagccgaccaacaaattgccgcattcattgatcaagtcgcaacgggcaacatccgtgaattagcacgcagtcaagacttcaacttactagatgacgaagtaataaatgcatatatcgaaaaaacggcccgcttaagccaagagaacaaaatggctctcaactatgtttatacggcaatgcacggcgtagggtatgaagtattacagaaaacactcaaacaagcgggtttatctcaacccaaattagtcagcgaacaaattgagccggatggcaattttcccaccgtcagcttcccaaacccagaagaaaaaggcgcactagatttagccatcaaattagcacaacaagaaaacgcagaatttattattgccaacgatccagacgcagaccgtttagctgttgctattcctgatgcacaaggaatctggaaaagtttgcacggcaatgtattaggttgcttattaggatggcatttagccaaaaaataccacgcacaaggtcaacaaggcgtattagcttgctccttagtttcttctcccgcacttgctgaaattgccaaaaaatatggcctaaaatcagaagaaacgctgaccggctttaaatatattgggaaagttgataacttattgtttggttttgaagaagcgataggttatttagtcgacccggacaaagtccgtgataaagacggcatctcagccgctgtagctttcttggatcttgtactttacttaaaaaaacaaggcaaaactattttagattatattaatgaatttaaccaacaatttggcgcctatataagtggacaaatttctattcgtgttagcgatttggcggaaattagcaaattaatgaccgctttacgtaataatccacccactaaaattggtggcgtaaaggttactcaattaattgaccacaccaaaacagaccgccaaagtgatattttggtattcaacttagcaaatggtagccgtttaattactagaccatctggcactgaacccaaaattaagttttacttagatgtaaaaggcaacaatggacaacaagaagcagaaagagcccttgcccactttgatgaaagcgtccgccaaatgttacgtcaaacacaatatggcaaccaagattgctaa

SEQ ID NO: 12577 - protein, 553 aa, Haemophilus ducreyi 35000HP
MTTIFTIAQHWLAQDPDLETQNELSHLIDNAKAGGKQALKELTARFGGRLQFGTAGLRGPLQAGPMGMNRVLVAQAAAGLALYLKTYDKQPSIVIGYDGRKNSDVFARDTAEIMAGVGIKAYLLPRKLPTPVLAYAIKHLDTTAGVMVTASHNPPEDNGYKVYLGKANGGGQIVSPADQQIAAFIDQVATGNIRELARSQDFNLLDDEVINAYIEKTARLSQENKMALNYVYTAMHGVGYEVLQKTLKQAGLSQPKLVSEQIEPDGNFPTVSFPNPEEKGALDLAIKLAQQENAEFIIANDPDADRLAVAIPDAQGIWKSLHGNVLGCLLGWHLAKKYHAQGQQGVLACSLVSSPALAEIAKKYGLKSEETLTGFKYIGKVDNLLFGFEEAIGYLVDPDKVRDKDGISAAVAFLDLVLYLKKQGKTILDYINEFNQQFGAYISGQISIRVSDLAEISKLMTALRNNPPTKIGGVKVTQLIDHTKTDRQSDILVFNLANGSRLITRPSGTEPKIKFYLDVKGNNGQQEAERALAHFDESVRQMLRQTQYGNQDC

SEQ ID NO: 12578 - DNA, 1653 bp, Porphyromonas gingivalis W83
  CDS (1)..(1653): transl_table=11
atgctggacaatgcagatacgaccgaactcgtggatgcattctaccgagatttggagtttggtacaggcggacttcgcggcatcatgggagccggaaccaatcgtatgaaccgctatacggtaggcgcagctactcaaggactctccaactatctcttgcgcgagtttgccggttcttcaaatatcagtgtcgttatcggctacgactgtcggaacaatagtcgtttttttgccgatacggcagcggctgtattctcggccaacggcatcggggtttatctgtttgaggaacttcgtcccacaccggaaatatcttacgccattcgtcatctgggatgtaagagcggtgtaatgattacagcttcgcacaatcctaaggaatacaacggctataaggcttattgggaagacggggcacagattatagctccacacgatcgtaatatcattgccgaggtcaatagaattcgctccgttgatgagatcaaattcgaagccaagcccgagctgattcggatgataggtgagaatatcgattcggctttcattgctgaagtcaaggcactgagtctttctcccgaaagcattgcccgtcatcgggatatgaagatcgtatacacgcctatccacggtaccggaagtacggtggtaccccgtgccttacgtgaatatggttttgccaatatcattcacgtacccgaacaggatgttgtaagcggagacttccctacggtacattctcccaatcccgaagagcctgcagctctcgccatggctatagccaaagcggaagaaacaggtgccgatttggttttggccagcgaccccgatgcagatagaataggagttgctgtgcgcaataatgagggtaggatggtgctcatcaatggcaacgagatttgttcgctgcttatctattattccatcatgcgtcgcaaggaattgggcgatttgcatcctgatgattatatcgtcaagacgattgtgactacggaattgatccgcgatatagcgaagaaagagcatgtgagcatgttcgattgctacaccggtttcaaatggatagcagccgtaataagagagaatgaaggtcgtcgccgctatataggaggtggagaggagagttatggatttttgtgggaagactttattcgagacaagagttcggtatctgcttgtgcactcttctgtgaaatggcagcttgggctttggatcgaggcatgagtgtctatcgactcatccgcagcatctatttggaatacggtctttactacgaaaagggacttagtgtggtgcgtaaaggcaaatccggagcagaagagatagaagccatgatgagaaattatcgtgagtatgcacctgtagaactcggaggctcgcctgtgcaggaaatattggactatgcttctctcgaaggaaaagatttcacaagaggagagaagttttcactcgatatgcctacaacgagcaatgttcttcagtacaagaccgaggatggcaccaaggtttccatccgtccgtcgggtactgaaccgaaaatcaagttttacatcggagttcatttctcggtcgctaatgagcaggaattagaccgggcctatatagtagcagaagaaaagattgctaccatcctccacgacctcggtgtctga

SEQ ID NO: 12579 - protein, 550 aa, Porphyromonas gingivalis W83
MLDNADTTELVDAFYRDLEFGTGGLRGIMGAGTNRMNRYTVGAATQGLSNYLLREFAGSSNISVVIGYDCRNNSRFFADTAAAVFSANGIGVYLFEELRPTPEISYAIRHLGCKSGVMITASHNPKEYNGYKAYWEDGAQIIAPHDRNIIAEVNRIRSVDEIKFEAKPELIRMIGENIDSAFIAEVKALSLSPESIARHRDMKIVYTPIHGTGSTVVPRALREYGFANIIHVPEQDVVSGDFPTVHSPNPEEPAALAMAIAKAEETGADLVLASDPDADRIGVAVRNNEGRMVLINGNEICSLLIYYSIMRRKELGDLHPDDYIVKTIVTTELIRDIAKKEHVSMFDCYTGFKWIAAVIRENEGRRRYIGGGEESYGFLWEDFIRDKSSVSACALFCEMAAWALDRGMSVYRLIRSIYLEYGLYYEKGLSVVRKGKSGAEEIEAMMRNYREYAPVELGGSPVQEILDYASLEGKDFTRGEKFSLDMPTTSNVLQYKTEDGTKVSIRPSGTEPKIKFYIGVHFSVANEQELDRAYIVAEEKIATILHDLGV

SEQ ID NO: 12580 - DNA, 1707 bp, Vibrio vulnificus YJ016
  CDS (1)..(1707): transl_table=11
atgctaaaacaagtcactgactggttggccagagatccggatccacgcacccgtgaagaacttcagtacctcattgatgagaagatgacggaagaattgcaagaccgttttcgcggcaggcttgaatttggtaccgccggattacgtggaaaagtcggttcgggaccaaatcgcatgaaccgacttgtagttcaagaaaccgcgacaggactcggacattatctcatcgagacgattcgtgatgccgctgctcgtggcgtggtgattggctatgatggccgaaccgattcgaagcaatttgctcacgacacggccgctgtactcaccgccttgggcattaaggtttacctcacccataaagtggccccaaccccagtggtggcatttggtgtcaaacagtttaatgccgcagcagcggtagtggttaccgcaagccacaacccaccggaatacaacggctttaaagtgtattgggaaaatggcgcgcaaatcattccacctcatgatgcgggtattgccgccgagattgagcaagcgacgcacaaacctatccctctcatgtcattgagtgatgcggaaaaacacggccttttggtttggctcaaagaggattactaccaaacgtatcgccaagcgatgaacactcacccattgttaaaatctggccatgcggttgatatttccatcgcgtacaccgctatgcatggtgtcggcgctgagatggctgagacactgctggccgatgccggtttcactcacgtgctgagcgtacctgaacaacaggagcctgatggcacgttcccgacggtcaacttccctaacccagaagaagctggggcgatggatatggtgatgaatctagcaaaaaccgtcgatgcagagattgcctgtgccaatgaccctgatgccgaccgctttgccgttgctgttcgcaaaccggatggtaactaccaaatgctcacaggagatcaagtgggcgcgttattcgccaattatctcctcagcagcgtggatgccagcaagcagttggttggtaacaccattgtctcttcccgcttgttggctgacatcgccaaacagcacggcgctcactactaccaaacgctcacgggctttaagtggctcaccaatgtagccatgactcagcaaagcgatgacaagcagttcttgtttgcgtatgaggaagcgctgggctacaccgtgggcaataaagtttgggataaagacggtttgtcagcgctggtcgcgtttgcccagctcacggcacatcttaaagaaaatggcctgactttgtgggacaaattagagcaactttatcgccaacatggcttctattttaacgcgcagcgcagtattgccttatcgcctgattcgccacccatcggggaccagctgagagccaaaccgccgaaaaccattgcagggcagaaggtaacggtgattgaagatctcaaagcgtcgttgcgatacgtgaccaatggcgtgacagaagcgattaacctgccggccagcgatgttctgatctatcaccttgaagatcgctcacgcgttatcgttcgcccttcaggcactgagccgaaactgaagtgctactacgaggtgattagcgatttccctgctgagttggattaccaaaccgcacagtttaaggccgagagcaaaatgaacgcgcttattgctgcccatcaacaaagcttgtcatcgtaa

SEQ ID NO: 12581 - protein, 568 aa, Vibrio vulnificus YJ016
MLKQVTDWLARDPDPRTREELQYLIDEKMTEELQDRFRGRLEFGTAGLRGKVGSGPNRMNRLVVQETATGLGHYLIETIRDAAARGVVIGYDGRTDSKQFAHDTAAVLTALGIKVYLTHKVAPTPVVAFGVKQFNAAAAVVVTASHNPPEYNGFKVYWENGAQIIPPHDAGIAAEIEQATHKPIPLMSLSDAEKHGLLVWLKEDYYQTYRQAMNTHPLLKSGHAVDISIAYTAMHGVGAEMAETLLADAGFTHVLSVPEQQEPDGTFPTVNFPNPEEAGAMDMVMNLAKTVDAEIACANDPDADRFAVAVRKPDGNYQMLTGDQVGALFANYLLSSVDASKQLVGNTIVSSRLLADIAKQHGAHYYQTLTGFKWLTNVAMTQQSDDKQFLFAYEEALGYTVGNKVWDKDGLSALVAFAQLTAHLKENGLTLWDKLEQLYRQHGFYFNAQRSIALSPDSPPIGDQLRAKPPKTIAGQKVTVIEDLKASLRYVTNGVTEAINLPASDVLIYHLEDRSRVIVRPSGTEPKLKCYYEVISDFPAELDYQTAQFKAESKMNALIAAHQQSLSS

SEQ ID NO: 12582 - DNA, 1653 bp, Corynebacterium diphtheriae NCTC 13129
  CDS (1)..(1653): transl_table=11
atgagctacgcagagctagagcgcacagcccgcgagtgggcggatcacgatcccgaccctcgcaccaaagaaaccatcgagggctggcttaaaactcacgacgaagaatccctccagcaggcattcaacggaccgctgacttttggcaccgccggcctgcgagcacgagtgggcgcaggtgaatcccagctcagcctggcagtcatcctgcgcaccacctacggcctagtcgactgggtaaaaacccagctcggcgcagatgccacccctacgatcgtgatcggctgcgacgcccgccacggatccctagagttccaccaagccgcagcggaggtagtctccgcagccggcggacgcgccctgctgctaccagctaaaaaccccaccccactgaccgcctttagtgtgaagaagtttggtgccgatgccggcatcatggtcaccgcctcgcacaacccaccagccgacaacggctacaaggtctacctcggtggacgcatcgcccaaggcccagccgaaggcgtgcaactgatcagcccagctgacaaagaaatctccgaggcaatcgcagcagcaccgtacgcagacgaaatcccacgcaccaccgacaacatcgaacatgttgacccacgcgaggactacctcacccgcgcactgaccctcgcagacaagaagagcgacatcctcatcgccctgactgccatgcatggtgtcggcgcagccttgggcgaaaaggtgctcaccgctgccggattcaacgtctccctcgtcccagaacaagccgagccagacccagatttccctacggtgtccttcccgaacccagaggaaaaaggtgccctcgacctggcgaaagcacacgccaacaccatcggtgcagatgtcatcatcgcctacgatcctgacgcggaccgctgtgccgtcgccaccccagacgctaacgccgaaggcggatggcgccagctcagcggcgacgagacaggtgcggtgctaggtgcataccgtgcgagcgtcgcaaagccaggctccatggccaactccatcgtctccggccgcctgctctccaagatcgccgaagccgcagggcgtacccacgccaccacgctcaccggattcaaatggatcgcacgcacccctgaactcgtattcggctatgaggaagccatcggattctgctgcgacccagaagcagtcgccgacaaagatggtgtctccgcctccgtggtcgtagcaagcctcgtcagtgccctcaaagccgaaggccgcaccctcgatgacgccctcgacgacctagcccgcgaacacggcctctaccagaccgcgccgctgaccttccgcgtcgacgacctctccatcatcgcccgcgccatgagcaccctacgcgcacaaccgccaacggaactcgcaggtgcaaccgtcaccgaggtcaccgacctcaacgacccaaccctgccatggggcgcaaccgacggcatgatgtttatcaccgaccacaacgaccgcatcatctgccgcccatccggcaccgagccaaaactcaagtgctacctcgaagtggttatgcctgtcaccggcgacaccatcccacgcgccgaagccgcccaacgcctcgacgctatcgccaccgcactgcgcacccacctcggaatgtag

SEQ ID NO: 12583 - protein, 550 aa, Corynebacterium diphtheriae NCTC 13129
MSYAELERTAREWADHDPDPRTKETIEGWLKTHDEESLQQAFNGPLTFGTAGLRARVGAGESQLSLAVILRTTYGLVDWVKTQLGADATPTIVIGCDARHGSLEFHQAAAEVVSAAGGRALLLPAKNPTPLTAFSVKKFGADAGIMVTASHNPPADNGYKVYLGGRIAQGPAEGVQLISPADKEISEAIAAAPYADEIPRTTDNIEHVDPREDYLTRALTLADKKSDILIALTAMHGVGAALGEKVLTAAGFNVSLVPEQAEPDPDFPTVSFPNPEEKGALDLAKAHANTIGADVIIAYDPDADRCAVATPDANAEGGWRQLSGDETGAVLGAYRASVAKPGSMANSIVSGRLLSKIAEAAGRTHATTLTGFKWIARTPELVFGYEEAIGFCCDPEAVADKDGVSASVVVASLVSALKAEGRTLDDALDDLAREHGLYQTAPLTFRVDDLSIIARAMSTLRAQPPTELAGATVTEVTDLNDPTLPWGATDGMMFITDHNDRIICRPSGTEPKLKCYLEVVMPVTGDTIPRAEAAQRLDAIATALRTHLGM

SEQ ID NO: 12584 - DNA, 1581 bp, Mycobacterium avium subsp. paratuberculosis K-10
  CDS (1)..(1581): transl_table=11
gtgacgcccgaggaatggatcgcgcacgatcccgacccccgcacggccgccgagctcgccgcatgcggcgccgcagaactcgccgcccgcttcgcccggcccttgcgattcggcacggcgggactgcgcggcccggtccgcgccggccccgacgcgatgaacgtcgcggtggtgtcgcgggccagctgggcgctggcgcaggtgctcaagcgccgcggcccggccggcgcgcgggtgatcgtgggacgcgacgcccggcacggctcggcggtattcgccacggtggccgctgaagtgcttgccgcccaagggttttcggtactgctgctgcccggtccggcacccaccccggtggtcgcgttcgcggtgcggcacaccggcgccgccgccggggtccagatcaccgcctcgcacaacccgccgaccgacaacggctacaaggtgtacgacggcggcggcatccagatcgtctcccccaccgaccaccagatcgaagccgcgatggccgacgcgccaccggccgacgagatccgccgaacacccgtcccaccggcgcacaccgacctcgtccagcgctacatcgagcgggcggccggggtgcggcgcggcaccggttcggtgcgggtggcgctcaccgctctgcacggcgtgggcgggacggtggccgtcgacgctctgcaccgcgccggtttcggccgaatacacaccgtggcaagccaattcgcgcccgacccggactttcccaccgtcgtgttccccaaccccgaggagcccggcgccaccgacgcgctgctgaccctggccgccgatgtggacgccgacgtggcgatcgcactggatcctgacgccgaccgctgcgccgtcggcatacccgacgcctccggctggcggatgctctccggcgacgaaaccggttggctgctcggcgattacctgctctcccagccgcagcgggccgaccgacccgtggtggccagcacggtggtgtcgtcgcggatgttgtcggccatcgccgcgcggcacggcgccgtgcacgtggaaaccctcaccggcttcaagtggttggcacgcgccgacgccgaggtgcccggcggcaccctggtgtacgcctatgaggaggcgatcggacactgcgtggaccccgccgcggtgcgcgacaaggacggcatcagcgccgccgtgctggtgtgcgacctggtggccggcctgatcgcgcggggcggttcggtgtccggccggctcgacgagctggcccgccgccacggcgtgcacgacgtcgccgcggtgtcgcgccgcgtcgggaccgacggggctgccgagctgatgcgacggctgcgcaccagcccgccggagacgctggccgggttcggggtggcgctcaccgacatcaccgacgcgctgatcttcaccggcggcgacgacgacacgtcggtcaggctggtggtgcggccttccgggaccgagccgaaggtgaagtgctacttggagattcgctgcgcgccgagcgacgacctggcgtcttcgcggcggcgcgcccgcgccctgcgggagcttctggtcgcgacggtgcggagctggtga

SEQ ID NO: 12585 - protein, 526 aa, Mycobacterium avium subsp. paratuberculosis K-10
MTPEEWIAHDPDPRTAAELAACGAAELAARFARPLRFGTAGLRGPVRAGPDAMNVAVVSRASWALAQVLKRRGPAGARVIVGRDARHGSAVFATVAAEVLAAQGFSVLLLPGPAPTPVVAFAVRHTGAAAGVQITASHNPPTDNGYKVYDGGGIQIVSPTDHQIEAAMADAPPADEIRRTPVPPAHTDLVQRYIERAAGVRRGTGSVRVALTALHGVGGTVAVDALHRAGFGRIHTVASQFAPDPDFPTVVFPNPEEPGATDALLTLAADVDADVAIALDPDADRCAVGIPDASGWRMLSGDETGWLLGDYLLSQPQRADRPVVASTVVSSRMLSAIAARHGAVHVETLTGFKWLARADAEVPGGTLVYAYEEAIGHCVDPAAVRDKDGISAAVLVCDLVAGLIARGGSVSGRLDELARRHGVHDVAAVSRRVGTDGAAELMRRLRTSPPETLAGFGVALTDITDALIFTGGDDDTSVRLVVRPSGTEPKVKCYLEIRCAPSDDLASSRRRARALRELLVATVRSW

SEQ ID NO: 12586 - DNA, 1725 bp, Lactobacillus johnsonii NCC 533
  CDS (1)..(1725): transl_table=11
atgaacgcaaaagaaatttatagtcaatggactaatgcaaataatttacctgattatttaaaagatcaattaaatgatctaggtaaagatgaaaagtggattgaagatgctttcggacaagatattaattttggtactgccgggatgagaggtagacttgaacctggtacaaacagaattaatttgtttactgtgggaagagtaaccgaaggtcttgcaagactaattgatgaaaatggtgaagaagctaagaaacgtggcgttgcaatttcttttgattcacgttatcactcaagagaattcgccgaacacgcagctcgtattttaggtgcacatggaattcatgtatacttatttgatgatttgagaccaactcctgaattatcatttgctgtccgtcacttaaatacctttgctggaattaacatcactgcttcacataatgctaaacaatataatggttataaggtttatggtgaagacggtgctcagatggcgccagaaaatgcagatcgcttgtttgcttatgctcaaaaagttgatgacatttttagcgttaaagctgctcccgtggaagaactacgggctaatggcacgctacagttgattggtgaagatgtagatgaagcatacttagctcgtttaaaggatgttactgttgatcctgaaatggttaaggctaatgctgataaattaaagattatctatactccattacatggtactggaaagatgctatatgatcgtgccttcagacaaggtggttttgataatgtgattccagttccaagtcaatctatcattgatccagaattccctacaactatcaagcctaacccagaataccgtgatgtatttgaaccaggatttaagcttgctaatgaagttgatgcaaatgttattattgcaacggacccagatgctgatagaatgggtgctgctgttagaaaatcagatggcgatttccaagttttaactggtaatcaaattgctacattaatggcctattacttattagttcatatgaaggaaaacggaactctttcatccgactatgaattagtaacttcagtagtttcaagtgcacttccatttaagattgctgatgattttggtattaaaactaagcatgtgctaactggattcaagtacattggtgaagaagttgaccggatgaataaagaagatgacggtaaattcctgatgggatttgaagaaagttacggttacttatttaaaccattcgctagagataaggatgctatgcaaggtgcattaatgtttgcagaagtagcaagttactatgcatctaaaggaatgactgtttttgatggattacaagagatctggcaaaaatatggtgtagcttacgaaattactaaggctatcgaaatgcctggtattggtggtcaaaagaagatggctgaattaatgagtaagttacgtaaagaacatttaactgaaattaatgatgcaaaggttgttaagattcaagactttgaaacccaagaaactattgaagatggaaagaaaactccattaactggtttccctaagtctaacgttttgaagtacttcttagatgatgaaacttgggttgctcttcgtccatcaggaactgaacctgtaatcaaggcttatgttggagtaaataagaaagatattgaaactgcagaaaaagctgcagaagagtatcaagatgcattagctaatatattaaagtaa

SEQ ID NO: 12587 - protein, 574 aa, Lactobacillus johnsonii NCC 533
MNAKEIYSQWTNANNLPDYLKDQLNDLGKDEKWIEDAFGQDINFGTAGMRGRLEPGTNRINLFTVGRVTEGLARLIDENGEEAKKRGVAISFDSRYHSREFAEHAARILGAHGIHVYLFDDLRPTPELSFAVRHLNTFAGINITASHNAKQYNGYKVYGEDGAQMAPENADRLFAYAQKVDDIFSVKAAPVEELRANGTLQLIGEDVDEAYLARLKDVTVDPEMVKANADKLKIIYTPLHGTGKMLYDRAFRQGGFDNVIPVPSQSIIDPEFPTTIKPNPEYRDVFEPGFKLANEVDANVIIATDPDADRMGAAVRKSDGDFQVLTGNQIATLMAYYLLVHMKENGTLSSDYELVTSVVSSALPFKIADDFGIKTKHVLTGFKYIGEEVDRMNKEDDGKFLMGFEESYGYLFKPFARDKDAMQGALMFAEVASYYASKGMTVFDGLQEIWQKYGVAYEITKAIEMPGIGGQKKMAELMSKLRKEHLTEINDAKVVKIQDFETQETIEDGKKTPLTGFPKSNVLKYFLDDETWVALRPSGTEPVIKAYVGVNKKDIETAEKAAEEYQDALANILK

SEQ ID NO: 12588 - DNA, 1764 bp, Treponema denticola ATCC 35405
  CDS (1)..(1764): transl_table=11
atggataaaaatgaaatattaaatagagcaaaaaaatatgtttccgaagaaaaggaagtaaaattcgcagaagaggttaaggctttaatcgaaaaaaatgatgaaaaggaattatatgaccgcttttatagggacttggaattcggaacggcaggtttaaggggaattatagggggcggcacaaaccgcatgaatcctttagtaataaaaaatgcaacccaaggacttgcggattatctgattgaagcaaaatctgagaaggctaaggccggctctttaagtgccgtaattgcctacgattcaagacgcttttcggatgtttttgcaaaaacggctgctcttatttttgcggcaaacaatatccgctgttaccttttttcgagccttaggcctacgccggaactttcttatgccataagggaactcggctgcgatacgggaattgtagtaacagcctcgcacaaccctcccgaatacaacggctacaaggcctactggtcggacggagcccagattaccccgccccatgatttagggataatcaaaaaggtaggcgaggtttcttcaatcaaaatgatgagcgaagaagaagctcttaaaaacggaaagctcgtaataatcgataaagaaatcgatgaaaaatactgggctatgcttaaaaagaaaatcagccgtcaagaaattattaaaaatatggcttccaaggtaaagatagtttacactccccttcacggaacgggagctatgcatgtagaaaaggtactgggagaaatgggctttaatgttataagcgttcccgagcagcgtgaacctgacgggaatttcccgacggtaagctatcccaatcccgaagaccccaaagccttaaagatggccatggatttagctataaaggaaggagccgatattctgatggccacagatcccgatgccgaccgctttgcctgtgcagtaaaaaacgatgcaggcgaaatgcagcttataagcggcaatcagatgggagccctctttgcggattatatctgtcttacattaaaagaacaaaataaactgcctcaaaatgccgcaatagtacgctcgatagtaacctcccccttaagcgatttgattgcggcctcttacaatgtgcaaagcgaagaatgtcttaccggctttaagtggatatgcggcgttgccgaaagaatggtaagcacgggctcccactcctatctttacggttatgaagaaagcttcggctacaacttcggaaccgaggtaagagataaggacggtattgcctcttctgcaatttgtgccgagatgaccctctattggaggagcaagggaaagagtcttttagacaggctaaacgaaatcttttctcaattcggtttttacggagaaaagaccatcaatatggtatacccgggagcagaaggcttaaagattatgcaggacatgatggtaagagttcgggaaagaaatttaagcgaaatcgccggcgtgaaggtaaaaaccatcagggatattcaggaaagcacggaatattctccattagagccggccaaaaaaactaaggttactttacctaagagcaatgttcttcaatattatttggaagacggctccataatatgcataaggcccagcggcaccgaacccaagataaagatctacataatccattccgaaaaggttgtttcatcggttgaagaagctaaaaaacaatcggataaaaagattgccgaattcgaaaaagaatttaacggtgtactaaacgcataa

SEQ ID NO: 12589 - protein, 587 aa, Treponema denticola ATCC 35405
MDKNEILNRAKKYVSEEKEVKFAEEVKALIEKNDEKELYDRFYRDLEFGTAGLRGIIGGGTNRMNPLVIKNATQGLADYLIEAKSEKAKAGSLSAVIAYDSRRFSDVFAKTAALIFAANNIRCYLFSSLRPTPELSYAIRELGCDTGIVVTASHNPPEYNGYKAYWSDGAQITPPHDLGIIKKVGEVSSIKMMSEEEALKNGKLVIIDKEIDEKYWAMLKKKISRQEIIKNMASKVKIVYTPLHGTGAMHVEKVLGEMGFNVISVPEQREPDGNFPTVSYPNPEDPKALKMAMDLAIKEGADILMATDPDADRFACAVKNDAGEMQLISGNQMGALFADYICLTLKEQNKLPQNAAIVRSIVTSPLSDLIAASYNVQSEECLTGFKWICGVAERMVSTGSHSYLYGYEESFGYNFGTEVRDKDGIASSAICAEMTLYWRSKGKSLLDRLNEIFSQFGFYGEKTINMVYPGAEGLKIMQDMMVRVRERNLSEIAGVKVKTIRDIQESTEYSPLEPAKKTKVTLPKSNVLQYYLEDGSIICIRPSGTEPKIKIYIIHSEKVVSSVEEAKKQSDKKIAEFEKEFNGVLNA

SEQ ID NO: 12590 - DNA, 1677 bp, Mycoplasma mycoides subsp. mycoides SC str. PG1
  CDS (1)..(1677): transl_table=4
atgagttttaacaaattagatcaaacttatttagattgaattaatcatcctaatttagatcaagaattaaaagaattattaaataaagcagatgataatgaactaaatgctgcttttaatttggaattaaaatttggaacagcaggaattagaggaatactaggagctggtcctggtagatttaatgtttatactattaaaaaagtaacaatagcttatgctaaattattacaaacaaaatatagtaatgacttaaataaaggtgttgttattggtcatgataatagacataattctaaaaaatttgctaaattagtagcagatattttaacaagttttaatattaaggcttatttatttaaaaataatgatcttcaaccaacaccagtagttagttttgcaacaaaagctttaaattgtattggtggaattgttataactgcttctcataatccagctgaatataatgggtataaaatttatgatccatatgggtgtcaattaatgccacatgatactgatgttattgctagttatatgaatgaaattacaaatattttagattgaacatttatatcaaacaataacttattagaaattgttgatcaaactgtaattgataaatattttgaaatgattaaaaacttagagttttataaaaatcaagataaatctaatttaaaaattatttattcagctgtaaatggaactggaagcttatatactccaattgttttaaaacaatcaggatatcaagtaatagaagtaaaagaacatgcttttgaagatgaaacttttaaaaatgtaattaatcctaatcctgaatttgatccagcatgaaaaatacctttagaatatgctaaaaaatatgatgctgatattattattttaaatgatccagatgctgatagatttggtatggctattaagcataataatgaatttattagattaaatggtaatcaaactggagctattttaattgattgaaaactaagtaatttaaaacgtttaaatgaattaccaaagaacccaactttatattctagttttgtaacaagtgatcttggtgatagaattgctagtgaaacttataatgctaatgtagttaagactttaactggatttaaatgaatgggtcaagaaatgttaaaagagcctttaaatggtttaaattttgtgtttgcttatgaagaaagttatggttatgtaattgatgattcaacaagagataaagatggaatccaagcatcaattattgcagctgaagcttgctgatattataaaaatcaaaatatgactttagttgattatttaaatcagttatatgaaaaatatggatattattacacaactacttataatttaaactttaaacctgaagaaaaagattcaaaaattgctccaattatgaaattattaagaactacaggaattaaacaaattaataatttaaaagtagttcaaattgaagattatattaatgggttatataatatgccatctgaagatttattaaaaatttatttagaagataaatcttgaattgcaattagaccatcaggaacagaatctaaattgaaaatttattttgtaatagttgatagttctttacaaaaagcagaaaataaagctgaaaagatctataaagaattaaaagaaattttgaatatttag

SEQ ID NO: 12591 - protein, 558 aa, Mycoplasma mycoides subsp. mycoides SC str. PG1
MSFNKLDQTYLDWINHPNLDQELKELLNKADDNELNAAFNLELKFGTAGIRGILGAGPGRFNVYTIKKVTIAYAKLLQTKYSNDLNKGVVIGHDNRHNSKKFAKLVADILTSFNIKAYLFKNNDLQPTPVVSFATKALNCIGGIVITASHNPAEYNGYKIYDPYGCQLMPHDTDVIASYMNEITNILDWTFISNNNLLEIVDQTVIDKYFEMIKNLEFYKNQDKSNLKIIYSAVNGTGSLYTPIVLKQSGYQVIEVKEHAFEDETFKNVINPNPEFDPAWKIPLEYAKKYDADIIILNDPDADRFGMAIKHNNEFIRLNGNQTGAILIDWKLSNLKRLNELPKNPTLYSSFVTSDLGDRIASETYNANVVKTLTGFKWMGQEMLKEPLNGLNFVFAYEESYGYVIDDSTRDKDGIQASIIAAEACWYYKNQNMTLVDYLNQLYEKYGYYYTTTYNLNFKPEEKDSKIAPIMKLLRTTGIKQINNLKVVQIEDYINGLYNMPSEDLLKIYLEDKSWIAIRPSGTESKLKIYFVIVDSSLQKAENKAEKIYKELKEILNI

SEQ ID NO: 12592 - DNA, 1725 bp, Bacillus cereus ATCC 10987
  CDS (1)..(1725): transl_table=11
atgaactggaaacaagaatttagtcgctggctttcatatgcagagttagatgcagaactaaaagaacagttagaaaacatgaagcaagatgagaaaaaaatcgaggacagcttttataaaaatctagaattcggcacaggtggtatgcgtggtgaacttggtgctggtacgaaccgtctgaacgtatacacagttcgtaaagcgacacaaggattagcgaagtttattgaaaagttaggtgaagaagcgaagaagcgtggtgttgttgtagcgtatgattctcgccataaatcacctgagttcgcaatggaagttgctgctacactaggtgcacacggcattacaacatatgtgtttgaaagcttacgtccaacgccagtgctttctttcgcagttcgtcatttacatacagtgagtggaatcgttcttacggcaagtcataatccgcctgaatataacggttataaagtatacggtgaagatggtgggcagttgcctccaaaagaagctgatgaattaattagctacgtaaacgcagtagaagatgaattaacagttgaggttgctgatgtggagcaattaaaagctgacggtttattacatattattggacaagaagtcgatgatgcatatgctgcagaattgaacaatgtcattattaataaagaaatggtacaaaaggttgggaaagatttaaaaatcgtcttcacaccactacacggaacatcaaatatttctgtacgccgtggtttaaaagaagttggatttacagatgtaacagttgtaaaagagcaagagttaccagatccgaacttctctacagtaaaatcaccgaacccagaagagcatgcagcatttgaatatgcaattcgtgacggtgagaaggtaggcgcagatgtgttaatcgcaacggatcctgacgcagaccgccttggtgtagcagttcgtaatcacgatggtgagttccaagtattaactggtaaccaaacaggtgcattaatgcttgattacttattatctcaaaagaaagaaaacggaacactaccagagaacggtgttgtattaaaaacaatcgtaacgtctgaaattggtcgtacaatcgcgaaagcatacggtttagatacagttgatacgttaactggatttaaatttatcggtgagaaaattaaacagtatgaagaaagcggacaatacgaattccaattcggttatgaggaaagctatggttatttaatccgtccattctgccgtgataaagatgcagtacaatctgttctatttgcatgtgaagtagctgcatactacaaatcacaaggtaaaacgttatacgatggtctattagaagtgtttgagaagtacggtttcttccgtgaagatcttgtatcgttaacgctaaaaggaaaagatggagcggaacaaattcaagaaatgatggcaacattccgtgaaaatcctccgaaagaagtagcgggcttaacagttgtagcagttgaagactataaagcgagcatgattacatctttacaagatggacataaagaagagattcacttgccgaaatcaaatgtgttaaaatatcaattagaagatggttcttggttctgcctacgtccatctggaactgaaccgaagattaagttctacttcggtgttcaagataattctttacaaaatagtgaacaaaagttacttactattaaagaagatattatgaatcgtttataa

SEQ ID NO: 12593 - protein, 574 aa, Bacillus cereus ATCC 10987
MNWKQEFSRWLSYAELDAELKEQLENMKQDEKKIEDSFYKNLEFGTGGMRGELGAGTNRLNVYTVRKATQGLAKFIEKLGEEAKKRGVVVAYDSRHKSPEFAMEVAATLGAHGITTYVFESLRPTPVLSFAVRHLHTVSGIVLTASHNPPEYNGYKVYGEDGGQLPPKEADELISYVNAVEDELTVEVADVEQLKADGLLHIIGQEVDDAYAAELNNVIINKEMVQKVGKDLKIVFTPLHGTSNISVRRGLKEVGFTDVTVVKEQELPDPNFSTVKSPNPEEHAAFEYAIRDGEKVGADVLIATDPDADRLGVAVRNHDGEFQVLTGNQTGALMLDYLLSQKKENGTLPENGVVLKTIVTSEIGRTIAKAYGLDTVDTLTGFKFIGEKIKQYEESGQYEFQFGYEESYGYLIRPFCRDKDAVQSVLFACEVAAYYKSQGKTLYDGLLEVFEKYGFFREDLVSLTLKGKDGAEQIQEMMATFRENPPKEVAGLTVVAVEDYKASMITSLQDGHKEEIHLPKSNVLKYQLEDGSWFCLRPSGTEPKIKFYFGVQDNSLQNSEQKLLTIKEDIMNRL

SEQ ID NO: 12594 - DNA, 1854 bp, Candida glabrata CBS 138
  CDS (1)..(1854)
atgtctacgactgatataccggtggaattaagaactgcgatcgaatcatggctacagctagataagaatgaggagactaggaatgaagtgattaagctttgcaatgatcaaaattgggatgaattacataagaggtttgactccaggatagtgtttggtactgctggtttaagagctcggatggaagcaggtactaataggctaaacaaattggtgattttacaggcgtcccagggattagcaacatacatcaaggataaattccctcaaaatttaacagcggtagtgggtcatgatcacagatatcattcacaagaattcgcacaggttactgctgcgacatttataagagcgggattcaaagtttactacctcaacccccacgatgaatttgttcacactcctatggtgccctatagtgtagaccatctcaatgcctctgttggtgttatgattactgccagtcataacccgaaaatggataatggctataaggtatattataccaatggctgtcaaataataccacctcatgaccatggcattgctgagactattaataataacttggaaccatggtcaaccgattggaactttactaagatcttatcaaatgcagagacagatggaaaaattgaatatgttagaaagagaatgttgacttcatatttgaattcagtagtaaatcagcttattcaaagagattttgctgccccagatgaaaagccctggtttgtgtatacaccaatgcatggagttggccatcagatttttagcactattttaaatgaatctcttaatttgaaagacaatattgactatatcacagttcctgagcaaaaagatccagatccttcctttagaacagttagttttccaaacccagaggagaaaggtgctttgaatttagcaattacgttggctgaagccaatggaattaagttagttttagcgaatgatccaaacgccgacaggttttctgttgctgttagagatgacagtaaaaatgagtggaagcagttaacagggaatgaaattggtttactttttgccttttatgaattcaaaatgtatcaaaaggctgcagacaagggtattaaaaacaaacctttggctatgcttaattcaacggtatctgctcaggttatcaaaaggatggctgagaaagagggtttcctttacaaagacacattgacagggttcaaatggattggaaatgaagctgcaaaacttgaggagaaaggctattttgttccattcggctatgaagaagctatcggttatatgttcccagctatggagcatgacaaagatggtgtcagtgcagccatagtcttcttgcaagcttacgccaactggctacaatcttcatccaaccctattgatataatccacgaatgctatgataaatatggagtttcagccgagtataatggttattatattgtatcagatccgtctaaaacagacaaagtttttgaatctataaggtcctcctatacatcaatgggattaagttttcctgagtcaatcggtgagcattttagagtaactgagtttagagatttaactattggatttgattcaacaacagctgataaaaaacctttactacctgtagataagaattcccagatgattactattactgccgttccttctggtgcctctaatactggcgagtctgttaggttcacaataagaggatctggaactgaacccaaattgaaagtatatattgaaggaataagttccactgagggacgtgcacgtattcttgcaaaaagtctttgggagaccttaaaacatgaatggtttaaaccctcttcaaatggattatccacagacttttag

SEQ ID NO: 12595 - protein, 617 aa, Candida glabrata CBS 138
MSTTDIPVELRTAIESWLQLDKNEETRNEVIKLCNDQNWDELHKRFDSRIVFGTAGLRARMEAGTNRLNKLVILQASQGLATYIKDKFPQNLTAVVGHDHRYHSQEFAQVTAATFIRAGFKVYYLNPHDEFVHTPMVPYSVDHLNASVGVMITASHNPKMDNGYKVYYTNGCQIIPPHDHGIAETINNNLEPWSTDWNFTKILSNAETDGKIEYVRKRMLTSYLNSVVNQLIQRDFAAPDEKPWFVYTPMHGVGHQIFSTILNESLNLKDNIDYITVPEQKDPDPSFRTVSFPNPEEKGALNLAITLAEANGIKLVLANDPNADRFSVAVRDDSKNEWKQLTGNEIGLLFAFYEFKMYQKAADKGIKNKPLAMLNSTVSAQVIKRMAEKEGFLYKDTLTGFKWIGNEAAKLEEKGYFVPFGYEEAIGYMFPAMEHDKDGVSAAIVFLQAYANWLQSSSNPIDIIHECYDKYGVSAEYNGYYIVSDPSKTDKVFESIRSSYTSMGLSFPESIGEHFRVTEFRDLTIGFDSTTADKKPLLPVDKNSQMITITAVPSGASNTGESVRFTIRGSGTEPKLKVYIEGISSTEGRARILAKSLWETLKHEWFKPSSNGLSTDF

SEQ ID NO: 12596 - DNA, 1824 bp, Kluyveromyces lactis NRRL Y-1140
  CDS (1)..(1824)
atgtcagaaactgaagtaatcgagagccttccttcggacctgcaaggaaaagtacggaattggttgaagtatgacaaagtcgaagagacacgtaatgagatacttcaactctgtttgaagggcgacatcacggagttgcataaaagattggatactatgattgcatttggaaccgctggtcttagaggtcgcatggaggcgggcttcaataggatgaacgccttaactgtgaaacaagcatcacaagggttggctaaatatattaagaagcagttcccggagaatttaaccgttgtagttgggcacgatcacagacacaactctagactgtttggcaaggttacagtagatacttttctacaattgggattcaaagtgttccatttgaaccatgagaatgagaagtctttagtccatactccattggttccattcaccgtcaatgcaaccggtgcatccgttggaatcatgattactgcgagtcataatccgaaaatggataacggatacaaagtgtactatacgaatggatgtcagatcatacctccacatgacaagcttattgccgaatccatcattcataacttagaaccatttagttcacctcaaactggtaccatcatcgattgcaaggaaaaaatgaccaagaaatatatcgatgcgattggttctacattgattgatggtgctgttaataagaaaaccaacgaaccgtggttcgtttatactccgatgcatggagtaggttttgagatttttgaaagtatcagtaaacaacttttatcccttgaagaaggtaaagattacttagtagtagaagagcagaagtatccagatgctgatttccccacggtgtctttccctaacccagaagaaaaaggtgctttggatctagccgttgaatatggaaggaagaacgatactgtcgacctaattatagccaatgatccagatgccgataggtttagtgtcgcagtaagggacaacgatcaaaatacaactacagcttggagacaattgaccggaaacgagattggattcttgtttgcatactatgaatgggaaaggtacaagcatagtcctatcgacgaaccgcttgcgatgttgaactcaactgtttcttcacagatgatcaagcgtatggctgaaatagaagggttccattacgaggatacgctaactgggttcaaatggcttggaaatcgcgcacttgagctagaacaagagggatactatacgccattcgcatacgaggaagctatagggtacatgttttcatctgtggttcacgacaaagacggaatcagcgctgccatcgtctttcttcaagcctattcgaagtggcgtgcgagtggtcagactgtgctggatattttggccacagcatcacttaagtacggccactttaaagagtttaacgggtattatatcgtccccgatctcgctataacgaagcaggtattcgatgccatcagatctatcgagtccccataccctaagaaactcgggtcctcattcgaaatcatcaaattcagagacttaaccaatgggtatcaatctgacactcccgatcacatccctgaactagcatcagacccgtcttcacagatgatcacctgcgaaatgctattagtcgagcagccaacgagtagagtcagattcacaattagaggttcaggaactgaaccgaaattgaaagtatacattgaagcacgtacaaatacagaaccgaattcgatagccttagcgaagttcacatgggatgtgctaagacaagaatggtttaaaccagaactcactggactcctcacaccattccaatga

SEQ ID NO: 12597 - protein, 607 aa, Kluyveromyces lactis NRRL Y-1140
MSETEVIESLPSDLQGKVRNWLKYDKVEETRNEILQLCLKGDITELHKRLDTMIAFGTAGLRGRMEAGFNRMNALTVKQASQGLAKYIKKQFPENLTVVVGHDHRHNSRLFGKVTVDTFLQLGFKVFHLNHENEKSLVHTPLVPFTVNATGASVGIMITASHNPKMDNGYKVYYTNGCQIIPPHDKLIAESIIHNLEPFSSPQTGTIIDCKEKMTKKYIDAIGSTLIDGAVNKKTNEPWFVYTPMHGVGFEIFESISKQLLSLEEGKDYLVVEEQKYPDADFPTVSFPNPEEKGALDLAVEYGRKNDTVDLIIANDPDADRFSVAVRDNDQNTTTAWRQLTGNEIGFLFAYYEWERYKHSPIDEPLAMLNSTVSSQMIKRMAEIEGFHYEDTLTGFKWLGNRALELEQEGYYTPFAYEEAIGYMFSSVVHDKDGISAAIVFLQAYSKWRASGQTVLDILATASLKYGHFKEFNGYYIVPDLAITKQVFDAIRSIESPYPKKLGSSFEIIKFRDLTNGYQSDTPDHIPELASDPSSQMITCEMLLVEQPTSRVRFTIRGSGTEPKLKVYIEARTNTEPNSIALAKFTWDVLRQEWFKPELTGLLTPFQ

SEQ ID NO: 12598 - DNA, 1905 bp, Debaryomyces hansenii CBS767
  CDS (1)..(1905)
atggaagaatattctgaagagcaaattaagaccttgaatactttagtcgaacagtggatatcggttgatatcaatccgaaatcaagaaaggagataattgaactacaacaagaaggaaattattcaaaattgaatgaaaaactttcgaagcgaattgcgtttggtaccgccgggttgaggtcaacgatgacttctggctttgcacatatgaatgatgttaccatacttcaggcttctcaagggttgatcaaatatttactcgagaaaaatgaatcaaaccagaatttatctattgttgtgggttatgatcatagatttcattcccagagatttgctgaaattacagccagtgttgctttgacacaagggtttaaggtatattacttaggttcaacaactaatttatcacgcgaatctattgaactttcagaggctaaatttaatgagctccaagaagctgatagaggatatgtgcatacgccattagtaccattcgccattgattatttcaaagcctcagcaggagttatggtcacagcttctcataatcctgctcaagataatgggtataaagtctattatggaaatggttgccaaatcatacccccaaatgactcaggaatagctaactctattgagagaaatttggacccttggcttaaccaacatgtatgggatattgtagggaatttcaagaaaaatgctgataagttattatttggggtaaaaggaaaagctacagaaatgtatgttaacgcagttaatgagcttttaatccaaaatcataaattgagctatgatttcacttacactccaatgcatggagtaggaatggagattttcgataaaattatctctttatttgaaacaaaatccgatatcaaacctgtcacagagcaaatgaatcctgatcccgagtttctgacggtgaagtttcccaatccagaagaaaagggtgcattagctttatcgatcaaaaatgcaaacgaactgggccataagttagttattgcgaacgatccggatgcggatagatttagtgttgcaattaagtcatataaaacaaatgaatgggtgcagttaacagggaatgagattgggttcttgtttgcaatgtacgtgattgaagaattaactccagaaaataagctagataaaacatacttaattaattctaccgtttcatcacaagtcttagcctcaatggcacaacatcatgggtttaagtttattgacaccttaactggattcaaatggattggtaataaggccattgatttaaagaaagaagggtttaacgtaccatttggttacgaggaagcgataggctttatgtttagtgtagctaatgacaaagatggcatttctgccctagttatttggctacaattgtacgaaacttggtttgcaaacaaagaaaattacgatcccgttgataaattaaacgagggatatgaaaaatacggttggtacaaagaagcaaatggctactataagctaaacgatctatcgatgacccaaaaaatatttgaaaacactattcgtaaatcgtatgaaggaaggcctcatccacaaactctaggagacacattcttagtcgattcatggagagatctaaccctaggatacgatactctgacccccacccatgtgcctgatttacctgttgatcccacctcacagatgattactgccacattgaaaccaaaagatgcacaatcagataacgaattagtgagatttacttgtcgtggttcaggaactgaacccaaattaaaaatctacattgaaggaaaatctgatattggtgaaaatcgagctttatctcttgctaaactttgttggaataccttgaagacagaatggtttaaacccgaagagaatggattgcaagaggttatatag

SEQ ID NO: 12599 - protein, 634 aa, Debaryomyces hansenii CBS767
MEEYSEEQIKTLNTLVEQWISVDINPKSRKEIIELQQEGNYSKLNEKLSKRIAFGTAGLRSTMTSGFAHMNDVTILQASQGLIKYLLEKNESNQNLSIVVGYDHRFHSQRFAEITASVALTQGFKVYYLGSTTNLSRESIELSEAKFNELQEADRGYVHTPLVPFAIDYFKASAGVMVTASHNPAQDNGYKVYYGNGCQIIPPNDSGIANSIERNLDPWLNQHVWDIVGNFKKNADKLLFGVKGKATEMYVNAVNELLIQNHKLSYDFTYTPMHGVGMEIFDKIISLFETKSDIKPVTEQMNPDPEFLTVKFPNPEEKGALALSIKNANELGHKLVIANDPDADRFSVAIKSYKTNEWVQLTGNEIGFLFAMYVIEELTPENKLDKTYLINSTVSSQVLASMAQHHGFKFIDTLTGFKWIGNKAIDLKKEGFNVPFGYEEAIGFMFSVANDKDGISALVIWLQLYETWFANKENYDPVDKLNEGYEKYGWYKEANGYYKLNDLSMTQKIFENTIRKSYEGRPHPQTLGDTFLVDSWRDLTLGYDTLTPTHVPDLPVDPTSQMITATLKPKDAQSDNELVRFTCRGSGTEPKLKIYIEGKSDIGENRALSLAKLCWNTLKTEWFKPEENGLQEVI

SEQ ID NO: 12600 - DNA, 1788 bp, Yarrowia lipolytica CLIB122
  CDS (1)..(1788)
atgacaaccactctagtaaagcaatggcttgatctcgaccagaaccccgtcacccgaaagcagattgaggatctgcagaccgccaatgacaccaagcagctggagactctgctcagcaagcggatctcatttggaactgctggacttcgtgctcgaatggaggctggattcgcgcgaatgaatgacgtgaccgttttgcaggcctctattggactcgcctcctacgtagatcgagaagtccccgacgccacctccaagggtgtggtcattggccatgatcatcggcacaactccgaacagtttgccaagctcacagccctggccttcgtcaacaagggcttcaaggtgtacctgttcaagggccttgtccacacacccatcgttcctttcgccattgatgcccttggagcctcttgtggtgtcatggtgaccgcatcccacaaccccgcggctgacaacggctacaaggtctactggggaaacggatgccagattatccctccccatgatactggcattgccgccgagattgacgctctcgctgacaagaccaccaagtttgaatgggacctgtcaaagttggacaagctcattgagggagagactatcgacaaccgaacagagatgcagcaaaagtataacgacaacctaaagaacctggtgcaccacaagtttgagccctccggccctctggcttcgggtgtcgtctacactgccatgcatggtgtcggctacctgccttctattgaggcattcaagctctttggcattcctctggaagatgttttctctgttcgaaagcagcaggagcccaaccccgatttccccacagtagcattccctaaccccgaagagcacggcgcgctcgatctcgctatgaaactcggtgatgctcagggggctgatctcattgttgctaacgatcccgatgctgaccgattcgctgttgctgtcaaggagaacggagataagtgggtgcagctcactggaaaccagattggtatcctgttttctgcttaccagtgggatcagtacaagaactctggcaagaagattgcgatgctcaactccacagtctcttctcagatgctgaaattcatggctgagaaggagggcttcctgtatgaagatactcttactggcttcaagtggatcggaaaccgagctattgatctcgagaaggagggctacactgtgccctttgcctacgaggaggctattggatatatgttccccggtgtacatgacaaggacggcgtgagcgcgtcactcgtcttccttcagctggctcaggcctatggaggaggcgccaagcttattgagaagctcaactctctctatgacaaatacggccattttgctgagaagaacggctactatattgccaagactcctgagctcaccactgaagcattcaagcatgttcgatcctacttcaaaggtagatttcagaagggcgactaccccaagaccattggtccctttgatgtgaccagctggagagatcttaccactggttacgactccaccactcctgaccacaagcccactcttcctgtttctccatctactgagatgatcactgccactctggccactcacgataaccccgatgagtttattagattcactgctcgaggtagtggaactgagcccaagctcaagatttacattgatgctaaggccgcctccactgagcgagctcaggagcttgcccaggagacctgggatgctctggatgaagagtggtggagacctgaggaaagcggactccagagagtccactaa

SEQ ID NO: 12601 - protein, 595 aa, Yarrowia lipolytica CLIB122
MTTTLVKQWLDLDQNPVTRKQIEDLQTANDTKQLETLLSKRISFGTAGLRARMEAGFARMNDVTVLQASIGLASYVDREVPDATSKGVVIGHDHRHNSEQFAKLTALAFVNKGFKVYLFKGLVHTPIVPFAIDALGASCGVMVTASHNPAADNGYKVYWGNGCQIIPPHDTGIAAEIDALADKTTKFEWDLSKLDKLIEGETIDNRTEMQQKYNDNLKNLVHHKFEPSGPLASGVVYTAMHGVGYLPSIEAFKLFGIPLEDVFSVRKQQEPNPDFPTVAFPNPEEHGALDLAMKLGDAQGADLIVANDPDADRFAVAVKENGDKWVQLTGNQIGILFSAYQWDQYKNSGKKIAMLNSTVSSQMLKFMAEKEGFLYEDTLTGFKWIGNRAIDLEKEGYTVPFAYEEAIGYMFPGVHDKDGVSASLVFLQLAQAYGGGAKLIEKLNSLYDKYGHFAEKNGYYIAKTPELTTEAFKHVRSYFKGRFQKGDYPKTIGPFDVTSWRDLTTGYDSTTPDHKPTLPVSPSTEMITATLATHDNPDEFIRFTARGSGTEPKLKIYIDAKAASTERAQELAQETWDALDEEWWRPEESGLQRVH

SEQ ID NO: 12602 - DNA, 1800 bp, Aspergillus nidulans FGSC A4
  CDS (1)..(1800)
atggcctccctcgagtcagctaatatcgaccaggatcccaccacccgctcggaaatcgagcagcttcgggacactaggcaagccgcagagctagagaaacgcctgcggaagcgcatccagtttggcacggccggtttgcgcggccgcatggctgctgggttttcatgcatgaattctctaacagtcatccaggcgtcgcagggtttggccaagtacttgcgggaaaaccatggcgactttgtacattgcggggtggtcatcggtcatgatgcccgccacaactcagcaagattcgcggttctggccgcgaatgcttttattgcccaggagattccagtttggttctattcagggccggccgttactccggccgtgccctttggcgtgaccgacatgcgtgcccttgcaggtgtcatggtcacagcgagtcatgctacaaagtgtctggttccaccttccagcgtttttatttttctcctaacatcgttcagttatttcaagaatggctgccaaattaactcccctatggacagagagatctccgaatcaattgagcggaatctagagccatggcccaacgcctggactgagtcaccaaccggcaaatacttcaatcccaaaacttatgaagagctgcttccacgttacaccactcgagtctggcattactctaaatccaccgttcaaaactggaggtacccaaagccatttgtttacacccctttgcatggcgtcggaggactggtgcttcccgccctgtgccgctcattaggcatcacggatttcacgacagtaaaggagcaggcggaaccagaccctgacttcccaacgttacccttcccaaatccggaggaaaacggagcgctagatcttgcagttgagacggctgaccgggaaggtaaatctcttatcattgctaacgatccagatgccgatcgatttgctgcagccgagaaagtcgacggcaaatggtttttcttcactggtaatcatatgggagctcttttggcgtctcatctattcgattcgctcgagaatattgatactgacacgcgagttgctgttctgaattccgccgtttcctccacaatgcttgagaaaatggcaagggctaagaatatctactttgaagaatccctcacaggcttcaagtggatgggaaatacatctcgcaaactggaggagtcaggatactacgttacctttgcatttgaggaggctctcggttatatgttcccggaggtttgctacgacaaggacgggattacggcggctatgatcttcctctccgcccaagccagatgggccacgcaaggtctcaccccttacactaaactgcaacaattattcgccgaattcggacaccatgagacgcttaacaattacttccgctcgccgaatccagagacaagcatggcgctattcgacgcgattagagctggtcagttcagatcagaaatgaagctggggccgttcaaaatccttcgatggcgagatatgacagagggttatgattccggcacggaagacaagacaccccggcttcccgctgataagagcagtcagatgctgaccctgtggcttgatcgggacgtacggttcacaattcgcgcatcaggcaccgaagccaaggttaaattctacattgagagctgtggctcgtctaagcaacaagccatcgacgctgtctgtgataccctccgggcagtcgtcaaggaatggatccagccttttgccccgtcattgacctatagcaagcaacttcccacatcatctggatacactcttcagcttgattag

SEQ ID NO: 12603 - protein, 599 aa, Aspergillus nidulans FGSC A4
MASLESANIDQDPTTRSEIEQLRDTRQAAELEKRLRKRIQFGTAGLRGRMAAGFSCMNSLTVIQASQGLAKYLRENHGDFVHCGVVIGHDARHNSARFAVLAANAFIAQEIPVWFYSGPAVTPAVPFGVTDMRALAGVMVTASHATKCLVPPSSVFIFLLTSFSYFKNGCQINSPMDREISESIERNLEPWPNAWTESPTGKYFNPKTYEELLPRYTTRVWHYSKSTVQNWRYPKPFVYTPLHGVGGLVLPALCRSLGITDFTTVKEQAEPDPDFPTLPFPNPEENGALDLAVETADREGKSLIIANDPDADRFAAAEKVDGKWFFFTGNHMGALLASHLFDSLENIDTDTRVAVLNSAVSSTMLEKMARAKNIYFEESLTGFKWMGNTSRKLEESGYYVTFAFEEALGYMFPEVCYDKDGITAAMIFLSAQARWATQGLTPYTKLQQLFAEFGHHETLNNYFRSPNPETSMALFDAIRAGQFRSEMKLGPFKILRWRDMTEGYDSGTEDKTPRLPADKSSQMLTLWLDRDVRFTIRASGTEAKVKFYIESCGSSKQQAIDAVCDTLRAVVKEWIQPFAPSLTYSKQLPTSSGYTLQLD

SEQ ID NO: 12604 - DNA, 1851 bp, Candida albicans SC5314
  CDS (1)..(1851): transl_table=12
atgacagttgataaaaacaaactagacgagctagtcaagtcttggttatctattgatatgaatccagaatcaagacatgaaatcgagcagttacacattagtgggaactatgaacaattggatagaaagttgtcaaagagaattgcgttcggaactgctgggttgagatcgtcaatggagtcggggttttcacacatgaatgacgttactgtgctccaagcttcccaagggttggtcaagtatttattgaaaaagacaccaacatcaattgtaattggatacgatcacagattcaattctcaaagatttgcagagatcttagccagtgttgcactcactcaaggtgtgcacgtttattacttggggtcagttgcaaacttgtctgaagaaacaatgaaattgactaaaggtgatattgaaaacgatagttcaacagatagaggatatgtccatacgccattggttccatttgcaattgattactatggagcatcgggtggagtgatgatcactgcctctcataatccagcaaatgacaatggttataaagtatattatctgaatgggtgtcagattattccgccagttgataaagaaatagctgactctattgaagaaaatttgaccccatgggagggtgtttgggatgtgtatgataatatcaagaagggggtacaaaagggattattgtcacttgctggagatgaggttacaaaagagtatcttaagggagtgaaagagaagttaattcaagacaacaatttagatttcagttttgtttacacaccaatgcatggagttgggtacagaatattcaaagagtgtcttgatttattccatgccctgacttggaatgtggttcaagaacaagcagacccagatcctactttccgaactgttagtttccctaatcctgaagaaaagggtgctcttgatttggctattgaaactgccagaaaattgggttacaaattggttctcgctaacgacccagatgctgatagattcagtgttgcggtcgagaccaagggacagtggaatcaattgactggtaacgaaattgggtttttgtttgcaatgtatgtgattgaacaacaaaaggaacaagatttggaccgtgtatatttggtgaactcaacagtatcgtcacaaatacttaaggcaatggctgataaggatgggttccattttcaagatacgttaacagggttcaaatggattggaaataaagcaattgacttacaaaaagagggatttaaggttccgtttggatacgaagaggctattggatttatgtttgacttggtgcatgataaagatggtatttcggctgctacaatatttttgcaattgtatcagaaatggtttagtggtggcaaaatagatgttacagataaattagaagctgggtatgctaagtatggttggtttaaagattacaatggttattacagactagcagacatgtcaacattagataaaatatttaccaacatcagaggctcctttgatagtaaatccccagaaaatattggcgaattcaaagtaactagttggcgtgatttaacaattggatacgactcgtctactgtcgatcacactcccgttttacctgttgattcaagttcacaaatgataacagccctgttgaagttaccaggtaatgacaatgcagttgtaagatttacttgcagagggtctggtaccgagccaaagttaaaattgtatattgaagggaaatctactatcaatgaacagagtgctaaagaaattgctgttaaatgttgggagaccttaaaacaagaatggtttcaaccggagaaatataatttgacagaagttaaaccgtaa

SEQ ID NO: 12605 - protein, 616 aa, Candida albicans SC5314
MTVDKNKLDELVKSWLSIDMNPESRHEIEQLHISGNYEQLDRKLSKRIAFGTAGLRSSMESGFSHMNDVTVLQASQGLVKYLLKKTPTSIVIGYDHRFNSQRFAEILASVALTQGVHVYYLGSVANLSEETMKLTKGDIENDSSTDRGYVHTPLVPFAIDYYGASGGVMITASHNPANDNGYKVYYSNGCQIIPPVDKEIADSIEENLTPWEGVWDVYDNIKKGVQKGLLSLAGDEVTKEYLKGVKEKLIQDNNLDFSFVYTPMHGVGYRIFKECLDLFHASTWNVVQEQADPDPTFRTVSFPNPEEKGALDLAIETARKLGYKLVLANDPDADRFSVAVETKGQWNQLTGNEIGFLFAMYVIEQQKEQDLDRVYLVNSTVSSQILKAMADKDGFHFQDTLTGFKWIGNKAIDLQKEGFKVPFGYEEAIGFMFDLVHDKDGISAATIFLQLYQKWFSGGKIDVTDKLEAGYAKYGWFKDYNGYYRLADMSTLDKIFTNIRGSFDSKSPENIGEFKVTSWRDLTIGYDSSTVDHTPVLPVDSSSQMITASLKLPGNDNAVVRFTCRGSGTEPKLKLYIEGKSTINEQSAKEIAVKCWETLKQEWFQPEKYNLTEVKP

SEQ ID NO: 12606 - DNA, 1860 bp, Ustilago maydis 521
  CDS (1)..(1860)
atgacacccaacgtgctgactcaggccaaagcttggctcgagaaggatcctgatccgattaccaagaaccggctttccatcctgatcgatagcaatgacaccgaacagctgcaagcaagtttcaacggccgactggagttcggaactgctggtctgcgaggtatcatgggtgtcggtcccagcaaaatgaacctcctcaccgtgctagaaactagcgcaggcttagcagaatacctgctcaagagtgacaaggacaaagtcatcaccaaaggtgttgctattgcctttgatggtcgattcggcagcaaggaatttgcctattcgtcagcgcagcactttgccttccgtggtattccttcgcatatctatccgactcccacgcctacgcccatgtgtggctatgcggtcaagaagttgggacttgcgggaggcatcgttgtcaccgccagtcacaatcccaaagagtacaatggctacaaggtgtacggccccgccggtactcagatcaatacccctgttgatggccttatcgctgacgagatcctaaagatcgctcagcaaacccaaccacccacactgcgcgatctggaagagtgcaagagcaagggcatcatcaaggagtttggcgatgagatgctgaccagctatatcaaggacgttcagcttctcaacacgttcagtagcgctgcagttcatggcaaaggcgcacccattagcatcgcctacagtccgcttcacggtgtcggtgcgccttcgattgagcgattgtccaacgaggtaattggccttacggaaggtgtcaacttctggatctcgcaagagcagaggaagccagatggtgctttcccaacgctcgaattcccaaaccccgaagaactctcgacgctcgagctggtgcataagctctctgaacaacaccagacaggattggctatcgttaacgacccggacgcagatcgtctcgccgtttccgcgcgcgatcaaactggaaaactccgtgctctcactggcgatcagctcggcgctctgctcggcgatgaggttcttcgacgtgcggcaaaagcgcatggtggtaaggctggcatttggacgttgagcaccatcgtttcgagtcgtctcctcgctcgtctttccggacactggggcggccaccacgtcgagacgctcaccggattcaagtggcttggtaacgttgctcgtggtattgaagcacgagagggtgcgggatcttttggtttcggttacgaggaggcgctcggctacatggctgccagctccgtttgggacaaggacggactgtcgtcctacttactgatcgtgtctatggcattcgaccttgccagagaaggcaagacgctgtgggatcgtttggaggagctgcatcgccttgttggtctctctgttaccatgcagaagatcatcaagctcagccctaccatgaagggaacggatgttatgaccaagcttcgtgccgatctcgatgcgggcaaaaatcatgtcacggacaaggctggggccaaatcatatgcgttcagcttggtcgacgatttgaagacaagacctgcttacgaccaggcaaaagccgaaggtggcgatcttagcatccccaaaaacgacgtgcttaggttttatgtacctcccagccacgttgatcctgccgctgcgaagcgtgatcaacaagagatcatgcttggagacgtccgtgtcattgtccgaccgtcgggcacagaacccaaggtcaagatctacactgaagctctaggtcagatcaagaaggatgaacattactcggatgcggtacaacgtgtcacaaaggagctcgaggaggttgtagatgctttctgggattggatgagctaa

SEQ ID NO: 12607 - protein, 619 aa, Ustilago maydis 521
MTPNVLTQAKAWLEKDPDPITKNRLSILIDSNDTEQLQASFNGRLEFGTAGLRGIMGVGPSKMNLLTVLETSAGLAEYLLKSDKDKVITKGVAIAFDGRFGSKEFAYSSAQHFAFRGIPSHIYPTPTPTPMCGYAVKKLGLAGGIVVTASHNPKEYNGYKVYGPAGTQINTPVDGLIADEILKIAQQTQPPTLRDLEECKSKGIIKEFGDEMLTSYIKDVQLLNTFSSAAVHGKGAPISIAYSPLHGVGAPSIERLSNEVIGLTEGVNFWISQEQRKPDGAFPTLEFPNPEELSTLELVHKLSEQHQTGLAIVNDPDADRLAVSARDQTGKLRALTGDQLGALLGDEVLRRAAKAHGGKAGIWTLSTIVSSRLLARLSGHWGGHHVETLTGFKWLGNVARGIEAREGAGSFGFGYEEALGYMAASSVWDKDGLSSYLLIVSMAFDLAREGKTLWDRLEELHRLVGLSVTMQKIIKLSPTMKGTDVMTKLRADLDAGKNHVTDKAGAKSYAFSLVDDLKTRPAYDQAKAEGGDLSIPKNDVLRFYVPPSHVDPAAAKRDQQEIMLGDVRVIVRPSGTEPKVKIYTEALGQIKKDEHYSDAVQRVTKELEEVVDAFWDWMS

SEQ ID NO: 12608 - DNA, 1737 bp, Clostridium thermocellum ATCC 27405
  CDS (1)..(1737): transl_table=11
atgcgaagtagcgcgctttataaattttgggtggagaatgattattttgatgcggaaacaaagaaagaacttttgagtattaaagacaatccgaaggaaatagaagagaggttttacaaggatttggaatttggtaccggcggacttaggggaattatcggtgccgggaccaacagaatcaatatttacaccgtcagaaaagcttcccagggacttgcggattatataaagagtcttggattgcaagacaggggaatagcaattgcttatgattcccgttacaaatccccggaatttgctttggaagctgccaaggtttttgcgggaaacggcataaaagcgtttctttttgatgaattgagaccaacaccggaactttcttttaccgtaaggcatttaaatgcagctgccggtgtggttattacggcgagccataatcccaaggagtataatggatacaaagtttatggagaagacgggggacaacttcctgtagaggcatcaaacaaagttatatcctatataaataaaattgaggatataactcaggttaaggttatggaaaaggacgaagcgatagagaagggtttgctcaggattataggcaaggaaattgacgatgagtatatatcgaaattaaaaactctttctgcaaaccctgaactggctgcagaaataggcaaaactttcaaaatagtgtacacgccgttgcatggcgcaggaaacaaacctgtaagaagaatacttgacgaaattggatttaaaaatgtacttgtggtcaaagaacaggagcttccggacagcgaattttccacggtaaaatcacccaatccggaggaaagggaagcgtttgagcttgccattgagctggcaaaaaaagaaaatgttgaccttatcataggtaccgaccctgactgtgacagagtgggtattgtcgtaagaaacaaagaaggcgagtatgtgcctcttacgggtaatcagacgggttgtttgctgcttgagtacatactgtctcaaaagaagcaaagaggagagcttcctgaaaacggatttgtcgtaaagacaatagttacaacggagcttgccagagctattactgatgcttacaatgtggaacttgtggaagttttgacgggatttaagtttataggcgagaaaattaagcagctggatgagtttggagacaaaaaatatctttttggttttgaagaaagctatggataccttgcaggaacttttgcaagagacaaggacgctgttgttgcatccatgcttattgccgaaatggcggcttattacaaatcaagaggtctgactctttacgagggactgatggagttacttgagaaatatggatacactcttgaaggaattacttcgtttactctcaagggaaaagacggcgtggaaaagataaagtcggctatgaaaaaccttagagaaaacagagttgtaaaatttggagaatatgaagccgttgccgtaagggactatttgacaagtgaacggtatgaagtggcaacgggtgcgaaagagaaacttacacttgttgagtcggatgtgttgtattatgagcttaaggataaagcctggttctgtataagaccttccggcacagagccgaaaataaagatttattatggtgttacagaaaagagtatggatgctgcaaaagagaaattgaaacatttgcaggataatgtactgtcagttatagaaccgcttcttaaagactga

SEQ ID NO: 12609 - protein, 578 aa, Clostridium thermocellum ATCC 27405
MRSSALYKFWVENDYFDAETKKELLSIKDNPKEIEERFYKDLEFGTGGLRGIIGAGTNRINIYTVRKASQGLADYIKSLGLQDRGIAIAYDSRYKSPEFALEAAKVFAGNGIKAFLFDELRPTPELSFTVRHLNAAAGVVITASHNPKEYNGYKVYGEDGGQLPVEASNKVISYINKIEDITQVKVMEKDEAIEKGLLRIIGKEIDDEYISKLKTLSANPELAAEIGKTFKIVYTPLHGAGNKPVRRILDEIGFKNVLVVKEQELPDSEFSTVKSPNPEEREAFELAIELAKKENVDLIIGTDPDCDRVGIVVRNKEGEYVPLTGNQTGCLLLEYILSQKKQRGELPENGFVVKTIVTTELARAITDAYNVELVEVLTGFKFIGEKIKQLDEFGDKKYLFGFEESYGYLAGTFARDKDAVVASMLIAEMAAYYKSRGLTLYEGLMELLEKYGYTLEGITSFTLKGKDGVEKIKSAMKNLRENRVVKFGEYEAVAVRDYLTSERYEVATGAKEKLTLVESDVLYYELKDKAWFCIRPSGTEPKIKIYYGVTEKSMDAAKEKLKHLQDNVLSVIEPLLKD

SEQ ID NO: 12610 - DNA, 1638 bp, Mycobacterium sp. JLS
  CDS (1)..(1638): transl_table=11
atgacttccccggcgacctcgacgaccgtgcaggagtggattgctcacgacccagacccgcacaccgcggcggagttgtccgagtgcagtcccgacgaactcgacgagcggttctcccgctcactgacattcgggacggcggggctgcgcgggccgctgcgcgccggcccgaacgggatgaacctggcggtggtgctgcgcacgacgtgggcggtcgccaaggtgctcaaggaccgcggccgagcgggttcgcaggtcgtcgtgggccgtgacgcccggcaccgctccgacgaattcgcccgcgccgctgccgaagtgctcgccgcacaagggttcgaggtgctgctgctgctggccgccgtaccgacgcccgtggtggcgttcacggtgcggcacatgcacgccgccgcgggaatccagatcaccgcatcgcacaacccgccgaccgacaacgggtacaaggtgtacttcgaggaggggctgcagatcatcggccccaccgacaccgacatcgaggccgcgatcgccgaggcgccgatggccgacgagatcgccagggccgaagtggaaaccggcggcatggaggagatcgcccactacgtcgaacgggcggccaacgtccggtactcgacggccccggtgcgggtggcgttcaccccgatgcacggggtgggcggtgagtacgcgatggacacgttcgtgcgggcaggcatcaccgatgtccacgtggtcgacaaacagttcgcacccgaccccgacttccccaccgtgtcgctgcccaacccggaagaaccgggtgcggtcgacgcgctgctcgaactggccgccgacgtcgacgccgacgtcgcgatcgcgctcgacccggacgccgaccggtgcgcggtcggggtgccgacacccgacggctggcggatgctctcgggggacgaaaccggttggctgctgggcgattacattcttgaccaggtcgagcccggcgaggtcatggacgcgaccgtggtggccagcaccgtggtgtcgtcgcgaatgctcgcggcgatcgccgccgcgcacggcgcccactacgtcgaaacgctcaccggcttcaaatggctctcccgcgccgacgacgacctacccggcaagaccatggtgtacgcctacgaggaggccatcggccactgtgtggatccggccgcggtgcgcgacaaggacggcatcagtgcggcggtgttgttctgcgacctcgtcggcgtgctgaaacagcacggccgcaccgtgctcgacgtcctcgacgacctggcccgccgccacggcgtccatgtcaccgcggccgtcagccgcccggtcgccgacgccgacgaagccgccggggtgatggcccggctgcgggacaccccgcccgatcgcctcgccgggcacgaggtcgccgtcaccgacctgaacacctcacccgcgccgatgcgctcggatgcgctgatcctgagcggcggggatgccgacacctcggtgcgcatggtcgtgcgaccatccgggacggaaccgaaagtgaagtcctacatcgaggttcgacgcgcctgcgccggcgacgtggggcgggcgcgcgccgaggcgcagcggttgcgcgacgaactggtggccctggcgcaacagtggtga

SEQ ID NO: 12611 - protein, 545 aa, Mycobacterium sp. JLS
MTSPATSTTVQEWIAHDPDPHTAAELSECSPDELDERFSRSLTFGTAGLRGPLRAGPNGMNLAVVLRTTWAVAKVLKDRGRAGSQVVVGRDARHRSDEFARAAAEVLAAQGFEVLLLLAAVPTPVVAFTVRHMHAAAGIQITASHNPPTDNGYKVYFEEGLQIIGPTDTDIEAAIAEAPMADEIARAEVETGGMEEIAHYVERAANVRYSTAPVRVAFTPMHGVGGEYAMDTFVRAGITDVHVVDKQFAPDPDFPTVSLPNPEEPGAVDALLELAADVDADVAIALDPDADRCAVGVPTPDGWRMLSGDETGWLLGDYILDQVEPGEVMDATVVASTVVSSRMLAAIAAAHGAHYVETLTGFKWLSRADDDLPGKTMVYAYEEAIGHCVDPAAVRDKDGISAAVLFCDLVGVLKQHGRTVLDVLDDLARRHGVHVTAAVSRPVADADEAAGVMARLRDTPPDRLAGHEVAVTDLNTSPAPMRSDALILSGGDADTSVRMVVRPSGTEPKVKSYIEVRRACAGDVGRARAEAQRLRDELVALAQQW

SEQ ID NO: 12612 - DNA, 1698 bp, Clostridium difficile 630
  CDS (1)..(1698): transl_table=11
atggattatactaaaacttatgaagagtggataaagggttcatattttgatgaagatacaaagctagagttggagaatataaaaaataatgaaaaagaaatagaggatagattctataaggatttagaatttgggactgcgggtcttagaggaataattgaagcaggaacgaatagaataaataagtacacagttagaagagctacttttggattggcaaactatatattagaaaacacaacaaaagaagaaacaagtagaggagtagtaatagctcatgataatagacacaagtctagacaattctgtatagaatctgcaaatactttggcagcatgtggtataaaagcatatatatttgatagtttgagaactactccagaattatcttttgctgttagaagcttaaacgcaatcgctggtatagtcataacagcaagccataatcctccagaatataatggatataaggtatactgggaagatggagcacaagttatgccagagattgcaaatgcaataacagagaaagtaaatagtatacatgattatagtacaataccaaccttaacggaagctaataaaaatttggtagttttgttggacgaatcacaagatactaaatttatagaagcagtaaaaagccaaattataagaaaagatttagttaaaaatgtaggtaaaagctttaagatagtttatacacctctttgtggaacagggaatgttccaataagaagagcattgaaagaagttggttttgaaaatataattgtagttccagaagaagaaaatccagacccaaattttgcagggcttgattatccaaatccagaagagaaaaaagctttaaatagaggtatattactcgcaaaagaaaaaggagcagaccttgtaatagcaactgacccagattgtgatagagtaggtgtagcagtaaaaactactacaggtgagtatgctttacttacaggaaatcaaattggtggtatgctgacacattatataatagaaggattaaaagaaaataacaaattaaaagaaaatcctacaataataaaaaccatagttacatcagaatttggagcagatatagctaaagcaaataatgttgatgtattaaatgttcttacaggttttaaatttattggtgaaaaaataaaattatttgaacaaaataaaaatagaagttatgtatttggatatgaagaaagttatggttacttagttgggactcatgctagagataaagatggtgtagtttcttcattgttaatatctgaaatggcagcattttactattcaaaaggtatgagtttatatgatggtttaatagaactttataaaaagtatggatttttcaaagaacagactatatctttgactttaaaaggtatagaaggtgtagaaaagataaaagaaataatatcttattttagagaaaatcaaattgattatataaatagtattaaagtagttgataaaaaagattataaaaatggtatagataatcttcctaaatctgatgttttaaaatactttttggaagatgaatcttgggtagctataagaccatctggaacagaaccaaaacttaaattttacatagctgtaaaaggagctagtgatattgaagcagataaaaagattcaaggtttgaaaaagtatatagatgacatggtcgaaaaattaaaataa

SEQ ID NO: 12613 - protein, 565 aa, Clostridium difficile 630
MDYTKTYEEWIKGSYFDEDTKLELENIKNNEKEIEDRFYKDLEFGTAGLRGIIEAGTNRINKYTVRRATFGLANYILENTTKEETSRGVVIAHDNRHKSRQFCIESANTLAACGIKAYIFDSLRTTPELSFAVRSLNAIAGIVITASHNPPEYNGYKVYWEDGAQVMPEIANAITEKVNSIHDYSTIPTLTEANKNLVVLLDESQDTKFIEAVKSQIIRKDLVKNVGKSFKIVYTPLCGTGNVPIRRALKEVGFENIIVVPEEENPDPNFAGLDYPNPEEKKALNRGILLAKEKGADLVIATDPDCDRVGVAVKTTTGEYALLTGNQIGGMLTHYIIEGLKENNKLKENPTIIKTIVTSEFGADIAKANNVDVLNVLTGFKFIGEKIKLFEQNKNRSYVFGYEESYGYLVGTHARDKDGVVSSLLISEMAAFYYSKGMSLYDGLIELYKKYGFFKEQTISLTLKGIEGVEKIKEIISYFRENQIDYINSIKVVDKKDYKNGIDNLPKSDVLKYFLEDESWVAIRPSGTEPKLKFYIAVKGASDIEADKKIQGLKKYIDDMVEKLK

SEQ ID NO: 12614 - DNA, 1707 bp, Clostridium difficile 630
  CDS (1)..(1707): transl_table=11
atggattataagaataattatgagatgtggttaaattctccttattttgatgaacaaacgaaaaatgagctattaagtataaaagatgatgaaaaagaaatacaagatagattttataaaaatttagagtttggaacaggtggtttaagaggtataataggagcgggaactaatagaatcaatatttatactgttagacgtgcgacactgggcgttttaaattatatcatgaaaactcaaggagaagaaggtaagcaaaagggaatagttatagcacatgatagtagatacatgtctagggagttttgtatagaagtagcaaagactttaagtgcttatggtgtaaaggcttatatttttgaagaattaaagcctacaccagaactttcttttgctgttagatatttaaagtgtgctatgggaatagtaataacagcaagtcataatcctaaagaatacaatggatataaagtatatgactcagatggtggtcaaatctgtatagatatggcaaatgatataatagcagaagttaataagattgatgattacagtactattaaaagtatagattttgaagaagctttatctaaaaatttaataactatattagataatgaagtagatgatgagtttataaaagctgttaagaaacaagttttaagacaaaatataatagatgaatacgggaaaaaattaaaaataatatatacacctattcatggtacaggaaataagccagtaagaaaagtcttaaatgaatgtggttttgaaaatgtaatggtagttaaggagcaagaattgccagattctaatttttcaacagtaaagtatcctaatcctgaagaaaagtcagtgtttaatatagctattgaaatggcaaagaataatggcactgatttgataataggaacagaccctgattgtgatagagtaggtatcgttgtaaaagattcaagtggtgaatatgtagtcttaaatggaaatcaagtcggttcacttttagttagatatatattagagagtttagttgaagaaaataaacttcctaaaaacaatcctacaataataaaaactatagttacatcagaactaggtgcaaaaatagcaaaggcttataatgtagattgtttaaatactttaacaggatttaaatttataggagaaaaaataaaagcgtttgaagaaagcaatgatagaagttttataatgggatatgaggaaagctatggttacttaattggaactcatgctagagataaggatggtgttgtatcttcacttatgatatgtgaaatggcagcatactattcttcaaaaggtatgaacttgtatgaagctttgatagatacatataataaatttggatactacaaagaggacttaaagtcagtaactttaaaaggcatagatggaataaaaaaaataaaagagatgatgctttactttagaagtgttaaaatagataatgtggctgatgtaaaagtagataaaattttagactataaagatggtgttgatgatttacctaagtcagatgtacttaaatttttacttgaagatggttcttggatagctataagaccttcaggtacagaacctaaaattaaattttactttggagcaaattcagacaatcaagaagatgtagaatttaagttgaacaatttaatatcttatatattaaatgtagtggattctatataa

SEQ ID NO: 12615 - protein, 568 aa, Clostridium difficile 630
MDYKNNYEMWLNSPYFDEQTKNELLSIKDDEKEIQDRFYKNLEFGTGGLRGIIGAGTNRINIYTVRRATLGVLNYIMKTQGEEGKQKGIVIAHDSRYMSREFCIEVAKTLSAYGVKAYIFEELKPTPELSFAVRYLKCAMGIVITASHNPKEYNGYKVYDSDGGQICIDMANDIIAEVNKIDDYSTIKSIDFEEALSKNLITILDNEVDDEFIKAVKKQVLRQNIIDEYGKKLKIIYTPIHGTGNKPVRKVLNECGFENVMVVKEQELPDSNFSTVKYPNPEEKSVFNIAIEMAKNNGTDLIIGTDPDCDRVGIVVKDSSGEYVVLNGNQVGSLLVRYILESLVEENKLPKNNPTIIKTIVTSELGAKIAKAYNVDCLNTLTGFKFIGEKIKAFEESNDRSFIMGYEESYGYLIGTHARDKDGVVSSLMICEMAAYYSSKGMNLYEALIDTYNKFGYYKEDLKSVTLKGIDGIKKIKEMMLYFRSVKIDNVADVKVDKILDYKDGVDDLPKSDVLKFLLEDGSWIAIRPSGTEPKIKFYFGANSDNQEDVEFKLNNLISYILNVVDSI

SEQ ID NO: 12616 - DNA, 1695 bp, Streptococcus pyogenes str. Manfredo
  CDS (1)..(1695): transl_table=11
atgacttacaacgaggtatatcaagaatggttgcacaataatgatcttagtgatgatattaaagcagatttagcagccataaaagacaatgaggctgagattcaagatcgtttttacaaaacacttgaatttggaacagcagggctaagaggaaaacttggagcaggcaccaatcgcatgaatacctatatggttggtaaggcagcacaagctttagctaatactattattgatcatggacctgaagcagttaaaaagggcattgcggttagttatgatgttcgctatcaatctagaacatttgcagaattaacatgctctattatggcagctaacggtattaaggcgtacctttataaagggattcggccaacaccaatgtgttcgtacgctattcgtgctttgggatgtatctctggtgttatgattacggctagtcacaatccccaagcttacaatggttacaaagcttattggcaagaaggttctcaaattttggatgacattgcggatcaaattgcacaacacatggctgcactaactcagtatcaggaaatcaaacaaatgccttttgaaaaggctctggacagtggacttgttacttatattgatgagagtattgaagaagcatataaaaaagaagtgcttggtttaacgattaatgatactgacattgataagtcagtccgagtagtctatactcctttaaatggtgttgggaatctaccagtgcgtgaggttttaagacgccgcggttttgaaaatgtttatgtggtacctgagcaggaaatgcccgatcctgattttacgacagttggctatcctaatcccgaagtccctaaaacttttgcatattcagaaaaattaggtaaggcagttgatgctgatattttgattgcaactgatccagattgtgaccgtgtggctttagaagttaaaaacgcagtcggtgactatgtttttctcaatggcaataaaatcggagcgcttttatcttactatatcttttcacaacgatttgacttaggtaatttaccggctaatcctgttttagtgaaatccattgtaacaggagacttgtcacgggctattgctagccattatggtattgaaaccgttgaaacattgactggttttaagaatatttgtggcaaggcaaacgaatatgatgtgacgaaacagaaaaactatctgtttggttatgaagaaagtattggtttttgctatggcacttttgttcgtgacaaagacgctgttagcgcctctatgatgattgtagaaatggcagcttactacaagaaaaaggggcagaatttactagatgttttgcagactatttatgcgacatttgggtattataatgaacgtcaaattgccttggagcttgaggggatagaaggacaaaaatgcattgcgaggataatggaagatttcagacagacaccaatagctagtgttgcagagatggcgttagacaagacaattgattttattgatggctatcaagattttccaaagcaaaactgtctcaaattttatttggatgatggttcttggtatgcacttagaccatcaggaacagagcctaaaataaaattttatttatatactattggccaaacacaagaaaatagtgcaacaaaattagatgctattgaagcagcgtgtcgcacaaaaataaatcaggttaattaa

SEQ ID NO: 12617 - protein, 564 aa, Streptococcus pyogenes str. Manfredo
MTYNEVYQEWLHNNDLSDDIKADLAAIKDNEAEIQDRFYKTLEFGTAGLRGKLGAGTNRMNTYMVGKAAQALANTIIDHGPEAVKKGIAVSYDVRYQSRTFAELTCSIMAANGIKAYLYKGIRPTPMCSYAIRALGCISGVMITASHNPQAYNGYKAYWQEGSQILDDIADQIAQHMAALTQYQEIKQMPFEKALDSGLVTYIDESIEEAYKKEVLGLTINDTDIDKSVRVVYTPLNGVGNLPVREVLRRRGFENVYVVPEQEMPDPDFTTVGYPNPEVPKTFAYSEKLGKAVDADILIATDPDCDRVALEVKNAVGDYVFLNGNKIGALLSYYIFSQRFDLGNLPANPVLVKSIVTGDLSRAIASHYGIETVETLTGFKNICGKANEYDVTKQKNYLFGYEESIGFCYGTFVRDKDAVSASMMIVEMAAYYKKKGQNLLDVLQTIYATFGYYNERQIALELEGIEGQKCIARIMEDFRQTPIASVAEMALDKTIDFIDGYQDFPKQNCLKFYLDDGSWYALRPSGTEPKIKFYLYTIGQTQENSATKLDAIEAACRTKINQVN

SEQ ID NO: 12618 - DNA, 1719 bp, Streptococcus pyogenes str. Manfredo
  CDS (1)..(1719): transl_table=11
atgacttacacagaaaattttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattagcaaaattaatcgaaactaagggagaggaagctaaaaaacgtggtgtagccatcgcttatgattcgcgccacttctctccagaatttgcttttgagtctgcacaggtcttggcacagcatggaattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgcgctattgaaaatccatttgcagttgaacttgctgatttagatgaaagcaaatcatcaggtcttattcaagttatcggtgaagatgttgatatggaatatcttagagaggttaaagatgttaatatcaatcaagatttaatcaataactttggaaaagacatgaaaattgtctatactcctctccacggaactggtgagatgttgacacgccgtgcccttgctcaagccggttttgaatctgttgttgtagtcgaatcacaagctaaggcagatccagacttttctactgttaaatcgcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttatggcgctacaatgtttaacgttttaactggattcaaattcatcgctgagaaaattcaagagtttgaagaaaaacataaccacacctatatgtttggttttgaagaaagcttcggatatcttattaaaccatttgtccgtgataaagatgctattcaagcagttcttttggttgctgagatcgcagcttattaccgttcgcgtggtttaacacttgcagatggtattgatgaaatttacaaagaatatggctattttgctgaaaaaacgatttcagtaacactttcaggtgtggatggagctgctgaaattaagaagattatggacaaattccgtgaaaatggtccaaaacaatttaacaatactgatattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacaataggtgatactcttgacatcgctcaagaaaaaattgctaacattgaaacagaaatcaatacctttgttggctaa

SEQ ID NO: 12619 - protein, 572 aa, Streptococcus pyogenes str. Manfredo
MTYTENFQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDESKSSGLIQVIGEDVDMEYLREVKDVNINQDLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFNNTDIVLLEDFQKQTATKNDGTISNLTTPPSNVLKYTLADDSWIAVRPSGTEPKIKFYIATIGDTLDIAQEKIANIETEINTFVG

SEQ ID NO: 12620 - DNA, 1617 bp, Dichelobacter nodosus VCS1703A
  CDS (1)..(1617): transl_table=11
atgtctactttaattgaacaggcgcaagcatggcttgcccaagatcccgattcggaaacgcgcgccgaattacaagcgtttattgatgccaacgatgaagcggaattaaaacgccgttttgaagggcgcttgcaatttggcacggcgggtttgcgcggacgtttgcaggcgggacccaatggcatgaatcgtgtattagtggcgcaggcggcagcgggtttggcgcgttatttgggcgccggaaaaaaagtggttatcggttatgacgggcgcaaacattcgcgccgttttgccaaagatacggcagaaattttgcaagcatcaggaattgaagcttatttaatgcctgatttacgtccgacgccagttttggcttttgctttgcgcgtttatcaagctgatgctggtgtgatggtgacggcgagccataatcctgccgaagataacggttataaagtttatttgggcggtgaacatcgtggggcgcaaattgtgccgccagctgatgccgatattgccgcggaaattgattatgtggcgcaacatttacgcgttaacgaattgccgcgggatattcattatcatctgattccgatgtcggtgattgatcaatatattgaacgcacggcagcggtgtttcaaagtaaaccggttttaatgaattacgtttataccgcgatgcacggcgtgggcacggaaactttgctcgatactttgcacgcggtgggattaacgcaaccgcaattggtggaaacgcaggcgcaacctgatgcgaatttcccaacggtagcatttcccaatcctgaagaaaaaggcgctttggatttggcaattgagttggcaaaaaaagtcaacgcggaatttattattgccaacgatcccgatgctgatcgtttggcggtagcattgccgagttctgaaggcgtttgggaacgtttgcacggcaatatggtgggattgtatttggcgtggcatttagcgcaacgcgcgcaggcgcaaggaaaaaaaggtgtttttgcctgttcattggtttccagtccgttattgaaaaaaatcgccgccgcgtacgatatgacgtatcaagaaacgccgaccggttttaaatggattggcagaattgaggggctgatttttggttttgaagaagctttgggttatctcgttgatgccgataaagttgcggataaagatggtatttctgccgcgattgcttttttggatttaatggcaaccttaaaagcgcaaggcaaaacgtttttggattatatgcaagcatttcaagcgcaatttggcgcttttcacagccaacaaatcagtatacgtattgaagataatgaaaaaattaatcgtattatcaatgtattgcgtgaaaaaccttttgaaaaagtgggcgattatcgcgtgatgcattattgcgatcatttaaaaacggcaatggcaagtaatatgttggtatttgaattggtggacggtcatcgcgtgatcgtgcgtccatcgggcaccgaacccaaattaaagatttatttagatacttttgccgataatcaaaaaacagctgccgaaatcgccgcgcaattagcgatgaatatcgaacaatttttaaaaatgacgaattga

SEQ ID NO: 12621 - protein, 538 aa, Dichelobacter nodosus VCS1703A
MSTLIEQAQAWLAQDPDSETRAELQAFIDANDEAELKRRFEGRLQFGTAGLRGRLQAGPNGMNRVLVAQAAAGLARYLGAGKKVVIGYDGRKHSRRFAKDTAEILQASGIEAYLMPDLRPTPVLAFALRVYQADAGVMVTASHNPAEDNGYKVYLGGEHRGAQIVPPADADIAAEIDYVAQHLRVNELPRDIHYHLIPMSVIDQYIERTAAVFQSKPVLMNYVYTAMHGVGTETLLDTLHAVGLTQPQLVETQAQPDANFPTVAFPNPEEKGALDLAIELAKKVNAEFIIANDPDADRLAVALPSSEGVWERLHGNMVGLYLAWHLAQRAQAQGKKGVFACSLVSSPLLKKIAAAYDMTYQETPTGFKWIGRIEGLIFGFEEALGYLVDADKVADKDGISAAIAFLDLMATLKAQGKTFLDYMQAFQAQFGAFHSQQISIRIEDNEKINRIINVLREKPFEKVGDYRVMHYCDHLKTAMASNMLVFELVDGHRVIVRPSGTEPKLKIYLDTFADNQKTAAEIAAQLAMNIEQFLKMTN

SEQ ID NO: 12622 - DNA, 1779 bp, Candidatus Protochlamydia amoebophila UWE25
  CDS (1)..(1779): transl_table=11
atggaactcgctgaaaaacccctttttgatttagtcacgcagaaaaatgttaatctatggctagaaggtcaatacgatgtagctacaaaagcagaaattaagcaactccttttagaagaccctaaacatattgttgatgcattttttacgaatctgacttttggaacgggaggacttagaggaatcatgggagttggaactaatcggatgaacttttacactgtccgagccgctacacagggattagccaattacatcaataagcaacccaatgaaactcaaaaaaaacgagcagtatttattggttacgactctcgtcatcactccagggaatttgctgaagaaactgccaaagtattagcagctaataaaattcacgtttatctgtttaaagatattcgccccactccccttgtttcttttgcttgccgttataaaaaatgtatagcagctgtcatgattacagcttctcacaacccccctgaatataacggttataaagtttattggtctgatggaggacaattagtgccccctcatgatgatggagtcattgcagaagcttcaaaaattgtcgatcccaatcaggtaaaagtttgtcattcccttgacgacttattaatcgaagaaattgacaatgaaattgatgaagcctatttgaaggcaattcgtcctcttcagcattaccctgaaataaatcgaaagcaaggcagccaattaaaaattgcctatactagtttacacggaacgggaattacgatggctcccctagccttaaaggaatggggatttaccaattatgtttttgttgaacctcaagtcattcccgatggtaccttcccaactgttcgatttcccaatccagaagaaccagctgccttaaaactcggtatcgaattaatgctacaatcaaaatgtgatcttttaatcgctaatgatccagatgccgacagaatgggaattgctgtccttcacaatggagaagctgttttattaaatggaaatcaaatttgtgcccttcttctcgaacacgtctgtgaggctttagctaaacaaaaaaaacttcctgaaaaagctgcttttattaaaacgattggaaccacagagctttttcaagccatttgtgatgcctatgagagaccctgctttaatgtattaacaggctttaagtatattgctgaaaaaattcatgaatgggaattattcaaagggagacaccaatttatttttggtggagaagagtcatacggatatctattggggactcacgcacgcgacaaagatgctattgtttgtagcgcacttatctctgaattagctttaaaagctaaattagaaggaaaaactttgctagataaacttcatgacctttatcacaaatatgggatttatcaagaaaaattactttcaattaactttggcgaaactaaagaaggaaaagagcaaatgtctttgggaatgcaaaaacttcgctctacacatctgaaaaatatttgcggtatccctgtcatggtgattgaagattatttattatccaccaaaattcatttagaaacaaatcaaacagatcctattactctacccatttcagacgttcttttatactggctcaaggatggcacaaaagtgatggttcgtccttcaggaactgaacctaaagttaaaatttattgtggacttgtagaaaaacaatttacaacgattgaacaaggtcttgaaataagtaaaacaagatgtgatcaattattgaattttatgaaaacacatctcatgtcttaa

SEQ ID NO: 12623 - protein, 592 aa, Candidatus Protochlamydia amoebophila UWE25
MELAEKPLFDLVTQKNVNLWLEGQYDVATKAEIKQLLLEDPKHIVDAFFTNLTFGTGGLRGIMGVGTNRMNFYTVRAATQGLANYINKQPNETQKKRAVFIGYDSRHHSREFAEETAKVLAANKIHVYLFKDIRPTPLVSFACRYKKCIAAVMITASHNPPEYNGYKVYWSDGGQLVPPHDDGVIAEASKIVDPNQVKVCHSLDDLLIEEIDNEIDEAYLKAIRPLQHYPEINRKQGSQLKIAYTSLHGTGITMAPLALKEWGFTNYVFVEPQVIPDGTFPTVRFPNPEEPAALKLGIELMLQSKCDLLIANDPDADRMGIAVLHNGEAVLLNGNQICALLLEHVCEALAKQKKLPEKAAFIKTIGTTELFQAICDAYERPCFNVLTGFKYIAEKIHEWELFKGRHQFIFGGEESYGYLLGTHARDKDAIVCSALISELALKAKLEGKTLLDKLHDLYHKYGIYQEKLLSINFGETKEGKEQMSLGMQKLRSTHLKNICGIPVMVIEDYLLSTKIHLETNQTDPITLPISDVLLYWLKDGTKVMVRPSGTEPKVKIYCGLVEKQFTTIEQGLEISKTRCDQLLNFMKTHLMS

SEQ ID NO: 12624 - DNA, 1674 bp, Listeria monocytogenes str. 4b F2365
  CDS (1)..(1674): transl_table=11
atgacttggcaacaacatttgaacgcttggcaaaatgccgatttatcagatgagtggcgccgtgaattacaacgagtggaacaggagcgggaacgatttgatggttatttaacctttgggactggcgggatgcgcggtaaaatgggcgttggaacgaagcgcatcaatctttttatcattagacgagtagcgaaaggtttgggagattatgttgtcgcgaatggaggagccgaaatgggtgttgcgattgcgtatgactcgagacatcattcgggtgcttttgcgcaggaaacggcaaaggtcctggcggcgcagggagtcaaagtttatttatccgatacgattcgcccaacaccagcgctatctttttgcgttcgagaaaagggggcatttgcgggcgttgtgattacagcaagccacaatccttctatctataatggtttcaaagtatatgataaaaatggctgtcaaatcacattgggtgtagcgcaggaaattgctggctatttagaaaacataacggatatctttaccataccagtgcgcgaattacccaatccactcgttatgacgctaggaaaagaaatggacgatgcttatttaaaagctttaacagcagtcgtttctcgccctgatttgcttgctgactacggtaatgaactacagatttgctacacaccgcttcatggagctggaaaagaacttgttatgcgtgggcttttggaaaatggattttcggaaacgaccatgattgctgagcaaagtgagcctgacgggggttttccgacagtggtttcgcctaatccagaagaagaaaacagttttgaactagccaaaaagcaggcgaaagaaatacaagccgatattattttggcgacagatccggatgctgataggctgggggtagctgttttaaacaagcaagctacgtatcaaattttaacagggaatcagctaggcgcattgcttttacagtatattttagaagccaaaacgtcggtaactcaggcggatacgatgattaatacaattgttactggggacttaggtggaagaatcgcgcatgactttggaattaatcatatccagacgctcacgggtttcaaatttatcggtgaaaaaatagccgaaatggaaggcacggaaaaaaactttctttttggatacgaggaaagttacggttatttaatcgcgccatttgttcgggacaaggacgccgttcaggcagcattacttacagcagaaatggcccttttctataaaaaagaaggaacaacacttcttcaaaaactaacaaatttatatgaaaagttcggctatcataaagaacacttgcacacgattacgctagatgatagcgatggaacaactaaaatgaatcaagtgatagacgatttgcgcaaagagccaacttgtattcccggcataacggttttagaagactttctaacgagtaagcgaaccaatctttcaacgatggaaatgacaaacatagagctaccaaaagaaaatgttttaaaattttacttaaacgataacgcctggtttgcaatacgtccttctggaacggaaccgaaatgcaaaatctatttccaaacaatcggtcaaacagaagaaatagcgacaaaagctatggatgagttgaaaaaatgcgttttagccaaatgggattaa

SEQ ID NO: 12625 - protein, 557 aa, Listeria monocytogenes str. 4b F2365
MTWQQHLNAWQNADLSDEWRRELQRVEQERERFDGYLTFGTGGMRGKMGVGTKRINLFIIRRVAKGLGDYVVANGGAEMGVAIAYDSRHHSGAFAQETAKVLAAQGVKVYLSDTIRPTPALSFCVREKGAFAGVVITASHNPSIYNGFKVYDKNGCQITLGVAQEIAGYLENITDIFTIPVRELPNPLVMTLGKEMDDAYLKALTAVVSRPDLLADYGNELQICYTPLHGAGKELVMRGLLENGFSETTMIAEQSEPDGGFPTVVSPNPEEENSFELAKKQAKEIQADIILATDPDADRLGVAVLNKQATYQILTGNQLGALLLQYILEAKTSVTQADTMINTIVTGDLGGRIAHDFGINHIQTLTGFKFIGEKIAEMEGTEKNFLFGYEESYGYLIAPFVRDKDAVQAALLTAEMALFYKKEGTTLLQKLTNLYEKFGYHKEHLHTITLDDSDGTTKMNQVIDDLRKEPTCIPGITVLEDFLTSKRTNLSTMEMTNIELPKENVLKFYLNDNAWFAIRPSGTEPKCKIYFQTIGQTEEIATKAMDELKKCVLAKWD

SEQ ID NO: 12626 - DNA, 1731 bp, Listeria monocytogenes str. 4b F2365
  CDS (1)..(1731): transl_table=11
atgaattggcaagaagaatatcaaaaatgggttgctaatgacaaattagatagcacattaagaaaacaattaacgaatatggaagcaaatgaaaaagaacttgaggatagtttttatcgtaatatggaatttggaacggctgggatgcgtggtgtactaggcgctggaacaaaccgcatgaatatctatactattcgtaaggcttctctaggtttggcgcaatttgtggcggagaacggggaagaggctaaaaaacgtgggatagttattgcgtatgatcctcgtcatatgtcgcgtgaatttgcttttgaatcggcggcggtattagggcatcatggtgtgaaaagctatgtttttgatgcgcttcgaccaacacccgaactttcctttgcagtacgtcatttaaatgcgtttggtgggattgttattacagctagccataacccaccagaatacaatggctacaagatttatggtgaagatggcggacaaatgcctccaacaggggcaagtgctgtaattgaatacataaacgcggtagaggatattttttctgtagaagtagcgaaccaagagctattaattgaaaatggtttacttgaggtaatcagtgaaaaagtagaccgtccatatttggaaaaattaaaagaggttattgtcaataaagagcttgttcaagaacgaggggaggatttgaaaattgttttcacgccccttcatggtactggcggaattcttggcgttcctgcgcttgaaagtgttggctttacgaatattgttaaggttgacgagcaatttgtgaatgatcccgattttggaacggtaaaatcgcctaacccggaaaaccgcgaagcctttttacttgcgattgaatatggtaagaagtttggtggcgacattttagtcggaacagatccggatgctgaccgtttaggcgtggcagttcgtaatcttgacggcgaatatgaagtgttatctggaaaccaaattggcgcgattattttacattatttattaaaacaaaagaaagcgcaaaatgaattgccagctaatgcagcggtattaaaatctattgtaacaagtaatcttggaacagaaatcgcgaaacattacggtgcggaaatgattgaagtattaactggtttcaaatttattgcagaacaaattaagcactttgaagaaactggcaagcatacgtttgaatttggttatgaagaaagtaatggttatatggttaagccgtttacgcgtgataaagatgcgattcaagcggtgcttgcgattgcggaagtggcgctcgttagcaaagtagaaggtggaagtttactagaagatttagagcaaatttatgctgagtttggctattacaaagaagatctagtttccttaactttaagcggtaaggatggttctcggcgcatcaaagaaattacaagtaattttcgcgagcaactaccaacaagtatgggtggattccccgtggaacgtgcggaagattatttaagaagcgaaacaacttggattgctaccggaaaaacggaagcgattcatttgccaacagcagatgtcattaaatgttattttgaagatggttcatggttctgtttacgtccatccggcacagaaccgaaaatcaaattctactttagtattcgtggtgaaagtaaagaagaaagtgcaacaaaattagaaaaagtgaaagctgatttgatgcaacatatcgaagcttaa

SEQ ID NO: 12627 - protein, 576 aa, Listeria monocytogenes str. 4b F2365
MNWQEEYQKWVANDKLDSTLRKQLTNMEANEKELEDSFYRNMEFGTAGMRGVLGAGTNRMNIYTIRKASLGLAQFVAENGEEAKKRGIVIAYDPRHMSREFAFESAAVLGHHGVKSYVFDALRPTPELSFAVRHLNAFGGIVITASHNPPEYNGYKIYGEDGGQMPPTGASAVIEYINAVEDIFSVEVANQELLIENGLLEVISEKVDRPYLEKLKEVIVNKELVQERGEDLKIVFTPLHGTGGILGVPALESVGFTNIVKVDEQFVNDPDFGTVKSPNPENREAFLLAIEYGKKFGGDILVGTDPDADRLGVAVRNLDGEYEVLSGNQIGAIILHYLLKQKKAQNELPANAAVLKSIVTSNLGTEIAKHYGAEMIEVLTGFKFIAEQIKHFEETGKHTFEFGYEESNGYMVKPFTRDKDAIQAVLAIAEVALVSKVEGGSLLEDLEQIYAEFGYYKEDLVSLTLSGKDGSRRIKEITSNFREQLPTSMGGFPVERAEDYLRSETTWIATGKTEAIHLPTADVIKCYFEDGSWFCLRPSGTEPKIKFYFSIRGESKEESATKLEKVKADLMQHIEA

SEQ ID NO: 12628 - DNA, 1542 bp, Mycoplasma mobile 163K
  CDS (1)..(1542): transl_table=4
atgaaagaattagaatttggaactgcaggattaagaggaattttaggtaaaactaaagagcatttgaatattttccatgtagcaagagtaattgaaggttttgcaaaatatttgaaatcagaaacttttaattgaaaaaataaaattgtaataatcggaagagataatcgaagaaaatcaagagagttttcaagattggcagcaagtattttagcttttcacaaaataaatgttttaatttctagagaaattattgcgaccccaattataagttatgcaacaaaatatcataaggcacttggtgctattaatattacagctagtcataatccaaaagaatataatggaattaaactttatgataaaaatggctcacaaattttgccagatgttgttgataaaattaaatctaattttttaaattatgaagattatacaaaaaagcaagcactaaatcaatttatttttagtattaaaaataaatacataaattatattccaaaacaaactttgcaatcatatgaagaaaaagttttaaaagttggtggcagccaaaaaaatctatcaaatatcaatttatcttttagtcctcaacatggaacaggtgctaaaatagttaaatctatttttaaaaaattaaatgtaaatgctttttttgaagaagcacaaatgaaaaatgatccggattttactcatacaaaaagtccaaatccagaagataaatcttcttatgaaaatgtaattaaattaggtttaattcataaatcagatgctgttctaattacagatccagatgcagatagggtaggaattggaattttaagaaataatgagtacattcttctaaacggaaacgaaacagcaactttaatttttaattatttgattgaaataaacgaaaataaattgcaagataaatatttaatttattcctttgtttcttcaagtttacctaaaaaaatggcaattgaaaacaatataaaatggtatgaagttgctacaggatttaaatatataggaaatttaattgaacaaatcaaaaatgaatcaaaaacttcaaaattattatttgcctttgaagaatcatatggatctctgataaatgattcattagcatatgataaagatgcaattcaaagttgtgtaattcttgcaaaaatgattagtttttacaaaaagaaaagcaaaacccttttagatgttttagaagatatttataaaaaatatggatatattaaaagtgaaagtttttcaattaatttggatgaaaaaaatcctttgcatttagaaaatattcagtcaaaatttataaatctaaaatttaatgaagactttaaaattgaaaactttattaaaggtaaagaaaatattgccccgagtaatatgataagaattagttttcaaaatttaaattgaatcgctcttagaccttctggaacagaagcaaaaattaaattttatctttatgttgttgataaggataaaattttagtagaaaaaaattgaaatattttaaaagaaaaaattctttctattatataa

SEQ ID NO: 12629 - protein, 513 aa, Mycoplasma mobile 163K
MKELEFGTAGLRGILGKTKEHLNIFHVARVIEGFAKYLKSETFNWKNKIVIIGRDNRRKSREFSRLAASILAFHKINVLISREIIATPIISYATKYHKALGAINITASHNPKEYNGIKLYDKNGSQILPDVVDKIKSNFLNYEDYTKKQALNQFIFSIKNKYINYIPKQTLQSYEEKVLKVGGSQKNLSNINLSFSPQHGTGAKIVKSIFKKLNVNAFFEEAQMKNDPDFTHTKSPNPEDKSSYENVIKLGLIHKSDAVLITDPDADRVGIGILRNNEYILLNGNETATLIFNYLIEINENKLQDKYLIYSFVSSSLPKKMAIENNIKWYEVATGFKYIGNLIEQIKNESKTSKLLFAFEESYGSLINDSLAYDKDAIQSCVILAKMISFYKKKSKTLLDVLEDIYKKYGYIKSESFSINLDEKNPLHLENIQSKFINLKFNEDFKIENFIKGKENIAPSNMIRISFQNLNWIALRPSGTEAKIKFYLYVVDKDKILVEKNWNILKEKILSII

SEQ ID NO: 12630 - DNA, 1725 bp, Bacillus thuringiensis serovar konkukian str. 97-27
  CDS (1)..(1725): transl_table=11
atgaactggaaacaagaatttagtcgctggctttcatatgcagagttagacgcagaactaaaagaacagttagaaaacatgaagcaagatgagaaaaaaatcgaggacagcttttataaaaatctagaatttggcacaggtggtatgcgtggtgaacttggtgctggtacgaaccgtttgaacgtatatacagttcgtaaagcaacacaaggattagcgaagtttattgaaaagttaggtgaagaagcgaagaagcgcggtgttgttgtagcgtatgattctcgccataaatcacctgagttcgcaatggaagtagcagctacacttggtgcacacggtattacaacatatgtgtttgaaagcttacgtccaacgccagtgctttctttcgcagttcgtcatttacatacagtgagtggaatcgttcttacggcaagccataatccgcctgaatataacggttataaagtgtacggtgaagatggtgggcagttgcctccaaaagaagctgatgaattaattagctacgtaaacgcagtagaagatgaattaacagttgaagttgctgatgtagagcaattaaaagctgacggtttattacatatgattggacaagaagtagatgatgcatatgctgcagaattgaacaatgtcattattaataaagaaatggtacaaaaggttgggaaagacttaaaaatcgtcttcacaccactacatggaacatcaaatctttctgtacgccgtggcttagcagaagttggatttacagatgtaacagttgtaaaagagcaagagttaccagatccgaacttctctacagtaaaatcaccgaacccagaagagcatgcagcgtttgaatatgcaattcgtgacggtgagaaggtaggcgcagatgtgttaatcgcaacagatcctgacgcagaccgccttggtgtagcagttcgtaatcatgatggtgagttccaagtattaacgggtaaccaaacaggtgcattaatgcttgattacttattatctcaaaagaaagaaaacggaacgcttccagagaacggtgttgtattaaaaacaatcgtaacgtctgaaattggccgtacaatcgcgaaagcatacggtttagatacagttgatacgttaactggatttaaatttatcggtgagaaaattaaacagtatgaagaaagcggacaatacgaattccaattcggttatgaggaaagctatggttatttaatccgtccattctgccgtgataaagatgcagtacaatctgttctatttgcatgtgaagtagctgcatactacaaatcacaaggtaaaacgttatacgatggtctattagaagtgtttgagaagtacggtttcttccgtgaagatcttgtatcgttaacgctaaaaggaaaagatggagcggaacaaattcaagaaatgatggcaacattccgtgaaaatcctccgaaagaagtagctggcttaacagttgtagcagttgaagactataaagcgagcatcattacatctttacaagatggacataaagaagagattcacttaccgaaatcaaatgtgttaaaatatcaattagaagatggttcttggttctgcctacgtccatctggaactgaaccgaagatcaagttctacttcggtgttcaagataattctttacaaaatagtgaacaaaagttacttactattaaagaagatattatgaatcgtttataa

SEQ ID NO: 12631 - protein, 574 aa, Bacillus thuringiensis serovar konkukian str. 97-27
MNWKQEFSRWLSYAELDAELKEQLENMKQDEKKIEDSFYKNLEFGTGGMRGELGAGTNRLNVYTVRKATQGLAKFIEKLGEEAKKRGVVVAYDSRHKSPEFAMEVAATLGAHGITTYVFESLRPTPVLSFAVRHLHTVSGIVLTASHNPPEYNGYKVYGEDGGQLPPKEADELISYVNAVEDELTVEVADVEQLKADGLLHMIGQEVDDAYAAELNNVIINKEMVQKVGKDLKIVFTPLHGTSNLSVRRGLAEVGFTDVTVVKEQELPDPNFSTVKSPNPEEHAAFEYAIRDGEKVGADVLIATDPDADRLGVAVRNHDGEFQVLTGNQTGALMLDYLLSQKKENGTLPENGVVLKTIVTSEIGRTIAKAYGLDTVDTLTGFKFIGEKIKQYEESGQYEFQFGYEESYGYLIRPFCRDKDAVQSVLFACEVAAYYKSQGKTLYDGLLEVFEKYGFFREDLVSLTLKGKDGAEQIQEMMATFRENPPKEVAGLTVVAVEDYKASIITSLQDGHKEEIHLPKSNVLKYQLEDGSWFCLRPSGTEPKIKFYFGVQDNSLQNSEQKLLTIKEDIMNRL

SEQ ID NO: 12632 - DNA, 1686 bp, Mesoplasma florum L1
  CDS (1)..(1686): transl_table=4
atggtttttgataaaaataacaaagtttatagtgaatgaataaatagccaaaaattggatgatgagttgaaaagccttttagtaaatgctactgatgatgaattgcatgcagcatttgaaggaatagagttagaatttggaacagcaggtataagaggtattcttggagcaggacctggaagatttaacgtttacactgttaaaaaagttactattgcatttgcagaattattaaaacaaaattacccaaataggttgaatgatggaatagttgttggtcatgataaccgtcataattctaaacagtttgcaaaagttgtagccgaagttttatcaagctttggaattaaagcatatttatttaaagaaaatgaaatgatgcctacacctgttgtttcatatgcaactaaatttttaaactgtattggaggtattgtaataacagcatcacataatccttcagaatataacggttataaaatatatgatccatacggatgtcaattgcaagatgaacaaacagcaattattgcaaaaagaatggatgaaattacagacattttaaattgagaatataaaataaatgattcgctaatagaaacagttagcgaaaatgttattaaagaatatgtagatatgattaaaaatcttgaattctacaaaaaagagcaagaagctaaaaaagatttaaaaattatttttagcgcagttaatggaacaggaactaaatttaccccaaaaatattacgtgaatcaggatataacgttattgaggttgaagagcatgcatttgaagatgaaacatttaaaaatgttgtaaatccaaatccagaatttgatcctgcatgaaaaataccgcttgaatatggtattaaacatgatgcagatattattattatgaatgacccagatgctgacagatttggaatggcaataaaacatgatggtcattttgtaagattagatggaaatcaaacaggaccaattttaattgattgaaaattatcaaatctaaaacgcttaaatagcattccaaaaaatccggctctatattcaagttttgtaacaagtgatttgggtgatagaatcgctcatgaaaaatatggagttaatattgtaaaaactttaactggatttaaatgaatgggtagagaaattgctaaagaagaagataacggattaaattttgtttttgcttatgaagaaagttatggatatgtaattgatgactcagctagagataaagatggaatacaagcttctatattaatagcagaggctgcttgattttataaaaaacaaaataaaacattagtagactatttagaagatttatttaaagaaatgggtgcatattacactttcactttaaacttgaattttaaaccagaagaaaagaaattaaaaattgaaccattaatgaaatcattgagagcaacacccttaactcaaattgctggacttaaagttgttaatgttgaagactacatcgatggaatgtataatatgccaggacaagacttactaaaattttatttagaagataagtcatgatttgctgttcgcccaagtggaactgaacctaaactaaaaatttattttataggtgttggtgaatctgttcaaaacgctaaagttaaagtagacgaaattattaaagaattaaaattaaaaatgaatatatag

SEQ ID NO: 12633 - protein, 561 aa, Mesoplasma florum L1
MVFDKNNKVYSEWINSQKLDDELKSLLVNATDDELHAAFEGIELEFGTAGIRGILGAGPGRFNVYTVKKVTIAFAELLKQNYPNRLNDGIVVGHDNRHNSKQFAKVVAEVLSSFGIKAYLFKENEMMPTPVVSYATKFLNCIGGIVITASHNPSEYNGYKIYDPYGCQLQDEQTAIIAKRMDEITDILNWEYKINDSLIETVSENVIKEYVDMIKNLEFYKKEQEAKKDLKIIFSAVNGTGTKFTPKILRESGYNVIEVEEHAFEDETFKNVVNPNPEFDPAWKIPLEYGIKHDADIIIMNDPDADRFGMAIKHDGHFVRLDGNQTGPILIDWKLSNLKRLNSIPKNPALYSSFVTSDLGDRIAHEKYGVNIVKTLTGFKWMGREIAKEEDNGLNFVFAYEESYGYVIDDSARDKDGIQASILIAEAAWFYKKQNKTLVDYLEDLFKEMGAYYTFTLNLNFKPEEKKLKIEPLMKSLRATPLTQIAGLKVVNVEDYIDGMYNMPGQDLLKFYLEDKSWFAVRPSGTEPKLKIYFIGVGESVQNAKVKVDEIIKELKLKMNI

SEQ ID NO: 12634 - DNA, 1677 bp, Propionibacterium acnes KPA171202
  CDS (1)..(1677): transl_table=11
atgaccaccacccgccctgaaaggcttagccccgaactcgtcgcagaagttcagtcctggctcgaccaagaccccgacgaggccacgcgcaccgaactgtccgatgtgctcgtccgcgcccagtctggtgaagctgaagccatcgtagcggtggagtcggccttcgccggaccattgaccttcggcaccgctggtctacgcgcggcgctcggccccggcccgtcccgcatgaaccgagtcgttgtccagcgtgccgctgccggtttcgcttcctggttgcgctcccacagcagccgaggaggaaccgtcgtcatcggtttcgacgctcgtcacaattctgacgtcttcgcccgcgataccgccgagatcatggccggggcaggtttccacgccctgttggccgactcccctattccgaccccggtgacggctttcgctattaagcactatggggcagttgccggtgtcatggtgacggcctcccacaatcctcccgctgataacgggtacaaggtctatctgggagacggttcccagatcgttccacccaccgacgccgagattgcccacgaaatcgaggtcgcgtctgaagagcccgtgggtgcgattgttcgcggtgacgacattgagttcatcggcgacgagctcattgatgcctatgtctgtcgcgccgccaagctgactacggccaatcccgacgtcacctgggtttataccgccatgcacggggtcggaacacgggtcgtgcgtcgtctcgttgagaaggctggcttatccgaatttatcggggtgaccgagcagctcaatccagacccggacttcccgactgtagccttcccgaaccccgaggagcccggcgccatcgatctggccattgctcaagcccgcaagcacgacgccgacgtcgttatcgcctctgaccccgacgccgaccgctgcgccgtagcagccgttattgacggggactggcggatgcttaccggcgacgaactgggcactcttcttggtgacgatgccctgcgtcgtggtctcgacggtgtttacgccaactcggtggtttcatcgacctgtctgggacggatggctaaggctgccggacgcgaacaccacatgaccttgaccgggttcaagtggatcggccgtgtgcctggactcgtcttcggctatgaggaagccattggttactgctgcgatccttcccacgtacccgacaaggacggcatcaccgccttggcgacgatcctgcgtctggtcggtgaactcaaggcctccggcaccaccatagccgaacgtctcgacgagatctgggccacccatggtctacaccgcacttcccagctcgcggtgcgcgtcaccaccatgtcgatcatctcccaggccatggaccgcttgcgcaaccagccccccgcaaccctgctaggtgatcgcgtcgatgtctgcgacctcgacgatcccagcaatgggtccgggctaccacagcagaacgcgatcgagctgaccggacctcgcgttcacgtcgtcactcgtccctcaggcaccgagccgaagctcaagtgctacctcgaggtacgcgcagccccagcggaatcggccgccgatctgtcagccaccaaggcccgtcttgacgcagacatgacgaccctacgagacgagatgtcccaggctctcggaatctga

SEQ ID NO: 12635 - protein, 558 aa, Propionibacterium acnes KPA171202
MTTTRPERLSPELVAEVQSWLDQDPDEATRTELSDVLVRAQSGEAEAIVAVESAFAGPLTFGTAGLRAALGPGPSRMNRVVVQRAAAGFASWLRSHSSRGGTVVIGFDARHNSDVFARDTAEIMAGAGFHALLADSPIPTPVTAFAIKHYGAVAGVMVTASHNPPADNGYKVYLGDGSQIVPPTDAEIAHEIEVASEEPVGAIVRGDDIEFIGDELIDAYVCRAAKLTTANPDVTWVYTAMHGVGTRVVRRLVEKAGLSEFIGVTEQLNPDPDFPTVAFPNPEEPGAIDLAIAQARKHDADVVIASDPDADRCAVAAVIDGDWRMLTGDELGTLLGDDALRRGLDGVYANSVVSSTCLGRMAKAAGREHHMTLTGFKWIGRVPGLVFGYEEAIGYCCDPSHVPDKDGITALATILRLVGELKASGTTIAERLDEIWATHGLHRTSQLAVRVTTMSIISQAMDRLRNQPPATLLGDRVDVCDLDDPSNGSGLPQQNAIELTGPRVHVVTRPSGTEPKLKCYLEVRAAPAESAADLSATKARLDADMTTLRDEMSQALGI

SEQ ID NO: 12636 - DNA, 1719 bp, Streptococcus pyogenes MGAS10394
  CDS (1)..(1719): transl_table=11
atgacttacacagaaaattttcaaaaatggttagattttgagcagcttcctgactatcttcgtcaagaattactatcaatggatgaaaaaacaaaagaagatgctttttacacaaacttagaatttggtactgctggtatgcgtggttatattggtgctggtacaaatcgtattaatatttatgttgtccgtcaagcaaccgaaggattagcaaaattaatcgaaactaagggagaggaagctaaaaaacgtggtgtagccatcgcttatgattcgcgccacttctctccagaatttgcttttgagtctgcacaggtcttggcacagcatgggattaaatcttacgtatttgaagctcttcgtccaacaccagaactctcttttgctgttcgccatttaaatgcctatgctggtattatggttactgcaagccacaatccagcacctttcaatggttataaagtctatggacaagacggaggtcaactaccaccagctgatgctgatgcactaacagactttatccgtgctattgaaaatccatttgcagttgaacttgctgatttagatgaaagcaaatcatcaggtcttattcaagttatcggtgaagatgttgatatggaatatcttagagaggttaaagatgttaatatcaatcaagttttaatcaataactttggaaaagacatgaaaattgtctatactcctctccatggaactggtgagatgttgacacgccgtgcccttgctcaagccggttttgaatctgttgttgtagtcgaatcacaagctaaggcagatccagacttttctactgttaaatcgcctaaccctgaaagccaagctgcctttgctcttgctgaagaactcggacgagaagttgatgcagatgtcttagtagctactgatcctgatgcagaccgcctaggcgttgaaattcgccaaccagatggttcttataaaaacctttctggaaatcaaattggagcgattattgcgaaatacatcctggaagctcataaaacagcaggaacacttccagaaaatgctgctctcgctaaatcaatcgtatcaacagaattagtaacaaaaattgccgaaagttatggcgctacaatgtttaacgttttaactggattcaaattcatcgctgagaaaattcaagagtttgaagaaaaacataaccacacctatatgtttggttttgaagaaagcttcggatatcttattaaaccatttgtccgtgataaagatgctattcaagcagttcttttggttgctgagatcgcagcttattaccgttcgcgtggtttaacacttgcagatggtattgatgaaatttacaaagaatatggctattttgctgaaaaaacgatttcagtaacactttcaggtgtggatggagctgctgaaattaagaagattatggacaaattccgtgaaaatggtccaaaacaatttgacaatactgatattgtattattagaagatttccaaaaacaaaccgctactaaaaatgatggaacaatatctaacttaacaactcctccaagtaatgttttgaagtacacgttagctgatgattcatggattgcagttcgcccttcaggaactgaaccaaaaatcaagttctatattgccacaataggtgatactcttgacatcgctcaagaaaaaattgctaacattgaaacagaaatcaatacctttgttggctaa

SEQ ID NO: 12637 - protein, 572 aa, Streptococcus pyogenes MGAS10394
MTYTENFQKWLDFEQLPDYLRQELLSMDEKTKEDAFYTNLEFGTAGMRGYIGAGTNRINIYVVRQATEGLAKLIETKGEEAKKRGVAIAYDSRHFSPEFAFESAQVLAQHGIKSYVFEALRPTPELSFAVRHLNAYAGIMVTASHNPAPFNGYKVYGQDGGQLPPADADALTDFIRAIENPFAVELADLDESKSSGLIQVIGEDVDMEYLREVKDVNINQVLINNFGKDMKIVYTPLHGTGEMLTRRALAQAGFESVVVVESQAKADPDFSTVKSPNPESQAAFALAEELGREVDADVLVATDPDADRLGVEIRQPDGSYKNLSGNQIGAIIAKYILEAHKTAGTLPENAALAKSIVSTELVTKIAESYGATMFNVLTGFKFIAEKIQEFEEKHNHTYMFGFEESFGYLIKPFVRDKDAIQAVLLVAEIAAYYRSRGLTLADGIDEIYKEYGYFAEKTISVTLSGVDGAAEIKKIMDKFRENGPKQFDNTDIVLLEDFQKQTATKNDGTISNLTTPPSNVLKYTLADDSWIAVRPSGTEPKIKFYIATIGDTLDIAQEKIANIETEINTFVG

SEQ ID NO: 12638 - DNA, 1680 bp, Leifsonia xyli subsp. xyli str. CTCB07
  CDS (1)..(1680): transl_table=11
gtgagcgacaccgcgcagctcctcgccgacgcccgcgtctggctggagcaagaccccgaccccgagacgcgccgggagctcgaggctctcctcgccagcgccgagtccggttcggccggggccatcgccgacctccgctcgcgcttcggcgcccgtctcgctttcggcacggccggtctccgcggcgagatcgccgccggcccgaaccggatgaaccgcgttctggtggcccaggccgcggccggcttcgcccgctggctgagggaaaacgccggggacggaaccccctcggtcgtcatcggctacgacggccgcaagaactccgctgtcttcgcccgcgacacggcggagctcatggtcggagccggcgtgcgcgccgtcctcctgccgcgcctgctgcccaccccggtgctcgcgttcgcggttcgacacctgggcacgagcgccggtgtcatggtcaccgccagccacaacccgcggaacgacaacggctataaggtctatctcggcggcaagagccacggctcgcagatcgtctccccgacggatgcggagatcgccgcgcacatcctggacgtggctcggggcagcgtcgcagagctgccccgctcggatcggtacgaggtcgccggcgaggaggtcgagcgcgactacatcgcggcgaccgccgccgtcgcgagcgcctccgctccgcgggacgccgtctcgttcgcgtacacggccatgcacggcgtcggctggcgcacggcccgggaggtgttcgcccgcgccgggttcgccgcgcccgcggtcgtgaccgcgcagcgcgatcccgatccggcgttcccgaccgtcgcgtttccgaaccccgaggaaccgggcgcgatgaatctcgcgttcgccacggcgcgcgaggccggggccgacctggtcatcgccaatgacccggacgccgaccggctcgcggtcgccatccccgacccagcctcgaccgacggctaccgccggctgagcggcaacgaggtcggcgccctgctgggctggcgcgccgccgaactgactgccgaagagggcggcacgctcgcctgctcgatcgtctcctccccggcgctggcggcggtcgcggaggcgtaccgcctcggcttcgcgaacacgctcaccggtttcaaatgggtctcccgcgcacccgggctgatcttcggctacgaggaggcgctgggctacctcgtgaacccgcagaccctccgcgacaaagacggcatctccgccgcgaccgcactgctcgacctggccagcagcctggccgcggaggggcgtacgatcgcggaccagctggacgccttcgccgagcgcttcggcttcttcgcgagcgaccagatctccctccgcgtcagcgatgtctcccgtatcggcgagatcatggcgactctgcgagcgaccccgccgagcaccctcggcgcggtcgccgtgagccggatcgacgacctgagcgacggtctcggcgacctcccgccgaacgatgtgctccgcatcctgctggcggacggctcgcgcgtgatggtgcgaccgagcgggacggagccgaagctcaagatctacatcgatgcgtcgagcgacgaaggcaccctcgccgagcggcgctcgaccgccgccgcacgggtcgctgccctggcggacgcgatgcgggcgctgacggcgtag

SEQ ID NO: 12639 - protein, 559 aa, Leifsonia xyli subsp. xyli str. CTCB07
MSDTAQLLADARVWLEQDPDPETRRELEALLASAESGSAGAIADLRSRFGARLAFGTAGLRGEIAAGPNRMNRVLVAQAAAGFARWLRENAGDGTPSVVIGYDGRKNSAVFARDTAELMVGAGVRAVLLPRLLPTPVLAFAVRHLGTSAGVMVTASHNPRNDNGYKVYLGGKSHGSQIVSPTDAEIAAHILDVARGSVAELPRSDRYEVAGEEVERDYIAATAAVASASAPRDAVSFAYTAMHGVGWRTAREVFARAGFAAPAVVTAQRDPDPAFPTVAFPNPEEPGAMNLAFATAREAGADLVIANDPDADRLAVAIPDPASTDGYRRLSGNEVGALLGWRAAELTAEEGGTLACSIVSSPALAAVAEAYRLGFANTLTGFKWVSRAPGLIFGYEEALGYLVNPQTLRDKDGISAATALLDLASSLAAEGRTIADQLDAFAERFGFFASDQISLRVSDVSRIGEIMATLRATPPSTLGAVAVSRIDDLSDGLGDLPPNDVLRILLADGSRVMVRPSGTEPKLKIYIDASSDEGTLAERRSTAAARVAALADAMRALTA

SEQ ID NO: 12640 - DNA, 1710 bp, Borrelia garinii PBi
  CDS (1)..(1710): transl_table=11
atgcaacaagtcacagccaaaagaaaattaaaaaattatattcttcttgaaaaagatacatattttaaagaagaagcaataaaaattcaaaaaacaaataatgagacagaaatcctaaacagattttataaagatctagaatttggcactgctggaatgagagggatcattggggctggaacatgctacataaacacttataatgtaaaaaaaataagccaaggaatatgcaactatgtacttaaaataaataaaaaccccaaagttgcaataagttatgattcaagatatttttcaaaagaatttgcttacaatactgctcaaatttttgcctcaaataattttgaaacatatatatataaaagcttaagacccactccccagctatcttatacaataagaaaatttgattgtgatgttggtgttatgataacagcaagtcataatccaaaagaatacaatggctataaagcatactggaaaggtggaatacaaataatgccgcctcatgacacactaataaccaatgaaatcaaaaaagtaaaaaacataataaataaaattaccataaaagaaggtattgaaaaaaagattatcaaagaactaaataatgagatagacaaagagtatgtacaaacaataaacaaagaattccctgattttgagaagaatagcaaaaaaacaaacttaaaagtagcttacacagcactacatggtactggtggaaccataataaaaaaactctttacaaatagcaaaatacagctttttttagaaaaaagtgaaatagtaccaaacccggaatttccaacaataacctatcctaatccagaaaaaaaaacatcaatgcttaaagtaatagagcttgcgaaaaaagaagattgtgacattgcccttgcaacagatccagatgctgatagaataggagttgcatttaaagatcaaaacgaatggatatttttaaacggaaatcaaatatcatgcattttaatgaactatatactctcaaaagaaataaatcctaaaaatacatttgtaatatcatcatttgtaacaacacaaatgttagaaaaaattgcaaaaaaatatggttctcaaatttttagaacttacacaggatttaaatggataggaagcttaattgatgaaatggaaaaaaatgaaccgaataaaaaatttgcttttgcatgcgaagagagtcatggatatctaataggaaaaaaagttagagataaggatgcattttcagccataaaagggatttgttctttagcgctttatttaaaagctaagaaacaaacaattaagaattatcttgaaaagatatacaaagaatttggatattatgaagaacttaatgtagaaaaaaactttgagggggctaatggagaaattcaaagagaagcactaatgtcaaagctaagaaaagaacaaaaaatgcaattcgcaggaatcaaaataattgaaaaattagactataaaactcttaaaaaaattaacttcaaaaaagaaatttcagaaataaaagaatataaatatcctataaacgcaataaaatttatacttgaaaacgaaattgtaataaccgtaagaccctctggaacagagccaaaaattaaattttacatatctgtaaagctcgagtataaggaaaaacataaaatatttggtataataaatgcaataaagatggagataaaaaaatattaa

SEQ ID NO: 12641 - protein, 569 aa, Borrelia garinii PBi
MQQVTAKRKLKNYILLEKDTYFKEEAIKIQKTNNETEILNRFYKDLEFGTAGMRGIIGAGTCYINTYNVKKISQGICNYVLKINKNPKVAISYDSRYFSKEFAYNTAQIFASNNFETYIYKSLRPTPQLSYTIRKFDCDVGVMITASHNPKEYNGYKAYWKGGIQIMPPHDTLITNEIKKVKNIINKITIKEGIEKKIIKELNNEIDKEYVQTINKEFPDFEKNSKKTNLKVAYTALHGTGGTIIKKLFTNSKIQLFLEKSEIVPNPEFPTITYPNPEKKTSMLKVIELAKKEDCDIALATDPDADRIGVAFKDQNEWIFLNGNQISCILMNYILSKEINPKNTFVISSFVTTQMLEKIAKKYGSQIFRTYTGFKWIGSLIDEMEKNEPNKKFAFACEESHGYLIGKKVRDKDAFSAIKGICSLALYLKAKKQTIKNYLEKIYKEFGYYEELNVEKNFEGANGEIQREALMSKLRKEQKMQFAGIKIIEKLDYKTLKKINFKKEISEIKEYKYPINAIKFILENEIVITVRPSGTEPKIKFYISVKLEYKEKHKIFGIINAIKMEIKKY

SEQ ID NO: 12642 - DNA, 1761 bp, Symbiobacterium thermophilum IAM 14863
  CDS (1)..(1761): transl_table=11
atgtccacggtcatggaacgcttccggctctggagcgaggatccgtacttcgatgaggagacccgccgggaactggccggcgtcgccggcgatccccgggaaatcgaggaccgcttctatcagatgctcgcgttcggcacgggcgggctgcggggggtcatcggcgcgggcaccaaccgcatcaaccggtacatggttcgcctggccacgcaggggctggcggaggcgcttcgcgccacgggccccgacgccctgcgcaggggcgtcgtcatcgcccacgactcccgccggcgctcggccgagttcgcccgcgaggcggccttcaccctggccgccaacggggtcgtcgcgcacctgtgggaggggctgcggcccacgcccatgctctccttcgccgtgcggaagctgggcgcggcggcgggcatcgtcatcactgccagccacaacccgcccgagtacaacgggtacaaggtgtactgggaggacggcggccaggtgccgccggaccgggccggtcagatccaggccgccatgcaggcggtgggcgacatccgctcgatccggccgatggccgagggggaggcccgtacccgggggctcctgcggccggtcccgccggaggtggacgaggcttactacagtcggctgctggggctcgtctcggcttcgcccacccagcggcacgcgttgcgcatcctgtatacgccgctgcacggcacggggctcgtgccggtgcggaccgtgctggagcgggccggcttccccgtggaggtggtggccgagcaggcggagcctgaccccggcttccccaccgtggccaagccgaacccggaggaaccggaggtgtacgagatcgcgctgcgccgcgccgcttccggccgtcccgacctgatcctggccacggatcccgacgccgaccggctcggcgtgctggtccgggaccgggagggcggctaccgggcgctgacgggcaaccagatcggggcgatcctggcggagcagatcctgcgctcccgggcagaggcggggacgctgccggccaacggcgccgtgatcaagaccatcgccacatccaacctggtcgcctccctctgccgggagtacggggtgaccctgctggagacgcacacggggttcaagttcatcggcgagaagatcaaggagttcgaagagacgggcagccacgagttcctcttcggcttcgaggagagctacggctacctggccgcgaccttcgtgcgggacaaggacgcggtgatggccgccctgctggtcgccgacgccgccgcccaccacaaggcggaggggcgcaccctgctggacgcgctggaggcgatctggcagcgccacggctacttccaggaggggctgcacaacgtcaccctgccgggccgggacgggcaggcccggatccggtccctgatggcggccctgcgggccgaccctccccgggccttcgccggcgtccccgtcgcctaccgcgacgactacgccgcgggcaccggcgtggaagtggccaccggccgcacttacccgctccagctggggcgggcggaggtgctgcactaccgcttcgccgacggcggcttcgtcatggtgcggccgtcgggcaccgaaccgaagctgaaggtgtacgtttcggtggtgggtgccgacgcggccgatgccgtcgccctgcgggaccgggtgatggccgacgccctggcccggatggggctctcgggaggggccggtgaaccggccggtgaaagaatagaatag

SEQ ID NO: 12643 - protein, 586 aa, Symbiobacterium thermophilum IAM 14863
MSTVMERFRLWSEDPYFDEETRRELAGVAGDPREIEDRFYQMLAFGTGGLRGVIGAGTNRINRYMVRLATQGLAEALRATGPDALRRGVVIAHDSRRRSAEFAREAAFTLAANGVVAHLWEGLRPTPMLSFAVRKLGAAAGIVITASHNPPEYNGYKVYWEDGGQVPPDRAGQIQAAMQAVGDIRSIRPMAEGEARTRGLLRPVPPEVDEAYYSRLLGLVSASPTQRHALRILYTPLHGTGLVPVRTVLERAGFPVEVVAEQAEPDPGFPTVAKPNPEEPEVYEIALRRAASGRPDLILATDPDADRLGVLVRDREGGYRALTGNQIGAILAEQILRSRAEAGTLPANGAVIKTIATSNLVASLCREYGVTLLETHTGFKFIGEKIKEFEETGSHEFLFGFEESYGYLAATFVRDKDAVMAALLVADAAAHHKAEGRTLLDALEAIWQRHGYFQEGLHNVTLPGRDGQARIRSLMAALRADPPRAFAGVPVAYRDDYAAGTGVEVATGRTYPLQLGRAEVLHYRFADGGFVMVRPSGTEPKLKVYVSVVGADAADAVALRDRVMADALARMGLSGGAGEPAGERIE

SEQ ID NO: 12644 - DNA, 1725 bp, Bacillus cereus E33L
  CDS (1)..(1725): transl_table=11
atgaactggaaacaagaatttagtcgctggctttcatatgcagagttagacgcagaactaaaagaacagttagaaaacatgaagcaagatgagaaaaaaatcgaggacagcttttataaaaatctagaatttggcacaggtggtatgcgtggtgaacttggtgctggtacgaaccgtttgaacgtatatacagttcgtaaagcaacacaaggattagcgaagtttattgaaaagttaggtgaagaagcgaagaagcgcggtgttgttgtagcgtatgattctcgtcataaatcacctgagttcgcaatggaagtagcagctacacttggtgcacacggtattacaacatatgtgtttgaaagtttacgcccaacgccagtgctttctttcgcagttcgtcatttacatacagtgagtggaatcgttcttacggcaagtcataatccgcctgaatataacggttataaagtatacggtgaagatggtgggcagttgcctccaaaagaagctgatgaattaattagctacgtaaacgcagtagaagatgaattaacagttgaagttgctgatgtagagcaattaaaagctgacggtttattacatataattggacaagaagtagatgatgcatatgctgcagaattgaacaatgtcattattaataaagaaatggtacaaaaggttgggaaagacttaaaaatcgtcttcacaccactacatggaacatcaaatctttctgtacgccgtggcttagcagaagttggatttacagatgtaacagttgtaaaagagcaagagttaccagatccgaacttctctacagtaaaatcaccgaacccagaagagcatgcagcgtttgagtatgcaattcgtgacggtgagaaagtaggcgcagatgtgttaatcgcaacagatcctgacgcagaccgccttggtgtggcagttcgtaaccacgatggtgagttccaagtattaactggtaaccaaacaggtgcattaatgcttgattacttattgtctcaaaagaaagaaaacggaacgcttccagagaacggtgttgtattaaaaacaatcgtaacatctgagattggccgtacaatcgcgaaagcatatggtttagatacagtcgatacgttaactggatttaaatttatcggtgagaaaattaaacagtatgaagaaagcggccaatacgaattccaattcggttatgaggaaagctatggttatttaatccgtccattctgccgtgataaagatgcagtacaatctgttctatttgcatgtgaagtagctgcatactacaaatcacaaggtaaaacgttatacgatggtctattagaagtatttgagaagtacggcttcttccgtgaagatcttgtatcgttaacgctaaaaggaaaagatggagcggaaaaaattcaagaaatgatggcaacattccgtgaaaatcctccgaaagaagtagctggcttaacagttgtagcagttgaagactataaagcgagcatcattacatctttacaagatggacataaagaagagattcacttaccgaaatcaaatgtgttaaaatatcaattagaagatggttcttggttctgcctacgtccatctggaactgaaccgaagatcaagttctacttcggtgttcaagataattctttacaaaatagtgaacaaaagttacttactattaaagaagatattatgaatcgtttataa

SEQ ID NO: 12645 - protein, 574 aa, Bacillus cereus E33L
MNWKQEFSRWLSYAELDAELKEQLENMKQDEKKIEDSFYKNLEFGTGGMRGELGAGTNRLNVYTVRKATQGLAKFIEKLGEEAKKRGVVVAYDSRHKSPEFAMEVAATLGAHGITTYVFESLRPTPVLSFAVRHLHTVSGIVLTASHNPPEYNGYKVYGEDGGQLPPKEADELISYVNAVEDELTVEVADVEQLKADGLLHIIGQEVDDAYAAELNNVIINKEMVQKVGKDLKIVFTPLHGTSNLSVRRGLAEVGFTDVTVVKEQELPDPNFSTVKSPNPEEHAAFEYAIRDGEKVGADVLIATDPDADRLGVAVRNHDGEFQVLTGNQTGALMLDYLLSQKKENGTLPENGVVLKTIVTSEIGRTIAKAYGLDTVDTLTGFKFIGEKIKQYEESGQYEFQFGYEESYGYLIRPFCRDKDAVQSVLFACEVAAYYKSQGKTLYDGLLEVFEKYGFFREDLVSLTLKGKDGAEKIQEMMATFRENPPKEVAGLTVVAVEDYKASIITSLQDGHKEEIHLPKSNVLKYQLEDGSWFCLRPSGTEPKIKFYFGVQDNSLQNSEQKLLTIKEDIMNRL

SEQ ID NO: 12646 - DNA, 1662 bp, Mannheimia succiniciproducens MBEL55E
  CDS (1)..(1662): transl_table=11
atgacaactatttttactattgctcaaaactggctggaacaagatccggatctcgaaactaaagccgaattagcgcaattaattgataatgcaaaagcgggtgacgaaaatgctttaaaagaattaaccgcccgttttgacggacggttgcagtttggcacggcaggtttgcgcggtcgcctgcaagccggttcaatgggcatgaacagagtattggtggcgcaagcggcaggcggattagccgattatatcaaacaatatgatcataatgcgccgtcaatcgtaattggttacgacggacgtaaaaactccgatatatttgcccgcgatacggcggaaattatgtcgggtgcaggcataaaagcctatttattgccacgcaaattaccgactcccgtattggcttatgcgattaattattttgatgccacagccggtgtaatggttaccgcaagccataacccgccggaagataacggttataaagtttatttaggtaaagaaaacggcggcggccagattgtttcacccgccgataaagatattgcggcattaattgataaagtagcggcgggcaatattaagaatttaccgcgcagccaagattatgttgtgctggatgatcaagtggtggatgcctatattgaaaaaacggcgagtattgcacaagagcctagaacggacatcaattacgtttacaccgcaatgcatggtgtcggttatgaagtgttaagcaaaacattgcaaaaagccgggctttcccaaccgcacttggtgaaagaacaagtgtatcccgacggtactttcccgactgtgagttttcctaatccggaagaaaaaggcgcactggatttagccgttaaattagcgaaaaaacaaaacgccgaatttattattgccaacgacccggatgccgaccgtttggcagtggcgattccggatgccaaaggtaattggaaaagcctgcatggcaacgtattaggttgcctgttgggctggcatttagcaaaaaaatatcatgccgcaggaaaacaaggtgtactggcctgctcgttggtttcttcaccggcactggcggaaatcgcgaaaaaatacggcttgcaatcggaagaaaccttaaccgggttcaagtatatcggtaaagttaaaggcttattatttggctttgaagaagccatcggctatttggttgacccggataaggttcgggataaagacggtatttccgcctccgttgcgtttttagatctggtactttatctgaaaaaacaaggcaaaaccattttagattacatgaatgaattcaatcgggaattcggcgcttatgtaagcggacagatctcaattcgcgtaagcgatcttacggaaatcagcaaattaatgaccgcacttcgtaacaacccgccaagcgaaatcggcggattcaaagtaacgcaatttatcgaccacttaaaaacagagcgtaataacgacattttagtgtttactttagaaaacggcagccgtttaattactcgtccgtccggaaccgaaccaaaaatcaagttttatctggatgccaaaggtaaagacgcgctcgacgccgataacgtattagcccaattcgacgaaagcgtccgcgcattactgcgccgggaacaatacggcaaacaggattgttag

SEQ ID NO: 12647 - protein, 553 aa, Mannheimia succiniciproducens MBEL55E
MTTIFTIAQNWLEQDPDLETKAELAQLIDNAKAGDENALKELTARFDGRLQFGTAGLRGRLQAGSMGMNRVLVAQAAGGLADYIKQYDHNAPSIVIGYDGRKNSDIFARDTAEIMSGAGIKAYLLPRKLPTPVLAYAINYFDATAGVMVTASHNPPEDNGYKVYLGKENGGGQIVSPADKDIAALIDKVAAGNIKNLPRSQDYVVLDDQVVDAYIEKTASIAQEPRTDINYVYTAMHGVGYEVLSKTLQKAGLSQPHLVKEQVYPDGTFPTVSFPNPEEKGALDLAVKLAKKQNAEFIIANDPDADRLAVAIPDAKGNWKSLHGNVLGCLLGWHLAKKYHAAGKQGVLACSLVSSPALAEIAKKYGLQSEETLTGFKYIGKVKGLLFGFEEAIGYLVDPDKVRDKDGISASVAFLDLVLYLKKQGKTILDYMNEFNREFGAYVSGQISIRVSDLTEISKLMTALRNNPPSEIGGFKVTQFIDHLKTERNNDILVFTLENGSRLITRPSGTEPKIKFYLDAKGKDALDADNVLAQFDESVRALLRREQYGKQDC

SEQ ID NO: 12648 - DNA, 1749 bp, Bacillus licheniformis ATCC 14580
  CDS (1)..(1749): transl_table=11
atgagctggagaacgagctatgaacgctggagaaacaaagaaaacttagattccgaattaaaagcgcttcttttggaagcggaaggaaatgaaaaagaactagaggattgcttttataaaaaacttgagtttggtacagccggtatgcgcggtgagatcggaccgggcccgaaccgcatgaacgtttatacggttcgcaaagcatcggcgggccttgccgcatacataggagcgaacggcggcgaagcaaaaaagcgcggcgttgtgatcgcgtacgattcccgccacaaatcgcctgaatttgcaatggaagctgctaagacgctcgcagaaaacggcgttcaaacgtacgtgtttgacgaactgcgcccgacacctgaactttcctttgcggtaagagaactgaatgcgtttgcaggtattgtcatcacggcgagccataacccgcctgaatacaacggctataaagtgtacggagaggacggcgcgcagcttccgcctgctgatgccgacaaactcaccggctatgtcaatgcgatagaaaacgaactggaaatcgaagccggagatgaagctgctttaaccgaaaaagggctgattaaaataatcggcgaggaaatcgatcaagcgtatctcgataaactgacatcgatttctgtcaaccctgatctggcaaaggagaccgaagtcaaagtcatcttcaccccgcttcacggcacggcaaacaagtctgtcagacggggcctgaaagctctcgggtatgaacatgtcacagtcgtccccgaacaggagctccctgaccctgacttttcgaccgtatcttctccgaatccggaagagcacgccgcttttgaatatgcgatcagactaggagaagaaaatggagccgacattctgatcggaaccgatccagacgcagaccggctcggcgtcgctgtaaaggatcaagaaggccgctacgtagtgctgacaggaaatcaaaccggcgcgctgctcctgcattatctgctgtcgcaaaaacagcagaaaggcatgctgcctgataacggcgtcgttctgaaaacgattgtgacgagcgaaatggggcgcgacatcgccgcttctttcggactggacacgatcgacacgctgaccggctttaaattcatcggagaaaaaatcaaacaatttgaagcatcgggcgaatatgctttccaattcggttatgaggaaagctacggctacttgatcggcgacttcgcaagggacaaggatgccgtccaggccgcactgcttgccgttgaagtatgcgccttctataaaaagcagggaaaatcgctttatgacgggctcctcgaattgtataaatcgttcggcttctatagagaaggcttgaagtccctgaccttaaaaggaaaagagggagcggagcaaatcgcagccatcctcagcacattcagagaacagccgcctctttccatcgccggaaaagatgtcgtatccgccgaagactatttgacagggaagcggacgctgctaaaggaaaacaaaagggaaacgatcgaccttccgaaatccaatgttttgaaatatttccttgaagacggctcatggttctgcctccgtccatcaggaacagagcctaaagtgaaattttatttcgcggtcaaaggccgaaccaatgaagaaagcgaagcgcttctcaatcaattgacagacgaagtgatgaaaaaaatcgacgatattgtaaaagcgacctcaaattcgtaa

SEQ ID NO: 12649 - protein, 582 aa, Bacillus licheniformis ATCC 14580
MSWRTSYERWRNKENLDSELKALLLEAEGNEKELEDCFYKKLEFGTAGMRGEIGPGPNRMNVYTVRKASAGLAAYIGANGGEAKKRGVVIAYDSRHKSPEFAMEAAKTLAENGVQTYVFDELRPTPELSFAVRELNAFAGIVITASHNPPEYNGYKVYGEDGAQLPPADADKLTGYVNAIENELEIEAGDEAALTEKGLIKIIGEEIDQAYLDKLTSISVNPDLAKETEVKVIFTPLHGTANKSVRRGLKALGYEHVTVVPEQELPDPDFSTVSSPNPEEHAAFEYAIRLGEENGADILIGTDPDADRLGVAVKDQEGRYVVLTGNQTGALLLHYLLSQKQQKGMLPDNGVVLKTIVTSEMGRDIAASFGLDTIDTLTGFKFIGEKIKQFEASGEYAFQFGYEESYGYLIGDFARDKDAVQAALLAVEVCAFYKKQGKSLYDGLLELYKSFGFYREGLKSLTLKGKEGAEQIAAILSTFREQPPLSIAGKDVVSAEDYLTGKRTLLKENKRETIDLPKSNVLKYFLEDGSWFCLRPSGTEPKVKFYFAVKGRTNEESEALLNQLTDEVMKKIDDIVKATSNS

SEQ ID NO: 12650 - DNA, 1740 bp, Bacillus clausii KSM-K16
  CDS (1)..(1740): transl_table=11
ttgaatattgtggagaaagtggaacgctggaaccaatttgcacaattagaaccagatgtgcgtcaacaattggacgccattttggataatgataaggcgcttgaagattgtttttaccgggaacttgcctttgggacaggaggcatgcgaggggaaattgggccaggaccaaaccggatgaatacatatactgttcgaaaagcagccgaaggactggcccgctttattgaaaaacgaggcgagacggcgaaaagcaaaggagtggcgatcgcttttgattcccgccataagtcggcaaagtttgctcatgaagcagcaatcacgttaggcgctcatggcattaaagcgtacgttttcgaaagtttgcggccaacgccagaattgtcgtttgccgtccgttatctcggggctgaagcgggcattgtcattaccgcttctcataacccgcctgaatataatggatttaaagtatacggctcagatggctgccaattcccgcctgcccctgcagaagagcttgttgcttgtgtgcaatcaatcgaagatgaattggctattgaagttggcgatgaagaggaattgaaagcagcacagttatacgagctcatctccactgaaattgacgatgcttataacgatcaattgaagacgattttgcttcagcctgaaatggacaagcagtatggcgatgagttggccattgtgtttacaccgctccatggcacagcgaatgttgcggttaggcgcgccctaaaagaaagcgggtttacaaacgttacagtggtggctgaacaagagcaacctgatcctgatttttcaactgtttcttcacccaacccagaggaacatgcagcttttacattggcgatggactatggggagcgccaagaggcagatcttttgcttgctacagacccggatgcagaccgagtagggcttgcagtgaaagatgacgagggaaactacgttgtcttgactggaaaccaaactggcgcgctcttgcttgactatcttctcgaaacacgccagcaaaaggggacgcttccgcaaaatggcatagtgctcaagacgattgtcacgtctgaactaggccgagcagttgctgatgcttacgggctgacaaccatcgatacattaacaggcttcaagtttatcggcgaaaagatgggcgaatatgaacgttctggtgaacatacatttttgttcggctatgaagaaagctatggctatttaataggtgatttcgtccgcgataaagatgctatacaagcttgcctgtttgctgctgagttggcactccattataagcgtaaaggcatgacggtttatgaagcaatgcagcaagtttatcgcaagtacggctattaccgtgaagggttgcaatcattaacgttaaaaggaaaagaaggggcagaaaaaattgcttctattcttgcctctctccgtcaagaagcgcctacacatatggctagcaagctcattacaacagtcgaagattttgaatcgagacaagcgcttgccacagcaaccggagaacggacagcgattgagttaccagcatcgaatgtactgaagtacacacttgaggacggttcgtggttctgtgtgcgtccttctggaacagaacctaaagtgaagttttattttggtgttgtcggctctagcaatgaagagagcgaacaaaaactgactcagttgcaacaagcggtcatgtcttatatggaagcttttatttcttaa

SEQ ID NO: 12651 - protein, 579 aa, Bacillus clausii KSM-K16
MNIVEKVERWNQFAQLEPDVRQQLDAILDNDKALEDCFYRELAFGTGGMRGEIGPGPNRMNTYTVRKAAEGLARFIEKRGETAKSKGVAIAFDSRHKSAKFAHEAAITLGAHGIKAYVFESLRPTPELSFAVRYLGAEAGIVITASHNPPEYNGFKVYGSDGCQFPPAPAEELVACVQSIEDELAIEVGDEEELKAAQLYELISTEIDDAYNDQLKTILLQPEMDKQYGDELAIVFTPLHGTANVAVRRALKESGFTNVTVVAEQEQPDPDFSTVSSPNPEEHAAFTLAMDYGERQEADLLLATDPDADRVGLAVKDDEGNYVVLTGNQTGALLLDYLLETRQQKGTLPQNGIVLKTIVTSELGRAVADAYGLTTIDTLTGFKFIGEKMGEYERSGEHTFLFGYEESYGYLIGDFVRDKDAIQACLFAAELALHYKRKGMTVYEAMQQVYRKYGYYREGLQSLTLKGKEGAEKIASILASLRQEAPTHMASKLITTVEDFESRQALATATGERTAIELPASNVLKYTLEDGSWFCVRPSGTEPKVKFYFGVVGSSNEESEQKLTQLQQAVMSYMEAFIS

SEQ ID NO: 12652 - DNA, 1746 bp, Bacteroides fragilis NCTC 9343
  CDS (1)..(1746): transl_table=11
atggggaatgaagaactaatcaaacaggtgactgagaaagccgaaaagtggctgaccccggcgtatgatgccgaaactcaggctgaagtgaaacgcatgctggagaacgaagataagacagaattgatcgaggccttttacaaagatctcgagtttggtacgggcggactccgtgggatcatgggcgtaggtaccaatcgtatgaacatctatactgtcggagctgctacccagggactctctaactatctgaacgcaaactttaaagatatgaaacagatttcggttgtagtcggatacgattgccgtaacaacagttctctgtttgccaagatctctgcggatattttctcggccaatggcattaaggtatatttgttcgaagagatgcgtcccactccggagatgtcttttgccatccgtcatctcggttgccagagcggcattatcctgactgcttcacacaacccgaaagaatacaacggttataaggcttattgggacgacggtgcgcaagtactggctccgcacgataagggcattatcgatgaagtgaataagattgcttctgctgccgatatcaagttccagggtaacccggatctgattcagatcatcggagaagatgtcgataagatatatctggatatggtgaagactgtttctatcgatcctgaagcgatcgcccgccataaagatatgaagattgtatacactccgatccacggtacaggcatgatgctgattccgcgtgcactgaagatgtggggattcgagaacgtatataccgtgcccgagcagatgattaaggacggtaacttcccgacagttgtctctccgaatccggagaatgcggaagctttgacgatggctcttaatctggctaaagaaattgatgccgaccttgtaatggcttccgacccggatgccgaccgcgtaggtatcgcttgtaagaacgataaaggcgaatgggtattgattaatggtaaccagacttgtctgatgtatctttattacatcatcactcaatataacaaactgggcaaaatgaccggtaatgaattttgtgtgaaaactatcgttactaccgaactgatcaagaagattgccgataagaatcacattgagatgctcgattgctacaccggtttcaaatggattgcccgtgaaattcgtttgcgtgaaggcaagaagaaatacatcggcggtggtgaagaaagctatggctttctggctgaggactttgttcgtgataaagacgctgtttctgcttgctgcctgattgccgaagtggctgcttgggccaaggataacggaaagactctgtatcagttgctgatggacatctacgttgaatatggattctctaaggaatttactgtaaacgttgtgaaaccgggtaagagcggtgcggaagagattaaagccatgatggagaatttccgtgctaaccctccgaaagagttgggtggttcgaaagtggttctgtcgaaagattacaagactctgaaacaaaccgacgcagcgggccatgtgactgacatcgatatgccggaatcatcgaatgtactgcaatatttcacagaagacggtggaaaagtatctgttcgtccgtcaggaacggagccgaagatcaaattctatatcgaagtgaaaggtgagatgggatgccgcaactgttttgctactgccgatgcagaagctactgaaaaagtagaagcagtgaagaagtcactgggtatttaa

SEQ ID NO: 12653 - protein, 581 aa, Bacteroides fragilis NCTC 9343
MGNEELIKQVTEKAEKWLTPAYDAETQAEVKRMLENEDKTELIEAFYKDLEFGTGGLRGIMGVGTNRMNIYTVGAATQGLSNYLNANFKDMKQISVVVGYDCRNNSSLFAKISADIFSANGIKVYLFEEMRPTPEMSFAIRHLGCQSGIILTASHNPKEYNGYKAYWDDGAQVLAPHDKGIIDEVNKIASAADIKFQGNPDLIQIIGEDVDKIYLDMVKTVSIDPEAIARHKDMKIVYTPIHGTGMMLIPRALKMWGFENVYTVPEQMIKDGNFPTVVSPNPENAEALTMALNLAKEIDADLVMASDPDADRVGIACKNDKGEWVLINGNQTCLMYLYYIITQYNKLGKMTGNEFCVKTIVTTELIKKIADKNHIEMLDCYTGFKWIAREIRLREGKKKYIGGGEESYGFLAEDFVRDKDAVSACCLIAEVAAWAKDNGKTLYQLLMDIYVEYGFSKEFTVNVVKPGKSGAEEIKAMMENFRANPPKELGGSKVVLSKDYKTLKQTDAAGHVTDIDMPESSNVLQYFTEDGGKVSVRPSGTEPKIKFYIEVKGEMGCRNCFATADAEATEKVEAVKKSLGI

SEQ ID NO: 12654 - DNA, 1806 bp, Chlamydophila abortus S26/3
  CDS (1)..(1806): transl_table=11
atgcagcatcttcagaagaaaatagaagctctttgtagccccattacaacaaagaatatccttacctggttatctaacgattgtaatgaacaagataaggataccatagctgagcttctaaacaatgatccaaaacgtcttgaagagctattcggaatgactctttcctttggtacaggtgggctgcggagccctatgggattaggcaccaatagaatcaatgtttttactataagacgtgcgacccagggattggctcaagtattaaaaaaacatcatccccattctggagatctcattcgcgtcgttgtaggctatgatacgcgccataattctttcgattttgcccaagagactgctaaggttctagcaggaaataacattcacgttctcctatttaaacaccctgaacctttggctcttgtctctttcactttaagagcagaacgcgctttggcaggagtcatgattaccgcttctcataatcctccagagtataacgggtataaagtgtacatggcatcgggaggccaggtgctccccccttgggatcaggaaatcatgcacgcctcagcacatatagaagagatcgccatggctagctcattacaagatccctatattcattttataggggaggaatatgagcagctctatgtcgaaactgtacatacactgcagctctatcccgaagataatcggatttctggaccagcaatccgtgtcagctattctccactacacggaacaggagtcgccatgattcctcgagtgttacgagattggaattttcctatggtcaaccttgtcgaaaaacaggcgattcctgatggcgatttccctacagtacacttgcccaaccctgaagatcctgaagcactcactttaggtattgagcaaatgctaagaaatcaagacgatatttttatcgctaccgacccggatgcagaccggttaggagtggtgtgtctgcatgagaatcaaccctatagatttaacggaaatcaaatagcctgtttgcttgcagatcatattttacgtgctttgtctgcgcgcgctcctctaggaaaggaggataaagtagtgaaaagtttagtcactacagagatgctctccgccatcgtaaaattttatggcggcgatatcgtgaatgtagggacaggatttaaatatatcggtgagaaaatagaagcttggcgagagagtgtagtaagatacatatttggtgccgaagaatcttacggctacctatacggcacacatgtagaagataaagatgcaatgagtacatcagcattaattacagaggcggctttgcatcagaagctccaaggaaaaactcttcgcgatgcgattttagacttatatgaaacccatggatatttcatgaataaaacactttcgttgtcctttgaacaaggacaagaaagtctcatgaagtctcatatagaaaagttggcaaagctcgatccttccaccatgtccttaagaggctattccattcacacgtgtgaaaattatgatcaagggacaggaatcaatattccctgcgggatcacgtacaaattgcctctccctaagatggccatgttgtgttattactatcaaaatggaggaaaaattatcgtgcgtccttcaggaacagaaccgaaaatcaaactctattttgagcttgtcaatcattacgaagtcatcacaggaaacaaaaaagaacaaagacaacgagaagaggaaagcagggaacaattagagaaattcattgctgaatttaaagagaaatttttctccatagagtcggaagaataa

SEQ ID NO: 12655 - protein, 601 aa, Chlamydophila abortus S26/3
MQHLQKKIEALCSPITTKNILTWLSNDCNEQDKDTIAELLNNDPKRLEELFGMTLSFGTGGLRSPMGLGTNRINVFTIRRATQGLAQVLKKHHPHSGDLIRVVVGYDTRHNSFDFAQETAKVLAGNNIHVLLFKHPEPLALVSFTLRAERALAGVMITASHNPPEYNGYKVYMASGGQVLPPWDQEIMHASAHIEEIAMASSLQDPYIHFIGEEYEQLYVETVHTLQLYPEDNRISGPAIRVSYSPLHGTGVAMIPRVLRDWNFPMVNLVEKQAIPDGDFPTVHLPNPEDPEALTLGIEQMLRNQDDIFIATDPDADRLGVVCLHENQPYRFNGNQIACLLADHILRALSARAPLGKEDKVVKSLVTTEMLSAIVKFYGGDIVNVGTGFKYIGEKIEAWRESVVRYIFGAEESYGYLYGTHVEDKDAMSTSALITEAALHQKLQGKTLRDAILDLYETHGYFMNKTLSLSFEQGQESLMKSHIEKLAKLDPSTMSLRGYSIHTCENYDQGTGINIPCGITYKLPLPKMAMLCYYYQNGGKIIVRPSGTEPKIKLYFELVNHYEVITGNKKEQRQREEESREQLEKFIAEFKEKFFSIESEE

SEQ ID NO: 12656 - DNA, 1593 bp, Corynebacterium glutamicum ATCC 13032
  CDS (1)..(1593): transl_table=11
atggacgagtctcgtcagcttagtttcggcacagcagggttgcgtgcaccagttggcccggcgcgccatcagatgaatgttttgcaggtaaccagaactacagcaggtgttgctagttggttggcagaacgtgcggcactaaatccagtgccgcatttggttcctgaggatgaaacaggaatcggcagggcgttgtatccccaagatggtccgttgcgggtcgttgtggggtatgacgctcgctatggttcgcatacttttgctgcaaccactgcggaggtgttcgcgggtgctggttttgaggtgacgttgctccccacgcctagccctacgccgttgattccgtggttggtgaacaagcatgggttggatgcgggcgttcagatcacggcttcgcataatggtgcggcggacaatggctacaaggtgtttttgtctaatggtcgccagctttattctgaactggagcctgagcttgaggcgcatatcaatgctgtggaagatccgattcgggttcctcgggtgacggtgcgccccactgctgatcagctgcgtcgatatgttgatgagatggtgtcgttggtgactcctgatcaggctgatttgttgcgggtgaattctgagcggggcaatcttcgcgtggtgtataccgctctgcatggtgtgggtggccgcgcgatggccaatgctttccaatttgctggttttccccatactcatggcgtgaaggctcagcagtatcctgatcccaccttccccactgtggcgttccccaatccggaagagccttctgcgattgagttgttgttggaacgcgcaaaggaaaagaacgctgacattttgtttgcgcttgatcctgatgccgatcgttgtgctgtgggtattcgtaccgctgatggcggccaccgaatgctctctggcgatgaggtgggcacacttttggctactcgtttggttccggagtattccggtgaaggcccacgtcccgtggttgccaccacggtggtgtcttcgcagcttctgggtatcatcgccgaggataaagggtgggattattccgagacactgacgggattcaaaaatctgtcgagggctgccgatggtctcgacggaccgcttgctttcgcttatgaggaagctgtgggcacctgcccggttccagatgtcgtgccggataaggacggcatctctacagcgttgttcatggcgtcgtgggctgccgaactgaaggctcagggcgcaagcctgcagcaaaaactcaatgagttgtatcgccgatatgggtattttgcgtcctcgcaaattgctgtgcgcacgagcagtccacgcgagttagttgatcactggattgcgcatcctcagcaagaactcattggagtgtctgtcaccccacatattcttcctgaaaaacagggcattgctttgcatggccaggtggggcatgtgcatatccgtgctattggtcgagtctctggaactgaggcgaaagccaagctctatttggaagttggtcaggccagctcccatgatgaagcagctcagttgttgcatcagctggaggatgaagtccaaagctggttgagcaagctttag

SEQ ID NO: 12657 - protein, 530 aa, Corynebacterium glutamicum ATCC 13032
MDESRQLSFGTAGLRAPVGPARHQMNVLQVTRTTAGVASWLAERAALNPVPHLVPEDETGIGRALYPQDGPLRVVVGYDARYGSHTFAATTAEVFAGAGFEVTLLPTPSPTPLIPWLVNKHGLDAGVQITASHNGAADNGYKVFLSNGRQLYSELEPELEAHINAVEDPIRVPRVTVRPTADQLRRYVDEMVSLVTPDQADLLRVNSERGNLRVVYTALHGVGGRAMANAFQFAGFPHTHGVKAQQYPDPTFPTVAFPNPEEPSAIELLLERAKEKNADILFALDPDADRCAVGIRTADGGHRMLSGDEVGTLLATRLVPEYSGEGPRPVVATTVVSSQLLGIIAEDKGWDYSETLTGFKNLSRAADGLDGPLAFAYEEAVGTCPVPDVVPDKDGISTALFMASWAAELKAQGASLQQKLNELYRRYGYFASSQIAVRTSSPRELVDHWIAHPQQELIGVSVTPHILPEKQGIALHGQVGHVHIRAIGRVSGTEAKAKLYLEVGQASSHDEAAQLLHQLEDEVQSWLSKL

SEQ ID NO: 12658 - DNA, 1644 bp, Haemophilus influenzae 86-028NP
  CDS (1)..(1644): transl_table=11
atgacaacactttttgaggttgcacaacattggttaaaccaagatcctgacacagaaactcgtgcagaattaaccgcacttttagatgcagcaaaaggcggagataaagcggcagaagcagaattacatgcgcgttttgatggtcgcttacaatttggtacggcaggtttacgtggtcgtttacaagctggctcaatagggatgaaccgagttttagtttctcaagctgctggtggtttagcggaatatttaaaaggttacgataaagaaccctcaatcgtcattggttacgatggccgtaaaaactctgacgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggattaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgcgaatgacccagatgcagaccgtttagccgttgctgtgcctgatgcacaaggcaactggaaatcactacacggtaacgtggttggctgtttcttagggtggtatttggcaaaacaatatcaaggcaaacaaggtacattggcttgctcacttgtttcttccccagctcttgctgaaattgcgaaaaaatacggtttccaatcagaagaaaccttaactggtttcaaatacattggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaatcggaaaattaatgaccgcacttcgtaacaatccaccagcagaaatcgctggcgtgaaagtggcacaatttatcgaccatattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagattgcgtattggcagaatttgatgaaggtgttcgtcacattcttcgccaagatacttatggcaaataa

SEQ ID NO: 12659 - protein, 547 aa, Haemophilus influenzae 86-028NP
MTTLFEVAQHWLNQDPDTETRAELTALLDAAKGGDKAAEAELHARFDGRLQFGTAGLRGRLQAGSIGMNRVLVSQAAGGLAEYLKGYDKEPSIVIGYDGRKNSDVFARDTAEIMAGAGVKAYLLPRKLPTPVLAYAIQYFDTTAGVMVTASHNPPEDNGYKVYLGKANGGGQIVSPADKDIAALIDKVAAGNIQDLPRSDNYVVLNDEVVDAYITKTASLAKEPACDINYVYTAMHGVGYEVLSKTLAKAGLPQPHVVADQVWPDGTFPTVNFPNPEEKGALDLAIKVAKEKNAEFIIANDPDADRLAVAVPDAQGNWKSLHGNVVGCFLGWYLAKQYQGKQGTLACSLVSSPALAEIAKKYGFQSEETLTGFKYIGKVSGLLFGFEEALGYLVDPDKVRDKDGISAAIVFLDLVRNLKKQGKTLADYADEFTKEFGAYVSGQISIRVSDLSEIGKLMTALRNNPPAEIAGVKVAQFIDHIKTDRQSDILVFNLENGGRLIARPSGTEPKIKFYLDARGKDPKDADCVLAEFDEGVRHILRQDTYGK

SEQ ID NO: 12660 - DNA, 2043 bp, Frankia sp. CcI3
  CDS (1)..(2043): transl_table=11
atgccgtccgcgtcccgacccggcccgacgtccctgcccggcccgacgtccctgcccagcccgacgtccctgcccagcccgacgtccctgcccagcccgctcgccgagcaggtcgaggcctggctgaacgatgatccggatcccgccgaccgggccgaactggcccggctgcgcgacggcgcgggtcacgatgccacgctgctcgcggaactgaccacacgtttccacggaccgctgcggttcggcacagccgggttgcgcgggccactgcgcgccggtccagccggcatgaacactgccgtggtgcgccgcgccgccgccggactcgccacctggctcacgagcagggcaccaccagcaccggcaccaccagcaccggcggcaccgaagccggatccggccacggccgggagctccatgaacgccgcaccgggctcggccgcggccccgaattcctcgacggcgaccgtcgtcgtcggctacgacgcccggcatcgcagcgaggcgttcgccctcgacagcgcccgggtgttcgccggtgccggattgcgggcgctggtactccccgggccgctacccactccggtgctggccttcgccgtgcgcaggctgggcgcggacgccggcgtgatggtcacggccagccacaatccggccaccgacaacggctacaaggtctacctgggtgatgcttcctctgacgccgcgaggggagcgcagctcgtggctccggcggaccgtgagatcgaaggaatgatcgcggctgccggccccgcccgggcgatcccactcgccgagacctggcggaggctcgatgcggatgtcgtcgacgactacatacacgcggcggccacggccggccgggcagccaccgccacagccaccgccacagccacagccaccgacctacgcacagacgtgaccacagacccgacggccctgaccgttgcgtacaccccgttgcacggtgtcggcgcaggcgttctcggcgccgtgttcaccgccgcgggtctcgccgcacccagggtcgtccacgagcaggccgaacccgatccggagtttccgacagtccagtggccgaaccccgaggaggcgggggcgatggaccgggttctggcgctcggcgagcgcatcgacgccgatctggtactcgccaacgatcccgacgccgaccggtgcgccgtcgccgtcggagggcgggtactcagcggcgacgaggtcggtctgcttctcgccgatcatgtcctgcactcctgccccggtccggtggcgaccaccatcgtcagctcctccggtctgcgtgcgctggccgccgaggtcggcgttccttacgccgagacgctgaccggattcaagtggatcatgcgtgcggacgcgcggctggtcttcggctacgaggaggcactcggctacgccgtcgccccggagctggtccgcgacaaggacggcatcaccgccgccctcgccatcgccctggtcgccgcgcgggcgaagcaacgaggccggaccttgccagacctactcgacgagttgtccgcacgactcggtgtccatctcacggggcaacgctcggcgcgcttcgacgacgtcacccagatcgacgagacgatgcaccgcctgcgggcccagccgccgaccagcctcgccgggcgtcccgtcaccgcggtccgtgacctgctggccggtccgcgggacggggacgcaccggcgggaggcattccccctcgacccgcacgccccgtggaccgcgccgacgcggcgcatccggttctgccacccgccgacgtgctcatgctgttcctcgacgaggaccgggtgatcttccgcccgagcgggaccgaacccaaactgaaggtgtacctcgagaccgtggagccggtgccggggcatgccgttgacgcggtgcccgcggctcgggaccaggccgcggcacgcctgctccacctgcatacggccgcgggcaatctgctcgacggacgcgacggagatcacatctcgccgaagatccgatcacccgcgtcgccgagcccgggcacaatatag

SEQ ID NO: 12661 - protein, 680 aa, Frankia sp. CcI3
MPSASRPGPTSLPGPTSLPSPTSLPSPTSLPSPLAEQVEAWLNDDPDPADRAELARLRDGAGHDATLLAELTTRFHGPLRFGTAGLRGPLRAGPAGMNTAVVRRAAAGLATWLTSRAPPAPAPPAPAAPKPDPATAGSSMNAAPGSAAAPNSSTATVVVGYDARHRSEAFALDSARVFAGAGLRALVLPGPLPTPVLAFAVRRLGADAGVMVTASHNPATDNGYKVYLGDASSDAARGAQLVAPADREIEGMIAAAGPARAIPLAETWRRLDADVVDDYIHAAATAGRAATATATATATATDLRTDVTTDPTALTVAYTPLHGVGAGVLGAVFTAAGLAAPRVVHEQAEPDPEFPTVQWPNPEEAGAMDRVLALGERIDADLVLANDPDADRCAVAVGGRVLSGDEVGLLLADHVLHSCPGPVATTIVSSSGLRALAAEVGVPYAETLTGFKWIMRADARLVFGYEEALGYAVAPELVRDKDGITAALAIALVAARAKQRGRTLPDLLDELSARLGVHLTGQRSARFDDVTQIDETMHRLRAQPPTSLAGRPVTAVRDLLAGPRDGDAPAGGIPPRPARPVDRADAAHPVLPPADVLMLFLDEDRVIFRPSGTEPKLKVYLETVEPVPGHAVDAVPAARDQAAARLLHLHTAAGNLLDGRDGDHISPKIRSPASPSPGTI

SEQ ID NO: 12662 - DNA, 1728 bp, Myxococcus xanthus DK 1622
  CDS (1)..(1728): transl_table=11
atggacaccaccggactgaaggagcgggcggaggcgtggcgtcaggcggacccggatccgtccaccgcggcggagctggcggcgttgctggcgaaggcggactgggccgagctggaggaccgcttctcgcaggacctggagttcggcaccgcgggcctgcgcggcgtgctgggcgccggtcccaaccggatgaaccgcgccgtcatccgccgcaccaccgcgggccttgcgcgctacctcaaggagcaggtgccggacgtcgccacccggggcgtggtggtgggccgtgacgcgcgcaacctgagcgcggagctggccgaggacaccgccgcggtgctcgccgccgagggcatccccgcccatgtcttcccggagccggtgcccacgccgctggtggcctttgccgcgctgcacctcaacgccgccgcggccgtcatggtgacggccagccacaacccgcccgagtacaacggctacaaggtctattggggcaacggcgcgcaaatcatcccgccgcatgacacgggcatcgcctccgccatcgcccgggtggagcccgccaaccgcgtgccgctgctgacgccggccgatgcgcgcgccaagggcctgtggcgggatttgcctgcggccatcggcgatgcctacgtgcgcgccatcctggggctgcgcgtggtgggcaagggctccgagtcgctgtccatcgtctacaccgccatgcacggcgtgggcggcgactgggccgtgcgcgccctgcgcgaggcgggcttcccgcgcgtcacccccgtggccgagcagcagcagccggatggccgcttccccaccgtgcgcttccccaacccggaggagccgggcgccatggacctggccaccgccaccgccgagcgcgtgaaggcggacgtggtgctggccaatgacccggacgcggaccggctggccgtcatggcgcgcgacgcggacgggtcgctgcggctgctgacgggcaacgaggtgggcgtgctgctgggccactacgtcctcacccagggggcgaagcagggcaagccccacgtcgtcaccaccatcgtctcctcggcgcagttgggagacatcgcgcgctcgctgggcgccgcgtgtgacgaggtgctcaccggcttcaagtggatcgccaaccgcgcgctggagcgcgagcaggccgagggcacccgcttcgtcttcggttacgaggaggcgctgggctacaccgtgggcacggtgacgcgcgacaaggacggcgtgggctcggcgctcgtcatggcggacctggcggcgtggtgtcaggcgcgcggcaccacggtgctgggctacctggaggagattcagcgcgcgcatggcctgtacgtgggcgcgcagcgcaacttcacgttccccggtgcggcgggcgcgcaggtcatccgcggcatcatggacgcgttccgtgcctcgcctccgaaggacattggcggcgacgccgtccgtgccgtgagcgactacaagaagggcgagcggggcctgcctccgtccaacgtcgtcgcgctcgagttggagagcggcggccgcgtcacgctgcgcccctccggcaccgagccgaaaatcaaatactacttcgagctgaaggagacgctcgccgacggtgagcccctggctcaggcccgtgcgcgcgccgagtcccggctggcccgcttcatcgatgctttcctcggcctcgcgcgtgagcgcgggcagccggcatga

SEQ ID NO: 12663 - protein, 575 aa, Myxococcus xanthus DK 1622
MDTTGLKERAEAWRQADPDPSTAAELAALLAKADWAELEDRFSQDLEFGTAGLRGVLGAGPNRMNRAVIRRTTAGLARYLKEQVPDVATRGVVVGRDARNLSAELAEDTAAVLAAEGIPAHVFPEPVPTPLVAFAALHLNAAAAVMVTASHNPPEYNGYKVYWGNGAQIIPPHDTGIASAIARVEPANRVPLLTPADARAKGLWRDLPAAIGDAYVRAILGLRVVGKGSESLSIVYTAMHGVGGDWAVRALREAGFPRVTPVAEQQQPDGRFPTVRFPNPEEPGAMDLATATAERVKADVVLANDPDADRLAVMARDADGSLRLLTGNEVGVLLGHYVLTQGAKQGKPHVVTTIVSSAQLGDIARSLGAACDEVLTGFKWIANRALEREQAEGTRFVFGYEEALGYTVGTVTRDKDGVGSALVMADLAAWCQARGTTVLGYLEEIQRAHGLYVGAQRNFTFPGAAGAQVIRGIMDAFRASPPKDIGGDAVRAVSDYKKGERGLPPSNVVALELESGGRVTLRPSGTEPKIKYYFELKETLADGEPLAQARARAESRLARFIDAFLGLARERGQPA

SEQ ID NO: 12664 - DNA, 1740 bp, Cytophaga hutchinsonii ATCC 33406
  CDS (1)..(1740): transl_table=11
ttgccaaaagcagacgttgcaaccaagaaaaaaatccagacatggctgagcggcagttatgatgcagatacaaaaaaagaaattcaatctttagtagatgcgggcaaagaagacgaattgattgaatgtttctataaagatcttgaatttggtacaggtggtttgcgaggccttatgggtgttggttcaaacagaatgaacaaatatacgataggggctgcaacacaaggtttgtgtaattacttaaaaaagaattttcccggccaaccgttaaaagcagccatcgcacacgacagcagaaacaattcagacttttttgcccgtactacggcagaagtttttgcagcaaacggcattcaggtatatttctttaaagcactgcgttctacaccggaactttcgttcgctatccgtcatttcggttgccagacaggtgtagtgcttaccgcttcacacaacccgaaagaatataatggttacaaagcctattggaacgatggggcacaggtaattgctccgcacgataaaaacattataacagaagttcagaagatctccagcatcgacgatgtaaactttaatgcggaccaatcattgattacagagatcggtgaagaagttgataatgcttatctgaatgaaattgtaaagcttactgtttcacctgacgccatcaaacgtcagaaggacatgaaaatcgtttatacacccatccacggtacaggcattgtgctggttcctgagattttaaaacgttttggttttgaaaatgtacgcgtagtgcaggaacaggctgttccggatggcaacttccctaccgtagtatatccaaacccggaagaaaaagatgctttaagcttagctgtgaaacaggcaaccgaatggaacgcagaccttgtaatggcaaccgatccggatgcggatcgcgtaggcattgccattaaaaatgataagaatgaattccagttgttaaacggtaaccagacaggtagtttactgatcctgtatatgctgcaggcctggaagaatgcgaataaaatcaccggaaaagaattcattgttaagaccattgtaacaacggatctgatcgaaaagatcgcgaacaaatttggcgtgaagtattacaataccttaaccggtttcaaatacattgccgctaaaataaaagagcttgaaggcaaggaacaattcattgccggtggcgaagagagctacgggtacctgattggcgacagcgtacgcgataaagatgcgatcgcatcatgtgcgttcattgctgaaatggttgcgtatgcgaaagatcagggcaaatccttatacgacatgctgctggatatgtacgtggaatatggcttctacaaagaacacctcatctccctgacaaaaaaaggcaaatccggcgcggaagaaatccagaccatgatgaaagagcttcgtgctacgcctcctaaaacattaagcggttctccggttgaatggatgttcgattacgatagtcagcttgcaacaaacattatcaacggtactacaaagaaaattgaattgccgcaggaaaatgtattacagttcaaaacggcagacggcacattagtatctgcgcgcccatccggtacagaaccgaagatcaaattctatttcagtgttaacgaaccgttggcatcaagagcagaattcgcagcggtagataaaaaattagatacgaagattcagacgcttattagtgatttgaaattggcgtaa

SEQ ID NO: 12665 - protein, 579 aa, Cytophaga hutchinsonii ATCC 33406
MPKADVATKKKIQTWLSGSYDADTKKEIQSLVDAGKEDELIECFYKDLEFGTGGLRGLMGVGSNRMNKYTIGAATQGLCNYLKKNFPGQPLKAAIAHDSRNNSDFFARTTAEVFAANGIQVYFFKALRSTPELSFAIRHFGCQTGVVLTASHNPKEYNGYKAYWNDGAQVIAPHDKNIITEVQKISSIDDVNFNADQSLITEIGEEVDNAYLNEIVKLTVSPDAIKRQKDMKIVYTPIHGTGIVLVPEILKRFGFENVRVVQEQAVPDGNFPTVVYPNPEEKDALSLAVKQATEWNADLVMATDPDADRVGIAIKNDKNEFQLLNGNQTGSLLILYMLQAWKNANKITGKEFIVKTIVTTDLIEKIANKFGVKYYNTLTGFKYIAAKIKELEGKEQFIAGGEESYGYLIGDSVRDKDAIASCAFIAEMVAYAKDQGKSLYDMLLDMYVEYGFYKEHLISLTKKGKSGAEEIQTMMKELRATPPKTLSGSPVEWMFDYDSQLATNIINGTTKKIELPQENVLQFKTADGTLVSARPSGTEPKIKFYFSVNEPLASRAEFAAVDKKLDTKIQTLISDLKLA

SEQ ID NO: 12666 - DNA, 1728 bp, Clostridium perfringens ATCC 13124
  CDS (1)..(1728): transl_table=11
gtgtatagagaaaaatatgaagaatggctaaattctgatattatttctgaggaaataaaggcggaattaagagacgtaaaagaagataaggaaatagaagatagattttataaggaattagattttggtactggtggattaagaggtattattggtgctgggactaatagaatgaatatctatactgtaggaaaagctactcaaggatttgcagattatttaaatgataattatgcgggggaaaaatctgttgcaatagcttatgactcaagaaatatgtctaaggagtttgcaaaagcggctgctttaactctttgtgcaaatggaataaaggttaatctttttgaatctttaagaccgactccaatgttatcctttgcagtaagagaattaaattgtaagggtggtattgttataacagcatcacataatccaaaacaatacaatggatataaagtttatggagatgatggatgtcaattaacagatgctcctgcaaaagctgttattggatatgttaacaaagttacagattacgcaaacataaagacaatgagtgaagaaaaggctttagaagaaggacttttagtttatattggtgaagaaatagataaaaaatatatagatgatttaaaaactttaactataagagaagatttagttaagaagcatgctaaagatttaaaaataatttatactccaattcatggttcaggaaatgttcctgtaagaagaatattaaaagagttaggatatgagaatgtgtttgttgttaaagaacaagaaatgccagatggaaatttcccaacagctccatatccaaatccagaagatccaaaggtatttaaattagctttagacatggctaaagaaattcaacctgatataatatttggaacagatccagactgtgatagaataggtgttgttgttaaagacaataatggagagtaccaagtattaagtggtaaccaaacaggaatgttactaactaactatatattaagttcattaaaggaaatgaataaattacctgaaaatggtgcagttataaaaactatagttactacagagtcagtaagaaaaatgactgaggaatatggggtaactttaatagatacattaacaggatttaaatatataggtgaaaagataagagaatttgaagaatcaggttcaaatgaatatttatttggttttgaagaaagctatggttacttagctggaacttttgctagagataaggatgctgttgtagcttcaatgttaatagctgaaatgactttatattataaagaacaaggaaaaactctttatgatggtttaatagagctttataataaatatggttacttcaaagaaagcttagtatcaatagaacttgctggaaaagaaggacaagaacaaatagctaagtgcatagatggcttaagaaatgatgccctaaaagaaatgaatggagttaaagttattacatctttcgattataagttaagcaaagaagtaaataacttaactgatgaagaaaaagaaataaaacttccaaaatcaaatgttttaaaatatgttttagaagatgattcttggtttgttgtaagaccatcaggtacagagcctaagatgaaaatttacttatcagtaaaaggttcaagtttagaagattcaaaagaaaaaactgaaaactttaaaaatgcaataatggaagtaattaatgctaaattaaaatag

SEQ ID NO: 12667 - protein, 575 aa, Clostridium perfringens ATCC 13124
MYREKYEEWLNSDIISEEIKAELRDVKEDKEIEDRFYKELDFGTGGLRGIIGAGTNRMNIYTVGKATQGFADYLNDNYAGEKSVAIAYDSRNMSKEFAKAAALTLCANGIKVNLFESLRPTPMLSFAVRELNCKGGIVITASHNPKQYNGYKVYGDDGCQLTDAPAKAVIGYVNKVTDYANIKTMSEEKALEEGLLVYIGEEIDKKYIDDLKTLTIREDLVKKHAKDLKIIYTPIHGSGNVPVRRILKELGYENVFVVKEQEMPDGNFPTAPYPNPEDPKVFKLALDMAKEIQPDIIFGTDPDCDRIGVVVKDNNGEYQVLSGNQTGMLLTNYILSSLKEMNKLPENGAVIKTIVTTESVRKMTEEYGVTLIDTLTGFKYIGEKIREFEESGSNEYLFGFEESYGYLAGTFARDKDAVVASMLIAEMTLYYKEQGKTLYDGLIELYNKYGYFKESLVSIELAGKEGQEQIAKCIDGLRNDALKEMNGVKVITSFDYKLSKEVNNLTDEEKEIKLPKSNVLKYVLEDDSWFVVRPSGTEPKMKIYLSVKGSSLEDSKEKTENFKNAIMEVINAKLK

SEQ ID NO: 12668 - DNA, 1590 bp, Rhodococcus sp. RHA1
  CDS (1)..(1590): transl_table=11
gtgagcgatccgatcacggactggatcgacgccgatcccgaccccgaaacccgggcggaactcgcaaatctctccgccgacgagctcgccgaccgcttcgccgctccgctgagtttcgggaccgcgggtctgcgcgggccggtacgggcaggcccgaacggcatgaatcacgccgtggtgatccgcacgacggccgggctgagcgcgtggctgaaagaccggtgcccgggcggctccaccgtcgtcgtcgggcgcgacgcgcggcacggatccgagaagttcgccgtcgccgccgcggaagtgctggcggccgcaggattctcggtcgtcctcctcccccgcccgctccccacaccgattgtcgcgttcgcggtccgccgcctccgcgccgcggccggcgtgcagatcaccgcctcccacaaccccgccgccgacaacgggtacaaggtctacctcgacggcggcgcccagttgatctcgccgtccgacaaggagatcgaaacatcgatcgcccgggtcgggccggcgaatctcgtgccccgcaccccggtgacaccgacgtccgaggaactcctcgaccgctacgtcgagcgggtcgcgtccctgccgacgggacggtcgcggaccctgcgcatcgcgatcaccgccatgcacggcgtcggcggcgagaccgcggtcaccgcactgaaatccgccggattcaccgacgtccacaccgtcgccgcacagttccacccggacccggactttccgaccgtcgaattccccaatcccgaggagccgggcgcctcggacgccgtcctcgctctcgccgcggacgtcggcgccgacatcgcgctggccctcgaccccgacgcagaccggtgcgcggtcggcgtgcgcgggccggacggctggcggatgctccgcggcgacgagacaggggtcctgctcggcgagcacgtccttgcctccgcccctgccgattcgctcgtcgcgacgacgatcgtctcgtccgacctcctcggaaagctcgccgaagcccgcggcgcccgcttcgcccgcaccctcaccggcttcaagtggctcgtccgagcgggcgagggtctcgtgtacgcgtacgaggaagcgatcggtcactgcgtcgacccggagtcggtgcgcgacaaggacggtatctccgccgcggtgatggccgccgatctcgccgcgaccctgcgagcagaggggacgacactcctcgacaggctggacgactacgcgctcgaattcggattgcacgccggagaccagctgtcgcgacgtgtcaccgacctcacggacatcaccgcgatgatgcagcgcttgcggtcggaactgccgaccgaactggccggcgaacccgtcgaggccaccgacctggcggaactgcgggggccgtcccgcaccgacgccgtcgtcctcgccgggtccaccgttcggatggtcgtgcgtccctcgggaaccgaacccaagctcaagtgctacctggaggtcatagtcccggtgcccgatcaatcggcgctaccctcagcccgcgagacggccgcaacccggttgaacctgttgcgcgagttcgccgaagccctgtag

SEQ ID NO: 12669 - protein, 529 aa, Rhodococcus sp. RHA1
MSDPITDWIDADPDPETRAELANLSADELADRFAAPLSFGTAGLRGPVRAGPNGMNHAVVIRTTAGLSAWLKDRCPGGSTVVVGRDARHGSEKFAVAAAEVLAAAGFSVVLLPRPLPTPIVAFAVRRLRAAAGVQITASHNPAADNGYKVYLDGGAQLISPSDKEIETSIARVGPANLVPRTPVTPTSEELLDRYVERVASLPTGRSRTLRIAITAMHGVGGETAVTALKSAGFTDVHTVAAQFHPDPDFPTVEFPNPEEPGASDAVLALAADVGADIALALDPDADRCAVGVRGPDGWRMLRGDETGVLLGEHVLASAPADSLVATTIVSSDLLGKLAEARGARFARTLTGFKWLVRAGEGLVYAYEEAIGHCVDPESVRDKDGISAAVMAADLAATLRAEGTTLLDRLDDYALEFGLHAGDQLSRRVTDLTDITAMMQRLRSELPTELAGEPVEATDLAELRGPSRTDAVVLAGSTVRMVVRPSGTEPKLKCYLEVIVPVPDQSALPSARETAATRLNLLREFAEAL

SEQ ID NO: 12670 - DNA, 1659 bp, Haemophilus somnus 129PT
  CDS (1)..(1659): transl_table=11
atgactgccctttttaccactgctcaaaactggctcgctcaagaccctgatgcggaaactcgtgcagaattacaaacattactcaaccaagccaaagcaggcgatatgaatgcacagaaagagttacataaccgttttaacggtcggttgcaattcggtaccgctggtttacgcggtcgcttacaagctggttctatgggtatgaaccgtgtactcgtggctcaagcagcgggcggtttggcggaatacctaaaaggctatgatagtgaaccctctatcgtattaggttatgacggtcgtaaaaactctaatgtgttcgtacgagataccgctgaaattatggctggtgcgggcatcaaaaccttccttttgccacgaaaattgccaacacctgtactggcttacgctatcaaatacctcaacactacggcaggcgtgatggtcaccgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacacagtgttagacgatgagatcgtagaggcatatatcgcaaaaaccgcctctattgccaaagagccacaagcaaatattaactacgtttacaccgcaatgcacggagtaggctatgaagtgttgagtaaaaccttagcgaaagcaggcttaccacaaccacatttggtcgaagagcaaattcaacctgatggctcattcccaacggtcaagttcccaaatccagaagagaaaggtgcgttagatttagcaattaaactggcaaaagcaaaaaatgccgagttcatcattgccaacgaccctgacgcagaccgtcttgcagttgcggtacctgattcggaaggcaactggaaacctttgcacggtaacgtgataggctgtttcttaggttggtatctagcaaaacaataccacgcacagggcaaacagggcaaattagcttgctcactggtttctagtcctgctctggcggaaattgcgaaaaaatacggtttccaatccgaagaaactttaactggtttcaaatatatcggcaaagtgaacgacttattgttcggctttgaagaagctttgggctacttagtcgatccagacaaagtacgtgataaagacgggatttcagctgctattgccttcttagatttagtccgtagcctgaaaaaagagggtaaaacactaacagattacgctaatgactttactgcggaattcggtgcatatgtaagcggacaaatctctattcgtgtgaacgaattatcggatatcggcaaaatgatgaccgcacttcgtaaagaaccactaacagaattaggcggtttcaaagttacacaatttattgatcacagtaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcaggcgaagtattagcggagtttgatgagaacgtacgccaaatcctccgacaagagaagtacggaaaacaggattgctaa

SEQ ID NO: 12671 - protein, 552 aa, Haemophilus somnus 129PT
MTALFTTAQNWLAQDPDAETRAELQTLLNQAKAGDMNAQKELHNRFNGRLQFGTAGLRGRLQAGSMGMNRVLVAQAAGGLAEYLKGYDSEPSIVLGYDGRKNSNVFVRDTAEIMAGAGIKTFLLPRKLPTPVLAYAIKYLNTTAGVMVTASHNPPEDNGYKVYLGKANGGGQIVSPADVDIAKLIDKVANGDIRDLPRSQHYTVLDDEIVEAYIAKTASIAKEPQANINYVYTAMHGVGYEVLSKTLAKAGLPQPHLVEEQIQPDGSFPTVKFPNPEEKGALDLAIKLAKAKNAEFIIANDPDADRLAVAVPDSEGNWKPLHGNVIGCFLGWYLAKQYHAQGKQGKLACSLVSSPALAEIAKKYGFQSEETLTGFKYIGKVNDLLFGFEEALGYLVDPDKVRDKDGISAAIAFLDLVRSLKKEGKTLTDYANDFTAEFGAYVSGQISIRVNELSDIGKMMTALRKEPLTELGGFKVTQFIDHSKTDRASDILVFVLENGSRLIVRPSGTEPKVKFYLDVCGTDPKNAGEVLAEFDENVRQILRQEKYGKQDC

SEQ ID NO: 12672 - DNA, 1722 bp, Shewanella sp. MR-4
  CDS (1)..(1722): transl_table=11
atgaatacccatttgcaattacaggttaagcattggctcgaaaatgacccagatccccgcactcaggcacaactgcaagccttaatcgacgccggaaatgacaccgaactcgaggcacgttttgcgggacgtttagaatttggaaccgccggattacgcggtgtagtgggcgcaggtcctatgggcatgaatcgcttggttatccgccaaacgtctgcagggcttggtacctatctacttgaacaaattaaagatgctgccgagcgcggagtcgtgattggatacgatggccgtcacgattcacgcactttcgcccatgataccgccagtgtgctcaccgcgatggggattaaagtgcgcctcaccgccaaagtggcaccaacgccgctggtggcctttggggttaagcattttaatgccgccgccggtattgtggtgaccgccagccataacccgccacaatacaatggctacaaagtgtattgggaaaacggcgcgcagattatcccgccccatgactcaggtatcgccgctcaaattgagctggcggcaacccaagcaattccgtttatggatcaggtggaggcgaccaaacagggcaagcttatctggttgcaggacgattattacgaaacctatcgccgcggcgtgatgcacgccaatgtgctgcaaaataacaccgcgcctgaaaaagtcagtcttgcctataccgcgatgcacggagtgggcgcagaaatggctgaaaccgtgctcaaggatgcgggttttacccaagtgtattcggtggcggcgcagcgcgaacctgatggcgatttcccaacggttaatttcccgaatccggaagaaaaaggtgcgatggacttagtcatcgccgaagcgaaaaagcatggtgctatgcttgcctgcgccaatgaccccgatgccgacagattcgcggttgctgtacgtaaggatgatggcgagtatcaaatgctaacgggcgaccaagtgggcgtgctctttggccattatctgttaagccatgccgcgaaagaccaacgtctggtgggcaccaccattgtgtcctccagtctattatctaaaatcgccaaaggctttggcgttgaaagttataccacgctcaccggttttaaatggctgatgaatgtggggattgcgcagactcagcctgataatcaattcctgtttgcctacgaagaggcgctgggttacaccgtcggtaacatggtgtgggataaggacggcctatcggcattagtcgccttcgcccaattaaccgccgagcttgccgccaaagggcaaagcatttgggatagactcgaacagatataccgcgagcagggtttccatctcaatgctcaagttagcattgccttaaaacccgacacgcctaatatcggcgcctatctgcgtgaacatccgccgctggcaattggtgaacatgccgtggtgtcgaccgatgatctcaaggcgttagagcgccgttttgccgatggcaaggtcgagaaaatcaatctgcccgccagtgacgtattaacctatcgcttagccaatggcgcgcgggtgatagtacggccatcgggcactgagccaaaaatcaagtgctattacgaggtggtcgagcctatgacggcgcaagacaccttggccagcgcccaagctcgggcaactcaggcgatggaggcgtttatttcagcccatcaggcgagcctacctaaataa

SEQ ID NO: 12673 - protein, 573 aa, Shewanella sp. MR-4
MNTHLQLQVKHWLENDPDPRTQAQLQALIDAGNDTELEARFAGRLEFGTAGLRGVVGAGPMGMNRLVIRQTSAGLGTYLLEQIKDAAERGVVIGYDGRHDSRTFAHDTASVLTAMGIKVRLTAKVAPTPLVAFGVKHFNAAAGIVVTASHNPPQYNGYKVYWENGAQIIPPHDSGIAAQIELAATQAIPFMDQVEATKQGKLIWLQDDYYETYRRGVMHANVLQNNTAPEKVSLAYTAMHGVGAEMAETVLKDAGFTQVYSVAAQREPDGDFPTVNFPNPEEKGAMDLVIAEAKKHGAMLACANDPDADRFAVAVRKDDGEYQMLTGDQVGVLFGHYLLSHAAKDQRLVGTTIVSSSLLSKIAKGFGVESYTTLTGFKWLMNVGIAQTQPDNQFLFAYEEALGYTVGNMVWDKDGLSALVAFAQLTAELAAKGQSIWDRLEQIYREQGFHLNAQVSIALKPDTPNIGAYLREHPPLAIGEHAVVSTDDLKALERRFADGKVEKINLPASDVLTYRLANGARVIVRPSGTEPKIKCYYEVVEPMTAQDTLASAQARATQAMEAFISAHQASLPK

SEQ ID NO: 12674 - DNA, 1722 bp, Shewanella sp. MR-7
  CDS (1)..(1722): transl_table=11
atgaatacccatttgcaattacaggttaagcattggctcgaaaatgacccagatccccgcactcaggcacaactgcaagccttaatcgacgccggaaatgacgccgaactcgaggcacgttttgcgggacgtttagaatttggaaccgccggattacgcggtgtggtgggcgcaggtcctatgggcatgaatcgcttggttatccgccaaacatcagcaggacttggtgcctatttactcgaacaaattaaagatgccgccgagcgcggagtcgtgattggttacgatggccgtcacgattcacgcactttcgcccatgataccgccagtgtgctcaccgcgatggggattaaggtgcgcctcaccgccaaagtggcgccaacgccgctggtggccttcggggttaagcattttaatgccgctgcgggtattgtggtgactgccagccataacccgccacaatacaatggctacaaagtgtattgggaaaacggcgcgcagattatcccgccccatgactcaggtatcgccgctcaaattgagctggctgcaacccaagctattccgtttatggatcaggtggaggcgaccaaacagggcaagcttatctggttgcaggacgattattacgaaacctatcgccgcggcgtgatgcacgccaatgtgctgcaaaataacaccgcgcccgaaaaagtcagtcttgcctataccgcgatgcacggagtgggcgcagaaatggcggaaaccgtgctcaaggatgcgggttttacccaagtgtattcggtggcggcgcagcgcgaacctgatggggatttcccaacggttaatttcccgaatccggaagaaaagggtgcgatggacttagtcatcgccgaagcgaaaaagcatggtgccatgctcgcctgcgccaatgaccctgatgccgacagattcgcggttgctgtacgtaaggatgatggcgagtatcaaatgctaacgggcgaccaagtgggcgtgctctttggccattatctgttaagccatgcgagcaaggagcaacgtctggtgggctcgactattgtgtcctccagtctgttatctaaaatcgccaaaggctttggcgttgaaagttataccacgctcaccggttttaaatggctgatgaatgtggggattgcgcagactcagcctgaaaatcaattcctgtttgcctacgaagaggcgctgggttacaccgtcggtaacatggtgtgggataaggacggcctatcggccctagtcgccttcgctcaattaaccgccgaggttgccgccaaagggcaaagcatttgggatagactcgagcagatctaccgcgagcagggttttcatctcaatgctcaagttagcatcgccttaaaacccgatacgcccaatatcggtgcctatctgcgtgaacattcgccgcaggcaattggtgaacatgccgtggtgtcgactgatgatctcaaggcgttagagcgccgttttgccgatggcaaggttgagaaaatcaatctgcccgccagtgatgtattaacttaccgcttagccaatggcgcgcgggtgatagtacggccgtcgggcactgagcctaaaatcaagtgctattacgaggtggttgagcctatgacggcgcaagacaccttggccagcgcccaagctcgggcaactcaggcgatggaggcgtttatttcagcccatcaggcgagcctacctaaataa

SEQ ID NO: 12675 - protein, 573 aa, Shewanella sp. MR-7
MNTHLQLQVKHWLENDPDPRTQAQLQALIDAGNDAELEARFAGRLEFGTAGLRGVVGAGPMGMNRLVIRQTSAGLGAYLLEQIKDAAERGVVIGYDGRHDSRTFAHDTASVLTAMGIKVRLTAKVAPTPLVAFGVKHFNAAAGIVVTASHNPPQYNGYKVYWENGAQIIPPHDSGIAAQIELAATQAIPFMDQVEATKQGKLIWLQDDYYETYRRGVMHANVLQNNTAPEKVSLAYTAMHGVGAEMAETVLKDAGFTQVYSVAAQREPDGDFPTVNFPNPEEKGAMDLVIAEAKKHGAMLACANDPDADRFAVAVRKDDGEYQMLTGDQVGVLFGHYLLSHASKEQRLVGSTIVSSSLLSKIAKGFGVESYTTLTGFKWLMNVGIAQTQPENQFLFAYEEALGYTVGNMVWDKDGLSALVAFAQLTAEVAAKGQSIWDRLEQIYREQGFHLNAQVSIALKPDTPNIGAYLREHSPQAIGEHAVVSTDDLKALERRFADGKVEKINLPASDVLTYRLANGARVIVRPSGTEPKIKCYYEVVEPMTAQDTLASAQARATQAMEAFISAHQASLPK

SEQ ID NO: 12676 - DNA, 1725 bp, Pediococcus pentosaceus ATCC 25745
  CDS (1)..(1725): transl_table=11
atgagttgggaagattctgtcaaagaatggcaagattatgcagatttagattttaatttaaaaaaagaattagcaactttagctgaagataaagatgctttaaaagaagccttttatgctccaatggaatttggtacagcaggaatgcgtggcgtaatgggccctggtatcaaccggatgaatatctatacggttcgtcaagcaacagaaggtttagctaattttatggataccttggattttactgataagaaacggggagtggcgatcagttttgattcccgctatcactcacaagagtttgctttagcagcagctggtgttttaggtaagcatggtattccaagttttgtttttgatagtatgcgtcccactccagaattatcatatacagtacgtgagttaaacacttatgctggaatcatgattactgctagtcataatcctaaacaatataatggatataagatttatggtcctgatggcggacaaatgccaccaatggaatctgataagattacagaatatattcgccaagtaactgacatctttggtgttgaaactcttactcaaagtgaattaagagctaagggcttaatgaccattattggtgaagacattgacctcaagtatcttgaggaagttaagacggtatcaattaatcatgaactaatccaacgctttggtgcagacatgaagttgatctactcaccattacatggtactggaaaagtagttggtggacgtgcgttagaaaatgctggttttaaggattacactatggtccctgaacaagcaattgctgacccagaatttattacaacgccattccctaacccagaattcccacaaacttttgatttggctattgaattaggtaaaaagcaagatgctgaccttttgattgccactgatccggatgccgatcgtttgggagctgccgttcgtttaccaaatggtgactacaaattattgacaggaaatcaaattgcagccctgatgttagaatacatcttaactgcgcatgatgcagcgggtgacttgccaagtaatgcagctgccgttaaatcaattgtttctagtgaactagcaaccagaattgccgaagcccatcatgtagaaatgattaacgttctaactgggtttaagtacattgctgaccaaattaaacattacgaagaaaatggcgaccatacctttatgtttggtttcgaagaaagttatggctatcttgttcggccatttgttcgcgataaagatgccatccaaggaattgtcctattggctgaaattgctgcttattatcgtagtaaggggcaaaccttatatgacggtcttcaaaacttatttactacttacggatatcatgaagaaaagaccatttcaaaagatttccctggagttgacggtaaagaaaaaatggctgccattatggaaaaggttcgtgaagaacgcccaagtcaatttgatcagtacaaggtattagaaactgaagacttcttagctcaaactaagtatgaagcagacggatctacccaagctatcaaattaccaaaagcggatgttttgaaatttacattagatgatggtacttggattgcaattcgcccttctggaacagaaccaaaaattaaattctatattggtacagttggcgaagatgaaaaagatgctttgaataagattgatgtttttgaaacagctattaatgaacttataaaataa

SEQ ID NO: 12677 - protein, 574 aa, Pediococcus pentosaceus ATCC 25745
MSWEDSVKEWQDYADLDFNLKKELATLAEDKDALKEAFYAPMEFGTAGMRGVMGPGINRMNIYTVRQATEGLANFMDTLDFTDKKRGVAISFDSRYHSQEFALAAAGVLGKHGIPSFVFDSMRPTPELSYTVRELNTYAGIMITASHNPKQYNGYKIYGPDGGQMPPMESDKITEYIRQVTDIFGVETLTQSELRAKGLMTIIGEDIDLKYLEEVKTVSINHELIQRFGADMKLIYSPLHGTGKVVGGRALENAGFKDYTMVPEQAIADPEFITTPFPNPEFPQTFDLAIELGKKQDADLLIATDPDADRLGAAVRLPNGDYKLLTGNQIAALMLEYILTAHDAAGDLPSNAAAVKSIVSSELATRIAEAHHVEMINVLTGFKYIADQIKHYEENGDHTFMFGFEESYGYLVRPFVRDKDAIQGIVLLAEIAAYYRSKGQTLYDGLQNLFTTYGYHEEKTISKDFPGVDGKEKMAAIMEKVREERPSQFDQYKVLETEDFLAQTKYEADGSTQAIKLPKADVLKFTLDDGTWIAIRPSGTEPKIKFYIGTVGEDEKDALNKIDVFETAINELIK

SEQ ID NO: 12678 - DNA, 1701 bp, Oenococcus oeni PSU-1
  CDS (1)..(1701): transl_table=11
atggtgaaagaaaaaacaatccaagaaaaaataaaagactgggaagtcgcggatcttccggaggatttgcgactggaatttgctaattccagtcaatctcaactagaagatgctttttatcaggatcttaattttggtacggccggaatgcgtggcttgttgggcgtcggtaccaatcggatgaatatttatacagttgcccaaacaaccgaagctttggcccggcatatggaaaaacagggagaaagcgcaaaacagcgtggcgtggtgatttccggtgattcgagaatcaattcggaattatttaaaaaaatatctgccgaagtgctaagagcgcacgggattacggtttatctattcaatggcccgcatccgactccggaattgagttttgctgtaatgcatctgcatacctatgccggaattatgattacagccagtcacaatagcaaagaatataacggttacaagttatatggagaagatggtggccagctgccgccaaaacctgccgatgaaatcgttagagaacgtcaagaagttacggatatttttcatatcaaaaaagtttccggcggtattaaaaagattggttctgaaatcgataaagaatacctgaatcaggttaaaacaattccgattaatcgtgatttgattaaaaaatggggagacaaattaacgattagcttcacgccgctgcacggtgctggcggtgatcttggctcaaaagcgcttaaagaggccggttttaacaaaatattgactgttaaagaacaattcaaaccggacggcacttttccgacggttaagtatccaaatccggaattccatgaagtcttcaaaatttctgaaagttatggagcagatgttgaattagcagtcgatcccgattctgatcgaatgggagtcggttatcgaacaaaggacggttcctataattacctgactggaaatcaaattgctgctctgatggttaattatattttaacggcccagcagaaggccggaactttgccaaaaaatggtgcgattgtcacttcgattgtctcttcgaatttgccggaactaattgccaaatcgtttaaagttaaacaattcactgttttaaccggttttaaatacattgccgataaaattgttgaatttgacaagaaacagaattacagctttgaattcggttttgaagaatcctacggttttttgattaaaccctttgttcacgataaagatgccattcaggcaatcacgctgatgtccgaattggctgcttattataaagaccgcggcatgacgatcggtgatggtttggacgaaattcatgctaagtttggtgcctttgccgaggaaaccaaagcgactgaatttcctggcgagaagggccaagaagaaatgactgccgtcatgaccaagtttagaaatcgtggaccaaaagaaatcggtaatttaaagattaatctcgttgaagataacgatctgcggattgcaaaagatttgaataccggagcaaccaaaaaaatctcgcttccaagggccaatgttatcaaatattggcttgaagacggttcatgggttgctcttcgaccatccggtaccgaaccaaaattaaaagtgtatattggagcgaaaggcgaaaatatgagttcggctaataaacgtttggattatcttcagaccgaacttgagaaacttttgaaaaaataa

SEQ ID NO: 12679 - protein, 566 aa, Oenococcus oeni PSU-1
MVKEKTIQEKIKDWEVADLPEDLRLEFANSSQSQLEDAFYQDLNFGTAGMRGLLGVGTNRMNIYTVAQTTEALARHMEKQGESAKQRGVVISGDSRINSELFKKISAEVLRAHGITVYLFNGPHPTPELSFAVMHLHTYAGIMITASHNSKEYNGYKLYGEDGGQLPPKPADEIVRERQEVTDIFHIKKVSGGIKKIGSEIDKEYLNQVKTIPINRDLIKKWGDKLTISFTPLHGAGGDLGSKALKEAGFNKILTVKEQFKPDGTFPTVKYPNPEFHEVFKISESYGADVELAVDPDSDRMGVGYRTKDGSYNYLTGNQIAALMVNYILTAQQKAGTLPKNGAIVTSIVSSNLPELIAKSFKVKQFTVLTGFKYIADKIVEFDKKQNYSFEFGFEESYGFLIKPFVHDKDAIQAITLMSELAAYYKDRGMTIGDGLDEIHAKFGAFAEETKATEFPGEKGQEEMTAVMTKFRNRGPKEIGNLKINLVEDNDLRIAKDLNTGATKKISLPRANVIKYWLEDGSWVALRPSGTEPKLKVYIGAKGENMSSANKRLDYLQTELEKLLKK

SEQ ID NO: 12680 - DNA, 1701 bp, Leuconostoc mesenteroides subsp. mesenteroides ATCC 8293
  CDS (1)..(1701): transl_table=11
atgagttataaagaagcacttaaaaaatggcaagaagcgactttaccagattatttggctgctgatttagaaaaatacacaccagaccagcaggaagacgctttttatcaaaatctaagttttggtacagctggaatgcgcggtgtattgggtgcagggacaaaccgcatgaatgttttcacagttcgtcaagtaactgaagctttggcgcgttacattgatgagcaaggatcagatgcaaaaaagcgtggcgtagcaatcagttttgattcgcgtcatttttcgcctgaatttgcttcaaatgcggcacaagtattgtcggcacacggaattaagagtttcctttttagttcgttgcgtccaacaccagaattgtcatttactgtacgtgaattacacgctttcgccggcattatgatcactgcatcacataatcctaaagaatataacggttacaaggtttatggagaagatggcggtcaaatggttccagaagcagttgatgctgtggttaacgaactggcgaacattactgatatttttaatatcgcattagacgaagacaacaaaaatgtacaaattattgatgatgaaattgataataaatatttgaagaagatggaaacagtgacggtgaacgctgaccttgttgccaaagagggtgcttcgctaaagtttgtttattcaccgctacacggaacagggcaatacattggtgaaaaagcattgcagcaggcaggtttcacaaattacacaattgtaaaagaacaagctgttattgatggtgattttccaacggttaaaaaacctaatccggaagatgctgccgcgttatcattagctattgaatatgctaagcgtgatggggcagatgctgttgtagcaacagatcctgacgctgatcgtatgggggctgctgttaaactagcggatggtacattccaaattttgacaggaaatcaaattgccgctgtgttggttaactacttattaacagctaaaaaagacacaaacactttgccaactaatgggtcgattgtgacatcaattgtatcgtcacgctttgcgtcaaaggttgctgaaagctttggtgttgaaacagctgatgtgttaactgggtttaaatatattgcagctacaattgatcaatttgaggaaacaaaatccaatacatttttgtttggttttgaagaaagttttggctacttggtcaagccattctctcatgataaagatgccattcaagcattggtattatttgcagaggtagctgcatactacaagtcacaagggaagactttcgcagatggattgtatgaattatttgagaaatttggatactttgaagagaaaacaattagcttagatttcccaggaattcatggcaatgatgaaatggcggcaattatagctggctttcgtgataaccaacccgctgaaattggcggagtaaaagttgcacgcgtgcaagacttttcaacctcggtcgaaacaagcaaagatggatcaacggctaagttatctcaaccaaaagcaaatgtgttaaagtattggttggatgatggttcttgggtggccttacgaccatcaggcacagaacctaagctaaagttctacattggggttgaatctgagtcacaacaagaatcacaagctaaaattgatattatttccgccgatttaatgaagcgcgcaaaataa

SEQ ID NO: 12681 - protein, 566 aa, Leuconostoc mesenteroides subsp. mesenteroides ATCC 8293
MSYKEALKKWQEATLPDYLAADLEKYTPDQQEDAFYQNLSFGTAGMRGVLGAGTNRMNVFTVRQVTEALARYIDEQGSDAKKRGVAISFDSRHFSPEFASNAAQVLSAHGIKSFLFSSLRPTPELSFTVRELHAFAGIMITASHNPKEYNGYKVYGEDGGQMVPEAVDAVVNELANITDIFNIALDEDNKNVQIIDDEIDNKYLKKMETVTVNADLVAKEGASLKFVYSPLHGTGQYIGEKALQQAGFTNYTIVKEQAVIDGDFPTVKKPNPEDAAALSLAIEYAKRDGADAVVATDPDADRMGAAVKLADGTFQILTGNQIAAVLVNYLLTAKKDTNTLPTNGSIVTSIVSSRFASKVAESFGVETADVLTGFKYIAATIDQFEETKSNTFLFGFEESFGYLVKPFSHDKDAIQALVLFAEVAAYYKSQGKTFADGLYELFEKFGYFEEKTISLDFPGIHGNDEMAAIIAGFRDNQPAEIGGVKVARVQDFSTSVETSKDGSTAKLSQPKANVLKYWLDDGSWVALRPSGTEPKLKFYIGVESESQQESQAKIDIISADLMKRAK

SEQ ID NO: 12682 - DNA, 1722 bp, Shewanella sp. ANA-3
  CDS (1)..(1722): transl_table=11
atgaatacccatttgcaattacaggttaagcattggctcgaaaatgaccccgatccccgcactcaggcacaactgcaagccttaatcgacgccggaaatgacgccgaactcgaggctcgttttgcgggacgtttagaatttggtaccgccggattacgcggtgtggtgggcgctggtcctatgggcatgaatcgcctagtgatccgtcaaacatctgctgggcttggtgcctatttactcgaacaaattaaagatgccgcagaacgtggtgtcgtgattggttacgatggccgccatgattcacgcactttcgcccatgataccgccagtgtgcttaccgcgatgggtattaaggtgcgcctcaccgccaaagtggcgccaacgccgctggtggcctttggggttaagcattttaatgccgctgcgggcattgtggtgaccgccagccataacccgccacaatacaatggctacaaagtgtattgggaaaacggcgcacagattatcccgccccatgactctggtatcgccgctaagattgagctggcggcaactcaagctattccgtttatggatcaggttgaggcgaccaaacagggcaagcttatctggttgcaggacgattattacgaaacctatcgccgcggcgtgatgcacgccaatgtgctgcaaaataacactgcgcccgaaaaagtcagccttgcctataccgccatgcacggtgtgggcgctgaaatggcggaaactgtgctcaaggatgcgggttttgcccaagtgtattcggtggtggcgcagcgcgagcccgatggggatttcccaacggttaacttccctaatccggaagaaaagggtgcgatggacttagtcattgccgaagcgaaaaagcatggcgccatgctcgcctgtgccaatgaccccgatgcggacagatttgcggttgcagttcgtaaggatgatggcgagtatcaaatgctaacgggtgaccaagtgggtgtgctctttggtcattatctgttaagccatgcgagcaaggagcagcgtctggtgggcacgactattgtctcctccagtctattatctaaaatcgctaaaggctttggcgttgaaagctataccacgctcaccggttttaagtggctgatgaatgtgggaattgcgcagagtcagcctgataaccaattcctgtttgcctacgaagaagccctgggttacacggtcggtaacatggtgtgggataaggacggcttgtcggctctcgtcgcctttgcccaattaaccgccgagcttgccgctaaagggcaaaccatttgggatagactcgagcagatttaccgcgagcagggtttccatctcaatgctcaagttagcattgccttaaaacccgacacgcctaatattggcgcgtatctgcgtgaacatccaccgctggcaattggtgaacatgccttggtgtcgaccgatgatctcaaggcattagagcgccgttttgccgatggtaaggttgagaaaatcaatctgcccgccagtgatgtattaacctatcgcttagccaatggcgcgcgggttatagtcaggccgtcaggcactgagcctaaaatcaagtgttactacgaggtggtcgaacctatgacggcgcaagacaccttagccagcgcccaagcacgggcaactctggcgatggaggcgtttatttcagcccatcaggcgagcctgcctaaataa

SEQ ID NO: 12683 - protein, 573 aa, Shewanella sp. ANA-3
MNTHLQLQVKHWLENDPDPRTQAQLQALIDAGNDAELEARFAGRLEFGTAGLRGVVGAGPMGMNRLVIRQTSAGLGAYLLEQIKDAAERGVVIGYDGRHDSRTFAHDTASVLTAMGIKVRLTAKVAPTPLVAFGVKHFNAAAGIVVTASHNPPQYNGYKVYWENGAQIIPPHDSGIAAKIELAATQAIPFMDQVEATKQGKLIWLQDDYYETYRRGVMHANVLQNNTAPEKVSLAYTAMHGVGAEMAETVLKDAGFAQVYSVVAQREPDGDFPTVNFPNPEEKGAMDLVIAEAKKHGAMLACANDPDADRFAVAVRKDDGEYQMLTGDQVGVLFGHYLLSHASKEQRLVGTTIVSSSLLSKIAKGFGVESYTTLTGFKWLMNVGIAQSQPDNQFLFAYEEALGYTVGNMVWDKDGLSALVAFAQLTAELAAKGQTIWDRLEQIYREQGFHLNAQVSIALKPDTPNIGAYLREHPPLAIGEHALVSTDDLKALERRFADGKVEKINLPASDVLTYRLANGARVIVRPSGTEPKIKCYYEVVEPMTAQDTLASAQARATLAMEAFISAHQASLPK

SEQ ID NO: 12684 - DNA, 1581 bp, Mycobacterium avium 104
  CDS (1)..(1581): transl_table=11
gtgacacccgaggaatggatcgcccacgatcccgacccccgcacggccgccgagctcgccgcatgcgacgccgcagaactcgccgcccgcttcgcccggcccttgcgattcggcacggcgggactgcgcggcccggtccgcggcggccccgacgcgatgaacgtcgcggtggtgtcgcgggccagctgggcgctggcgcaggtgctcaagcgccgcggcccggccggcgcgcgggtgatcgtgggacgcgacgcccggcacggctccgcggtattcgccacggtggccgccgaagtgattgccgcccaagggttttcggtactgctgctgcccggtccggcacccaccccggtggtcgcgttcgcggtgcggcacaccggcgccgccgcgggggtccagatcaccgcctcgcacaacccgccgaccgacaacggctacaaggtgtacgacggcggcggcatccagatcgtctcccccaccgaccaccagatcgaagccgcgatggccgacgcgccaccggccgacgagatccgccgaacacccgtcccaccggcgcacaccgacctcgtccagcgctacatcgagcgggcggccggggtgcggcgcggcaccggttcggtgcgggtggcgctcaccgcgctgcacggcgtgggcgggacggtggccgtcgacgctctgcaccgcgccggcttcggccgaatacacaccgtggcaagccaattcgcgcccgacccggactttcccaccgtcgcgttccccaaccccgaggagcccggcgccaccgacgcgctgctgaccctggccgccgatgtggacgccgacgtggcgatcgcactggatcctgacgccgaccgctgcgccgtcggcatacccgacgcctccggctggcggatgctctccggcgacgaaaccggttggctgctcggcgattacctgctctcccagccgcagcgggccgaccgaccggtagtggccagcacggtggtgtcgtcgcggatgttgtcggccatcgccgcgcggcacggcgccgtgcacgtcgaaaccctcaccggcttcaagtggttggcacgcgccgacgccgaggtgcccggcggcaccctggtgtatgcctacgaggaggcgatcggacattgcgtggaccccgccgcggtgcgcgacaaggacggcatcagcgccgccgtgctggtgtgcgacctggtggccgccctgatcgcgcggggcggttcggtgtccggccggctcgacgagctggcccgccgccacggcgtgcacgacgtcgccgcggtgtcgcgccgcgtcgggaccgacggggctgccgagctgatgcgacggctgcgcaccagcccgccggagacgctggccgggttcggggtggcgctcaccgacatcaccgacgccctgatcttcaccggcggcgacgacgacacgtcggtcaggctggtggtgcggccttccgggaccgagccgaaggtgaagtgctacttggagattcgctgcgcgccgagcgacgacctggcatcttcgcggcggcgcgcccgcgccctgcgggagcttctggtcgcgacggtgcggagctggtga

SEQ ID NO: 12685 - protein, 526 aa, Mycobacterium avium 104
MTPEEWIAHDPDPRTAAELAACDAAELAARFARPLRFGTAGLRGPVRGGPDAMNVAVVSRASWALAQVLKRRGPAGARVIVGRDARHGSAVFATVAAEVIAAQGFSVLLLPGPAPTPVVAFAVRHTGAAAGVQITASHNPPTDNGYKVYDGGGIQIVSPTDHQIEAAMADAPPADEIRRTPVPPAHTDLVQRYIERAAGVRRGTGSVRVALTALHGVGGTVAVDALHRAGFGRIHTVASQFAPDPDFPTVAFPNPEEPGATDALLTLAADVDADVAIALDPDADRCAVGIPDASGWRMLSGDETGWLLGDYLLSQPQRADRPVVASTVVSSRMLSAIAARHGAVHVETLTGFKWLARADAEVPGGTLVYAYEEAIGHCVDPAAVRDKDGISAAVLVCDLVAALIARGGSVSGRLDELARRHGVHDVAAVSRRVGTDGAAELMRRLRTSPPETLAGFGVALTDITDALIFTGGDDDTSVRLVVRPSGTEPKVKCYLEIRCAPSDDLASSRRRARALRELLVATVRSW

SEQ ID NO: 12686 - DNA, 1653 bp, Nocardioides sp. JS614
  CDS (1)..(1653): transl_table=11
atgacctccgccgatgtgagcagcctgctccggaccgcccgtgcctgggtggccgacgaccccgacgaccagacccgtgccgagctcgaggcggtgatcgcggaggtggagtcgggcggtcccgccgacgacctgcgcgaccgcttcgccgggaccctcgagttcggcaccgccgggctgcgtggcgcgctcggcgcgggttccaaccggatgaaccgggtcgtggtgatccgcgccgcggccgggctcgcggcgtacctcaaggacaccggcaccgagcgcggctccgtggtgatcgggtacgacgcgcggcacaactccgacgtcttcgcgcgcgacaccgcggaggtgatgacgggcgccgggctgaccgcctacctcctgccgcggccgctgccgacgccgctgctggcctacgcgatccgcgagctcggctgcgccgcgggcgtgatggtgacggcgagccacaacccgccgcaggacaacggctacaaggtctacctcggcgacggcagccagatcgtcccgcccgccgacgccgagatcgcggcgcggatcgcggcggtcggcgcggtggccgacgtcccgcgcgggagcggcggcaccgtgctcgaggaggagatcgtcgaccgctacctcgacaccgtggcggggctcgccgaggacggcccgcgcgacctgtcggtcgtctacaccccgctgcacggcgtgggcggtacgacggtccagcgggtgctcgaggccgcaggcttctccgagcccgcggtcgtcgtccagcaggagctgcccgacgccgacttcccgaccgtcgcgttcccgaaccccgaggagccgggcgcgatggacctggcgatggagctggcccgggcgcgcggtgcggacctggtcgtcgcgaacgacccggacgcggaccggtgcgcggcggccgtgcccggcccgcacagctggcggatgctgcgcggcgacgaggtcggggcgctgctcgcccacgcgctgctgagccgcggcaagcagggcacctacgccaccagcatcgtgtcgtcgagcctgctcgggaagatggcgagggcggccggccggccctacgccgagaccctgaccggcttcaagtggatcggccgggtcgaggggctcgcgttcggctacgaggaggcgctcggctactgcgtcgaccccgagcacgtgaaggacaaggacggcgtctccgccctgctgctgctctgcgagctcgcggccgccgcgaaggccgagggccgcgggctggtggacctgctcgacgacctggccgtcgagcacggcctgcacgcgaccgaccagctctcggtacgggtctccgacctcggcgagatcgccgcggcgatggcccggctgcgggcgaccccgcccgccgcgctcggcgggctcgccgtcgagcgcgcggaagacctgtcgaccggcagcgcggacctgccgccgaccgaggggctgcgctacctgctggccgacggcgcgcgcgtcgtggtgcgcccgagcggcaccgagccgaagctgaagtgctacctcgaggtcgtggtgcccgtcgacgccgaaggcggagtggatgcggcccggatcgctgccgccggccggctcgacgcgctgcgtgacggcatcaagcaggctgccggcatctag

SEQ ID NO: 12687 - protein, 550 aa, Nocardioides sp. JS614
MTSADVSSLLRTARAWVADDPDDQTRAELEAVIAEVESGGPADDLRDRFAGTLEFGTAGLRGALGAGSNRMNRVVVIRAAAGLAAYLKDTGTERGSVVIGYDARHNSDVFARDTAEVMTGAGLTAYLLPRPLPTPLLAYAIRELGCAAGVMVTASHNPPQDNGYKVYLGDGSQIVPPADAEIAARIAAVGAVADVPRGSGGTVLEEEIVDRYLDTVAGLAEDGPRDLSVVYTPLHGVGGTTVQRVLEAAGFSEPAVVVQQELPDADFPTVAFPNPEEPGAMDLAMELARARGADLVVANDPDADRCAAAVPGPHSWRMLRGDEVGALLAHALLSRGKQGTYATSIVSSSLLGKMARAAGRPYAETLTGFKWIGRVEGLAFGYEEALGYCVDPEHVKDKDGVSALLLLCELAAAAKAEGRGLVDLLDDLAVEHGLHATDQLSVRVSDLGEIAAAMARLRATPPAALGGLAVERAEDLSTGSADLPPTEGLRYLLADGARVVVRPSGTEPKLKCYLEVVVPVDAEGGVDAARIAAAGRLDALRDGIKQAAGI

SEQ ID NO: 12688 - DNA, 1638 bp, Mycobacterium sp. KMS
  CDS (1)..(1638): transl_table=11
atgacttccccggcgacctcgacgaccgtgcaggagtggattgctcacgacccagacccgcacaccgcggcggagttgtccgagtgcagtcccgacgaactcgacgagcggttctcccgctcactgacattcgggacggcggggctgcgcgggccgctgcgcgccggcccgaacgggatgaacctggcggtggtgctgcgcacgacgtgggcggtcgccaaggtgctcaaggaccgcggccgggcgggttcgcaggtcgtcgtgggccgtgacgcccggcaccgctccgacgaattcgcccgcgccgctgccgaagtgctcgccgcacaagggttcgaggtgctgctgctgctggccgccgtcccgacaccggtggtggcgttcacggtgcggcacatgcacgccgccgcgggaatccagatcaccgcatcgcacaacccgccgaccgacaacgggtacaaggtgtacttcgaggaggggctgcagatcatcggccccaccgacaccgacatcgaggccgcgatcgccgaggcgccgatggccgacgagatcgccagggccgaagtggaaaccggcggcatggaggagatcgcccactacgtcgaacgggcggccaacgtccggcactcgacggcgccggtgcgggtggcgttcaccccgatgcacggggtgggcggtgagtacgcgatggacacgttcgtgcgggcaggcatcaccgacgtccacgtcgtcgacaagcagttcgcacccgaccccgacttccccaccgtgtcgctgcccaacccggaggaaccgggtgcggtcgacgcgctgctcgaactggccgccgacgtcgacgccgacgtcgcgatcgcgctcgacccggacgccgaccggtgcgcggtcggggtgccgacacccgacggctggcgaatgctctcgggggacgaaaccggttggctgctgggcgattacattctggaccaggtcgagcccggcgaagtcatgaacgcgaccgtggtggccagcaccgtggtgtcgtcgcggatgctcgcggcgatcgccgccgcgcacggcgcccaccacgtcgaaacgctcaccggcttcaaatggctctcccgcgccgacgacgacctgcccggcaagaccatggtgtacgcctacgaggaggccatcggccactgtgtggatccggccgcggttcgcgacaaggacggcatcagtgcggcggtgctgttctgcgacctcgtcggcgtgctgaaggagcacggccgcaccgtgctcgacgtcctcgacgacctggcccgccgccacggcgtccacgtcaccgcggccgtcagccgcccggtcgccgacgccgacgaagccgccggggtgatggcccgactgcgggacaccccgcccgatcgcctcgccgggcacgaggtcaccgtcaccgacctgagcacctcacccgagccgatgcgctcggatgcgctgatcctgagcggtggggatgccgacacctcggtgcgcatggtcgtgcgaccgtccggaaccgaaccgaaagtgaagtcctacatcgaggttcgacgcgcctgcgccggcgacgtggggcgggcgcgcgccgaggcgcagcggctgcgcgacgagctggtggccctggcgcaacagtggtga

SEQ ID NO: 12689 - protein, 545 aa, Mycobacterium sp. KMS
MTSPATSTTVQEWIAHDPDPHTAAELSECSPDELDERFSRSLTFGTAGLRGPLRAGPNGMNLAVVLRTTWAVAKVLKDRGRAGSQVVVGRDARHRSDEFARAAAEVLAAQGFEVLLLLAAVPTPVVAFTVRHMHAAAGIQITASHNPPTDNGYKVYFEEGLQIIGPTDTDIEAAIAEAPMADEIARAEVETGGMEEIAHYVERAANVRHSTAPVRVAFTPMHGVGGEYAMDTFVRAGITDVHVVDKQFAPDPDFPTVSLPNPEEPGAVDALLELAADVDADVAIALDPDADRCAVGVPTPDGWRMLSGDETGWLLGDYILDQVEPGEVMNATVVASTVVSSRMLAAIAAAHGAHHVETLTGFKWLSRADDDLPGKTMVYAYEEAIGHCVDPAAVRDKDGISAAVLFCDLVGVLKEHGRTVLDVLDDLARRHGVHVTAAVSRPVADADEAAGVMARLRDTPPDRLAGHEVTVTDLSTSPEPMRSDALILSGGDADTSVRMVVRPSGTEPKVKSYIEVRRACAGDVGRARAEAQRLRDELVALAQQW

SEQ ID NO: 12690 - DNA, 1656 bp, Haemophilus somnus 2336
  CDS (1)..(1656): transl_table=11
atgactgccctttttaccactgctcaaaactggctcgctcaagaccctgatgcggaaactcgtgcagaattacaaacattactcaaccaagccaaagcaggcgatatgaatgcacagaaagagttacataaccgttttaacggtcggttgcaattcggtaccgctggtttacgcggtcgcttacaagctggttctatgggtatgaaccgtgtactcgtggctcaagcagcgggcggtttggcggaatacctaaaaggctatgatagtgaaccctctatcgtattaggttatgacggtcgtaaaaactctgatgtgttcgtacgagataccgctgaaattatggctggtgcgggcatcaaaaccttccttttgccacgaaaattgccaacacctgtactggcttacgctatcaaacacctcaacactacggcaggcgtgatggtcaccgcaagccacaaccctcctgaagataacggctataaagtttatttaggtaaagcgaacggcgggggacaaatcgtctccccagccgatgttgacatcgctaaactgattgacaaagtggctaacggcgatattcgtgacttaccacgtagccaacactacacagtgttagacgatgagatcgtagaggcatatatcgcaaaaaccgcctctattgccaaagagccacaagcaaatattaactacgtttacaccgcaatgcacggagtaggctatgaagtgttgagtaaaaccttagcgaaagcaggcttaccacaaccacatttggtcgaagagcaaattcaacctgatggatcattcccaacggtcaatttcccaaatccagaagagaaaggtgcgttagatttagcaattaaactggcaaaagcaaaaaatgccgagttcatcattgccaacgaccctgacgcagaccgtcttgcagttgcggtacctgattcggaaggcaactggaaacctttgcacggtaacgtgataggctgtttcttaggttggtatctagcgaaacaataccacgcacagggcaaacagggcaaattagcttgctcactagtttctagtcctgctctggcggaaattgcgaaaaaatacggtttccaatccgaagaaactttaaccggtttcaaatatatcggcaaagtgaatgacttattgtttggctttgaagaagctttgggctacttagtcgatccagacaaagtacgtgataaagacgggatttcagctgctattgccttcttagatttagtccgtagcctgaaaaaagagggtaaaacactaacagattacgctaatgactttactgcggaattcggtgcatatgtaagcgggcaaatctctattcgtgtgaacgaattatcagatatcggcaaaatgatgaccgcacttcgtaaagaaccactaacagaattaggcggtttcgttacacaatttattgatcacagtaaaactgatcgtgctagcgatattctcgtgtttgtgcttgaaaatggtagtcgccttattgttcgtccatccggcaccgagccgaaagtgaagttctacttagatgtgtgcggtacagatccgaaaaatgcagacgaagtattagcggagtttgatgagaacgtacgccaaatcctccgacaagagaagtacggaaaacaggattgctaa

SEQ ID NO: 12691 - protein, 551 aa, Haemophilus somnus 2336
MTALFTTAQNWLAQDPDAETRAELQTLLNQAKAGDMNAQKELHNRFNGRLQFGTAGLRGRLQAGSMGMNRVLVAQAAGGLAEYLKGYDSEPSIVLGYDGRKNSDVFVRDTAEIMAGAGIKTFLLPRKLPTPVLAYAIKHLNTTAGVMVTASHNPPEDNGYKVYLGKANGGGQIVSPADVDIAKLIDKVANGDIRDLPRSQHYTVLDDEIVEAYIAKTASIAKEPQANINYVYTAMHGVGYEVLSKTLAKAGLPQPHLVEEQIQPDGSFPTVNFPNPEEKGALDLAIKLAKAKNAEFIIANDPDADRLAVAVPDSEGNWKPLHGNVIGCFLGWYLAKQYHAQGKQGKLACSLVSSPALAEIAKKYGFQSEETLTGFKYIGKVNDLLFGFEEALGYLVDPDKVRDKDGISAAIAFLDLVRSLKKEGKTLTDYANDFTAEFGAYVSGQISIRVNELSDIGKMMTALRKEPLTELGGFVTQFIDHSKTDRASDILVFVLENGSRLIVRPSGTEPKVKFYLDVCGTDPKNADEVLAEFDENVRQILRQEKYGKQDC

SEQ ID NO: 12692 - DNA, 1659 bp, Actinobacillus pleuropneumoniae serovar 1 str. 4074
  CDS (1)..(1659): transl_table=11
atgagtacaatttttactatcgcccaaaattggttggcacaagatacggatcaggaaactcgagctgaattagcgcaacttattgaaatggcgcaagcaggcgatgaaaaagccttagcggaattgaccgctcgttttgacggtcgtttacaattcggcacggcaggtttacgtggtcgtttacaagcaggttctatggggatgaaccgagtattagtggctcaagctgctggcggtttagcggattatttaaaaggctacgataaagaaccttcaatcgttatcggttatgacggtcgtaaaaactcggacgtgtttgcacgtgataccgcagaaattatggcgggtgcagggattaaggcttatttattaccccgtaaattaccaacgcctgtacttgcgtatgcaattaaatattttgatactacagcgggcgttatggtgacagcaagtcacaacccaccggaagataacggttataaagtgtatttaggtaaagcaaacggcggtggtcaaatcgtttcgccggcggataaagatattgcggcattaattgataaagtggcggcaggtaatattgcggatctaccacgtagccaagactttacggtattagatgatgaaatcgtagaagcatatatcgaaaaaacagctgcattagcgaaagagcaggcagcagagattaactatgtttataccgcaatgcatggtgtcggttatgaagtgttaagcaaaacgttagaaaaagccggcttaccgcaaccgcatttagtggcggaacaaattcaaccggacggttctttcccaaccgtgaatttcccaaatccggaagaaaaaggtgcattagacttagcaattaaattagcgaaagagaagaatgcggaatttatcattgccaatgatcctgacgcagaccgtttagcggtagctatgccggatgcacaaggtaactggaaaggtttacacggtaacgttgttggctgtttattaggttggtatttagctaaacagtatcacgcacaaggtaaacaaggcgtattagcttgttcattagtgtcttcgccggcattggctgaaattgcgaaaaaatacggtttacaatcggaagaaactttaaccggctttaaatatatcggtaaagtaaacggcttattattcggttttgaagaagcgttaggctatttggttgaccctgataaagtacgtgataaagacggtatttcagcggctattgtgttcttagattttatccgtaacttaaaagcacaaggtaaaacgttgcaagacgcaatcaccgatttcaataatgaattcggtgcttatgtaagcggtcaaatttcaattcgtgtcagcgatttatctgaaatcggtaaattaatgacggcattacgcaacaacccaccaagtgcaatcggtagtttcaacgtggtgcaattaattgaccatacgaaaacggatcgtcaaagcgatattttggtattcgtattagaaaacggtagccgtttaatcactcgtccgtccggtacggaaccgaaaattaagttctacttagatgcgaaaggtaaagatgcagcggatgcagacaaagtattaagccaatttgacgaaagcgtacgtgaattattacgccaagagcaatacggcaaacaagattgctaa

SEQ ID NO: 12693 - protein, 552 aa, Actinobacillus pleuropneumoniae serovar 1 str. 4074
MSTIFTIAQNWLAQDTDQETRAELAQLIEMAQAGDEKALAELTARFDGRLQFGTAGLRGRLQAGSMGMNRVLVAQAAGGLADYLKGYDKEPSIVIGYDGRKNSDVFARDTAEIMAGAGIKAYLLPRKLPTPVLAYAIKYFDTTAGVMVTASHNPPEDNGYKVYLGKANGGGQIVSPADKDIAALIDKVAAGNIADLPRSQDFTVLDDEIVEAYIEKTAALAKEQAAEINYVYTAMHGVGYEVLSKTLEKAGLPQPHLVAEQIQPDGSFPTVNFPNPEEKGALDLAIKLAKEKNAEFIIANDPDADRLAVAMPDAQGNWKGLHGNVVGCLLGWYLAKQYHAQGKQGVLACSLVSSPALAEIAKKYGLQSEETLTGFKYIGKVNGLLFGFEEALGYLVDPDKVRDKDGISAAIVFLDFIRNLKAQGKTLQDAITDFNNEFGAYVSGQISIRVSDLSEIGKLMTALRNNPPSAIGSFNVVQLIDHTKTDRQSDILVFVLENGSRLITRPSGTEPKIKFYLDAKGKDAADADKVLSQFDESVRELLRQEQYGKQDC

SEQ ID NO: 12694 - DNA, 1653 bp, Haemophilus influenzae R2846
  CDS (1)..(1653): transl_table=11
atgacaacactttttgaggttgcacaacattggttaaaccaagatcctgacacagaaactcgtgcagaattaaccgcacttttagatgcagcaaaaggcggagataaagcggcagaagcagaattacatgcgcgttttgatggtcgtttacaatttggtacggcaggtttacgtggtcgtttacaagctggctcaatggggatgaaccgagtgttagtttctcaagctgctggtggtttagcggaatatttaaaaggttacgataaagaaccatcaatcgttattggttacgatggccgtaaaaactccgatgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaacagcatcactagctaaagagcccgcttgcgacattaactatgtttataccgctatgcatggtgttggctatgaagttttaagtaaaacgctggcaaaagcaggattaccacaaccccacgtagtagcagatcaagtttggccagatggcacattcccaacggtgaattttccaaatccagaagaaaaaggcgcattagatttagcaattaaagtggcaaaagaaaagaatgctgaatttatcattgctaatgacccagatgcagaccgtttagccgttgctgtgcctgatgcacaaggcaactggaaatcactacacggcaacgtagtaggctgtttcttaggttggtacttagcaaaacaatatcaaggtaaacaaggcacattggcttgctcacttgtttcttctccagcacttgctgaaattgcgaaaaaatacggtttccaatcagaagaaaccttaactggtttcaaatatatcggtaaagtatctggcttattgtttggttttgaagaagcattgggctatttagtggatccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaatcggaaaattaatgaccgcacttcgtaacaatccaccagcagaaatcgctggcgtgaaagtggcacaatttatcgaccatattaaaacagatcgtcaaagcgatatccttgtatttaacttggaaaatggcggacgcttaattgctcgtccttcaggtactgaaccaaaaattaaattctacttagatgcacgcggtaaagatccaaaagatgcagatcgcgtattagcagaatttgatgaaggtgttcgtcacattcttcgccaagatgcttatggcaaacaagactgctaa

SEQ ID NO: 12695 - protein, 550 aa, Haemophilus influenzae R2846
MTTLFEVAQHWLNQDPDTETRAELTALLDAAKGGDKAAEAELHARFDGRLQFGTAGLRGRLQAGSMGMNRVLVSQAAGGLAEYLKGYDKEPSIVIGYDGRKNSDVFARDTAEIMAGAGVKAYLLPRKLPTPVLAYAIQYFDTTAGVMVTASHNPPEDNGYKVYLGKANGGGQIVSPADKDIAALIDKVAAGNIQDLPRSDNYVVLNDEVVDAYITKTASLAKEPACDINYVYTAMHGVGYEVLSKTLAKAGLPQPHVVADQVWPDGTFPTVNFPNPEEKGALDLAIKVAKEKNAEFIIANDPDADRLAVAVPDAQGNWKSLHGNVVGCFLGWYLAKQYQGKQGTLACSLVSSPALAEIAKKYGFQSEETLTGFKYIGKVSGLLFGFEEALGYLVDPDKVRDKDGISAAIVFLDLVRNLKKQGKTLADYADEFTKEFGAYVSGQISIRVSDLSEIGKLMTALRNNPPAEIAGVKVAQFIDHIKTDRQSDILVFNLENGGRLIARPSGTEPKIKFYLDARGKDPKDADRVLAEFDEGVRHILRQDAYGKQDC

SEQ ID NO: 12696 - DNA, 1731 bp, Listeria monocytogenes str. 4b H7858
  CDS (1)..(1731): transl_table=11
atgaattggcaagaagaatatcaaaaatgggttgctaatgacaaattagatagcacattaagaaaacaattaacgaatatggaagcaaatgaaaaagaacttgaggatagtttttatcgtaatatggaatttggaacggctgggatgcgtggtgtactaggcgctggaacaaaccgcatgaatatctatactattcgtaaggcttctctaggtttggcgcaatttgtggcggagaacggtgacgaggctaagaagcgcggaatagtaattgcgtatgaccctcgtcatatgtcacgcgaatttgcttttgaatcggcggcggtattagggcatcatggtgtgaaaagctatgtttttgatgcgcttcgaccaacaccggaactttcctttgcagtacgtcatttaaatgcgtttggtgggattgttattacagctagccataacccaccagaatacaatggctacaagatttatggtgaagatggcggacaaatgcctccaacaggggcaagtgctgtaattgaatacataaacgcggtagaggatattttttctgtagaagtagcgaaccaagagctattaattgaaaatggtttacttgaggtaatcagtgaaaaagtagaccgtccatatttggaaaaattaaaagaggttattgtcaataaagagcttgttcaagaacgaggggaggatttgaaaattgttttcacgccccttcatggtactggcggaattcttggcgttcctgcgcttgaaagtgttggctttacgaatattgttaaggttgacgagcaatttgtgaatgatcccgattttggaacggtaaaatcgcctaacccggaaaaccgcgaagcctttttacttgcgattgaatatggtaagaagtttggtggcgacattttagtcggaacagatccggatgctgaccgtttaggcgtggcagttcgtaatcttgacggcgaatatgaagtgttatctggaaaccagattggcgcgattattttacattatttattaaaacaaaagaaagcgcaaaatgaattgccagctaatgcagcggtattaaaatctattgtaacaagtaatcttggaacagaaatcgcgaaacattacggtgcggaaatgattgaagtattaactggtttcaaatttattgcagaacaaattaagcactttgaagaaactggcaagcatacgtttgaatttggttatgaagaaagtaatggttatatggttaagccgtttacgcgtgataaagatgcgattcaagcggtgcttgcgattgcggaagtggcgctcgttagcaaagtagaaggtggaagtttactagaagatttagagcaaatttatgctgagtttggctattacaaagaagatctagtttccttaactttaagcggtaaggatggttctcggcgcatcaaagaaattacaagtaattttcgcgagcaactaccaacaagtatgggtggattccccgtggaacgtgcggaagattatttaagaagcgaaacaacttggattgctaccggaaaaacggaagcgattcatttgccaacagcagatgtcattaaatgttattttgaagatggttcatggttctgtttacgtccatccggcacagaaccgaaaatcaaattctactttagtattcgtggtgaaagtaaagaagaaagtgcaacaaaattagaaaaagtgaaagctgatttgatgcaacatatcgaagcttaa

SEQ ID NO: 12697 - protein, 576 aa, Listeria monocytogenes str. 4b H7858
MNWQEEYQKWVANDKLDSTLRKQLTNMEANEKELEDSFYRNMEFGTAGMRGVLGAGTNRMNIYTIRKASLGLAQFVAENGDEAKKRGIVIAYDPRHMSREFAFESAAVLGHHGVKSYVFDALRPTPELSFAVRHLNAFGGIVITASHNPPEYNGYKIYGEDGGQMPPTGASAVIEYINAVEDIFSVEVANQELLIENGLLEVISEKVDRPYLEKLKEVIVNKELVQERGEDLKIVFTPLHGTGGILGVPALESVGFTNIVKVDEQFVNDPDFGTVKSPNPENREAFLLAIEYGKKFGGDILVGTDPDADRLGVAVRNLDGEYEVLSGNQIGAIILHYLLKQKKAQNELPANAAVLKSIVTSNLGTEIAKHYGAEMIEVLTGFKFIAEQIKHFEETGKHTFEFGYEESNGYMVKPFTRDKDAIQAVLAIAEVALVSKVEGGSLLEDLEQIYAEFGYYKEDLVSLTLSGKDGSRRIKEITSNFREQLPTSMGGFPVERAEDYLRSETTWIATGKTEAIHLPTADVIKCYFEDGSWFCLRPSGTEPKIKFYFSIRGESKEESATKLEKVKADLMQHIEA

SEQ ID NO: 12698 - DNA, 1674 bp, Listeria monocytogenes str. 1/2a F6854
  CDS (1)..(1674): transl_table=11
atgacttggaaacactatttgagtgcttggcaaaatgccgatttatcaaatgagtggcgccgtgaattacaacgagtggaagaagagcaggaacgttttgatggttacttaacatttggaactggcgggatgcgcggtaaaatgggtattggaacaaagcgcatcaatctttttaccattagacgagtagcgaaaggtttgggagattatgttgtcgcaaacgaaggagccgaaatgggcgttgcaattgcgtttgactctagacatcattcgggtgcttttgcgcaggaaacggcaaaggtcctagcggcgcagggtatcaacgtttatttatccgattcgattcgaccaacaccagctttatcattttgcgttcgagaaaagggggcattcgcgggcgtggtgattaccgcaagccataatccttctatctataatggtttcaaagtatatgataaaaatggctgtcaaatcacattgggtgtagcgcaggaaattgctggctatttagaaaaaataacggatatctttactataccagtgcgcgaattacccaatccactcgtgacacctctaggaaaagaaatggatgatgcttatttaaacgctttaacagcagtcgtttctcgccctgacttgcttgctgactacgggaatgaactacggatttgttacacgccgcttcatggtgccggaaaagaactcgttatgcgtggacttttggaaaatggattttcggaaacgaccattattgcagaacaaagcgaaccggatggggattttccgacagtgatttcgcctaatccggaagaagaaaatagtttcgacctagccaaaaagctggcaaaagaaatacaagccgatattattttggcaacagatcctgatgctgatagactgggagtggctgttttaaacaagcaagctacataccaaattttaacagggaatcagctaggagcgttacttttaaattatattttagaagcaaaaacaccggtaactggggcggatacgatgatcaacacgatagttactggggatttaggtgggaaaatcgcgtatgactttggaattaaccatatccaaacgctcactggttttaaattcatcggtgagaaaatagctgaaatggaaggcacggaaaaaaatttcctatttggatatgaggaaagttatggttatttaatcgcaccctttgttcgcgataaagatgcagtgcaggcagcattacttacagcagaaatggcgcttttctataaaaaagaaggaacaacacttcttggaaagctaaccaatttatatgaaaaatttggctaccataaagaatatttgcacacgataacattagacgatagcgatggaataactaaaatgaatcaagtgatagacgctttgcgcaaagagccaacttgtatttccggcatatcggttttagaagactttctaacgagtaagcgaactaatctttcaacgatggaaatgacaaacttagagctaccaaaagaaaatgttttaaaattccacttaaacgataacgcctggtttgcaatacgtccttctggaacggaaccgaaatgcaaaatctattttcaaacaagcggtgaaacggaagaaattgcgacaaaagccatgaatgagttgagaaaacgcgtattagctgtatgggactaa

SEQ ID NO: 12699 - protein, 557 aa, Listeria monocytogenes str. 1/2a F6854
MTWKHYLSAWQNADLSNEWRRELQRVEEEQERFDGYLTFGTGGMRGKMGIGTKRINLFTIRRVAKGLGDYVVANEGAEMGVAIAFDSRHHSGAFAQETAKVLAAQGINVYLSDSIRPTPALSFCVREKGAFAGVVITASHNPSIYNGFKVYDKNGCQITLGVAQEIAGYLEKITDIFTIPVRELPNPLVTPLGKEMDDAYLNALTAVVSRPDLLADYGNELRICYTPLHGAGKELVMRGLLENGFSETTIIAEQSEPDGDFPTVISPNPEEENSFDLAKKLAKEIQADIILATDPDADRLGVAVLNKQATYQILTGNQLGALLLNYILEAKTPVTGADTMINTIVTGDLGGKIAYDFGINHIQTLTGFKFIGEKIAEMEGTEKNFLFGYEESYGYLIAPFVRDKDAVQAALLTAEMALFYKKEGTTLLGKLTNLYEKFGYHKEYLHTITLDDSDGITKMNQVIDALRKEPTCISGISVLEDFLTSKRTNLSTMEMTNLELPKENVLKFHLNDNAWFAIRPSGTEPKCKIYFQTSGETEEIATKAMNELRKRVLAVWD

SEQ ID NO: 12700 - DNA, 1731 bp, Listeria monocytogenes str. 1/2a F6854
  CDS (1)..(1731): transl_table=11
atgaattggcaagaagaatatcaaaaatgggttgctaatgacaaattagatagcacattaagaaaacaattaacgaatatggagacaaatgaaaaagaacttgaagatagtttttatcgtaatatggaatttggaactgctgggatgcgtggcgtactaggtgctggaacaaaccgcatgaatatctatactattcgtaaggcttctctaggtttggcgcaatttgtggcagagaacggtgaagaggctaagaagcgcggaatagtaattgcgtatgaccctcgtcatatgtcacgcgaatttgcttttgaatcggcggcagtattagggcatcatggtgtgaaaagttatgtttttgatgcgcttcgaccaacaccggaactttcttttgcagtgcgtcatttaaatgcgtttggtggaattgttatcacagctagccataatccgccagaatacaatggctacaagatttatggtgaagatggcggacaaatgcctccaacaggtgcaagtgctgtaattgaatacataaacgcggtagaggatattttttctgtagaagtagcgaaccaagagctattaattgaaaatggtttacttgaggtaatcagtgaaaaagtagaccgtccatatttggaaaaattaaaagaggttattgtcaataaagagcttgttcaagaacgcggggaggatttgaaaattgttttcacgccgcttcatggtactggcggaattcttggcgttcctgcgcttgaaagtgttggctttacgaacattgttaaggttgacgagcaatttgtgaatgatcctgattttggaacggtaaaatcgcctaacccggaaaaccgcgaagcctttttacttgcgattgaatatggtaagaagtttggcggggatattttagtaggaaccgacccggatgctgaccgtttaggcgtggctgttcgtaatgcggacggagaatacaaagttttatctggaaaccaaattggtgcgattattttacattatttattaaaacaaaagaaagcgcaaaatgagttgccggctaatgcagcggtattaaaatctatcgtaacaagtaatcttggaacagaaatcgcgaaacattacggcgctgaaatgattgaagtattaactggtttcaaatttattgcagaacaaattaagcactttgaagaaactggcaagcatacgtttgaatttggttatgaagaaagcaatggttatatggttaagccgtttacgcgtgataaagatgcgattcaagccgttcttgcggttgctgaagtggcgctcgttagcaaagtagcaggtagaactttattagaagatttagatcaaatttatgatgaatttggttattataatgaggatctcgtttcacttacgttaagtggaaaagatggttctgagcgcatcaaagaaattacaagtaacttccgtgaacaactgccaacaagtatgggtgggttcgtagtagaacgtgcggaagattatttgagaagtgaaacgacttggattgcaacagggaaaaccgaagcaattcatttaccaacagcagatgtcattaaatgttattttgaagatggttcatggttctgtttacgtccatcgggcacagaaccgaaaatcaaattctactttagtattcgtggtgaaagtaaagaagaaagtacggcaaaattagaaaaagtgaaagctgatttgatgcaacatatcgaagcttaa

SEQ ID NO: 12701 - protein, 576 aa, Listeria monocytogenes str. 1/2a F6854
MNWQEEYQKWVANDKLDSTLRKQLTNMETNEKELEDSFYRNMEFGTAGMRGVLGAGTNRMNIYTIRKASLGLAQFVAENGEEAKKRGIVIAYDPRHMSREFAFESAAVLGHHGVKSYVFDALRPTPELSFAVRHLNAFGGIVITASHNPPEYNGYKIYGEDGGQMPPTGASAVIEYINAVEDIFSVEVANQELLIENGLLEVISEKVDRPYLEKLKEVIVNKELVQERGEDLKIVFTPLHGTGGILGVPALESVGFTNIVKVDEQFVNDPDFGTVKSPNPENREAFLLAIEYGKKFGGDILVGTDPDADRLGVAVRNADGEYKVLSGNQIGAIILHYLLKQKKAQNELPANAAVLKSIVTSNLGTEIAKHYGAEMIEVLTGFKFIAEQIKHFEETGKHTFEFGYEESNGYMVKPFTRDKDAIQAVLAVAEVALVSKVAGRTLLEDLDQIYDEFGYYNEDLVSLTLSGKDGSERIKEITSNFREQLPTSMGGFVVERAEDYLRSETTWIATGKTEAIHLPTADVIKCYFEDGSWFCLRPSGTEPKIKFYFSIRGESKEESTAKLEKVKADLMQHIEA

SEQ ID NO: 12702 - DNA, 1725 bp, Bacillus cereus G9241
  CDS (1)..(1725): transl_table=11
atgaactggaaacaagaatttagtcgctggctttcatatgcagagttagacgcagaactaaaagaacagttagaaaatatgaagcaagatgagaagaaaatcgaggacagtttttataaaaatctagaattcggtacaggtggtatgcgtggtgaacttggtgctggtacgaaccgtttgaacgtatatacagttcgtaaagcgacacaaggattagcgaagtttattgaaaaattaggtgaagaagcgaagaagcgcggtgttgttgtagcgtatgattctcgtcataaatcacctgagttcgcaatggaagttgctgctacactaggtgcacacggcattacaacatatgtgtttgaaagcttacgtccaacgccagtgctttctttcgcagttcgtcatttacatacagtgagtggaatcgttcttactgcaagccataatccgcctgaatataacggttataaagtatacggtgaagatggtgggcagttgcctccgaaagaagctgatgaattaattagctacgtaaacgcagtagaagatgaattaacagttgaggttgctgatgtggagcaattaaaagctgacggtttattacatattattggacaagaagtagatgatgcatatgctgcagaattgaacaatgtcattattaataaagaaatggtacaaaaggttgggaaagacttaaaaatcgtcttcacaccactacacggaacatcaaatatttctgtacgccgtggtttagaagaagttggatttacagatgtaacagttgtaaaagagcaagagttaccagatccgaacttctctacagtaaaatcaccgaacccagaagagcacgcagcatttgaatatgcaattcgtgacggtgagaagataggcgcagatgtgttaattgcaacagatcctgacgcagaccgccttggtgtagcagttcgtaatcacgatggtgagttccaagtgttaactggtaaccaaacaggtgcgttaatgcttgattacttattatctcaaaagaaagaaaacggaacgcttccagagaacggtgttgtattaaaaacaatcgtaacgtctgaaattggccgtacaatcgcgaaaacatacggtttagatacagttgatacgttaactggatttaaatttatcggtgagaaaattaaacagtatgaagaaagcggacaatacgaattccaattcggttatgaggaaagctatggttatttaatccgtccattctgccgtgataaagatgcagtacaatctgttctatttgcatgtgaagtagctgcatactacaaatcacaaggtaaaacgttatacgatggtctattagaagtgtttgagaagtacggtttcttccgtgaagatcttgtatcgttaacgctaaaaggaaaagatggagcggaacaaattcaagaaatgatggcaacattccgtgaaaatcctccgaaagaagtagcgggcttaacagttgtagcagttgaagactataaagcgagcattattacatctttacaagatggacataaagaagagattcacttaccgaaatcaaatgtgttaaaatatcaattagaagatggttcttggttctgcctacgtccatctggaactgaaccgaagattaagttctacttcggtgttcaagataattctttacaaaatagtgaacaaaagttacttactattaaagaagatattatgaatcgtttataa

SEQ ID NO: 12703 - protein, 574 aa, Bacillus cereus G9241
MNWKQEFSRWLSYAELDAELKEQLENMKQDEKKIEDSFYKNLEFGTGGMRGELGAGTNRLNVYTVRKATQGLAKFIEKLGEEAKKRGVVVAYDSRHKSPEFAMEVAATLGAHGITTYVFESLRPTPVLSFAVRHLHTVSGIVLTASHNPPEYNGYKVYGEDGGQLPPKEADELISYVNAVEDELTVEVADVEQLKADGLLHIIGQEVDDAYAAELNNVIINKEMVQKVGKDLKIVFTPLHGTSNISVRRGLEEVGFTDVTVVKEQELPDPNFSTVKSPNPEEHAAFEYAIRDGEKIGADVLIATDPDADRLGVAVRNHDGEFQVLTGNQTGALMLDYLLSQKKENGTLPENGVVLKTIVTSEIGRTIAKTYGLDTVDTLTGFKFIGEKIKQYEESGQYEFQFGYEESYGYLIRPFCRDKDAVQSVLFACEVAAYYKSQGKTLYDGLLEVFEKYGFFREDLVSLTLKGKDGAEQIQEMMATFRENPPKEVAGLTVVAVEDYKASIITSLQDGHKEEIHLPKSNVLKYQLEDGSWFCLRPSGTEPKIKFYFGVQDNSLQNSEQKLLTIKEDIMNRL

SEQ ID NO: 12704 - DNA, 1737 bp, Exiguobacterium sibiricum 255-15
  CDS (1)..(1737): transl_table=11
atgtcatggaaagagacctatcaaaaatggaatcagtttgcaggcctggaaacggaactaaaagaagagttgacggcactcgcgaacgacgataaagcagccgaggaagccttttacaaagagttggaattcgggacaggcggtatgcgtggggaaatcggtgtcggaacgaaccggatgaatgtctacacggtacgtaaagcctcacaagggtttgctgacttcatcaaggcggaaggcgatgaagcggtcgcgcaagggattgtcatcgcccatgactcccgtcactactctccggagtttgcattagaagcagcgaagacgcttgccagtaatggaatcaaagcttatttgttcgacggacttcgtccaacaccagaactgtcatttgccgtgcgtgaacttcgggcagcagggggaatcgtcattacggcgagccataatccaccggaatataacggctataaagtctatgggaatgacggcggccaattaccgccgaaagaagcggacgacctcgtctcttatgtcgatcaagtggcagatgaactttcaattgaactggaagcagaagaagtcttgcgtgcaaacggattgatcgttcgtgtcggcgaacagctggatgacgcctatcaggaacaattgaaaacgattcgtgtcttaccgacgattcaagacgagttggcggatcctttaaaaatcgtctttactccgcttcacgggacagggcttgtaccggtcacagtcggattgaagagttacgggtttgaacacgtgacggtcgtcgaagaacaagcgaagccggatggcgcgttcccaacggtttcttctccgaatccggaagaacatgcagcatttaagttagccatcgaatacggagaccgtgtcgatgcagatgtgttactcgcgacggatccggatgccgaccgtgtcggtgttgcgacacgtgatgcggacggagagtgggtcgttcttacagggaaccagaccggcgcgttactgctcgactacatcttgtcacaaaaagcggctcaaggcacattgccgaaaaacggttttgtagcaaaaacgattgttacatcggaactcggagccttgattgcaagacattatgacttacacgttgaaaatacattaacaggatttaaattcatcggtgaaaaaatcaagcaatataatgaatctggtgaatatgaatatctgtttggttatgaagaaagttacggttacttgatcggcgacttctgccgtgacaaggatgccgtccaagcctgcctgcttgctgccgagatgacagcgtatcacaagaaagaaggacggacgctgtacgaggcattacaagccatctatgagcagttcggttactttgaagaatcactccgttcgttgacgctcaaagggaaagacggtgtcgcgcagatcggccggatcatggatacgttccgcgagcatccgccaaaacaagtagcgggtgaaaaagtcatcttatttgaagactacgatgcaagcatttcgcatgatttggtgaagcatcagccgtcaccgatcaatctgccgaaatctaatgtcttgaaattcacgttagaagacggttcgtggttctgcctccgcccatcagggactgaaccgaaaatcaaattctatttcagcgtgacatcacctgacgctgcagaaacaacacgtaaacgtcagatgattgaagatgaagtaatgcaagaagtcgaacaaattcaataa

SEQ ID NO: 12705 - protein, 578 aa, Exiguobacterium sibiricum 255-15
MSWKETYQKWNQFAGLETELKEELTALANDDKAAEEAFYKELEFGTGGMRGEIGVGTNRMNVYTVRKASQGFADFIKAEGDEAVAQGIVIAHDSRHYSPEFALEAAKTLASNGIKAYLFDGLRPTPELSFAVRELRAAGGIVITASHNPPEYNGYKVYGNDGGQLPPKEADDLVSYVDQVADELSIELEAEEVLRANGLIVRVGEQLDDAYQEQLKTIRVLPTIQDELADPLKIVFTPLHGTGLVPVTVGLKSYGFEHVTVVEEQAKPDGAFPTVSSPNPEEHAAFKLAIEYGDRVDADVLLATDPDADRVGVATRDADGEWVVLTGNQTGALLLDYILSQKAAQGTLPKNGFVAKTIVTSELGALIARHYDLHVENTLTGFKFIGEKIKQYNESGEYEYLFGYEESYGYLIGDFCRDKDAVQACLLAAEMTAYHKKEGRTLYEALQAIYEQFGYFEESLRSLTLKGKDGVAQIGRIMDTFREHPPKQVAGEKVILFEDYDASISHDLVKHQPSPINLPKSNVLKFTLEDGSWFCLRPSGTEPKIKFYFSVTSPDAAETTRKRQMIEDEVMQEVEQIQ

SEQ ID NO: 12706 - DNA, 1728 bp, Croceibacter atlanticus HTCC2559
  CDS (1)..(1728): transl_table=11
atgactaacaaccaagccatcttaaaaaaggccaactcttggatgacctcgacttatgatgctgatactactgcaaaagtaaatcacctaattacaaataatcctacagaacttgaagatagtttttataaaaatcttgaatttggcactggtggtatgcgcggtattatgggcgttggcacaaacagaattaataaatacactttaggaaaaaacacacaaggcctttctaattttatgaaacagcagtttaatggcgagcaacttaaggttgttatcgcttatgactgcaggcataatagtaagtctcttgcaaagactgtggcagatgtttttactgcaaatggtatagatgtgtttctattttcagacttgagaacaactccagagttatctttttcagtaaaatatttaaactgtcattgcggtattgtattaactgcaagtcataatccgccagagtataatggttataaagtgtattggcaagatggcggtcaattggtgccaccacaagatgctgctattataaatgaaatagattctttaaagtatgaagacattttatttaaaggacaagatgaacgcattacttatatagacagcactattgatgaagccttctttgctgcatctgtagataatggtagttttaataccccaaattctgctaaagaaaatcttaatatcgtattcacgtctttacacggtacatcgataactgcaataccacaagtacttgaaagagcaggttataacaatgtgaatattgtaaaggaacaggcagagccgaacggcgattttccaacagtaaaatcccctaatccagaagaacctgaagctttaaaaatggctacagatttagctttagctataaatgcagatattgtaattggtacagatccagattcagatagattaggtatcgctgtaagagatcttaaagatcaaatggttttgcttaatggtaatcaaaccatggtggttatgacttggtttttgcttgaacaatggaaaaaagcgggaaaactacataatgatacttttgtaggctctactattgtctctacacctatgctaaaggttatgacagaagcttatggtgctcaataccatgaaggtctcacaggctttaaatggattgctaaaatgataaaagatttaccagatttagattttattggtggcggtgaagaaagctttggatttatggttggagattttgtgagagataaagatgcggtaacctctactctattagcgtgtgagatagcggctcaattaaaagctgaaggctcttctatactagacaaacttcacgacctttactcacaatttggctattacaaagaagaattaatctctcttgtgaaaaagggcaaagaaggtgcagaagaaataaagcaaatgcttatcgagttaagaaacaaccctttacaaactatagcaggtgaaactgttgtaaaggtggaagactatgcaaactctacatctttaaaccctgtatcccaaaaaacgacagagttaaatatccctaaatctaacgttcttatttactatacagataaaggcactaaaatagctgcaaggccaagtggaacagaacctaaaattaagttttatataagtgtaaatagtacgttatcttctaaagaaactatagacgaaactactgctgttttaaattcaaaaattgcttcaataaaatctcaacttggattgagttaa

SEQ ID NO: 12707 - protein, 575 aa, Croceibacter atlanticus HTCC2559
MTNNQAILKKANSWMTSTYDADTTAKVNHLITNNPTELEDSFYKNLEFGTGGMRGIMGVGTNRINKYTLGKNTQGLSNFMKQQFNGEQLKVVIAYDCRHNSKSLAKTVADVFTANGIDVFLFSDLRTTPELSFSVKYLNCHCGIVLTASHNPPEYNGYKVYWQDGGQLVPPQDAAIINEIDSLKYEDILFKGQDERITYIDSTIDEAFFAASVDNGSFNTPNSAKENLNIVFTSLHGTSITAIPQVLERAGYNNVNIVKEQAEPNGDFPTVKSPNPEEPEALKMATDLALAINADIVIGTDPDSDRLGIAVRDLKDQMVLLNGNQTMVVMTWFLLEQWKKAGKLHNDTFVGSTIVSTPMLKVMTEAYGAQYHEGLTGFKWIAKMIKDLPDLDFIGGGEESFGFMVGDFVRDKDAVTSTLLACEIAAQLKAEGSSILDKLHDLYSQFGYYKEELISLVKKGKEGAEEIKQMLIELRNNPLQTIAGETVVKVEDYANSTSLNPVSQKTTELNIPKSNVLIYYTDKGTKIAARPSGTEPKIKFYISVNSTLSSKETIDETTAVLNSKIASIKSQLGLS

SEQ ID NO: 12708 - DNA, 1728 bp, Desulfitobacterium hafniense DCB-2
  CDS (1)..(1728): transl_table=11
atgattcaagaacgttaccgattttggctgaccagcccctactttgatgaggatacccgctcggaagtggccgctattaacgatgagaaagagatcgaggaccgcttctatacggatttggaatttggcaccggaggattgcggggggtgctcggtgccggcaccaaccgcatgaatatctatgttatccgcaaggcaactcaaggcttggcggacttaatcctggaagggggagaagcggggaagaaccggggtgtggtgattgcctacgattcccgccgcttttccgatcgctttgccaaagaggccgctttagtgctggccggcaacggcattaaagcttatctgtttgatgatctgcgccccacgccggagctttctttcgcggtccgccacctcaaggctcaggcaggcctggtgattaccgccagccataaccccaaggagtataatggctataaggtgtattgggaggacggcggccaggttccgccggatcgtggggaccggattctggctcatatcaaagctcatcaggcttgggatgatatcctcccccttgaggaggcagaagcccgggacaagggacttttagttgagattggggaagagatcgatgcagtttatctgagcaaggtcaaagaactggccttgtatccggaactttcccaggccaagggaagcaatctgtctatcgtctatactcccttgcatggggcggggaatgtgctggtcaacagaatcctcaccgagatgggctattccgtatttacggttcctgaacaggagaaaccggatccggagtttacaacagttccttaccctaatcctgaaatcccttccacctttgatctggccagaagttatggcaaagccagaaacgcccagatgctcatcgccaccgatcctgatgcagaccgtttgggcatggctctgcgcacccctcagggtgattaccggcagctcaccgggaatcaggtggggacccttctgagctattatctgctcacccaaaagaagaggctgggtattctgcctgagcaagccgtcgtcatcaagaccattgcctccaccgatctggcggatctcctggtcaaagacttgggagcccgggtggaaaatgtcctcaccggctttaaattcattgccgagaaagagcaggaaatggaagttcagggcagcggagatttccagttcggctttgaagagagctatggctatttagccgggcattttgtgcgggataaggacgcggtgatcgcttcgctcctgctggcggaagccgctctctactatcaggaaaaagaaggccgttccctgctggaggttctggaggatatttacggcaagtacggttattttattgacgatcagatctccattactttagaaggcaaagcaggaaaagagcaaatggagaagatgatggttaaactccgtgagaccgatgtcaagtccttcggtgggattgccgtcgcctgcattgacgattatgaactgagaaaaggaagaaggatgattgctcccttccatagttatgagcttgctcttccccaatccaatgtgattcgctattccttccagggcggagggtttgtgatggcccggccttcgggaacagagccgaaaattaagttttacttcaatatcaggggtgttaatccacaagaactccccaccaccttggaagctgtgaaaaaggatttgctggaactgattaaggattaa

SEQ ID NO: 12709 - protein, 575 aa, Desulfitobacterium hafniense DCB-2
MIQERYRFWLTSPYFDEDTRSEVAAINDEKEIEDRFYTDLEFGTGGLRGVLGAGTNRMNIYVIRKATQGLADLILEGGEAGKNRGVVIAYDSRRFSDRFAKEAALVLAGNGIKAYLFDDLRPTPELSFAVRHLKAQAGLVITASHNPKEYNGYKVYWEDGGQVPPDRGDRILAHIKAHQAWDDILPLEEAEARDKGLLVEIGEEIDAVYLSKVKELALYPELSQAKGSNLSIVYTPLHGAGNVLVNRILTEMGYSVFTVPEQEKPDPEFTTVPYPNPEIPSTFDLARSYGKARNAQMLIATDPDADRLGMALRTPQGDYRQLTGNQVGTLLSYYLLTQKKRLGILPEQAVVIKTIASTDLADLLVKDLGARVENVLTGFKFIAEKEQEMEVQGSGDFQFGFEESYGYLAGHFVRDKDAVIASLLLAEAALYYQEKEGRSLLEVLEDIYGKYGYFIDDQISITLEGKAGKEQMEKMMVKLRETDVKSFGGIAVACIDDYELRKGRRMIAPFHSYELALPQSNVIRYSFQGGGFVMARPSGTEPKIKFYFNIRGVNPQELPTTLEAVKKDLLELIKD

SEQ ID NO: 12710 - DNA, 1704 bp, Vibrio sp. Ex25
  CDS (1)..(1704): transl_table=11
atgattgatatgacagcactaattactcaatggctagaacgagaccctgatcctaagactcgcgaagagctacaacacctcgtcgatacaaataatgaacaagagcttactgatcgctttggatcgcgccttgcctttggtacagcagggttacgcggcaaagtgggcgcaggtccaaaccgaatgaaccgtttggtgattcaagagaccgccactggtttaggaaactatttgctagagcaggtcaaagatgccgcaagtcgtggtgtcgttattggctacgacggtcgtcctgattcaaaacaattcgcgcatgataccgcttccgtactgactgcccttggcatcaaggtttacctaacatacgatgttgcagcaaccccaattgttgcgtttggtgtccgtacattgaatgctgcggccgctgttgttgttaccgctagccacaatccaccagagtacaatggctttaaagtatattgggagaatggcgcacaaatcattcctccgcacgactctggaatcgcagcgaaaattgatgacgcaacaacaaagccattacctttaatgtctctcgatgatgcaaaacagcgcggtttgttagtttggttgaaagacggctactaccaaacttaccgtaaaacgatgaacgaaaacgcgctgcttactcctgacaacaacaccgatatttctatcgcttacactgcgatgcatggcgttggggcgaatatggcggaaacgctcctcgcagacgctggcttcaaaaaagtggcaagtgttaaggaacagcgcgaacctgatggcagcttcccaaccgtcaacttcccaaaccctgaagaagccggtgcaatggatatggtgatggcattaggtaagtccgtagatgcagatatcgcttgcgctaacgatccagatgccgaccgttttgcagtggcagttaaacgcccagatggcgaataccaaatgttaaccggcgaccaagtgggttcactgtttggcgattacttgctagaacagcaatctaacgctttggttggcaacaccatcgtatcctcaagaatgctgagtagcattgccaaagcgcatggcgcccaatactaccaaacgttaacaggcttcaaatggctcactaacgttgccatggagcaagagacagaagccaatccattcttgtttgcttatgaagaagcgctcggttataccgtaggtaacaaggtgtgggataaagatggtttatctgcaatcgtcgcatttgcccagctaacaggtaaacttaaagctcaaggcaaaacactatgggataaactggaagaactgtaccgcgagcacggtttctactttaacgcgcagcgcagtatcgctctcgacccgaactctccaccaatcggtgacaaactccgtgcaaacccaccaacagagattgctggtaaaaaagtcgcagtaactgaagatctaaaaacatcagttcgcatgtttgacgacggctctgaagaatccattgacttaccagcaagtgacgtattgatttatcacctagaagatcagtctcgtgtgattgttcgcccttcgggtactgagccaaaactaaaatgttactacgaagtcatcaaccttttccctgcggatatgagctatgcacaagcacagcaagcggcagaggcgaagatgaacgaacttatcgacgcgcatcagacaagtttgtaa

SEQ ID NO: 12711 - protein, 567 aa, Vibrio sp. Ex25
MIDMTALITQWLERDPDPKTREELQHLVDTNNEQELTDRFGSRLAFGTAGLRGKVGAGPNRMNRLVIQETATGLGNYLLEQVKDAASRGVVIGYDGRPDSKQFAHDTASVLTALGIKVYLTYDVAATPIVAFGVRTLNAAAAVVVTASHNPPEYNGFKVYWENGAQIIPPHDSGIAAKIDDATTKPLPLMSLDDAKQRGLLVWLKDGYYQTYRKTMNENALLTPDNNTDISIAYTAMHGVGANMAETLLADAGFKKVASVKEQREPDGSFPTVNFPNPEEAGAMDMVMALGKSVDADIACANDPDADRFAVAVKRPDGEYQMLTGDQVGSLFGDYLLEQQSNALVGNTIVSSRMLSSIAKAHGAQYYQTLTGFKWLTNVAMEQETEANPFLFAYEEALGYTVGNKVWDKDGLSAIVAFAQLTGKLKAQGKTLWDKLEELYREHGFYFNAQRSIALDPNSPPIGDKLRANPPTEIAGKKVAVTEDLKTSVRMFDDGSEESIDLPASDVLIYHLEDQSRVIVRPSGTEPKLKCYYEVINLFPADMSYAQAQQAAEAKMNELIDAHQTSL

SEQ ID NO: 12712 - DNA, 1719 bp, unidentified eubacterium SCB49
  CDS (1)..(1719): transl_table=11
atgatacacatagacccaagcatattagacaaagttaatacctggctcacccctacttttgataaagaaactcaagaagagattaaagaaatgatcgcccacgaccctgaaggtctagaagatagtttctacaaatctttagcgtttggaacaggtggtatgcgtggtgtaatgggagttggcgataacagaatcaataaatatacgctaggaaaaaacacacaaggaatttcagaatacttaaaaaaacaatttccttctgaaactttaaaagttgccatcgcttatgattgcagacacaatagtaaagaactcgcaaaagtggtagcagatgtattttccgcaaacggaatacacgtatatctttttactgaccttcgccctacgccagaactttcgtttgctgtaaaacacctagagtgtcattgtgggattgtcttaacagcatcacacaatccaccagaatacaacggctacaaagtgtactggcaagatggaggccaactagttccgccacaagatggagagatcatagatttgataaacagtctagattataacgatattaactttaaaggcgataacacgcttattaaagcgattgacaaagaagtagatgatgcttttgcagccgcatctttaaaaaatggctgcaaagtaaaagataacagcttgcgcgaaaatcttaaagtcgtgttcacttcgctacacggaacatcaatcacaatgattccaagagtactcgaagatgctggttatactaatgtacatctagtaaaagaacaagaaagccctgatggcgatttcccaaccgttgtttctcctaatccagaagaaccagaggcattatcaatggcaatagcactagcagataaagaacaggcagatatcgtgattggtacagacccagattgtgaccgcctaggtattgccgttcgtgacagtgatggcaaaatgcaaattttaaacgggaaccaagcaatggctataaaaacctatttcttgttagaccaattaaaagaacaaaaagcactcaaccaaaagcactttattgcatctactatagtatcaacacctatgattgctaagatcgcagcaaaatttggcgttatgtacaaagaaggacttactggctttaagtggattgcaaaaatggtgaaagactttccagagttagattttgtaggtggtggcgaagaaagttttggttatatggtaggtgattttgttagagataaagatgccgtaaccgctaccctactcgcttgcgaaattgcagcaatagagaaagcaaaaggaaatacattgctagattattttaatacagttcaaaacgaagtgggctattacaaagaacatctcatttccgtagtgaaaaaaggaaaaaagggtgccgaagaaattgccgaaatactaaaacaattacgcgaaaacccatttacagaaattaacggtagcaaagtagttagaatagaagattacctaacaagtgaatcaaaagatctggttaagaatatttcagaaacaatagagataccaaaatcaaatgtacttatctattatactgaagatggtagcaaaatagcagcaagacctagcggaacagagcctaaaattaaattttatatgagcgtgacagtgcaaggaggcaatactgacacagtattagaccaaagaattaaggatattcagacttcgttaaataatttaactagttag

SEQ ID NO: 12713 - protein, 572 aa, unidentified eubacterium SCB49
MIHIDPSILDKVNTWLTPTFDKETQEEIKEMIAHDPEGLEDSFYKSLAFGTGGMRGVMGVGDNRINKYTLGKNTQGISEYLKKQFPSETLKVAIAYDCRHNSKELAKVVADVFSANGIHVYLFTDLRPTPELSFAVKHLECHCGIVLTASHNPPEYNGYKVYWQDGGQLVPPQDGEIIDLINSLDYNDINFKGDNTLIKAIDKEVDDAFAAASLKNGCKVKDNSLRENLKVVFTSLHGTSITMIPRVLEDAGYTNVHLVKEQESPDGDFPTVVSPNPEEPEALSMAIALADKEQADIVIGTDPDCDRLGIAVRDSDGKMQILNGNQAMAIKTYFLLDQLKEQKALNQKHFIASTIVSTPMIAKIAAKFGVMYKEGLTGFKWIAKMVKDFPELDFVGGGEESFGYMVGDFVRDKDAVTATLLACEIAAIEKAKGNTLLDYFNTVQNEVGYYKEHLISVVKKGKKGAEEIAEILKQLRENPFTEINGSKVVRIEDYLTSESKDLVKNISETIEIPKSNVLIYYTEDGSKIAARPSGTEPKIKFYMSVTVQGGNTDTVLDQRIKDIQTSLNNLTS

SEQ ID NO: 12714 - DNA, 1737 bp, Phaeosphaeria nodorum
  CDS (1)..(1737)
atggctaaggacatcaaacagctagcccgggagtggctggagctcgaccaagacaaaaccacgacagatgagatatatgagctgcttatgcacgggaatacagaagagctagagagaagactgcggactcggatcgcctttgggaccgccggtctgcgaggccccatgcaggctgggttcgccttcatacaagcttctcagggactagcagcctatctcctcaagacagagcagaatgtcaagaagcgtggagttgtaatcggtcgggatgctcgccacaactctgagaaattcgccaaactcaccgcagccgcttttgtcgccaaaggtataaaggtctggtggtacgaaacaccttctcacacgcctttggttccgtttggtgtacgagaattgaacgctgttgctggaatcatggtaacggcgagccacaatcccgccaaagacaatggttacaaggtgtactggtcaaatggctgccaaatcatccctccacatgacagtggcattgctgcttctatactggaaaacctaaagcccgtcacgtgggacacatctgttgtggacaatcctgacctactcgttgagggctccctagatttggtcaaggacaagtaccacaaagcaatcctatgcgccgcccagcctgacggttctcacatcaaaatgagccccgacctgaggttcgtgtatacccctatgcacggcgtgggtctaccagcgatgactcaatgcgccgagaccctgggaatagcctcgcagatgactgttgtggaggctcaagctcaacccgatcctgacttcccgaccgtcaaattcccgaatccagaagaaaagggagccctcgacttggctattcagacggcagatcaatcttcgatcagcttgatattggctagcgatccggatgcggaccggctcgcggtagcggagaaggtacacgacaaatggcacatcttcacaggtaaccaattgggtgtgctccttggatcttacctttacgaacgttacccgtcttcaaagccccgagaaaagctcgccatgttagcatccactgttagctctaggatgctcgcggctttggcaaacaaagaaggattcaagttcaccgagaccttgacgggcttcaagtggttgggtaacgttgcaagagatctagatagcgaaggctacgatgtggtgtacgcgttcgaagaagccttgggctacatgattcctcagactgtgcacgacaaagactcgatcagcgcagcagcagtctttctcacggctgcgtcgcaatggtctacgcaaggcctgacgccatatgccaagcttcagagcctctacgagcatctggggtactttgaagacgcgaacacgtacctcgtgtcaccatcctcatccgtgacaacatcggttttcacggcgatccgcgcattgggcaacccgcatcccaccaccatcggaccccgcaagatcatgcgctggcgcgatctgacccttggctatgactcaaagagcaaggaccacaaaccagatctgccggtagacgtgacgagccaaatgatcacttgcgagctagatgatggagccgttttcacagtcagagggagcgggacggaaccgaagatcaagctttatatcgagtgccagggcaagagtagtgcggaggcaaaagaaggtgcgaatggaatcctggaggatttgctcaaggagtggttcaggcctgaagtgaatggcttgcaacttgcttga

SEQ ID NO: 12715 - protein, 578 aa, Phaeosphaeria nodorum
MAKDIKQLAREWLELDQDKTTTDEIYELLMHGNTEELERRLRTRIAFGTAGLRGPMQAGFAFIQASQGLAAYLLKTEQNVKKRGVVIGRDARHNSEKFAKLTAAAFVAKGIKVWWYETPSHTPLVPFGVRELNAVAGIMVTASHNPAKDNGYKVYWSNGCQIIPPHDSGIAASILENLKPVTWDTSVVDNPDLLVEGSLDLVKDKYHKAILCAAQPDGSHIKMSPDLRFVYTPMHGVGLPAMTQCAETLGIASQMTVVEAQAQPDPDFPTVKFPNPEEKGALDLAIQTADQSSISLILASDPDADRLAVAEKVHDKWHIFTGNQLGVLLGSYLYERYPSSKPREKLAMLASTVSSRMLAALANKEGFKFTETLTGFKWLGNVARDLDSEGYDVVYAFEEALGYMIPQTVHDKDSISAAAVFLTAASQWSTQGLTPYAKLQSLYEHLGYFEDANTYLVSPSSSVTTSVFTAIRALGNPHPTTIGPRKIMRWRDLTLGYDSKSKDHKPDLPVDVTSQMITCELDDGAVFTVRGSGTEPKIKLYIECQGKSSAEAKEGANGILEDLLKEWFRPEVNGLQLA

SEQ ID NO: 12716 - DNA, 1677 bp, Spiroplasma citri
  CDS (1)..(1677): transl_table=4
atgtcatatttagataatttaaatttatgaaaaaatgctaaaaatttagatccaacgttagccactgaatttcaacaaatgtctgaagcagatttaattgctgctttttcagatgatttagaatttggaaccgctggattacgaggtttattaggaccaggaaccggaaaaatgaatttatatacaattcggagagcaacattagcttttatgcagtatttaaaaacaatttattctgagacagatttaaaaacaaaaggaatcgtaattggacatgataaccgttatttttcagctgagtttgcgcaagcagtagcaaatatttttgctagtaataatattaaagcaattttatttgcgaataatgatcttcggccaacaccaatggtttcatataccattcgtaaaataaaagcggcagcgggtgttattattacggcaagtcataattcacgtgaatataatggttataaaatttatgatcataatggttcacaatttttgccagttgcaaccgatattattggtgaaaattacttaaaaattaaagaagaagtttttactttaactttaaacccaaattcaactttaattacatatgttccaaaagaggttgaggataattatgttagtgatgttaaagcaatgcagttttatccaaatcaaaaacgtaatattaagattgttttttctaatttgcacggaacaagtaaagaatgaacaccacgaatttttgaagaatgtggttatgatgtcacgattgtagaagagcaatttgacaatgaccctaattttacttttgcacctaatccaaatccagaattaacagaatgttatgatttagcattaaaatatgcgaaaaaagttaatgctgacgttatcattttaaatgaccctgatgctgatcggttaggaattggtgttaaaattaaggacaatgagtattatttaatgactggtaatgaaacagctccggtattaattgaatatttgttttctcattatcaacgtcaaaaaacattacctaagaatggagttatgtataatacctttgttactggtaatttatcagataaagttgctgaaggctatggtgttcaagttattaaaacattaactggttttaaatgaattggtgatcaaatgagcaaagcatcagctaaaggattacaatttttatttggatttgaagaagcatatggttatgttttaaaagacattactcgtgataaagatggaattcaatcgtcattaatcttagcagaagcttgctgatattatcataatcaaggaaaaacattatatgatgttttagttgaacaatataataaatttggttatttttattgtaaaacagttaatttagttcgtgatggaattgatggcaaaaaagttattaataatatgttaaaaaaattacgacaagaaacaattactagtttgaatcaaattaaatgtattaagaaagaagattatttgaatggcttgtatgaaatgccaggacaagacttattaaagttttattttgcagatggtagttgatttgcagttcgggcaagtggaacagaaccaaaaataaaattctattttgtttgtgttgataaaacaaatgaagaagcaaaaataaaaatggaagcaatgtaccaagaattagaaactacttatttaaaagaataa

SEQ ID NO: 12717 - protein, 558 aa, Spiroplasma citri
MSYLDNLNLWKNAKNLDPTLATEFQQMSEADLIAAFSDDLEFGTAGLRGLLGPGTGKMNLYTIRRATLAFMQYLKTIYSETDLKTKGIVIGHDNRYFSAEFAQAVANIFASNNIKAILFANNDLRPTPMVSYTIRKIKAAAGVIITASHNSREYNGYKIYDHNGSQFLPVATDIIGENYLKIKEEVFTLTLNPNSTLITYVPKEVEDNYVSDVKAMQFYPNQKRNIKIVFSNLHGTSKEWTPRIFEECGYDVTIVEEQFDNDPNFTFAPNPNPELTECYDLALKYAKKVNADVIILNDPDADRLGIGVKIKDNEYYLMTGNETAPVLIEYLFSHYQRQKTLPKNGVMYNTFVTGNLSDKVAEGYGVQVIKTLTGFKWIGDQMSKASAKGLQFLFGFEEAYGYVLKDITRDKDGIQSSLILAEACWYYHNQGKTLYDVLVEQYNKFGYFYCKTVNLVRDGIDGKKVINNMLKKLRQETITSLNQIKCIKKEDYLNGLYEMPGQDLLKFYFADGSWFAVRASGTEPKIKFYFVCVDKTNEEAKIKMEAMYQELETTYLKE

SEQ ID NO: 12718 - DNA, 1728 bp, uncultured Thermotogales bacterium
  CDS (1)..(1728): transl_table=11
atggattataaaaccagttaccatagatggcttgatagcccagtaatcgatgaggcaacccgtagagaattactttcaatcgcagaaaatgaaaccgaaataaaggaacgattctacaaggagctggagttcggcactgccgggcttcgaggaaaactaggtgccggtgacaaccgaatgaacaaatatactgtcgccagggccacacagggtctggcgaatctcattctctcgggagacccagaatacaggagaagaggcgtggtaattgctcatgattctagacatatgtctcgagcatttgccgagatcgcggcatcggtgcttactgcaaacgaaatcaaggtttatttgtttgatgacataagacctacacctttgctctccttttcggttctgcagctctcgacaatatctggaataatgattacagccagccacaatccaaaagagtacaatggctataagctttactgggaggacggggcccaggttctctccgatattgcagaccgggtctatgaagaaatgcgaagtacagagcttttcctcggaccaaagatgattgaacttgatgaagctcgtactaaaggcctgctagttgaagtaggagaggagcttgacgatctctacatatcgaaggtcttgtccctaacactgagagactcggaagaagaactggacaaatcaatcagaatagtctacacacctttgaatggcactggaaatgtccccgtgcgccgtgtcctgcgtgaacgaggcttcaaaaatgtatttgttgttccggagcaggaggaaccagatcccgatttttcgacgatcggttatccaaatcccgaagacttgaaggcctttacacttgccagagaggttggacaggagaagcgggccgacattctcctggcaaccgacccggacgccgataggcttgcagtaatggtgagggagaatggtgattttgttcccctaaacggcaatcaaactggcgcgctcattgttaactacctccttctctccatgaaagagaaatcctctatgcccgaggatggatttatcgtgaaatccattgttacaggtgacatggccaaaaccattgcggacagctacggagtgaaaacttatgaggctctcactgggttcaagaatatctgcggtaaagccctcgaagtagaagagaggagagagggcaaattcatcttcggctacgaagaaagcattggatatgttgcgggcaatttcgtgagagacaaggatgcagtttcttcatcaatgcttctttgcgaaatggcagcttacttcctgaggagaggaaagaccttgctgaacgttcttgaagagcttttcgtcaaatacggagtatttgctgaaaagcagatctccatggttctagaaggtgttgcgggacaaaagcgagtgaggaaaataatgaaagaatatcgaaaggaatacccaactgcaatcggcgattcaaagattgtgagatacatagactttttcagtgcaaccgacaatgacattctcagcggaagaactgtcgaaacaggggttcctacatcagacgttatcaagtttcagttcgacgacggctcatggtatgcaataaggccttccgggaccgaaccgaaactcaagatatacatctatactggagcgaaggatagagacgaagcctttgccaaattagcatacatagagaagtcagtgcttggcaagatacaatccatatag

SEQ ID NO: 12719 - protein, 575 aa, uncultured Thermotogales bacterium
MDYKTSYHRWLDSPVIDEATRRELLSIAENETEIKERFYKELEFGTAGLRGKLGAGDNRMNKYTVARATQGLANLILSGDPEYRRRGVVIAHDSRHMSRAFAEIAASVLTANEIKVYLFDDIRPTPLLSFSVLQLSTISGIMITASHNPKEYNGYKLYWEDGAQVLSDIADRVYEEMRSTELFLGPKMIELDEARTKGLLVEVGEELDDLYISKVLSLTLRDSEEELDKSIRIVYTPLNGTGNVPVRRVLRERGFKNVFVVPEQEEPDPDFSTIGYPNPEDLKAFTLAREVGQEKRADILLATDPDADRLAVMVRENGDFVPLNGNQTGALIVNYLLLSMKEKSSMPEDGFIVKSIVTGDMAKTIADSYGVKTYEALTGFKNICGKALEVEERREGKFIFGYEESIGYVAGNFVRDKDAVSSSMLLCEMAAYFLRRGKTLLNVLEELFVKYGVFAEKQISMVLEGVAGQKRVRKIMKEYRKEYPTAIGDSKIVRYIDFFSATDNDILSGRTVETGVPTSDVIKFQFDDGSWYAIRPSGTEPKLKIYIYTGAKDRDEAFAKLAYIEKSVLGKIQSI

SEQ ID NO: 12720 - DNA, 1725 bp, Lactobacillus reuteri
  CDS (1)..(1725): transl_table=11
gtgagctggaaagatacttataaggtttggcaagaacgaacagatcttgaatcagacttaaagcaagaattagctgcaatgagcgacgataaagaaattgaagatgccttttacggtccattatcattcggaactgcaggaatgcggggactaatgggaccaggaattaaccggatgaatgtttacactgtccgtcaagcaactgaaggtttggcaactttaatggattcattgggtgatgatattaaaaaacgaggagtcgctattggttacgattctcggcacaactcccgtaaatttgctcatgatgctgctcgtgtattaggtgctcatgggattaaggtttacatctatgataatttacgcccaacgcctgaattgtcatttgcagttcgtcacatggggacttatgcgggaatcatgattaccgctagtcataaccctaaggaatacaatggttacaagatttacggtgaagatggcggacagatgccacctaaagaatctgacatgatgacaggttacatccgtaagattgatgatatttttgacattgctttagctgatgaacaagaaatgcttgacaatggtttggaaacaatcatgggtgaagatgttgatgctgcataccttgctaatgctaagggtgtaactgttaaccctgaattagccaaggaatacggtaaagatatgaaatttgtctttaccccattatgtggaactggccgaatgcttggtgaacgggcattgcgtcaagctggttttacaaattatgaaatggaaccaactgaagcacaaccaaatggtgatttccctggtttggaacatcctaatccagaattcccagaagcatttgttcgttccattgcccttggcaaaaaagttgatgcagatgtgttgatcgccacggaccctgatgctgaccggcttggatgtgcagttcgtcaaccagatggtgaatatcaattgctaactggtaatcaaattgcttctatcatgcttgcctacattcttgaagcgcataaacaagcgggaaccttaccaaagaatgctgctgcggtaaaatcaattgtttctactaacttcgctgctaagatcgcagaaagttacggcgttgagatgatcaatgttttaactggtttcaagtggatcgctgaccaaattcatcaatatgagactggcaaagctgatcatacctttatgtttggttttgaaaaaagttatggttaccttattaagccatttgttcgtgacaaggatgctatccaatccttaactttacttgctgaggttgccgcttattcccgtagtcgtaacatgcccctttacgatggcttacaagaattgtttaagaagtacggctacttccgcgaaaagacaattgctaatacttatgctggtgttgatggcccagctaagattaaggctttaatgaagaagttcagagaagaagccccaactcattttgccggtcatcaagtagtagttactgaagacttcgctaatgggactaaaactacagctgatggcgaagtaagtgaattaggtatcccagaatcaaatgtattgcgttacattcttgatgatgatacttggattgctattcgtccatcgggaactgaaccaaagcttaagttctacattggtacaagtgctgataccttagataaggcaaatgaaaaattagctgatttcgaaaaggctttacaagagtttgctgaataa

SEQ ID NO: 12721 - protein, 574 aa, Lactobacillus reuteri
MSWKDTYKVWQERTDLESDLKQELAAMSDDKEIEDAFYGPLSFGTAGMRGLMGPGINRMNVYTVRQATEGLATLMDSLGDDIKKRGVAIGYDSRHNSRKFAHDAARVLGAHGIKVYIYDNLRPTPELSFAVRHMGTYAGIMITASHNPKEYNGYKIYGEDGGQMPPKESDMMTGYIRKIDDIFDIALADEQEMLDNGLETIMGEDVDAAYLANAKGVTVNPELAKEYGKDMKFVFTPLCGTGRMLGERALRQAGFTNYEMEPTEAQPNGDFPGLEHPNPEFPEAFVRSIALGKKVDADVLIATDPDADRLGCAVRQPDGEYQLLTGNQIASIMLAYILEAHKQAGTLPKNAAAVKSIVSTNFAAKIAESYGVEMINVLTGFKWIADQIHQYETGKADHTFMFGFEKSYGYLIKPFVRDKDAIQSLTLLAEVAAYSRSRNMPLYDGLQELFKKYGYFREKTIANTYAGVDGPAKIKALMKKFREEAPTHFAGHQVVVTEDFANGTKTTADGEVSELGIPESNVLRYILDDDTWIAIRPSGTEPKLKFYIGTSADTLDKANEKLADFEKALQEFAE

SEQ ID NO: 12722 - DNA, 1719 bp, Streptococcus gordonii
  CDS (1)..(1719): transl_table=11
atgacttaccaagaaaattatcaaaaatgggtcgatttcgctgatcttccagactaccttcgtcaagatttagaaaatatggatgaaaaaacaaaggaagatgccttttataccaatcttgaatttggtactgctggtatgcgtggtttgatcggtgctggtacaaaccgcatcaatatctatgttgtccgtcaagcgactgaaggtttggctcgtttgattgagtcaaaaggtagaaatgaaaaagaacgtggtgtggcaattgcctacgatagtcgtcacttctctccagaatttgcctttgaatctgctgcagttcttgcaaaacatggtatcaaatcgtatgtatttgaaagccttcgtccaactcctgaactttcattcgccgttcgccacctcaactgtttcgcaggtatcatgattactgccagccacaaccctgctccatttaacggttacaaggtttacggcgaagacggtggacaaatgcctccacacgatgcagatgctttgacaacttacatccgtgctatcgaaaacccattcgctgttgaagttgctgatgtcgaagctgaaaaagcttctggcttgattgaagtcatcggcgaagctgtcgacgtagagtacctaaaagaagtgaaagatgtgaacatcaatccagctttgattgaagaatttggtaaagacatgaagattgtctacacaccacttcatggtactggtgaaatgttggctcgtcgtgctcttgcccaagcaggatttgactctgttcaagttgttgaagcgcaagcaactccagatccagacttctcaactgttaaatctccaaatcccgaaaatcaagcagcctttgcccttgctgaagaacttggtcgtcaagttggtgcagatgttcttgttgcaactgacccagatgctgaccgtgttggtgtggaagtgcttcaaaaagatggtagctacctcaacctttcaggtaaccaaatcggtgctatcatggctaaatacatcttggaagcccacaaaaatgctggaactcttcctgataatgcagctctctgcaaatcaattgtatcaacagacctggtaacgaagattgctgaaagctacggcgcaaccatgttcaacgttttgactggtttcaaatttatcgctgaaaaaatccaagaatttgaggaaaaacacaatcacacttacatgatgggatttgaagaaagcttcggttacttgatcaaaccatttgtacgtgataaagacgccatccaagccgttcttgtcgttgctgagcttgccgcctactaccgttcacgtggtttgacacttgctgatggtatcgaagaaatctacaaagagtatggctactacgctgaaaagaccatctctgtgactctttcaggtgtagacggtgctgaacaaattaaagccatcatggctaagttccgtaacaatgctccaaaagaatggaatgcaacagctatctctgtcgtagaagacttcaaagcccaaacttctactgctgcagatggtactgtaacaaccttgacaactcctccaagtgatgtattgaaatatacacttgctgacggttcatggattgctgttcgcccttctggaactgaaccaaaaatcaagttctacattgccgttgtgggtgaaagcaacgaagattcacaagctaagattgcaaatatcgaagcagaaatcaatgcttttgtaaaataa

SEQ ID NO: 12723 - protein, 572 aa, Streptococcus gordonii
MTYQENYQKWVDFADLPDYLRQDLENMDEKTKEDAFYTNLEFGTAGMRGLIGAGTNRINIYVVRQATEGLARLIESKGRNEKERGVAIAYDSRHFSPEFAFESAAVLAKHGIKSYVFESLRPTPELSFAVRHLNCFAGIMITASHNPAPFNGYKVYGEDGGQMPPHDADALTTYIRAIENPFAVEVADVEAEKASGLIEVIGEAVDVEYLKEVKDVNINPALIEEFGKDMKIVYTPLHGTGEMLARRALAQAGFDSVQVVEAQATPDPDFSTVKSPNPENQAAFALAEELGRQVGADVLVATDPDADRVGVEVLQKDGSYLNLSGNQIGAIMAKYILEAHKNAGTLPDNAALCKSIVSTDLVTKIAESYGATMFNVLTGFKFIAEKIQEFEEKHNHTYMMGFEESFGYLIKPFVRDKDAIQAVLVVAELAAYYRSRGLTLADGIEEIYKEYGYYAEKTISVTLSGVDGAEQIKAIMAKFRNNAPKEWNATAISVVEDFKAQTSTAADGTVTTLTTPPSDVLKYTLADGSWIAVRPSGTEPKIKFYIAVVGESNEDSQAKIANIEAEINAFVK

SEQ ID NO: 12724 - DNA, 1716 bp, Streptococcus iniae
  CDS (1)..(1716): transl_table=11
  misc_feature (1127)..(1127): y is t or c
atgacttatacagaaaattatcaaaaatggcttaatgcctcaaacctccctgattatctaaaagatgaacttcttgcaatggatgaaaaaacaaaggaagatgctttctacacaaacttagagtttggaactgcaggtatgcgtggttatattggtgcaggaacaaatcgcattaatgtttttgttgttcgtcaagctactgaagggttagcaaaattagtagaatcaaaagggcaagcagccaaagatgctggtgttgctattgcatacgattcccgccacttctcacctgaatttgcatttgaatcagcacaagtattagctgctcacggcatcaaatcatatgtctttgaaagcttgcgccctacaccagaattatcttttgcggttcgccatttaggtgccgttgcgggcattatggtaacagcaagtcataatccagctccatttaatggctacaaagtttatggtgctgatggcggccaaatgcctcctgcagacgcagacgccctcacagactacattagagctattgaagatccattttctattgtattagctgacttagaagactcaaaatctaatggtctcattgaagttattggggaggctattgacacagaataccttaaagaagttaaagatgttactatcaatcaagaacttattgatacctttggccgtgatatgaaaattgtctacacaccattacatggtactggtgaaatgttgacgcgtcgcgcacttgcacaagctggctttgagtcagttgaagttgttgaaagtcaagccaaagcagaccctaatttctcaactgtagcatctcctaatccagaaagtcaagaagcatttgctttagcagaagaattaggaagaacagttaatgcagatgttttggttgcgactgaccctgatgccgatcgtcttggagttgaaattcgtcaagctgatggttcttattggaacttatctggtaaccaaattggtgcccttattgctaaatatatcttggaagcacataaagtagcaggaaccctaccagtcaatgctgcacttgcaaaatcaatcgtgtctactgaattggtaacaaaaattgctgagagttatggcgcaaccatgtttaatgycttaacaggctttaaatttattgcagaaaaaattcaagaatttgaagaaacacataaccatacctatatgtttggatttgaagaaagttttggttacctcattaaaccttttgtacgtgacaaagatgctattcaagcggtacttattgttgctgaaattgcagcttactaccgctctaaaggattaacacttgcagatggtattgatgacatttataaagaatatggttactttgcagaaaaaaccatttcattgacactttctggtgttgacggtgcaagtcaaatcaaagctatcatggacaaattccgtcaaagtgctcctactagcttcaatcaaacagaaattgttctatcagaagacttcttagaacaaactgctaaatctgctgatggcacaagtccattaacaacaccgccaagcaatgtcttaaaatacacacttgctgatgattcttggtttgctgttagaccatccggaacagaaccgaaaatcaaattctatgttgctactgttggccaaacacttttagaagctgaagaaaaaatcaaaacaattgaagctgaaatcaacacttttgtgaattag

SEQ ID NO: 12725 - protein, 571 aa, Streptococcus iniae
  misc_feature (376)..(376): The Xaa at location 376 stands for Ala, or Val.
MTYTENYQKWLNASNLPDYLKDELLAMDEKTKEDAFYTNLEFGTAGMRGYIGAGTNRINVFVVRQATEGLAKLVESKGQAAKDAGVAIAYDSRHFSPEFAFESAQVLAAHGIKSYVFESLRPTPELSFAVRHLGAVAGIMVTASHNPAPFNGYKVYGADGGQMPPADADALTDYIRAIEDPFSIVLADLEDSKSNGLIEVIGEAIDTEYLKEVKDVTINQELIDTFGRDMKIVYTPLHGTGEMLTRRALAQAGFESVEVVESQAKADPNFSTVASPNPESQEAFALAEELGRTVNADVLVATDPDADRLGVEIRQADGSYWNLSGNQIGALIAKYILEAHKVAGTLPVNAALAKSIVSTELVTKIAESYGATMFNXLTGFKFIAEKIQEFEETHNHTYMFGFEESFGYLIKPFVRDKDAIQAVLIVAEIAAYYRSKGLTLADGIDDIYKEYGYFAEKTISLTLSGVDGASQIKAIMDKFRQSAPTSFNQTEIVLSEDFLEQTAKSADGTSPLTTPPSNVLKYTLADDSWFAVRPSGTEPKIKFYVATVGQTLLEAEEKIKTIEAEINTFVN

SEQ ID NO: 12726 - DNA, 1605 bp, Mycobacterium leprae
  CDS (1)..(1605): transl_table=11
gtgacacccgaagagtggatcacgcacgatcccgacccacagacagccgccgagctggccgcgtgcgaccccgatgaacttgcggcgcggttcacccgtgcactgcgcttcggcacgtcgggcttgcgcggaccagtgcgcggcggccccgacgccatgaacctagcggtggtgttgcgagcgacctgggccgtggcacaggtgctcctgcaacgagcgggctcgcggcctgcaaccgtaatcgtcgggcgcgactctcggcacggctcggcggcattcgtcgctgcgaccgctgaggtgcttgccgctgaaggtttttccgttctgctgctacccaatccggcacccacgccggtggtggcgtttgcggtgcgcaataccggcgccgcggccgggatccagatcacagcatcgcacaacccgccgaccgataacgggtacaaggtgtatttcgacggcggcatccagatcatctctcccattgaccaccaaatcgaaaacgcgatggccgctgctcccctggccgaccagatcaccaggaaacccgtaaaccccagtgaaaacagcgcctccgatctggttgaccattatattcagcgagcggccgcggtacggcgctccaacggttcagttcgggttgcccttacaccgatgcacggagtgggcggtgcggtagccgtcgagacgctgcggcgcaccggctttgacgacgtgcacaccgtagcggcgcagttcgagcccgaccccgactttccaaccgtcgcgttcccaaacccggaggagcccggcgccaccgacgcattgctggccctggccgcccatgtcggggccgacgtcgcgatagcactggaccccgacgccgaccgctgcgccgttggtatacccaccaactcgggatggcggatgctgtccggagacgaaaccggttggctgctaggcgattacattttgtcgcaaaccgacaagccggaaaccgccgtggtagccagtaccgtggtgtcgtcgcgtatgttgccagcaatcgccacacactacaacgcggtccacgtcgagaccctcaccggcttcaagtggctggcgcgcgccgacgcaaacctgccgggcactcttgtgtacgcctatgaggaagctatcgggcattgtgtcgaccccactgccgtacgcgacaaagacggcatcagcgccgcggtgttagtgtgcgatctggttgccgcactgcacaagcagggccgctcggtgcccgacatgcttgaccaactcgccctacgccacggcgtgcacgacgttacagcaatatcacgtcgcattggccccaaacaaacgggagttgacgaggctgtcgacctgattcagcggctacgcgcagccccgccgagtcagctggccgggttcaccgcgaccactaccgatatcaccgacgcgctaatcttcaccggcggtgatgatgacacgtgggtccgggtagtggtgcggctatcaggaaccgaaccgaagttaaagtgctacttggaagttcgctgctcggtggctggcaacctaccatccacccgacaacgggccagggtgctgcgcgacgagctagtcaccttggtgcagcagtggtga

SEQ ID NO: 12727 - protein, 534 aa, Mycobacterium leprae
MTPEEWITHDPDPQTAAELAACDPDELAARFTRALRFGTSGLRGPVRGGPDAMNLAVVLRATWAVAQVLLQRAGSRPATVIVGRDSRHGSAAFVAATAEVLAAEGFSVLLLPNPAPTPVVAFAVRNTGAAAGIQITASHNPPTDNGYKVYFDGGIQIISPIDHQIENAMAAAPLADQITRKPVNPSENSASDLVDHYIQRAAAVRRSNGSVRVALTPMHGVGGAVAVETLRRTGFDDVHTVAAQFEPDPDFPTVAFPNPEEPGATDALLALAAHVGADVAIALDPDADRCAVGIPTNSGWRMLSGDETGWLLGDYILSQTDKPETAVVASTVVSSRMLPAIATHYNAVHVETLTGFKWLARADANLPGTLVYAYEEAIGHCVDPTAVRDKDGISAAVLVCDLVAALHKQGRSVPDMLDQLALRHGVHDVTAISRRIGPKQTGVDEAVDLIQRLRAAPPSQLAGFTATTTDITDALIFTGGDDDTWVRVVVRLSGTEPKLKCYLEVRCSVAGNLPSTRQRARVLRDELVTLVQQW

SEQ ID NO: 12728 - DNA, 1746 bp, Bacillus subtilis subsp
  CDS (1)..(1746): transl_table=11
atgacttggagaaagagctatgaacgctggaaacagacagaacatttagatctggaattaaaagagcgccttattgaattagagggagatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgccataagtctccggagttcgcgatggaagcggcaaaaacacttgcgacacaaggcatccaaacatacgtgtttgatgagcttcgcccgacgccagagctgtcattcgctgttagacagctgaacgcttatggtggaattgtggtaacggcaagccataacccgcctgaatataacggctacaaagtatacggggatgatggcggccagctgcctccaaaggaagcggacatcgtcattgagcaggtaaacgcgattgaaaatgagctgacgatcacagtggacgaagaaaataagttaaaagaaaaaggcttaatcaaaatcatcggtgaagatattgataaagtttatacagaaaaactgacgtccatttctgtacatcctgaattatcggaagaagtagatgtaaaggttgttttcacaccgctgcatggaactgcaaataaaccggtcagacgcggtcttgaagcactcggctacaaaaatgtaacggttgtcaaagaacaggaactgccggattcaaacttctccactgttacatcgccgaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgttgctgcttcattacctgctttctgaaaagaaaaaacaaggcatcctgcctgataacggtgttgttctcaaaacgatcgtcacaagcgaaatcggccgtgctgtagcttcttcattcggccttgatacgattgatacgctgacaggctttaagtttatcggtgaaaagattaaggaatacgaagcatcaggccagtataccttccaattcggttatgaagagagctacggttatttaatcggggattttgcccgcgataaggacgccattcaggctgcgcttttggcagttgaagtttgcgcgttctataaaaaacagggaatgtcattgtatgaggcgctcatcaatctctttaacgaatatggtttttatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaagcaaagaagaagccatcgacttgccaaaatcaaatgtattgaaatacttcctggaagacgggtcttggttctgtctccgtccttctggaactgagccgaaggttaaattttatttcgccgtaaaagggtcatctttggaagacagtgaaaagcgacttgccgtcctttctgaagatgtaatgaagacggtggatgaaattgttgagtcaacagcaaaataa

SEQ ID NO: 12729 - protein, 581 aa, Bacillus subtilis subsp
MTWRKSYERWKQTEHLDLELKERLIELEGDEQALEDCFYKDLEFGTGGMRGEIGAGTNRMNIYTVRKASAGFAAYISKQGEEAKKRGVVIAYDSRHKSPEFAMEAAKTLATQGIQTYVFDELRPTPELSFAVRQLNAYGGIVVTASHNPPEYNGYKVYGDDGGQLPPKEADIVIEQVNAIENELTITVDEENKLKEKGLIKIIGEDIDKVYTEKLTSISVHPELSEEVDVKVVFTPLHGTANKPVRRGLEALGYKNVTVVKEQELPDSNFSTVTSPNPEEHAAFEYAIKLGEEQNADILIATDPDADRLGIAVKNDQGKYTVLTGNQTGALLLHYLLSEKKKQGILPDNGVVLKTIVTSEIGRAVASSFGLDTIDTLTGFKFIGEKIKEYEASGQYTFQFGYEESYGYLIGDFARDKDAIQAALLAVEVCAFYKKQGMSLYEALINLFNEYGFYREGLKSLTLKGKQGAEQIEAILASFRQNPPQKMAGKQVVTAEDYAVSKRTLLTESKEEAIDLPKSNVLKYFLEDGSWFCLRPSGTEPKVKFYFAVKGSSLEDSEKRLAVLSEDVMKTVDEIVESTAK

SEQ ID NO: 12730 - DNA, 1728 bp, Corynebacterium glutamicum
  CDS (1)..(1728): transl_table=11
atgaggcaacctgcacaccaatttccatcacgtgaaatacctttctgttttgtccgcaggcgtatcaggaaaacctgcagcgcggtagagtcgagtctaatagtgatcccacgaaaacaaaggatcggggtgttcatggacgagtctcgtcagcttagtttcggcacagcagggttgcgtgcaccagttggcccggcgcgccatcagatgaatgttttgcaggtaaccagaactacagcaggtgttgctagttggttggcagaacgtgcggcactaaatccagtgccgcatttggttcctgaggatgaaacaggaatcggcagggcgttgtatccccaagatggtccgttgcgggtcgttgtggggtatgacgctcgctatggttcgcatacttttgctgcaaccactgcggaggtgttcgcgggtgctggttttgaggtgacgttgctccccacgcctagccctacgccgttgattccgtggttggtgaacaagcatgggttggatgcgggcgttcagatcacggcttcgcataatggtgcggcggacaatggctacaaggtgtttttgtctaatggtcgccagctttattctgaactggagcctgagcttgaggcgcatatcaatgctgtggaagatccgattcgggttcctcgggtgacggtgcgccccactgctgatcagctgcgtcgatatgttgatgagatggtgtcgttggtgactcctgatcaggctgatttgttgcgggtgaattctgagcggggcaatcttcgcgtggtgtataccgctctgcatggtgtgggtggccgcgcgatggccaatgctttccaatttgctggttttccccatactcatggcgtgaaggctcagcagtatcctgatcccaccttccccactgtggcgttccccaatccggaagagccttctgcgattgagttgttgttggaacgcgcaaaggaaaagaacgctgacattttgtttgcgcttgatcctgatgccgatcgttgtgctgtgggtattcgtaccgctgatggcggccaccgaatgctctctggcgatgaggtgggcacacttttggctactcgtttggttccggagtattccggtgaaggcccacgtcccgtggttgccaccacggtggtgtcttcgcagcttctgggtatcatcgccgaggataaagggtgggattattccgagacactgacgggattcaaaaatctgtcgagggctgccgatggtctcgacggaccgcttgctttcgcttatgaggaagctgtgggcacctgcccggttccagatgtcgtgccggataaggacggcatctctacagcgttgttcatggcgtcgtgggctgccgaactgaaggctcagggcgcaagcctgcagcaaaaactcaatgagttgtatcgccgatatgggtattttgcgtcctcgcaaattgctgtgcgcacgagcagtccacgcgagttagttgatcactggattgcgcatcctcagcaagaactcattggagtgtctgtcaccccacatattcttcctgaaaaacagggcattgctttgcatggccaggtggggcatgtgcatatccgtgctattggtcgagtctctggaactgaggcgaaagccaagctctatttggaagttggtcaggccagctcccatgatgaagcagctcagttgttgcatcagctggaggatgaagtccaaagctggttgagcaagctttag

SEQ ID NO: 12731 - protein, 575 aa, Corynebacterium glutamicum
MRQPAHQFPSREIPFCFVRRRIRKTCSAVESSLIVIPRKQRIGVFMDESRQLSFGTAGLRAPVGPARHQMNVLQVTRTTAGVASWLAERAALNPVPHLVPEDETGIGRALYPQDGPLRVVVGYDARYGSHTFAATTAEVFAGAGFEVTLLPTPSPTPLIPWLVNKHGLDAGVQITASHNGAADNGYKVFLSNGRQLYSELEPELEAHINAVEDPIRVPRVTVRPTADQLRRYVDEMVSLVTPDQADLLRVNSERGNLRVVYTALHGVGGRAMANAFQFAGFPHTHGVKAQQYPDPTFPTVAFPNPEEPSAIELLLERAKEKNADILFALDPDADRCAVGIRTADGGHRMLSGDEVGTLLATRLVPEYSGEGPRPVVATTVVSSQLLGIIAEDKGWDYSETLTGFKNLSRAADGLDGPLAFAYEEAVGTCPVPDVVPDKDGISTALFMASWAAELKAQGASLQQKLNELYRRYGYFASSQIAVRTSSPRELVDHWIAHPQQELIGVSVTPHILPEKQGIALHGQVGHVHIRAIGRVSGTEAKAKLYLEVGQASSHDEAAQLLHQLEDEVQSWLSKL

SEQ ID NO: 12732 - DNA, 1719 bp, Streptococcus pneumoniae
  CDS (1)..(1719): transl_table=11
atgtcttaccaagaaaattaccagaaatgggttgattttgtggagcttcctgactaccttcgtcaagatttggaaaatatggacgaaaaaactaaggaagatgccttctatacaaatcttgaatttggtactgcaggtatgcgtggcttggttggtgctggtacaaaccgtatcaacatctacgttgttcgccaagctactgaaggattggctcgtttgattgagtcaaaaggtggaaacgagaaagaacgcggtgtagcaattgcctacgatagccgtcacttctcacctgagtttgcctttgaatctgcggcagttcttgctaaacacggcatcaaatcttacgtatttgaaagccttcgtccgactccagaactatcatttgcagttcgtcatctcaactgtttcgcaggtatcatggtcacagccagccacaaccctgctccatttaacggttacaaggtttacggtgaagacggtggacaaatgcctccacacgatgcggacgctttgactacttatatccgtgcaatcgaaaacccatttgcagttgaagttgctgatgtggaaactgaaaaagcttctggcttgattgaagttatcggcgaagctgttgacgtagaataccttaaagaggttaaggacgtaaacatcaacccagccttgattgaagaatttggtaaagacatgaagattgtctacacaccacttcatggtactggtgaaatgttggctcgtcgtgctcttgcccaagcaggatttgactctgttcaagttgttgaagcgcaagcaactgctgacccagacttctcaactgtaacatctccaaacccagaaagccaagcagcctttgcccttgctgaagaacttggtcgtcaagttggtgcagatgttcttgtcgcaactgacccagacgctgaccgtgttggtgttgaagttcttcaaaaagatggtagctacctcaacctttcaggtaaccaaatcggtgctatcatggctaaatacatcttggaagctcacaaaaacgctggaactcttcctgaaaatgccgctctctgcaaatctatcgtttcaactgacttggtaacgaagattgctgaaagctacggcgcaactatgttcaacgtcttgacaggtttcaaatttatcgctgaaaaaatccaagaattcgaagaaaaacacaaccacacttacatgatgggatttgaagaaagcttcggttacttgattaaaccatttgtacgtgataaagatgccatccaagccgttcttgtcgttgctgaacttgctgcctactaccgttctcgtggtttgacacttgctgacggtatcgaagaaatctataaagaatatggctactacgcagaaaaaacaatctctgttactctttcaggtgtcgatggtgctgaacaaatcaaagcgattatggctaaattccgcaacaatgctccaaaagaatggaacgaaacagctatcactgtcgtagaagacttcaaggcacaaactgctactgttgctgacggtactgttacaaacttgacaactcctccaagtgatgtgttgaaatacacacttgctgacagttcatggattgccgttcgcccttcaggtacagaaccaaaaatcaagttctacattgcagttgtaggggaaaccaacgaagaatcacaagctaagattgctaacatcgaagcagaaatcaatgcatttgtaaaataa

SEQ ID NO: 12733 - protein, 572 aa, Streptococcus pneumoniae
MSYQENYQKWVDFVELPDYLRQDLENMDEKTKEDAFYTNLEFGTAGMRGLVGAGTNRINIYVVRQATEGLARLIESKGGNEKERGVAIAYDSRHFSPEFAFESAAVLAKHGIKSYVFESLRPTPELSFAVRHLNCFAGIMVTASHNPAPFNGYKVYGEDGGQMPPHDADALTTYIRAIENPFAVEVADVETEKASGLIEVIGEAVDVEYLKEVKDVNINPALIEEFGKDMKIVYTPLHGTGEMLARRALAQAGFDSVQVVEAQATADPDFSTVTSPNPESQAAFALAEELGRQVGADVLVATDPDADRVGVEVLQKDGSYLNLSGNQIGAIMAKYILEAHKNAGTLPENAALCKSIVSTDLVTKIAESYGATMFNVLTGFKFIAEKIQEFEEKHNHTYMMGFEESFGYLIKPFVRDKDAIQAVLVVAELAAYYRSRGLTLADGIEEIYKEYGYYAEKTISVTLSGVDGAEQIKAIMAKFRNNAPKEWNETAITVVEDFKAQTATVADGTVTNLTTPPSDVLKYTLADSSWIAVRPSGTEPKIKFYIAVVGETNEESQAKIANIEAEINAFVK

SEQ ID NO: 12734 - DNA, 1665 bp, Mycoplasma pneumoniae
  CDS (1)..(1665): transl_table=4
atgaacagtaacgcatacttggaagctcaaaggtggctaagccatccgcgggtaaaacccaacttaaaggaggtcattacggctatgagtgctgaggaaatcgagcacttctttagcttaaagaaaccgagttttggcactgctggggtacggggcaaaatggcaccggggtaccatgggatgaatgtgttttcctatgcttacttaacccagggttatgtcaactacatccagtcgttaaacccaactaaaaaaccattacgctttttagtagccagagacactagaaaacacggggcattgtttaatggcattgtgtgtgatgtgattacctctatgggtcatgtggtctatatgtttgataacaatgaaccaacaccaacaccattagtatcttatgtgattaagaagtaccactttgatggtggggtgaatgtcactgctagtcataatcctaaaaccgataatggctttaagatttacgatggtcatggcgcgcagttactagacttccaaactgatcaattaatcgcaatgttacccccagtggtaacaatgttagatttcgaaccacgtggtaacaacgagctgttacactttttggataacgaagtggtctacaaaaactactttgatgatcttaaggaaagcctagtagtggacaacgacagctttaaaaacctcccggtggtctttaccgggttacatggtacttcggtgaagttgttaccaaggtttttaacctatttgggttacagcaacattattagtgtccaaccacaaaacgtgtttgacgctaactttgctaatgctgaccacctcaaccccgaaagtaaggatacctgagagttagcgcgacagtatgcatccaacactaaggccaagttaatgatggcaattgatccggatgctgatcgctttgcgattgccgaatgaaatccgcaaacccaagactggcactacttctccgggaacgagtcaggagttatggtggcttactataagctcaaacacaagcagtttaagcgtcaaccttacattgtaacgacggtagtctctactgatctagtggataagattgccaagaagtacggggcttttgtcaagcgcacaaatgtcggctttaagtttattggtcaagctgttaatcacttctccaaagacaatgaactagtagtggcctttgaagaagcgattggtatgatggctagtgatggtttgaaccgcgaaaaggattcctttcaagcagcggccatcatgcttgaaattgcgcgctactgtcataataaaggaattagcttactagagttctaccgtggtgagatcttcggtgaatttggtgattactataactgaacggtaccacacaccattcacggagttaactggaaggaaaaaatggaacaggtattacaccagttaaccacagctaccattaaagaggttgtgggacacaagattaccaagattaaaaactatgtcgacattaacctagtcgaatatgtcttggaaaacggtaactggattaagttccgcatttccggtacagaaccgaagttaaagctgtactttaacctatctaacggttacttagcagctttaaaacacgaagcgaaaaagatgcacgagttcctagtgcgattgctcaacctcgataaagcttag

SEQ ID NO: 12735 - protein, 554 aa, Mycoplasma pneumoniae
MNSNAYLEAQRWLSHPRVKPNLKEVITAMSAEEIEHFFSLKKPSFGTAGVRGKMAPGYHGMNVFSYAYLTQGYVNYIQSLNPTKKPLRFLVARDTRKHGALFNGIVCDVITSMGHVVYMFDNNEPTPTPLVSYVIKKYHFDGGVNVTASHNPKTDNGFKIYDGHGAQLLDFQTDQLIAMLPPVVTMLDFEPRGNNELLHFLDNEVVYKNYFDDLKESLVVDNDSFKNLPVVFTGLHGTSVKLLPRFLTYLGYSNIISVQPQNVFDANFANADHLNPESKDTWELARQYASNTKAKLMMAIDPDADRFAIAEWNPQTQDWHYFSGNESGVMVAYYKLKHKQFKRQPYIVTTVVSTDLVDKIAKKYGAFVKRTNVGFKFIGQAVNHFSKDNELVVAFEEAIGMMASDGLNREKDSFQAAAIMLEIARYCHNKGISLLEFYRGEIFGEFGDYYNWTVPHTIHGVNWKEKMEQVLHQLTTATIKEVVGHKITKIKNYVDINLVEYVLENGNWIKFRISGTEPKLKLYFNLSNGYLAALKHEAKKMHEFLVRLLNLDKA

SEQ ID NO: 12736 - DNA, 1710 bp, Saccharomyces cerevisiae
  CDS (1)..(1710)
atgtcatttcaaattgaaacggttcccaccaaaccatatgaagaccaaaagcctggtacctctggtttgcgtaagaagacaaaggtgtttaaagacgaacctaactacacagaaaatttcattcaatcgatcatggaagctattccagagggttctaaaggtgccactcttgttgtcggtggtgatgggcgttactacaatgatgtcattcttcataagattgccgctatcggtgctgccaacggtattaaaaagttagttattggtcagcatggtcttctgtctacgccagccgcttctcacatcatgagaacctacgaggaaaaatgtactggtggtattatcttaaccgcctcacataatccaggtggtccagaaaatgacatgggtattaagtataacttatccaatgggggtcctgctcctgaatccgtcacaaatgctatttgggagatttccaaaaagcttaccagctataagattatcaaagacttcccagaactagacttgggtacgataggcaagaacaagaaatacggtccattactcgttgacattatcgatattacaaaagattatgtcaacttcttgaaggaaatcttcgatttcgacttaatcaagaaattcatcgataatcaacgttctactaagaattggaagttactgtttgacagtatgaacggtgtaactggaccatacggtaaggctattttcgttgatgaatttggtttaccggcggatgaggttttacaaaactggcatccttctccggattttggtggtatgcatccagatccaaacttaacttatgccagttcgttagtgaaaagagtagatcgtgaaaagattgagtttggtgctgcatccgatggtgatggtgatagaaatatgatttacggttacggcccatctttcgtttctccaggtgactccgtcgcaattattgccgaatatgcagctgaaattccatatttcgccaagcaaggtatatatggtctggcccgttcattccctacctcaggagccatagaccgtgttgccaaggcccatggtctaaactgttatgaggtcccaactggctggaaatttttctgtgctttgttcgacgctaaaaaattatctatctgtggtgaagaatcgtttggtactggttccaaccacgtaagggaaaaggacggtgtttgggccattatggcgtggttgaacatcttggccatttacaacaagcatcatccggagaacgaagcttctattaagacgatacagaatgaattctgggcaaagtacggccgtactttcttcactcgttatgattttgaaaaagttgaaacagaaaaagctaacaagattgtcgatcaattgagagcatatgttaccaaatcgggtgttgttaattccgccttcccagccgatgagtctcttaaggtcaccgattgtggtgatttttcatacacagatttggacggttctgtttctgaccatcaaggtttatatgtcaagctttccaatggtgcaagattcgttctaagattgtcaggtacaggttcttcaggtgctaccattagattgtacattgaaaaatactgcgatgataaatcacaataccaaaagacagctgaagaatacttgaagccaattattaactcggtcatcaagttcttgaactttaaacaagttttaggaactgaagaaccaacggttcgtacttaa

SEQ ID NO: 12737 - protein, 569 aa, Saccharomyces cerevisiae
MSFQIETVPTKPYEDQKPGTSGLRKKTKVFKDEPNYTENFIQSIMEAIPEGSKGATLVVGGDGRYYNDVILHKIAAIGAANGIKKLVIGQHGLLSTPAASHIMRTYEEKCTGGIILTASHNPGGPENDMGIKYNLSNGGPAPESVTNAIWEISKKLTSYKIIKDFPELDLGTIGKNKKYGPLLVDIIDITKDYVNFLKEIFDFDLIKKFIDNQRSTKNWKLLFDSMNGVTGPYGKAIFVDEFGLPADEVLQNWHPSPDFGGMHPDPNLTYASSLVKRVDREKIEFGAASDGDGDRNMIYGYGPSFVSPGDSVAIIAEYAAEIPYFAKQGIYGLARSFPTSGAIDRVAKAHGLNCYEVPTGWKFFCALFDAKKLSICGEESFGTGSNHVREKDGVWAIMAWLNILAIYNKHHPENEASIKTIQNEFWAKYGRTFFTRYDFEKVETEKANKIVDQLRAYVTKSGVVNSAFPADESLKVTDCGDFSYTDLDGSVSDHQGLYVKLSNGARFVLRLSGTGSSGATIRLYIEKYCDDKSQYQKTAEEYLKPIINSVIKFLNFKQVLGTEEPTVRT

SEQ ID NO: 12738 - DNA, 1698 bp, Bacillus subtilis
  CDS (1)..(1698): transl_table=11
atgacttggagaaagagctatgaacgctggaaacagacagaacatttagatctggaattaaaagagcgccttattgaattagagggagatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgccataagtctccggagttcgcgatggaagcggcaaaaacacttgcgacacaaggcatccaaacatacgtgtttgatgagcttcgcccgacgccagagctgtcattcgctgttagacagctgaacgcttatggtggagttgtggtaacggcaagccataacccgcctgaatataacggctacaaagtatacggggatgatggcggccagctgcctccaaaggaagcggacatcgtcattgagcaggtaaacgcgattgaaaatgagctgacgatcacagttgtaagatatgataaagtttatacagaaaaactgacgtccatttctgtacatcctgaattatcggaagaagtagatgtaaaggttgttttcacaccgctgcatggaactgcaaataaaccggtcagacgcggtcttgaagcactcggctacaaaaatgtaacggttgtcaaagaacaggaactgccggattcaaacttctccactgttacatcgccgaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgttgctgcttcattacctgctttctgaaaagaaaaaacaaggcatcctgcctgataacggtgttgttctcaaaacgatcgtcacaagcgaaatcggccgtgctgtagcttcttcattcggccttgatacgattgatacgctgacaggctttaagtttatcggtgaaaagattaaggaatacgaagcatcaggccagtataccttccaattcggttatgaagagagctacggttatttaatcggggattttgcccgcgataaggacgccattcaggctgcgcttttggcagttgaagtttgcgcgttctataaaaaacagggaatgtcattgtatgaggcgctcatcaatctctttaacgaatatggtttttatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaagcaaagaagaagccatcgacttgccaaaatcaaatgtattgaaatacttcctggaagacgggtcttggttctgtctccgtccttctggaactgagccgaaggttaaattttatttcgccgtaaaagggtcatctttggaagacagtgaaaagcgacttgccgtcctttctgaagatgtaatgaagacggtggatgaaattgttgagtcaacagcaaaataa

SEQ ID NO: 12739 - protein, 565 aa, Bacillus subtilis
MTWRKSYERWKQTEHLDLELKERLIELEGDEQALEDCFYKDLEFGTGGMRGEIGAGTNRMNIYTVRKASAGFAAYISKQGEEAKKRGVVIAYDSRHKSPEFAMEAAKTLATQGIQTYVFDELRPTPELSFAVRQLNAYGGVVVTASHNPPEYNGYKVYGDDGGQLPPKEADIVIEQVNAIENELTITVVRYDKVYTEKLTSISVHPELSEEVDVKVVFTPLHGTANKPVRRGLEALGYKNVTVVKEQELPDSNFSTVTSPNPEEHAAFEYAIKLGEEQNADILIATDPDADRLGIAVKNDQGKYTVLTGNQTGALLLHYLLSEKKKQGILPDNGVVLKTIVTSEIGRAVASSFGLDTIDTLTGFKFIGEKIKEYEASGQYTFQFGYEESYGYLIGDFARDKDAIQAALLAVEVCAFYKKQGMSLYEALINLFNEYGFYREGLKSLTLKGKQGAEQIEAILASFRQNPPQKMAGKQVVTAEDYAVSKRTLLTESKEEAIDLPKSNVLKYFLEDGSWFCLRPSGTEPKVKFYFAVKGSSLEDSEKRLAVLSEDVMKTVDEIVESTAK

SEQ ID NO: 12740 - DNA, 25 bp, Artificial sequence
  primer
atgttgcaaggaattttagaaaccg

SEQ ID NO: 12741 - DNA, 29 bp, Artificial sequence
  primer
tcaaaattttgtaactatattcatttcat

SEQ ID NO: 12742 - protein, 698 aa, Artificial sequence
  consensus sequence
  Variant (2)..(23): Xaa in position 2 to 23 is any amino acid
  Variant (24)..(35): Xaa in position 24 to 35 is any or no amino acid
  Variant (37)..(37): Xaa in position 37 is any amino acid
  Variant (38)..(40): Xaa in position 38 to 40 is any or no amino acid
  Variant (42)..(42): Xaa in position 42 is any amino acid
  Variant (46)..(46): Xaa in position 46 is any amino acid
  Variant (48)..(48): Xaa in position 48 is any amino acid
  Variant (51)..(52): Xaa in position 51 to 52 is any amino acid
  Variant (53)..(55): Xaa in position 53 to 55 is any or no amino acid
  Variant (57)..(57): Xaa in position 57 is any amino acid
  Variant (58)..(60): Xaa in position 58 to 60 is any or no amino acid
  Variant (62)..(68): Xaa in position 62 to 68 is any amino acid
  Variant (69)..(70): Xaa in position 69 to 70 is any or no amino acid
  Variant (72)..(86): Xaa in position 72 to 86 is any amino acid
  Variant (87)..(124): Xaa in position 87 to 124 is any or no amino acid
  Variant (126)..(126): Xaa in position 126 is any amino acid
  Variant (128)..(129): Xaa in position 128 to 129 is any amino acid
  Variant (131)..(132): Xaa in position 131 to 132 is any amino acid
  Variant (135)..(137): Xaa in position 135 to 137 is any amino acid
  Variant (139)..(144): Xaa in position 139 to 144 is any amino acid
  Variant (146)..(155): Xaa in position 146 to 155 is any amino acid
  Variant (156)..(180): Xaa in position 156 to 180 is any or no amino acid
  Variant (184)..(196): Xaa in position 184 to 196 is any amino acid
  Variant (197)..(198): Xaa in position 197 to 198 is any or no amino acid
  Variant (200)..(202): Xaa in position 200 to 202 is any amino acid
  Variant (208)..(210): Xaa in position 208 to 210 is any amino acid
  Variant (211)..(213): Xaa in position 211 to 213 is any or no amino acid
  Variant (215)..(217): Xaa in position 215 to 217 is any amino acid
  Variant (222)..(222): Xaa in position 222 is any amino acid
  Variant (224)..(226): Xaa in position 224 to 226 is any amino acid
  Variant (227)..(234): Xaa in position 227 to 234 is any or no amino acid
  Variant (236)..(236): Xaa in position 236 is any amino acid
  Variant (238)..(267): Xaa in position 238 to 267 is any amino acid
  Variant (268)..(289): Xaa in position 268 to 289 is any or no amino acid
  Variant (291)..(308): Xaa in position 291 to 308 is any amino acid
  Variant (309)..(329): Xaa in position 309 to 329 is any or no amino acid
  Variant (331)..(332): Xaa in position 331 to 332 is any amino acid
  Variant (335)..(335): Xaa in position 335 is any amino acid
  Variant (337)..(341): Xaa in position 337 to 341 is any amino acid
  Variant (342)..(343): Xaa in position 342 to 343 is any or no amino acid
  Variant (345)..(353): Xaa in position 345 to 353 is any amino acid
  Variant (354)..(358): Xaa in position 354 to 358 is any or no amino acid
  Variant (360)..(361): Xaa in position 360 to 361 is any amino acid
  Variant (363)..(365): Xaa in position 363 to 365 is any amino acid
  Variant (367)..(368): Xaa in position 367 to 368 is any amino acid
  Variant (370)..(370): Xaa in position 370 is any amino acid
  Variant (373)..(373): Xaa in position 373 is any amino acid
  Variant (374)..(376): Xaa in position 374 to 376 is any or no amino acid
  Variant (381)..(383): Xaa in position 381 to 383 is any amino acid
  Variant (385)..(397): Xaa in position 385 to 397 is any amino acid
  Variant (398)..(402): Xaa in position 398 to 402 is any or no amino acid
  Variant (404)..(404): Xaa in position 404 is any amino acid
  Variant (411)..(419): Xaa in position 411 to 419 is any amino acid
  Variant (420)..(433): Xaa in position 420 to 433 is any or no amino acid
  Variant (435)..(435): Xaa in position 435 is any amino acid
  Variant (437)..(439): Xaa in position 437 to 439 is any amino acid
  Variant (441)..(458): Xaa in position 441 to 458 is any amino acid
  Variant (459)..(470): Xaa in position 459 to 470 is any or no amino acid
  Variant (472)..(479): Xaa in position 472 to 479 is any amino acid
  Variant (481)..(490): Xaa in position 481 to 490 is any amino acid
  Variant (491)..(491): Xaa in position 491 is any or no amino acid
  Variant (497)..(508): Xaa in position 497 to 508 is any amino acid
  Variant (509)..(518): Xaa in position 509 to 518 is any or no amino acid
  Variant (521)..(522): Xaa in position 521 to 522 is any amino acid
  Variant (524)..(530): Xaa in position 524 to 530 is any amino acid
  Variant (531)..(532): Xaa in position 531 to 532 is any or no amino acid
  Variant (536)..(551): Xaa in position 536 to 551 is any amino acid
  Variant (552)..(554): Xaa in position 552 to 554 is any or no amino acid
  Variant (556)..(567): Xaa in position 556 to 567 is any amino acid
  Variant (568)..(572): Xaa in position 568 to 572 is any or no amino acid
  Variant (574)..(594): Xaa in position 574 to 594 is any amino acid
  Variant (595)..(601): Xaa in position 595 to 601 is any or no amino acid
  Variant (603)..(608): Xaa in position 603 to 608 is any amino acid
  Variant (609)..(627): Xaa in position 609 to 627 is any or no amino acid
  Variant (629)..(647): Xaa in position 629 to 647 is any amino acid
  Variant (648)..(683): Xaa in position 648 to 683 is any or no amino acid
  Variant (691)..(693): Xaa in position 691 to 693 is any amino acid
  Variant (695)..(695): Xaa in position 695 is any amino acid
  Variant (697)..(697): Xaa in position 697 is any amino acid
WXXXXXXXXXXXXXXXXXXXXXXXXXXXXXXXXXXFXXXXLXFGTXGXRGXXXXXGXXXXNXXXXXXXXXGXXXXXXXXXXXXXXXXXXXXXXXXXXXXXXXXXXXXXXXXXXXXXXXXXXXXXDXRXXSXXFAXXXAXXXXXXGXXXXXXXXXXXXXXXXXXXXXXXXXXXXXXXXXXXPTPXXXXXXXXXXXXXXXGXXXTASHNXXXXXXPXXXNGYKXYXXXXXXXXXXXGXQXXXXXXXXXXXXXXXXXXXXXXXXXXXXXXXXXXXXXXXXXXXXXXXXXXXXYXXXXXXXXXXXXXXXXXXXXXXXXXXXXXXXXXXXXXXXTXXHGXGXXXXXXXLXXXXXXXXXXXXXXVXXQXXXDXXFXTVXXXXPNPEXXXAXXXXXXXXXXXXXXXXXXAXDPDADRXXXXXXXXXXXXXXXXXXXXXXXLXGXXXGXXXXXXXXXXXXXXXXXXXXXXXXXXXXXXVXXXXXXXXAXXXXXXXXXXXLTGFKXXXXXXXXXXXXXXXXXXXXXXEEXXGXXXXXXXXXDKDXXXXXXXXXXXXXXXXXXXGXXXXXXXXXXXXXXXXXGXXXXXXXXXXXXXXXXXXXXXXXXXXXXRXXXXXXXXXXXXXXXXXXXXXXXXXDXXXXXXXXXXXXXXXXXXXXXXXXXXXXXXXXXXXXXXXXXXXXXXXXXXXXXXXRPSGTEPXXXKXKXY

SEQ ID NO: 12743 - protein, 24 aa, Artificial sequence
  protein pattern
  Variant (3)..(3): Xaa in position 3 is any amino acid
  Variant (4)..(4): Xaa in position 4 is Leu or Val
  Variant (5)..(5): Xaa in position 5 is Ala, Pro or Ser
  Variant (6)..(6): Xaa in position 6 is Phe or Tyr
  Variant (7)..(7): Xaa in position 7 is Ala, Cys, Gly, Ser or Thr
  Variant (8)..(12): Xaa in position 8 to 12 is any amino acid
  Variant (13)..(13): Xaa in position 13 is Ala, Cys or Thr
  Variant (14)..(15): Xaa in position 14 to 15 is any amino acid
  Variant (16)..(16): Xaa in position 16 is Ala or Gly
  Variant (17)..(17): Xaa in position 17 is Ile, Leu or Val
  Variant (18)..(18): Xaa in position 18 is any amino acid
  Variant (19)..(19): Xaa in position 19 is Ile, Leu or Val
TPXXXXXXXXXXXXXXXXXTASHN

SEQ ID NO: 12744 - protein, 10 aa, Artificial sequence
  protein pattern
  Variant (2)..(2): Xaa in position 2 is any amino acid
  Variant (6)..(6): Xaa in position 6 is Ala or Cys
  Variant (9)..(9): Xaa in position 9 is any amino acid
  Variant (10)..(10): Xaa in position 10 is Ala, Gly or Ser
AXDPDXDRXX

SEQ ID NO: 12745 - protein, 14 aa, Artificial sequence
  protein pattern
  Variant (3)..(4): Xaa in position 3 to 4 is any or no amino acid
  Variant (6)..(6): Xaa in position 6 is any amino acid
  Variant (8)..(8): Xaa in position 8 is Ala, Leu or Val
  Variant (9)..(10): Xaa in position 9 to 10 is any amino acid
PDXXFXTXXXPNPE

SEQ ID NO: 12746 - protein, 14 aa, Artificial sequence
  protein pattern
  Variant (2)..(4): Xaa in position 2 to 4 is any amino acid
  Variant (9)..(9): Xaa in position 9 is Ala, Ile or Val
  Variant (11)..(11): Xaa in position 11 is any amino acid
  Variant (12)..(13): Xaa in position 12 to 13 is any or no amino acid
PXXXNGYKXYXXXG

SEQ ID NO: 12747 - protein, 29 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(7): Xaa in position 7 is any amino acid
  Variant (9)..(10): Xaa in position 9 to 10 is any amino acid
  Variant (12)..(13): Xaa in position 12 to 13 is any amino acid
  Variant (16)..(17): Xaa in position 16 to 17 is any amino acid
  Variant (18)..(18): Xaa in position 18 is Ala, Ser, Thr or Val
  Variant (19)..(19): Xaa in position 19 is Ala or Cys
  Variant (20)..(25): Xaa in position 20 to 25 is any amino acid
  Variant (26)..(26): Xaa in position 26 is Asp, Glu, Gly or Asn
  Variant (27)..(28): Xaa in position 27 to 28 is any amino acid
  Variant (29)..(29): Xaa in position 29 is Ala, Cys, Ser, Thr or Val
VXXXXDXRXXSXXFAXXXXXXXXXXXXXX

SEQ ID NO: 12748 - protein, 18 aa, Artificial sequence
  protein pattern
  Variant (2)..(10): Xaa in position 2 to 10 is any amino acid
  Variant (11)..(11): Xaa in position 11 is Cys, Thr or Val
  Variant (12)..(12): Xaa in position 12 is any amino acid
  Variant (17)..(17): Xaa in position 17 is any amino acid
  Variant (18)..(18): Xaa in position 18 is Ile, Leu or Val
AXXXXXXXXXXXTGFKXX

SEQ ID NO: 12749 - DNA, 4302 bp, Saccharomyces cerevisiae
  CDS (1)..(4302)
atggcaaataataattctgatcgacaaggtttggaacccagagtcattagaactctgggttcacaagcgcttagcggtcctagcatatctaatagaacttcaagttcggaggcaaaccctcatttttccaagaacgtgaaggaagcaatgatcaagacagcttctccgactcctttatctacacctatttacaggatagctcaagcttgtgacaggtgtcgatctaagaaaacaaggtgcgatggaaaaagaccacagtgttcgcagtgtgctgctgtcggatttgaatgcagaataagcgataaattactgaggaaagcgtatccaaaagggtacacagaaagcctggaagaaagagtacgcgaactggaggcagagaataagcgtttgctagctttgtgtgatatcaaagaacagcaaataagccttgtttcacagtcgcgaccacagacatcaacggataataccataaatggcaatttcaaacatgatttgaaagatgctccattgaatctgtcttctacaaatatctatttattaaatcaaacggttaataagcagctacaaaatggcaaaatggatggtgataatagcggttctgcaatgagtccattgggggcaccacctccaccgccacacaaagaccatctttgtgacggcgtttcctgtacaaatcatttacacgtcaagcctacttctacgagtttaaacgatccaaccgctatatcttttgaacaggacgaggcacctggtcttcctgcggtaaaggcattaaaatcaatgacgactcatcaacgtagcactcaattggcaactttagtttctttatccatcccaagatctactgaagaaattctgtttattcctcagcttttaactaggataagacaaatatttggtttcaactcaaagcaatgtttgtatacggtttcattattatcttcattgaaaaatagattgccagcaccacggcttctagcaccttcaacatcaaccaagttaaaggagaaagatgaagataaaaaacttgatgatgattcggcttttgtgaaaaggtttcaaagcacaaacctctccgagtttgtcgatttgaaaaagtttttaatttctttgaaatttaacattaactcgttttcaaagcaatcagaaaagccggctaatgatcaggatgatgaactactttccctcactgaaattaaagagcttttacacctttttttcaaattttggtctaatcaggtaccaattctaaacaatgaccacttcttaatatatttcaacaattttgttgaagtcgtgaagcatttatctacagaaaatttggagacgaataacactactaaaagtacagtcaccactaatcatgaaatatttgccctaaagcttctgatgatgttacaaatggggttactcgttaagattaaaatggaaaaaataaaatacactgtaccgaagaatccgaaggccaaatatgctagattgatggcatattatcatcagctttccctaataattcctaaaaatccttattttttaaatatgtccacaacttcattaccatccttacaattgttatctttggcatccttttattatttaaacgtgggtgatatttcggcaatctatggggtaagaggccgtattgtttctatggcacaacaattgagacttcacagatgtcctagtgccgtattaagtgtacactctaacccagttctacaaaaatttgagcaaagcgagaggagattactgttttgggcaatttattacgttgacgtttttgcctcattgcaacttggtgttcctcgtttacttaaggattttgatattgaatgtgcattaccaatttctgatgttgagtataaggatcagttatctatggaaaatgaaaaagcagataaaaaagctaaaaagattcaactgcaaggtcaagtttcaagcttttcattgcagataatcagatttgcgaaaatattaggtaacattctagactcgatttttaagagaggaatgatggatgaacgtataacttctgaagttgcattagtacatgaaaacgcactggataactggagaaatcaacttcccgaaatgtactactttcaaataactgtaaacggaactgtgaatttagacgagattagagcaaccaatcaaagaaatactgagaccaaatttgataagaaagacataatattatttgaaaagaagattctattgctgttttatttcttggccaaatctatgatacatttaccggttattgcaaccaaacctttgcctaagaatgttgataatgccacaaagaagaaacagtcaatgttcaacaacgactctaaaggcgcaaccaaccaggaccacatgatattagatgttgatatgacttctcctgctataaggacatcatcctcatatatcattttacaacaagctaccaatgcaacgcttacgattttccaggccattaattccatgtatttacctttgccattgaatgtatcaagaacgttaatcagattttctttgctctgtgctagaggttctttggaatataccaaaggtggtgcgttattcttagataataaaaatcttctcctcgacaccatcaaagatatcgaaaacgataggcttttggatttacctggaattgcctcttggcacacgctgaaactgtttgacatgagcatcaacctgttgttgaaagcacctaatgttaaggttgaaagactggataaattcttggaaaagaaattgaattactacaatagattgatggggttaccaccggccacaaccacatccttaaaaccattatttggctctcaatcgaagaacagcctggaaaatagacaaagaacacctaatgtcaaaagagaaaacccagaacacgagtatctttatggaaacgatagtaataataacaataattctgaagcgggtcactctccaatgacaaatacaactaatggtaataagagattaaagtatgaaaaagatgcaaaacgaaatgcaaaagatggcggtatatccaagggggagaacgcacataatttccagaatgataccaaaaaaaacatgtccaccagcaatctgtttccattttcgtttagtaatacagaccttactgcgctgttcacccatcctgaaggaccgaattgtacgaatactaataatggcaacgtggatgtgtgtaacagagcttctacagatgccacggatgccaatatagagaacttaagctttttaaatatggcaccattcttacagaccggtaactccaatataggtcaaaacacgattgagaataagcctatgcacatggatgcgatattcagtctaccaagtaatttagatctaatgaaggataatatggactctaaaccggaacaattagaacccgttattaagcaaaaccctgagaattcaaaaaacaaccaatttcatcagaaaggaaaaagtacgaatatggaaaagaataatctctctttcaacaacaagagtaactacagcctaacaaagctaatgagattgctgaacaacgataattctttctcgaatattagtattaacaactttttataccaaaatgatcagaactccgcgtcagcggatccgggaacaaataaaaaagccgttacaaatgcaggtgccaacttcaaaccaccttcaactggcagtaataccagccaaggcagtatccttggaagtacaaagcatggaatggacaactgtgatttcaacgatttaggtaattttaacaatttcatgacaaatgtcaattattctggggtcgactatgattacattgtagatgcatcacttgggttggctcctttattagtggatacgcccgatatctcaaataccaacacgacgtctactacgtcaaatcgaagtaaaaacagcatcatcctagatacgacatttaacgatgacttggatcggtcacgcatgaatgccagagaagtattgaatcctaccgactcaattttaagtcaagggatggtatcctccgtaagtacgagaaataccagcaatcaaagatctctttcatcgggcaatgattcaaaaggtgacagtagttctcaagagaactcaaagagtgcaactggcaaccagttggatacaccttctacactgtttcaaatgagaaggacctcttcagggccctcggcgtcccaccgtggtccaagacggcctcagaaaaatcgttacaatacagatcgatcaaaaagttctggtggcggaagttccaacacagataatgtatctgatttattccaatggcaaaacgccaaataa

SEQ ID NO: 12750 - protein, 1433 aa, Saccharomyces cerevisiae
MANNNSDRQGLEPRVIRTLGSQALSGPSISNRTSSSEANPHFSKNVKEAMIKTASPTPLSTPIYRIAQACDRCRSKKTRCDGKRPQCSQCAAVGFECRISDKLLRKAYPKGYTESLEERVRELEAENKRLLALCDIKEQQISLVSQSRPQTSTDNTINGNFKHDLKDAPLNLSSTNIYLLNQTVNKQLQNGKMDGDNSGSAMSPLGAPPPPPHKDHLCDGVSCTNHLHVKPTSTSLNDPTAISFEQDEAPGLPAVKALKSMTTHQRSTQLATLVSLSIPRSTEEILFIPQLLTRIRQIFGFNSKQCLYTVSLLSSLKNRLPAPRLLAPSTSTKLKEKDEDKKLDDDSAFVKRFQSTNLSEFVDLKKFLISLKFNINSFSKQSEKPANDQDDELLSLTEIKELLHLFFKFWSNQVPILNNDHFLIYFNNFVEVVKHLSTENLETNNTTKSTVTTNHEIFALKLLMMLQMGLLVKIKMEKIKYTVPKNPKAKYARLMAYYHQLSLIIPKNPYFLNMSTTSLPSLQLLSLASFYYLNVGDISAIYGVRGRIVSMAQQLRLHRCPSAVLSVHSNPVLQKFEQSERRLLFWAIYYVDVFASLQLGVPRLLKDFDIECALPISDVEYKDQLSMENEKADKKAKKIQLQGQVSSFSLQIIRFAKILGNILDSIFKRGMMDERITSEVALVHENALDNWRNQLPEMYYFQITVNGTVNLDEIRATNQRNTETKFDKKDIILFEKKILLLFYFLAKSMIHLPVIATKPLPKNVDNATKKKQSMFNNDSKGATNQDHMILDVDMTSPAIRTSSSYIILQQATNATLTIFQAINSMYLPLPLNVSRTLIRFSLLCARGSLEYTKGGALFLDNKNLLLDTIKDIENDRLLDLPGIASWHTLKLFDMSINLLLKAPNVKVERLDKFLEKKLNYYNRLMGLPPATTTSLKPLFGSQSKNSLENRQRTPNVKRENPEHEYLYGNDSNNNNNSEAGHSPMTNTTNGNKRLKYEKDAKRNAKDGGISKGENAHNFQNDTKKNMSTSNLFPFSFSNTDLTALFTHPEGPNCTNTNNGNVDVCNRASTDATDANIENLSFLNMAPFLQTGNSNIGQNTIENKPMHMDAIFSLPSNLDLMKDNMDSKPEQLEPVIKQNPENSKNNQFHQKGKSTNMEKNNLSFNNKSNYSLTKLMRLLNNDNSFSNISINNFLYQNDQNSASADPGTNKKAVTNAGANFKPPSTGSNTSQGSILGSTKHGMDNCDFNDLGNFNNFMTNVNYSGVDYDYIVDASLGLAPLLVDTPDISNTNTTSTTSNRSKNSIILDTTFNDDLDRSRMNAREVLNPTDSILSQGMVSSVSTRNTSNQRSLSSGNDSKGDSSSQENSKSATGNQLDTPSTLFQMRRTSSGPSASHRGPRRPQKNRYNTDRSKSSGGGSSNTDNVSDLFQWQNAK

SEQ ID NO: 12751 - DNA, 3765 bp, Candida glabrata CBS 138
  CDS (1)..(3765)
atggtgtctaatgctgatgaaacttttgtggcgcctaggttgattcgggtagctggcgggggagatgatgatgtgcacgggagtgggtctggtgcgggccctgctaatgggaactcagtttctgggagtaacacaggtagtcgagggtctacacctacatatagagtggcacaggcttgtgatcgttgccggttgaagaagaccaagtgtgatgggaagataccgcagtgttcgcagtgcgcgctggtcgggtttgagtgtaagattagcgataggctcaatagaaaatccttcccaaggggatatactgagacactagaggagcgtgttcgggagctggaaactgaaaacaagcgtttaatggccttgtgcaactctgacctgggaagcaacacgagaagtgatggtttagagaagcaatcgccctcaaaaaggaagagatcaccatctatggaacgagatagtgagcgcggattcactgaaaacatggaattacaattgcagcagagctgctctagctgcggaaactcagaccctaatcatagatgtgttcatctgaagcctgttgtttcgaacatcattgtggattcaaacaccgatgtgtcttttgaacaaaatgtagcaccaggactgccagcagtaaaagcattaaattccatggctgagagagaggaaagtgcacagttggctatgttagtatcattagccctgcctagatcgacagaggaaattctattcataccacaattaatggctaatatacaaaagaccttcggattttcatcgaagcagtcattatatactgtatcattgctgtcatcattgaagaagaatctgccaacacctaatagtaattcatcggacgagaatctatcacctaactattatgtttcagaggattttcgcccattcttttatgaggttttgaagtttgatatacttggagaaacagaaactgaaaatgggtcaaatagaaacgaatctcctgatagtactatacctaatagtagaagtgatgatttattgtcatggatggaaatacaacgtctagttgatgtgtactttgaatgttggtcaaatacgataccgatattcagtagaaaattattcataaagcagatgaaggcttttaagacagaagttgacaaatttggtgatagactctttgaagtctacaaaaccgaacaaataaagattaattttctaaaaatttttgctacagtcttggccgttatgtgccaaatggctttgctgtctaggttgaaacaattggaagctacgacgcaagaattggagtgcaaaagaactcaaaacctaatagcgcattataaccagcttatagaaaaaatccatttagactctttcttccaggatatgtcgaccacaactgtgcaaagtcttcagctgctgtcgtttatttcgttttacttcttgaatgttggtgacattccgcggttgtatcagttaagaggaacagtaatatctatggctcaacaattgagattacatagatgtccaagtgctgtgttgctttcagcatcggggtcgacaatgcaaaagtttgaacaaggtgaaaggagattattattctgggcaatatactatttagatgtattttactccctacagttgggtgtaccgcggctaattaaagatcacgaaattgaatgtgccttacccgtctctgaagaagaagatagtcagctagaaggtcgagtttctgacttttctctagcggttatcagatatgccaaggtcttgggtaatattctagattctatattcaagagaaatatgatgtccgaagcggcaactgaaagtatggcctttgttcatgagaaggcgcttgatatttggaaaaatcgtctgcctgaaaagtatggtttccggttagaggcaaatgggcttttcaactttgatgaattgactgttgttaagaattccgaaaaggatttgatcgagaagtcgtcaatattattattttatttcttggcgaagtgtatgattcatttgcctgtaatcgcaacaaggtcggcctcattagagcagcaacttcaaccagggacgtcttctgacacatctgaaactccaaaagaaagtcaaaataagacaccaacgagagtttgtccatcttatattctaatgcaaaaagcagccagtaccatgcttcaggtaatgcattatacttcagaatactatttgccttcaccgatcaatatctctaggacaaaggccaggtttgcattgttgactgcctgtagcgctgtagaatatctgaagggtggttcgttatatgtggaaacaaaaaacctccttgagaacctaataattaagctggagcttgagaggaagctggatttaccaggaataatatcttggcatagtttgaaattattagatatggctttgatgttactgctacaatctccgacaactaagatggaaaaactagacaaactagtccaaaagaaaattaaccattataataggcaaatgggtattccagctatgaagctctccaacagcaggaagaataataaaaaaatcaaattagaaaatgagtctagccagctttccagcactagtaaccccatagcaaagggagaattaaagagtgattcagttgtttgtgaagaagatgataatgtgaatgataatgaagttacaactactgctaagctagaagaaaataatgaatttataaaccccaataaaattgaacaaggagttacttctaacacacttgccttttcatttagtagtactgatttatcggctttatttaatgcaccagaaagcttgtttaaagtacccaatgagaatactcagtataatcaacagcatgagatgcataataatagtatttctagttcccattcaaaagagcctgtaaataaggaaagggatagtgataaacaggaactaaacgccattttcaatgagactcaaaatagaagtacaagttttgctaaactaatgctactcctcaataatgagcataaatcactttcatcatctcttgagaatgacgttagaaatgtaggcaacaaactttcaagtgagaatgctgggcagttaccatcacatggtgccacttcgggcttaaattcgaaaggtaatgaatttttgtcaatgaatacactttatggaggagataatgatttcattattgatgcgtctcttggtttggcacctttgctatctgaaaataatgaaattcatagacagcatgaaggaacccaagttcaagctggaaataatgatatattatctacaaggataggttttaatggtaaggatgattattcgaattctcgaagcttcacaaatgaaatgtttggtggttcggacactaagcgaacaagatctgatacaactgctctcttgaccgcaaattcagaattgacgcatgactcacaggatggtaatgtcaattttgggtcaacaaattcagaattacatgagaggttgaataataatcactttgatgccgcaacttcatatcttcctgaacagaagagtgaatatggatcctcattcggcaataaaaatactgtaaagagtttgagccctagtactagctttctagatgacgatacattgagtttatcctttggggattacagtactcaaaggaggccaagaagataccctaattataacaatacactagggaaggattcattggccatgaaaactgaaattaatggcggtagaaatcaaggaaatctgcatgatttgttccagtggcaaaattcgaaatag

SEQ ID NO: 12752 - protein, 1254 aa, Candida glabrata CBS 138
MVSNADETFVAPRLIRVAGGGDDDVHGSGSGAGPANGNSVSGSNTGSRGSTPTYRVAQACDRCRLKKTKCDGKIPQCSQCALVGFECKISDRLNRKSFPRGYTETLEERVRELETENKRLMALCNSDLGSNTRSDGLEKQSPSKRKRSPSMERDSERGFTENMELQLQQSCSSCGNSDPNHRCVHLKPVVSNIIVDSNTDVSFEQNVAPGLPAVKALNSMAEREESAQLAMLVSLALPRSTEEILFIPQLMANIQKTFGFSSKQSLYTVSLLSSLKKNLPTPNSNSSDENLSPNYYVSEDFRPFFYEVLKFDILGETETENGSNRNESPDSTIPNSRSDDLLSWMEIQRLVDVYFECWSNTIPIFSRKLFIKQMKAFKTEVDKFGDRLFEVYKTEQIKINFLKIFATVLAVMCQMALLSRLKQLEATTQELECKRTQNLIAHYNQLIEKIHLDSFFQDMSTTTVQSLQLLSFISFYFLNVGDIPRLYQLRGTVISMAQQLRLHRCPSAVLLSASGSTMQKFEQGERRLLFWAIYYLDVFYSLQLGVPRLIKDHEIECALPVSEEEDSQLEGRVSDFSLAVIRYAKVLGNILDSIFKRNMMSEAATESMAFVHEKALDIWKNRLPEKYGFRLEANGLFNFDELTVVKNSEKDLIEKSSILLFYFLAKCMIHLPVIATRSASLEQQLQPGTSSDTSETPKESQNKTPTRVCPSYILMQKAASTMLQVMHYTSEYYLPSPINISRTKARFALLTACSAVEYLKGGSLYVETKNLLENLIIKLELERKLDLPGIISWHSLKLLDMALMLLLQSPTTKMEKLDKLVQKKINHYNRQMGIPAMKLSNSRKNNKKIKLENESSQLSSTSNPIAKGELKSDSVVCEEDDNVNDNEVTTTAKLEENNEFINPNKIEQGVTSNTLAFSFSSTDLSALFNAPESLFKVPNENTQYNQQHEMHNNSISSSHSKEPVNKERDSDKQELNAIFNETQNRSTSFAKLMLLLNNEHKSLSSSLENDVRNVGNKLSSENAGQLPSHGATSGLNSKGNEFLSMNTLYGGDNDFIIDASLGLAPLLSENNEIHRQHEGTQVQAGNNDILSTRIGFNGKDDYSNSRSFTNEMFGGSDTKRTRSDTTALLTANSELTHDSQDGNVNFGSTNSELHERLNNNHFDAATSYLPEQKSEYGSSFGNKNTVKSLSPSTSFLDDDTLSLSFGDYSTQRRPRRYPNYNNTLGKDSLAMKTEINGGRNQGNLHDLFQWQNSK

SEQ ID NO: 12753 - DNA, 4338 bp, Kluyveromyces lactis NRRL Y-1140
  CDS (1)..(4338)
atggtcgagaagaaagattcagctggccggtttaatggacaaccgagccatggcgggccgaggtttattaggacgctgggctcgcagtcattaagtggtctgaatcctttatccaatgcgcagcaaggggtttctcagcaacaacaacacctaagccatcattctcataacgttacagactcagactctcccagtattcaagattccgggattcctatcacatccgctttgatcaagaaggagtcacctagtcatgcggtttctggtataccgtctaactcaaacagtattaataacaatagtaaaagcaattccaataataatccatccagtgtttttagcagcagaaataatacatcgatacaacaattgcagcagggcccatcacctacactgtcgaattcagagtcgcccgtaaacgcgtcccttttatcgtctatcactacaccgttgttgcatcaaactggttcggcaagccatccgccatctaatacggggtccagtaccaatgggacaacaactccttcgtatcgtgtggctcaagcgtgtgacagatgtagagccaagaaaattagatgtgatggtaagaggccgcagtgtacacagtgtgctgcggttggttttgaatgtaaaattagtgataagctaagccgtagagctttcccaagaggatacacagaaacgttggaagaacgagtaagggaacttgaagctgaaaatagaaggttggtagctctctgcgatttgaaagaagagcaattgcatttggtatcgaaatatagtaacagcaaggacgaaaacggagtagagattccatccaccgaagaagaacaaattttgcatgaactctctaagaccaatggcggttccctaagagtcagttccacgaacttatacttacttaataagaaagcttcgcctggtgatgatagtcatattgagtcatcagagccatctataccagttcgcaaagtggcaatcactgcgccttcaccacgcatcatgtcgccaagaaacagtgttgcggattctgatccatcccaaactaataccggtaataacgaccatattcattccaataataataaccacaatcaaaacaatagtactgatccttacggaatttctttcgaacaaaatgaagcgccaggtcttcccgcgctaaaagctctctcatctttgtcgaagtataagcaaggaactcagttggccacattggtcgccgtttcagtgcctagaacaactgaagaaattctcttcgttcctcaacttttggcacgtatcggtcaaattcatggttttacttcaaaacaatgcatatataccgcatccgtcctagcatccttaaaagaaaacaacatctcttcaattccaccagagttagaagtgttgaaaaatcataacctatgggaaattgacgatgtcttgcatttctggaagaacgtgttcaagttggattttatgacacatactgccgtggaccattcctctactcatttaaattttgccgaagtcgaagaattgatgcaactcttttttcaggactggtacgagctaattcctttgttcgataaaaatgaattcaactcatactatgaaaagttcaagctgaacgtaactgaccccaatttctttgtcagaaaagatgacactgttttcaacaaccgcactagatctatttcctataaaatcttctcctgtttgttgattataatagttcaaatgggcatgttatctaagatcaaaagagacaagataacatctggtaaattgagtacattaatgaagtactatgataagctaatgactcatatttggatcaatccgtacttcaattcgagaaatacttccattcaggttttacaatgtctttcgatgctattattttatatgctaaatgttggagacatttcttccatttacgaacttcgtggaaaagttgtttcaatgtcacaacaactaaggttacacaggtgtcctagtgctgtactaggtggtgatggttccactgtctccaaagtacagcaaggtgaaagacgtatcctcttctggagtatttattacttggatgtgtttagtgctcttcaacttggtgtcccgaggttgctcaaagactttgaaattgaatgcgctctgccagtaactagtgacgacgacagacaggtcaatttggcgggccaaatgatcgcattagaaggtaaagtgtctcagttttctttgtctgtgataagatttgccaaagttatggggaatattttagattcaacgttcaagagaggcatgactacatcactgactaaacaagcagctttggtgcatgagaacgcccttgataattggagacatggtttacagaaagatctctttttccaattagatgttaatggcacgattaatatggacgaattcaatcaacaaaagcaatactctaaatcactttcaccacgcactgccgcttttactcacaattccttggtgttaatgacgttgtattttatggctaaatgtatgattcacctaccggtcgtggctaccaagccacttgttgctgaggcaattcaaaccccaaccgataatcaaactgaaaacggatcggttgacagatctctgtcatcatatgtcctattacagcaagcgaccaatacgctcctaaacgttttgacagcgttgaactctatatatctgccgttacctataaatttggcaagaaccaagactcgttttggtttattcagcgcacgtggctcgttggaatataccaaaggtggtgcattattccaagacaacaaagccttattactagacttagtaaaagaactggagactgataagaaattagaactaccaggcaatacaagctggcatagcttgaaactatttgatctctcgattaacttgatcttgcaacctgtcaattcaaatccagagaagacagaaaagatgatacaaaagaaaattaactactacaacaagctaatggggcagcctactgttgccgttaagcgtaaacgagacccgaaggctacagaaaatacatcaaaaaaagttaaggttgaagatgatcatagtcaggacaatctgcacaacattactactggcgagaccactgatactgtccactctgaagagttagtcaaggacgtacccaaagaattgaatgtttatcctgaaaactacactacaattgaagaagcgttccaaatggatccagtattgaacactaatttgttcagtaacaccgatctcaagactttgttcaattcaggtatctttgaaaatgcgggcagcatccataacaacattaatgacaataacaataataataataatactaataatactaataataataatggttctagtaggaacattcacaatcttggtgcaggcattgaagacatagaccatgggatgagcttgagaagcaatgacgcttcgttgttgaatctttctaatgcactcggtaatcatggaaacagtgctgaggggatgaaggatggcacaagtgtgtcgaatttattgaatttaagtaccagtgacagtttattcaaagtacctagcaatggagactttttgaaggattattacattaacaatatgagtaacacaggactatctaacctgcacacttcttctgtgaacaagggtccttcattatcacagttgggctctctattcatgtcgagtgggtcgggaacaaatttaccatatagcaatgtacgtggagaatcgaaacacccatctggggtaaatctgaacaaacaacgtgcccaacctgcaatggatggtttctcatttgctgcagatgcatcactcgggctagcaccattgctagcctggtctccggacgctaaacctcaattgaatagtaacaatgggaatgacggtttgaaccctgcgacaggcattgtacttgaatctggcgacaatgattctactaatgcatcagtcgttcaattacaacagcaccaacagcagactcaccaccctccctcccacaacagctcatctattccaatgggaaagcaatccagcacatcagatcgtcaaaacagccatcatcaagataatgttggaagtttccattccatgcattctccgactattccagagcaaacctctgcacagggattgcatcaacatcagatgcttggcatgcctaacagcacactaaactcggataccaataccggtggtgctaatgttacaaatagtatttcaagcaccaatcgccgtggaccaagacgccgttggaataacgctgcatcatcgtcagaccctaattctgctggtgattcatcagtgtccgatttgctgcgctggcaaaatggaaattga

SEQ ID NO: 12754 - protein, 1445 aa, Kluyveromyces lactis NRRL Y-1140
MVEKKDSAGRFNGQPSHGGPRFIRTLGSQSLSGLNPLSNAQQGVSQQQQHLSHHSHNVTDSDSPSIQDSGIPITSALIKKESPSHAVSGIPSNSNSINNNSKSNSNNNPSSVFSSRNNTSIQQLQQGPSPTLSNSESPVNASLLSSITTPLLHQTGSASHPPSNTGSSTNGTTTPSYRVAQACDRCRAKKIRCDGKRPQCTQCAAVGFECKISDKLSRRAFPRGYTETLEERVRELEAENRRLVALCDLKEEQLHLVSKYSNSKDENGVEIPSTEEEQILHELSKTNGGSLRVSSTNLYLLNKKASPGDDSHIESSEPSIPVRKVAITAPSPRIMSPRNSVADSDPSQTNTGNNDHIHSNNNNHNQNNSTDPYGISFEQNEAPGLPALKALSSLSKYKQGTQLATLVAVSVPRTTEEILFVPQLLARIGQIHGFTSKQCIYTASVLASLKENNISSIPPELEVLKNHNLWEIDDVLHFWKNVFKLDFMTHTAVDHSSTHLNFAEVEELMQLFFQDWYELIPLFDKNEFNSYYEKFKLNVTDPNFFVRKDDTVFNNRTRSISYKIFSCLLIIIVQMGMLSKIKRDKITSGKLSTLMKYYDKLMTHIWINPYFNSRNTSIQVLQCLSMLLFYMLNVGDISSIYELRGKVVSMSQQLRLHRCPSAVLGGDGSTVSKVQQGERRILFWSIYYLDVFSALQLGVPRLLKDFEIECALPVTSDDDRQVNLAGQMIALEGKVSQFSLSVIRFAKVMGNILDSTFKRGMTTSLTKQAALVHENALDNWRHGLQKDLFFQLDVNGTINMDEFNQQKQYSKSLSPRTAAFTHNSLVLMTLYFMAKCMIHLPVVATKPLVAEAIQTPTDNQTENGSVDRSLSSYVLLQQATNTLLNVLTALNSIYLPLPINLARTKTRFGLFSARGSLEYTKGGALFQDNKALLLDLVKELETDKKLELPGNTSWHSLKLFDLSINLILQPVNSNPEKTEKMIQKKINYYNKLMGQPTVAVKRKRDPKATENTSKKVKVEDDHSQDNLHNITTGETTDTVHSEELVKDVPKELNVYPENYTTIEEAFQMDPVLNTNLFSNTDLKTLFNSGIFENAGSIHNNINDNNNNNNNTNNTNNNNGSSRNIHNLGAGIEDIDHGMSLRSNDASLLNLSNALGNHGNSAEGMKDGTSVSNLLNLSTSDSLFKVPSNGDFLKDYYINNMSNTGLSNLHTSSVNKGPSLSQLGSLFMSSGSGTNLPYSNVRGESKHPSGVNLNKQRAQPAMDGFSFAADASLGLAPLLAWSPDAKPQLNSNNGNDGLNPATGIVLESGDNDSTNASVVQLQQHQQQTHHPPSHNSSSIPMGKQSSTSDRQNSHHQDNVGSFHSMHSPTIPEQTSAQGLHQHQMLGMPNSTLNSDTNTGGANVTNSISSTNRRGPRRRWNNAASSSDPNSAGDSSVSDLLRWQNGN

SEQ ID NO: 12755 - DNA, 3171 bp, Candida albicans
  CDS (1)..(3171): transl_table=12
atgtcgataaagttagaacaacagcagtcaagtgtatcacaggagaacaatttaccacctacaaagaagaagaccaaggctttgaagtcatctgatggtactgtaaatacaaggaccattaaagtaccaggatcgaaagttgaaagagtggcacaagcatgtgacagatgccgagctaagaaaacaaagtgtgatggacagaacccatgttcaacatgccagtcagtaggattagagtgtattgtttcagatcgtcttaccagaaaatcctatcccaaagcatataccgagactcttgaagaaagagtacgacagctagaggctgaaaacaagaaattagctggattattagatatgagagatgaacaactcgaactacttaatggatctggattaactgaagatacaagtgaaatgtctgagaacaaagaagatgactttaagaaagtaacagcttcaaacttgagtcttttggatatccaaaatagtttgcacctgcatctgccaaacgagaacggcgaaaactgcccatgtgggtgctccaatccacatgccgtccacgaacgaccagtttcgatagcagggtccatttacggtgctgttgctgccaatgaaagagttccaatatctatagctggatcgataaaattaagtgatgaagaagatgaagaagataatgcaagtttattgagtattgaagactataattctagacaccgagaccagcattttcattttgcttcaaactcaacaaatagagaacaaagtccagcaccaggggcgtttgccgcagctactgctattgctcaaatgcagaagaacaaacttttcctacaacaacagcaacaattagaaaacgaaaacaacaaacaacaaatgctcacatcattagtggccatgtcgataccaagaagtacagaagaaacattatgtgtacctacattacttgcaagaatttgtcaaacttatggatacgattctaagcaggcgattttagcagccaactctttagcatctttgaaagaaaatattacctctaatacaggaacactgttggatgaagaacgtaaaaatgctttgaacagtatgataatgaacagatatgaaacaacaaaattgtcagaggaagaggctattgtttttacaaaggatttgattaatttaccggcatccagattagacatggatcagttgattactgtgtatttccaagaatggggcaatgctctaccgatattggataagaatgcatttttgaaaaactatatgaaattgaattacatattggagcagggccattacaaggaatataaaggagagtcatcctatgagctgattgagaaatttggggccatactcatacttgttctatgtttggctttccacattagcaagaagaattatttagagtcgtttaaccctcagatccaactgagatttgtcacattgcttcagcattacgattatttgatccatgaatttattaaaccaaactgtttgataactcagtactgttctattcagtctttgcaaatcttatcgttggcattacaatactgcttagtgactggtgatacagccagttgttacgaactcagaggaagggtgatcagtatggctcaacaattgagattgcataggtgtccagctgcagtacttggattgagtggcaataaggagggagacattgatcttcaaaatttcatgcaaggggaaagacgtatcttattctggtgtatctattgtctcgatgtatattcttcactcaatttggggatccccagattgttcaaagattatgaaatagagtgtgcgatgccattttgcggtaaaagtgacgactacgacgacgtgaaccaggaggataatgtcaatatcttgattgttaacaataccaagttatctattgtagggaaagtgtcgaaaatggctctaagtgtgatgctgtacagtaaagtgttggcaaatattttggattctatatattcacgattcgataatactaacattcataagaaagcgttacaaagagataggatgctagattgttggagacgagaattacccctagacttaaaatttgaaatcgatattaatgggttgtctctcaaagattccagtaacaattttatagagggtaacatttggagaaactacaacaagcaacagttgacgttaatatttttgtattaccatgctaaaatattgatatatttgccaatattatcccggtttggaaatcaccataatgttgggttatcacagaaagagcagctcctgaaaggagaaggtgatgtggctactatagtgtcaagcattagtttgattcaacaatcatcgattcagatattagaggttttgaaatatttgacatcaacctcgtcgtcaaacattttacctataccaattcatattgtgcgtgagcagtcattattggcgttaatggtagcaaaaggagccttagattatataaaaggaggtcctttattcagcaatctgaagcaattattactagatacaatgggtaacctttctcgtgatgccaactttgacatccctggggctttgaatagaaaatcattcaaattgtttgagattacaatattaggtatccttggtttgaatataaacaaaagcatgacctcgggggttaatatgaaaagaaagggatcaagtgcactacaacctatcaccaaaactgcggttgaaagatcaccaactgttaatttaactaacaatttcgcagcttcgaaattgaaaacgccaactagcaatacagatatggtaaacaataatcaaatacttaaaatagagcaacaagatccagttttatcgcagcaacaaaaacaaacaaggaatatatctactagggaaatctctaataatggggatattgagttggacaattcgaataattacgccgatgacatagaatcattagaggaattattaaattttgatccatttaaagtcaatgttaaccgtcaaatgttagtgaacgagtttgtcactgatggatctttaggtttagttccatttttggaaatgaacaatgaacaattaaatgacagttctatgttatttgacaagtcgtacaatgctataaacgaacgcaagaccacaaaccatgatgattacatatcacataatgatagtcatttctggaaatga

SEQ ID NO: 12756 - protein, 1056 aa, Candida albicans
MSIKLEQQQSSVSQENNLPPTKKKTKALKSSDGTVNTRTIKVPGSKVERVAQACDRCRAKKTKCDGQNPCSTCQSVGLECIVSDRLTRKSYPKAYTETLEERVRQLEAENKKLAGLLDMRDEQLELLNGSGLTEDTSEMSENKEDDFKKVTASNLSLLDIQNSLHSHSPNENGENCPCGCSNPHAVHERPVSIAGSIYGAVAANERVPISIAGSIKLSDEEDEEDNASLLSIEDYNSRHRDQHFHFASNSTNREQSPAPGAFAAATAIAQMQKNKLFLQQQQQLENENNKQQMLTSLVAMSIPRSTEETLCVPTLLARICQTYGYDSKQAILAANSLASLKENITSNTGTSLDEERKNALNSMIMNRYETTKLSEEEAIVFTKDLINLPASRLDMDQLITVYFQEWGNALPILDKNAFLKNYMKLNYILEQGHYKEYKGESSYESIEKFGAILILVLCLAFHISKKNYLESFNPQIQSRFVTLLQHYDYLIHEFIKPNCLITQYCSIQSLQILSLALQYCLVTGDTASCYELRGRVISMAQQLRLHRCPAAVLGLSGNKEGDIDLQNFMQGERRILFWCIYCLDVYSSLNLGIPRLFKDYEIECAMPFCGKSDDYDDVNQEDNVNILIVNNTKLSIVGKVSKMALSVMSYSKVLANILDSIYSRFDNTNIHKKALQRDRMLDCWRRELPLDLKFEIDINGLSLKDSSNNFIEGNIWRNYNKQQLTLIFLYYHAKILIYLPILSRFGNHHNVGLSQKEQLSKGEGDVATIVSSISLIQQSSIQILEVLKYLTSTSSSNILPIPIHIVREQSLLALMVAKGALDYIKGGPLFSNSKQLLLDTMGNLSRDANFDIPGALNRKSFKLFEITILGILGLNINKSMTSGVNMKRKGSSALQPITKTAVERSPTVNLTNNFAASKLKTPTSNTDMVNNNQILKIEQQDPVLSQQQKQTRNISTREISNNGDIELDNSNNYADDIESLEELLNFDPFKVNVNRQMLVNEFVTDGSLGLVPFLEMNNEQLNDSSMLFDKSYNAINERKTTNHDDYISHNDSHFWK

SEQ ID NO: 12757 - DNA, 26 bp, Artificial sequence
  primer
atggcaaataataattctgatcgaca

SEQ ID NO: 12758 - DNA, 25 bp, Artificial sequence
  primer
ttatttggcgttttgccattggaat

SEQ ID NO: 12759 - protein, 1104 aa, Artificial sequence
  consensus sequence
  Variant (2)..(19): Xaa in position 2 to 19 is any amino acid
  Variant (20)..(86): Xaa in position 20 to 86 is any or no amino acid
  Variant (88)..(88): Xaa in position 88 is any amino acid
  Variant (97)..(97): Xaa in position 97 is any amino acid
  Variant (100)..(101): Xaa in position 100 to 101 is any amino acid
  Variant (105)..(106): Xaa in position 105 to 106 is any amino acid
  Variant (108)..(108): Xaa in position 108 is any amino acid
  Variant (110)..(111): Xaa in position 110 to 111 is any amino acid
  Variant (113)..(114): Xaa in position 113 to 114 is any amino acid
  Variant (117)..(117): Xaa in position 117 is any amino acid
  Variant (120)..(121): Xaa in position 120 to 121 is any amino acid
  Variant (124)..(124): Xaa in position 124 is any amino acid
  Variant (126)..(126): Xaa in position 126 is any amino acid
  Variant (128)..(130): Xaa in position 128 to 130 is any amino acid
  Variant (132)..(133): Xaa in position 132 to 133 is any amino acid
  Variant (137)..(137): Xaa in position 137 is any amino acid
  Variant (144)..(144): Xaa in position 144 is any amino acid
  Variant (147)..(147): Xaa in position 147 is any amino acid
  Variant (150)..(151): Xaa in position 150 to 151 is any amino acid
  Variant (153)..(154): Xaa in position 153 to 154 is any amino acid
  Variant (156)..(208): Xaa in position 156 to 208 is any amino acid
  Variant (209)..(219): Xaa in position 209 to 219 is any or no amino acid
  Variant (221)..(244): Xaa in position 221 to 244 is any amino acid
  Variant (245)..(288): Xaa in position 245 to 288 is any or no amino acid
  Variant (290)..(295): Xaa in position 290 to 295 is any amino acid
  Variant (297)..(299): Xaa in position 297 to 299 is any amino acid
  Variant (301)..(302): Xaa in position 301 to 302 is any amino acid
  Variant (304)..(315): Xaa in position 304 to 315 is any amino acid
  Variant (316)..(332): Xaa in position 316 to 332 is any or no amino acid
  Variant (334)..(335): Xaa in position 334 to 335 is any amino acid
  Variant (338)..(341): Xaa in position 338 to 341 is any amino acid
  Variant (344)..(344): Xaa in position 344 is any amino acid
  Variant (348)..(348): Xaa in position 348 is any amino acid
  Variant (350)..(351): Xaa in position 350 to 351 is any amino acid
  Variant (353)..(353): Xaa in position 353 is any amino acid
  Variant (355)..(357): Xaa in position 355 to 357 is any amino acid
  Variant (359)..(362): Xaa in position 359 to 362 is any amino acid
  Variant (364)..(365): Xaa in position 364 to 365 is any amino acid
  Variant (369)..(375): Xaa in position 369 to 375 is any amino acid
  Variant (377)..(377): Xaa in position 377 is any amino acid
  Variant (381)..(436): Xaa in position 381 to 436 is any amino acid
  Variant (437)..(464): Xaa in position 437 to 464 is any or no amino acid
  Variant (466)..(469): Xaa in position 466 to 469 is any amino acid
  Variant (471)..(472): Xaa in position 471 to 472 is any amino acid
  Variant (474)..(477): Xaa in position 474 to 477 is any amino acid
  Variant (479)..(484): Xaa in position 479 to 484 is any amino acid
  Variant (486)..(518): Xaa in position 486 to 518 is any amino acid
  Variant (519)..(520): Xaa in position 519 to 520 is any or no amino acid
  Variant (522)..(525): Xaa in position 522 to 525 is any amino acid
  Variant (527)..(549): Xaa in position 527 to 549 is any amino acid
  Variant (550)..(557): Xaa in position 550 to 557 is any or no amino acid
  Variant (559)..(561): Xaa in position 559 to 561 is any amino acid
  Variant (563)..(564): Xaa in position 563 to 564 is any amino acid
  Variant (566)..(584): Xaa in position 566 to 584 is any amino acid
  Variant (585)..(585): Xaa in position 585 is any or no amino acid
  Variant (588)..(588): Xaa in position 588 is any amino acid
  Variant (591)..(594): Xaa in position 591 to 594 is any amino acid
  Variant (596)..(596): Xaa in position 596 is any amino acid
  Variant (598)..(599): Xaa in position 598 to 599 is any amino acid
  Variant (602)..(605): Xaa in position 602 to 605 is any amino acid
  Variant (607)..(608): Xaa in position 607 to 608 is any amino acid
  Variant (611)..(613): Xaa in position 611 to 613 is any amino acid
  Variant (616)..(616): Xaa in position 616 is any amino acid
  Variant (626)..(626): Xaa in position 626 is any amino acid
  Variant (630)..(640): Xaa in position 630 to 640 is any amino acid
  Variant (641)..(645): Xaa in position 641 to 645 is any or no amino acid
  Variant (647)..(647): Xaa in position 647 is any amino acid
  Variant (651)..(651): Xaa in position 651 is any amino acid
  Variant (655)..(655): Xaa in position 655 is any amino acid
  Variant (658)..(659): Xaa in position 658 to 659 is any amino acid
  Variant (662)..(664): Xaa in position 662 to 664 is any amino acid
  Variant (666)..(666): Xaa in position 666 is any amino acid
  Variant (669)..(669): Xaa in position 669 is any amino acid
  Variant (673)..(673): Xaa in position 673 is any amino acid
  Variant (676)..(677): Xaa in position 676 to 677 is any amino acid
  Variant (682)..(682): Xaa in position 682 is any amino acid
  Variant (684)..(693): Xaa in position 684 to 693 is any amino acid
  Variant (694)..(713): Xaa in position 694 to 713 is any or no amino acid
  Variant (715)..(715): Xaa in position 715 is any amino acid
  Variant (718)..(720): Xaa in position 718 to 720 is any amino acid
  Variant (722)..(727): Xaa in position 722 to 727 is any amino acid
  Variant (729)..(731): Xaa in position 729 to 731 is any amino acid
  Variant (737)..(739): Xaa in position 737 to 739 is any amino acid
  Variant (741)..(749): Xaa in position 741 to 749 is any amino acid
  Variant (750)..(751): Xaa in position 750 to 751 is any or no amino acid
  Variant (753)..(758): Xaa in position 753 to 758 is any amino acid
  Variant (761)..(761): Xaa in position 761 is any amino acid
  Variant (763)..(765): Xaa in position 763 to 765 is any amino acid
  Variant (767)..(771): Xaa in position 767 to 771 is any amino acid
  Variant (773)..(776): Xaa in position 773 to 776 is any amino acid
  Variant (779)..(782): Xaa in position 779 to 782 is any amino acid
  Variant (784)..(804): Xaa in position 784 to 804 is any amino acid
  Variant (805)..(813): Xaa in position 805 to 813 is any or no amino acid
  Variant (815)..(816): Xaa in position 815 to 816 is any amino acid
  Variant (819)..(820): Xaa in position 819 to 820 is any amino acid
  Variant (822)..(822): Xaa in position 822 is any amino acid
  Variant (825)..(854): Xaa in position 825 to 854 is any amino acid
  Variant (855)..(874): Xaa in position 855 to 874 is any or no amino acid
  Variant (876)..(879): Xaa in position 876 to 879 is any amino acid
  Variant (881)..(886): Xaa in position 881 to 886 is any amino acid
  Variant (888)..(897): Xaa in position 888 to 897 is any amino acid
  Variant (898)..(901): Xaa in position 898 to 901 is any or no amino acid
  Variant (904)..(904): Xaa in position 904 is any amino acid
  Variant (906)..(909): Xaa in position 906 to 909 is any amino acid
  Variant (911)..(916): Xaa in position 911 to 916 is any amino acid
  Variant (918)..(919): Xaa in position 918 to 919 is any amino acid
  Variant (921)..(925): Xaa in position 921 to 925 is any amino acid
  Variant (927)..(927): Xaa in position 927 is any amino acid
  Variant (931)..(931): Xaa in position 931 is any amino acid
  Variant (933)..(936): Xaa in position 933 to 936 is any amino acid
  Variant (938)..(938): Xaa in position 938 is any amino acid
  Variant (941)..(955): Xaa in position 941 to 955 is any amino acid
  Variant (958)..(964): Xaa in position 958 to 964 is any amino acid
  Variant (967)..(974): Xaa in position 967 to 974 is any amino acid
  Variant (976)..(979): Xaa in position 976 to 979 is any amino acid
  Variant (980)..(1088): Xaa in position 980 to 1088 is any or no amino acid
  Variant (1090)..(1103): Xaa in position 1090 to 1103 is any amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXRXAQACDRCRXKKXXCDGXXPXCXXCXXVGXECXXSDXLXRXXXPXXYTEXLEERVRXLEXENXXLXXLXXXXXXXXXXXXXXXXXXXXXXXXXXXXXXXXXXXXXXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXSXXXXXXPXXXAXXAXXXXXXXXXXXXXXXXXXXXXXXXXXXXXLXXLVXXXXPRXTEEXLXXPXLXXXIXXXXGXXSKQXXXXXXXLXSLKXXXXXXXXXXXXXXXXXXXXXXXXXXXXXXXXXXXXXXXXXXXXXXXXXXXXXXXXXXXXXXXXXXXXXXXXXXXXXXXXXXXXLXXXXFXXWXXXXPXXXXXXFXXXXXXXXXXXXXXXXXXXXXXXXXXXXXXXXXXXIXXXXLXXXXXXXXXXXXXXXXXXXXXXXXXXXXXXXLXXXYXXLXXXXXXXXXXXXXXXXXXXXLQXLSXXXXYXLXXGDXXXXYXXRGXXXSMXQQLRLHRCPXAVLXXXXXXXXXXXXXXXXQXERRXLFWXIYXXDVXXXLXLGXPRLXKDXXIECAXPXXXXXXXXXXXXXXXXXXXXXXXXXXXXXXGXVSXXXLXXXXXXKXXXNILDSXXXRXXXXXXXXXXXAXXXXXXLDXWXXXLXXXXXFXXXXNGXXXXDXXXXXXXXXXXXXXXXXXXXXXXXXXXXXXYXXAKXXIXLPXXXXXXXXXXXXXXXXXXXXXXXXXXXXXXXXXXXXXXXXXXXXXXXXXXSXXXXQXXXXXXLXXXXXXXXXXXXXXLPXPXXXXRXXXXXXLXXAXXXXXYXKGGXLXXXXKXLLXXXXXXXXXXXXXXXPGXXXXXXXKLXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXXXXXXXXXXS

SEQ ID NO: 12760 - protein, 39 aa, Artificial sequence
  protein pattern
  Variant (2)..(2): Xaa in position 2 is Gly or Ser
  Variant (6)..(6): Xaa in position 6 is Ile or Leu
  Variant (10)..(10): Xaa in position 10 is Ala, Cys or Ser
  Variant (13)..(13): Xaa in position 13 is any amino acid
  Variant (14)..(14): Xaa in position 14 is Leu or Val
  Variant (17)..(17): Xaa in position 17 is any amino acid
  Variant (18)..(18): Xaa in position 18 is any or no amino acid
  Variant (20)..(20): Xaa in position 20 is any or no amino acid
  Variant (22)..(22): Xaa in position 22 is Asn or Gln
  Variant (25)..(25): Xaa in position 25 is Ile or Val
  Variant (29)..(29): Xaa in position 29 is Phe, Ile or Leu
  Variant (32)..(32): Xaa in position 32 is Phe, His or Tyr
  Variant (33)..(33): Xaa in position 33 is Asp or Glu
  Variant (38)..(38): Xaa in position 38 is Leu or Met
QXERRXLFWXIYXXDVXXSXLXLGXPRLXKDXXIECAXP

SEQ ID NO: 12761 - protein, 40 aa, Artificial sequence
  protein pattern
  Variant (2)..(2): Xaa in position 2 is any or no amino acid
  Variant (4)..(4): Xaa in position 4 is any amino acid
  Variant (5)..(6): Xaa in position 5 to 6 is any or no amino acid
  Variant (9)..(9): Xaa in position 9 is Phe or Leu
  Variant (12)..(12): Xaa in position 12 is any amino acid
  Variant (13)..(13): Xaa in position 13 is Ile or Val
  Variant (16)..(16): Xaa in position 16 is Lys or Arg
  Variant (18)..(18): Xaa in position 18 is any amino acid
  Variant (20)..(20): Xaa in position 20 is Lys or Arg
  Variant (21)..(21): Xaa in position 21 is Ala or Ser
  Variant (22)..(22): Xaa in position 22 is Phe or Tyr
  Variant (24)..(24): Xaa in position 24 is Lys or Arg
  Variant (25)..(25): Xaa in position 25 is Ala or Gly
  Variant (29)..(29): Xaa in position 29 is Ser or Thr
  Variant (36)..(36): Xaa in position 36 is Glu or Gln
  Variant (39)..(39): Xaa in position 39 is Ala or Thr
CXQXXXVGXECXXSDXLXRXXXPXXYTEXLEERVRXLEXE

SEQ ID NO: 12762 - protein, 45 aa, Artificial sequence
  protein pattern
  Variant (3)..(3): Xaa in position 3 is any or no amino acid
  Variant (5)..(5): Xaa in position 5 is any or no amino acid
  Variant (7)..(7): Xaa in position 7 is Phe, Leu or Met
  Variant (8)..(8): Xaa in position 8 is Ala, Ile or Leu
  Variant (9)..(10): Xaa in position 9 to 10 is any amino acid
  Variant (12)..(12): Xaa in position 12 is any amino acid
  Variant (14)..(14): Xaa in position 14 is Asn or Val
  Variant (15)..(15): Xaa in position 15 is Thr or Val
  Variant (18)..(18): Xaa in position 18 is any amino acid
  Variant (19)..(19): Xaa in position 19 is Ala, Pro or Ser
  Variant (20)..(21): Xaa in position 20 to 21 is any amino acid
  Variant (23)..(23): Xaa in position 23 is Glu, Gly or Gln
  Variant (24)..(24): Xaa in position 24 is Leu or Val
  Variant (27)..(27): Xaa in position 27 is any amino acid
  Variant (28)..(29): Xaa in position 28 to 29 is Ile or Val
  Variant (32)..(32): Xaa in position 32 is Ala or Ser
  Variant (42)..(42): Xaa in position 42 is Ala or Ser
LQXLXSXXXXYXLXXGDXXXXYXXRGXXXSMXQQLRLHRCPXAVL

SEQ ID NO: 12763 - protein, 50 aa, Artificial sequence
  protein pattern
  Variant (2)..(2): Xaa in position 2 is Ala or Thr
  Variant (3)..(3): Xaa in position 3 is any amino acid
  Variant (6)..(7): Xaa in position 6 to 7 is any or no amino acid
  Variant (9)..(9): Xaa in position 9 is any amino acid
  Variant (10)..(11): Xaa in position 10 to 11 is any or no amino acid
  Variant (14)..(14): Xaa in position 14 is Ser or Thr
  Variant (18)..(18): Xaa in position 18 is any amino acid
  Variant (20)..(20): Xaa in position 20 is any amino acid
  Variant (21)..(21): Xaa in position 21 is Ile or Val
  Variant (23)..(23): Xaa in position 23 is Gln or Thr
  Variant (25)..(25): Xaa in position 25 is Leu or Met
  Variant (26)..(26): Xaa in position 26 is Ala or Thr
  Variant (27)..(27): Xaa in position 27 is Asn or Arg
  Variant (29)..(31): Xaa in position 29 to 31 is any amino acid
  Variant (32)..(32): Xaa in position 32 is Phe, His or Tyr
  Variant (34)..(34): Xaa in position 34 is Phe or Tyr
  Variant (35)..(35): Xaa in position 35 is Asp, Asn, Ser or Thr
  Variant (39)..(39): Xaa in position 39 is Ala, Cys or Ser
  Variant (40)..(40): Xaa in position 40 is Ile or Leu
  Variant (41)..(41): Xaa in position 41 is any amino acid
  Variant (42)..(42): Xaa in position 42 is Ala or Thr
  Variant (43)..(43): Xaa in position 43 is Ala or Val
  Variant (44)..(44): Xaa in position 44 is Asn or Ser
  Variant (45)..(45): Xaa in position 45 is any amino acid
  Variant (47)..(47): Xaa in position 47 is Ala or Ser
LXXLVXXSXXXPRXTEEXLXXPXLXXXIXXXXGXXSKQXXXXXXXLXSLK

SEQ ID NO: 12764 - protein, 21 aa, Artificial sequence
  protein pattern
  Variant (2)..(2): Xaa in position 2 is Ile or Val
  Variant (11)..(11): Xaa in position 11 is any amino acid
  Variant (14)..(14): Xaa in position 14 is any amino acid
  Variant (15)..(15): Xaa in position 15 is Lys or Arg
  Variant (19)..(20): Xaa in position 19 to 20 is any amino acid
RXAQACDRCRXKKXXCDGXXP

SEQ ID NO: 12765 - protein, 54 aa, Artificial sequence
  protein pattern
  Variant (2)..(7): Xaa in position 2 to 7 is any amino acid
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (13)..(13): Xaa in position 13 is any amino acid
  Variant (14)..(14): Xaa in position 14 is Gly or Ser
  Variant (15)..(15): Xaa in position 15 is Ala or Ser
  Variant (16)..(16): Xaa in position 16 is Leu or Val
  Variant (17)..(17): Xaa in position 17 is Asp or Glu
  Variant (19)..(19): Xaa in position 19 is any amino acid
  Variant (23)..(23): Xaa in position 23 is Ala, Pro or Ser
  Variant (25)..(25): Xaa in position 25 is Phe or Tyr
  Variant (26)..(26): Xaa in position 26 is any amino acid
  Variant (27)..(27): Xaa in position 27 is Asp, Glu or Asn
  Variant (28)..(28): Xaa in position 28 is Asn, Ser or Thr
  Variant (30)..(30): Xaa in position 30 is Ala, Asn or Gln
  Variant (33)..(33): Xaa in position 33 is any amino acid
  Variant (34)..(34): Xaa in position 34 is Asp or Asn
  Variant (35)..(35): Xaa in position 35 is any amino acid
  Variant (36)..(36): Xaa in position 36 is Ile, Met or Val
  Variant (37)..(38): Xaa in position 37 to 38 is any amino acid
  Variant (39)..(39): Xaa in position 39 is Ile or Leu
  Variant (40)..(40): Xaa in position 40 is Glu or Ser
  Variant (41)..(41): Xaa in position 41 is any amino acid
  Variant (42)..(42): Xaa in position 42 is Asp or Glu
  Variant (43)..(44): Xaa in position 43 to 44 is any amino acid
  Variant (45)..(45): Xaa in position 45 is Phe or Leu
  Variant (46)..(46): Xaa in position 46 is Asp or Glu
  Variant (47)..(47): Xaa in position 47 is Ile or Leu
  Variant (50)..(51): Xaa in position 50 to 51 is any amino acid
  Variant (52)..(52): Xaa in position 52 is Asn or Ser
  Variant (53)..(53): Xaa in position 53 is any amino acid
  Variant (54)..(54): Xaa in position 54 is His or Lys
RXXXXXXXLXXAXXXXXYXKGGXLXXXXKXLLXXXXXXXXXXXXXXXPGXXXXX

SEQ ID NO: 12766 - protein, 30 aa, Artificial sequence
  protein pattern
  Variant (2)..(2): Xaa in position 2 is any amino acid
  Variant (5)..(5): Xaa in position 5 is any amino acid
  Variant (6)..(6): Xaa in position 6 is Phe or Met
  Variant (7)..(7): Xaa in position 7 is Ala or Ser
  Variant (9)..(9): Xaa in position 9 is Ala, Gln or Ser
  Variant (10)..(10): Xaa in position 10 is Ile or Val
  Variant (11)..(11): Xaa in position 11 is Ile or Met
  Variant (12)..(12): Xaa in position 12 is Arg or Ser
  Variant (13)..(13): Xaa in position 13 is Phe or Tyr
  Variant (14)..(14): Xaa in position 14 is Ala or Ser
  Variant (16)..(16): Xaa in position 16 is Ile or Val
  Variant (17)..(17): Xaa in position 17 is Leu or Met
  Variant (18)..(18): Xaa in position 18 is Ala or Gly
  Variant (24)..(24): Xaa in position 24 is any amino acid
  Variant (25)..(27): Xaa in position 25 to 27 is any or no amino acid
  Variant (29)..(29): Xaa in position 29 is Asp or Lys
  Variant (30)..(30): Xaa in position 30 is Asn or Arg
GXVSXXXLXXXXXXKXXXNILDSXXXXFXX

SEQ ID NO: 12767 - protein, 35 aa, Artificial sequence
  protein pattern
  Variant (2)..(2): Xaa in position 2 is Phe or Leu
  Variant (3)..(3): Xaa in position 3 is any amino acid
  Variant (4)..(4): Xaa in position 4 is His or Arg
  Variant (5)..(5): Xaa in position 5 is Asp or Glu
  Variant (6)..(7): Xaa in position 6 to 7 is any amino acid
  Variant (10)..(10): Xaa in position 10 is any amino acid
  Variant (12)..(13): Xaa in position 12 to 13 is any or no amino acid
  Variant (15)..(16): Xaa in position 15 to 16 is any or no amino acid
  Variant (18)..(18): Xaa in position 18 is Pro or Gln
  Variant (19)..(22): Xaa in position 19 to 22 is any amino acid
  Variant (24)..(24): Xaa in position 24 is Glu, Gln or Arg
  Variant (25)..(25): Xaa in position 25 is Ile or Leu
  Variant (26)..(26): Xaa in position 26 is Asp, Glu or Thr
  Variant (27)..(27): Xaa in position 27 is Ala, Ile or Val
  Variant (30)..(33): Xaa in position 30 to 33 is any amino acid
  Variant (35)..(35): Xaa in position 35 is Glu or Ser
AXXXXXXLDXWXXRXXLXXXXXFXXXXNGXXXXDX

SEQ ID NO: 12768 - protein, 14 aa, Artificial sequence
  protein pattern
  Variant (2)..(2): Xaa in position 2 is Phe or Tyr
  Variant (3)..(3): Xaa in position 3 is any amino acid
  Variant (6)..(6): Xaa in position 6 is any amino acid
  Variant (7)..(7): Xaa in position 7 is Leu or Met
  Variant (9)..(9): Xaa in position 9 is His or Tyr
  Variant (12)..(12): Xaa in position 12 is Ile or Val
  Variant (13)..(13): Xaa in position 13 is Ile, Leu or Val
  Variant (14)..(14): Xaa in position 14 is Ala or Ser
YXXAKXXIXLPXXX

SEQ ID NO: 12769 - protein, 28 aa, Artificial sequence
  protein pattern
  Variant (2)..(8): Xaa in position 2 to 8 is any amino acid
  Variant (10)..(10): Xaa in position 10 is any amino acid
  Variant (11)..(11): Xaa in position 11 is Glu or Asn
  Variant (12)..(12): Xaa in position 12 is any amino acid
  Variant (13)..(13): Xaa in position 13 is Ile, Leu or Val
  Variant (15)..(15): Xaa in position 15 is Ile or Leu
  Variant (16)..(16): Xaa in position 16 is Phe or Leu
  Variant (17)..(17): Xaa in position 17 is Asp, Asn or Ser
  Variant (18)..(20): Xaa in position 18 to 20 is any amino acid
  Variant (22)..(27): Xaa in position 22 to 27 is any amino acid
  Variant (28)..(28): Xaa in position 28 is Phe or Leu
LXXXXXXXWXXXXPXXXXXXFXXXXXXX

SEQ ID NO: 12770 - protein, 13 aa, Artificial sequence
  protein pattern
  Variant (3)..(3): Xaa in position 3 is Asp, Asn or Ser
  Variant (4)..(4): Xaa in position 4 is any amino acid
  Variant (8)..(8): Xaa in position 8 is Ala or Leu
  Variant (9)..(9): Xaa in position 9 is any amino acid
  Variant (11)..(11): Xaa in position 11 is any amino acid
  Variant (12)..(12): Xaa in position 12 is any or no amino acid
EQXXAPGXXAXXA

SEQ ID NO: 12771 - protein, 41 aa, Artificial sequence
  protein pattern
  Variant (2)..(2): Xaa in position 2 is any amino acid
  Variant (4)..(4): Xaa in position 4 is Phe or Leu
  Variant (6)..(6): Xaa in position 6 is Ile, Leu or Met
  Variant (7)..(7): Xaa in position 7 is Ala, Gln or Ser
  Variant (8)..(9): Xaa in position 8 to 9 is any amino acid
  Variant (11)..(13): Xaa in position 11 to 13 is any amino acid
  Variant (14)..(14): Xaa in position 14 is any or no amino acid
  Variant (16)..(19): Xaa in position 16 to 19 is any amino acid
  Variant (20)..(20): Xaa in position 20 is any or no amino acid
  Variant (22)..(23): Xaa in position 22 to 23 is any amino acid
  Variant (24)..(24): Xaa in position 24 is Asp, Glu or Pro
  Variant (25)..(27): Xaa in position 25 to 27 is any amino acid
  Variant (28)..(28): Xaa in position 28 is Glu, Gln or Ser
  Variant (29)..(31): Xaa in position 29 to 31 is any amino acid
  Variant (32)..(32): Xaa in position 32 is Ala or Asn
  Variant (33)..(33): Xaa in position 33 is any amino acid
  Variant (34)..(34): Xaa in position 34 is His or Tyr
  Variant (35)..(35): Xaa in position 35 is Glu or Asn
  Variant (36)..(36): Xaa in position 36 is Lys or Arg
  Variant (37)..(37): Xaa in position 37 is any amino acid
  Variant (38)..(38): Xaa in position 38 is Met or Val
  Variant (39)..(39): Xaa in position 39 is Gly or Ser
  Variant (40)..(40): Xaa in position 40 is any amino acid
  Variant (41)..(41): Xaa in position 41 is Ala or Pro
LXLXDXXXXLXXXXPXXXXXEXXXXXXXXXXXXXXXXXXXX

SEQ ID NO: 12772 - protein, 10 aa, Artificial sequence
  protein pattern
  Variant (2)..(2): Xaa in position 2 is Ala or Gly
  Variant (7)..(7): Xaa in position 7 is Ala or Val
  Variant (9)..(9): Xaa in position 9 is any or no amino acid
DXSLGLXPXL

SEQ ID NO: 12773 - DNA, 3135 bp, Saccharomyces cerevisiae
  CDS (1)..(3135)
atgtcagattcacaacaatcaatcaccgttctagaagagcttttccgaaagttggaaactgctacttcagaaacaagagagggtatttcttcggagctttcctcatttttaaacgggaacatcatcgagcatgacgttcccgaagttttttttgatgaatttcaaaaagctatccagagtaaacaaaaggcgctcaacacgctgggtgcggtggcttacatagcaaatgaaactaatctatcaccttctgttgaaccgtacatagttgcgacggtcccttctgtatgcagtaaagctggtagtaaagataatgatgttcaacttgcggcaacaaaggccctcaaagccatcgctagtgctgttaacccggttgccgttaaagcactcttacctcatttgattcattcgctggaaactagcaacaagtggaaagagaaggttgctgttctcgaagtaatctctgtattggtagatgccgctaaagaacagattgccttaagaatgccggaactaattcccgttctttcggaatccatgtgggacactaagaaaggagttaaggaggcggcaacgacaaccatcacaaaggcaactgaaactgttgataataaggatattgagagatttattccaaaattaatcgaatgtattgcaaatccaaatgaggtgcctgaaaccgttcatctcttgggtgcaactacttttgtagccgaagtaactccagcgactttgtctattatggttcctttattgagcagaggtttagccgagagagaaacctctataaaacgtaaagctgcggttattatcgataatatgtgtaaattggttgaagacccgcaagttgttgctccattcttaggtaaactactaccagggctaaagaacaattttgctactattgctgatcctgaagcgcgtgaagttacattaaaagctttaaaaaccctgagacgtgtgggtaatgtcggggaagatgatgtgttaccagaaatatcgcatgctggtgatgtttccacaacactgggcgtcatcaaggaattactggaacctgaaaaagtggccccaaggttcaccattgtggttgagtacatagccgcgattgccgcaaatctaattgatgaaaggatcattgatcagcaaacgtggtttacacatgttacaccttatatgactatatttttacatgagaaaactgcaaaggaaatactagacgatttcaggaaaagggcagtagataatattccagttggaccgaatttccaagacgaagaggatgagggtgaagatttgtgtaattgtgaattttccttggcatatggtgccaaaatattactaaacaagactcaattgaggttgaagcgaggtaggagatatggtctatgtggtcctaatggtgccggaaaatccactctaatgcgatccattgctaatggccaagttgacgggttccccactcaggatgaatgtcgcactgtttatgtggaacacgatatcgataatacacattcggacatgtccgttttagattttgtatattccggcaatgtaggaactaaggatgttattacctcgaaattaaaggagtttgggttcagcgatgaaatgatagaaatgccaattgcatccctatctggaggttggaaaatgaaattagctttggcgagggctgttctgaaggacgctgacattctactattggatgaaccaacaaatcatctagacactgttaatgtggagtggctggtaaattatttgaatacttgcggaattacatcggtgattgtctctcatgattctggttttctggataaggtttgtcaatacatcatacattatgagggtcttaaattaagaaagtacaagggtaatttatcagaatttgttcaaaaatgtcctacggcacaatcatactatgaattaggtgcctctgaccttgaatttcaattcccaactcctggttatctagaaggtgtcaaaacgaagcaaaaggcaattgttaaagtaagtaatatgacttttcaatatccagggacaactaaaccacaagtctcagatgttactttccagtgttctctatcctcaaggattgcagttatcggacctaatggggctggtaagtccactttaattaatgttcttactggtgaactgttaccaaccagcggtgaagtatatacacacgagaattgtcgtatagcgtatattaagcagcacgcttttgcacacattgaatcgcacttagacaaaactccatccgaatacattcaatggaggttccaaactggtgaggatagggaaacaatggatagagcaaataggcaaataaatgaaaatgacgcagaggccatgaataaaatatttaaaattgaagggaccccaagaagggttgcaggaatccattcaagaaggaaatttaaaaacacgtatgagtacgaatgttcgtttttgttaggtgagaacattggtatgaaatctgaaagatgggttccaatgatgtctgtcgacaatgcttggctaccaaggggcgaattgattgaatcccattctaaaatggttgctgaaattgatatgaaggaagctttggcttctggtcaattcagggctttaacaagaaaagagattgaattacattgcgccatgttggggttggattcagaattagtctcacattcaagaattagaggtttatcgggtgggcaaaaggttaaattggtactcgctgcctgcacgtggcaaagaccccatttgattgttttagatgaacctacgaattacttggacagagattcattgggtgctctttcaaaagcattaaaagcttttgaaggtggtgtcattattattacgcattcggcagaatttactaagaatctgactgacgaagtttgggcggttaaggatgggaaaatgacaccctctggccataattgggttgcaggacaaggtgctggcccaagaattgagaaaaaagaagaagagggtgataaatttgatgctatgggtaacaagattaatagtgggaagaaaaaaagcaaactctcttctgcagaattgagaaagaaaaagaaggagagaatgaagaagaaaaaagagatgggtgatgaatacgtttcttctgatgaagatttttaa

SEQ ID NO: 12774 - protein, 1044 aa, Saccharomyces cerevisiae
MSDSQQSITVLEELFRKLETATSETREGISSELSSFLNGNIIEHDVPEVFFDEFQKAIQSKQKALNTLGAVAYIANETNLSPSVEPYIVATVPSVCSKAGSKDNDVQLAATKALKAIASAVNPVAVKALLPHLIHSLETSNKWKEKVAVLEVISVLVDAAKEQIALRMPELIPVLSESMWDTKKGVKEAATTTITKATETVDNKDIERFIPKLIECIANPNEVPETVHLLGATTFVAEVTPATLSIMVPLLSRGLAERETSIKRKAAVIIDNMCKLVEDPQVVAPFLGKLLPGLKNNFATIADPEAREVTLKALKTLRRVGNVGEDDVLPEISHAGDVSTTLGVIKELLEPEKVAPRFTIVVEYIAAIAANLIDERIIDQQTWFTHVTPYMTIFLHEKTAKEILDDFRKRAVDNIPVGPNFQDEEDEGEDLCNCEFSLAYGAKILLNKTQLRLKRGRRYGLCGPNGAGKSTLMRSIANGQVDGFPTQDECRTVYVEHDIDNTHSDMSVLDFVYSGNVGTKDVITSKLKEFGFSDEMIEMPIASLSGGWKMKLALARAVLKDADILLLDEPTNHLDTVNVEWLVNYLNTCGITSVIVSHDSGFLDKVCQYIIHYEGLKLRKYKGNLSEFVQKCPTAQSYYELGASDLEFQFPTPGYLEGVKTKQKAIVKVSNMTFQYPGTTKPQVSDVTFQCSLSSRIAVIGPNGAGKSTLINVLTGELLPTSGEVYTHENCRIAYIKQHAFAHIESHLDKTPSEYIQWRFQTGEDRETMDRANRQINENDAEAMNKIFKIEGTPRRVAGIHSRRKFKNTYEYECSFLLGENIGMKSERWVPMMSVDNAWLPRGELIESHSKMVAEIDMKEALASGQFRALTRKEIELHCAMLGLDSELVSHSRIRGLSGGQKVKLVLAACTWQRPHLIVLDEPTNYLDRDSLGALSKALKAFEGGVIIITHSAEFTKNLTDEVWAVKDGKMTPSGHNWVAGQGAGPRIEKKEEEGDKFDAMGNKINSGKKKSKLSSAELRKKKKERMKKKKEMGDEYVSSDEDF

SEQ ID NO: 12775 - DNA, 3623 bp, Oryza sativa
  CDS (225)..(3422)
atcatcatccctttcctccccctccgcccccctttggcgatcaccatccttttcacagagctatcgctagcactgtacacatcaccttgctcaaagagcgatccacacgctctttcatcttttcttctgtgaagaaagcaaaaaaagtcgttcaccgactcgattccctaatcccggtctccgtaactctcttcacatcacagaaaaaaaaaacgctagacatcatggctcccgcacctaccgctgctggtgtccccgccactgtccccgccaagaccgtcaagggctcggctggcgctgctgccaagagcggcgccgccgccgagaagaaggaggccagcgccgagaccgacgccctcctctccggcgacaaggatgccgcccaggagctcaccaacctcgtcaagatcgagggtcccgctgctctggccaacctcggcatcgaggccgtcatcctcaagggcctcggcgacaagaagaacgccgccggccgcgagggcgcctgcgctctcctctccaacctctgcgagcagggtgtcggccacgaggtcgagcctttcctcttcgagaaggtcctcacccccctcgtcgaggccatgggtgacaaggagaaggccgtccagaaggctgccctcgacgccctcaaggctttcgtccaggtcatgtcgccctgggccaccccccagctgctcaaggtcatcctcgagcaggcccgctccgccggcaagtggcaggtcaagatcggctgcatcaccctcctcgaggagcttgtgaccgtcagctccgagcgcatggccgccctcatgcccgagatcatccccgtcatgaccgaggtcatctgggacaccaagtccgacgtccagaaggcttcgcgcgccgccctcaccaagctctgcgtgctcatctccaacaaggacattgagcgcttcatccccgccctcatcaactcgctcatccaccccgtcgaggaggtgcccaagaccatccagctcctctcggccaccaccttcgtccaggaggtcgacagcgccaccctcgccctcatggtgcccctgctctcgcgtggtctcaacgagcgccccaccgccaccaagcgtaaggtcgccgtcatcatcgacaacatgaccaagctcgtcgacaacgagcgcaccgtccgccccttcctcggcaagctcctccccggcttgatcaagatcgagtccaccctcgccgaccccgaggcccgtggtgtcgtccagcgcgccatcaagacgctccgcgaagtcggcaacgtcaccggcgacggctccgacgtcaagcccctcgaggacgtcagcatcaaggcctcgctcgagcaggtcaacaaggcgcttggcgagcagagcctccaggcccaggccaacctcggcgcctacgttgccaccctcgttgccaacctcgccaacgcccgcaacttcgagctcaccgagtgggagggtgccctcatcccctacatcaccctcatcaagggctccaagcccgagcaggccaaggccgtcagcaaggcgcttctcactgctctcgccaaggagaccggtgactcggtcgagatcttcgacgacgaggaggagggtgaggacctctgcaactgccagttctcgctcgcctatggtgccaagattctccttaacaccgccaccctgcgtctgaagcgcggccacaagtacggtctctgcggccgtaacggttcgggcaagtcgacgctcatgcgcgccatcaccaacggccaggtcgagggcttcccatcgcccgaggaggtccgcacctggtacgtcgagcacgacctcgacggctccgagggtctcaccaccgtcctcgagttcattctcgccgacaagcgcctcagcatgacccgcgaggaggccgtctccaccctccacgaggtcggcttcgacgacgctcgtcagaactcgcccatcgccggtctctctggtggctggaagatgaaggtcgcccttgcccgcgccatcctcttcaaggctgacatcctgctgctcgacgagcccacgaaccacttggacgtcgtcaacgtcgagtggatcaccgactacctcatcggcaccccggccaccgccatcatcgtctcgcacgactccaagttccttaacgacgtctgcaccgacatcctccacctcaaccgcttcaaggtgaagcgatacccgggtaacctcgacgcctttgtcaagcgcgtccccgaggccagggcctacgccgagctcaacaccggcgaggactactcgttcaagctgcccgaccctcctctgctggacggtgtcaagaccaaggagaagtcgctcaccaagatgaaggacgtcaccttccagtaccccggcacgcccgctccccagctcaagggtgtcagcatccagatctcgctcgcctcgcgtgtcgccatcctcggccccaacggttcgggcaagtcgacgctcgtcaagctcgtcgtcggcgacaccgagcccggctccggtgagatgtggaagcaccccaacctggtcatcggctacgtcgcccagcacgccttccaccacatcgaccagcacctcgacaagacccccctcgactacatgctctggcgttaccagaccggcgaggatctcgaggagcacatgaaggccaaccgtgagctctccgaggaggagaagctcgccatgaagcagggcgaggtctacgtcgtcgagggcgtcaagcgcctcatcgaggatatcgtggctcgtaagaagctgaagaactcgttccagtacgaggtctcgttcaagaacatgtcgtcggccgacaacgtttggatcccccgtgacgagctcatcaagcgtggcttcgagaagaaggtcatggcgttcgactcgaaggaggcgcagcgtctcggtatgaaccgaccccttgtgcgcaaggagatcgagcagcacttcgaggacttcggtctggagcgcgagttcacctcgcacaacaccatgcgcggtctctcgggtggtcagaaggttaaggtcgtgcttggtgccgccacgtggcgcaagccccacatcatcgtgctcgacgagcccaccaacttcttggaccgtgagtcgctcgccgcgctcatcaaggccatcgagagcttccagggcggtgttgcgatcatcacgcactcgcgcgagttctccgagggtacctgcaaggagatctgggccatgaacgacggtgtcctcgtcgcttccggccacgactggaccgagtccaactccaagggtaccaagatcgagacccaggaggacgacgaggacaagttcgacgctcttggcaacaagctcgagaaggtcaagaaggtcaagaaggaatcggcgtcagacaagcgaaaagcgcgtaaggaccgtcttgccaagaagaaggccggcacttacgacagcgccgacgagctggaggacctttgaacgagatgatggtagcatggcgatgatggtggaggcgtgagtacttttttttttgacaggtgtcgaaaaaaatgaattcccgctccactttttctcccgcacgcgtctctctgcgcttttccccctctccgcatattttcaattttcccctcttcttttttttcttttgtttttccgtcaattgaatcccgtccatctttt

SEQ ID NO: 12776 - protein, 1065 aa, Oryza sativa
MAPAPTAAGVPATVPAKTVKGSAGAAAKSGAAAEKKEASAETDALLSGDKDAAQELTNLVKIEGPAALANLGIEAVILKGLGDKKNAAGREGACALLSNLCEQGVGHEVEPFLFEKVLTPLVEAMGDKEKAVQKAALDALKAFVQVMSPWATPQLLKVILEQARSAGKWQVKIGCITLLEELVTVSSERMAALMPEIIPVMTEVIWDTKSDVQKASRAALTKLCVLISNKDIERFIPALINSLIHPVEEVPKTIQLLSATTFVQEVDSATLALMVPLLSRGLNERPTATKRKVAVIIDNMTKLVDNERTVRPFLGKLLPGLIKIESTLADPEARGVVQRAIKTLREVGNVTGDGSDVKPLEDVSIKASLEQVNKALGEQSLQAQANLGAYVATLVANLANARNFELTEWEGALIPYITLIKGSKPEQAKAVSKALLTALAKETGDSVEIFDDEEEGEDLCNCQFSLAYGAKILLNTATLRLKRGHKYGLCGRNGSGKSTLMRAITNGQVEGFPSPEEVRTWYVEHDLDGSEGLTTVLEFILADKRLSMTREEAVSTLHEVGFDDARQNSPIAGLSGGWKMKVALARAILFKADILLLDEPTNHLDVVNVEWITDYLIGTPATAIIVSHDSKFLNDVCTDILHLNRFKVKRYPGNLDAFVKRVPEARAYAELNTGEDYSFKLPDPPLLDGVKTKEKSLTKMKDVTFQYPGTPAPQLKGVSIQISLASRVAILGPNGSGKSTLVKLVVGDTEPGSGEMWKHPNLVIGYVAQHAFHHIDQHLDKTPLDYMLWRYQTGEDLEEHMKANRELSEEEKLAMKQGEVYVVEGVKRLIEDIVARKKLKNSFQYEVSFKNMSSADNVWIPRDELIKRGFEKKVMAFDSKEAQRLGMNRPLVRKEIEQHFEDFGLEREFTSHNTMRGLSGGQKVKVVLGAATWRKPHIIVLDEPTNFLDRESLAALIKAIESFQGGVAIITHSREFSEGTCKEIWAMNDGVLVASGHDWTESNSKGTKIETQEDDEDKFDALGNKLEKVKKVKKESASDKRKARKDRLAKKKAGTYDSADELEDL

SEQ ID NO: 12777 - DNA, 3624 bp, Oryza sativa
  CDS (253)..(3546)
atcccggcctgtgtgtcttcaagcagcgtcgatacaccaccaccaccaccactctacccccttagacggcttgctgcctccctttcgcggccctagcttccgtttcgtctttacgctcgtcttgcctcgccgatccaccaccactcttctttctgctcgatcaccaggcaacgcgcattctcacaaggcaaaacttcacttctgaacgatacccgccttccaaacactttccctcacacaaaaccatacatcatgtctggcgcatctcaggcccttgaaggcctctacaaggccccctccgccgaggagtgctacgtcgctgccgagcagctcgccgaatacgtcaacagcaccagcctccccgtgcttcagtccgaaggcgtcctcgacagcctcgtcaaggcttccaagaacaagaagagcggctacgagcgcgaggccgccgccatcggcctcgacgccatctttgtcaaggtcgccggcaagaacgctcccagcccgctcggcgcagagccatggctcctcgacaccctccccgccatcctcgagctctacgcagacaagggtgacgtcgtccgccaggctgcagagaccgccgccagctcgctcctcgccctcgtgccccccgaggccgcacccgagttcctcaccgtcctctacgaggtcctcggctccggcagcgcaaagtggcaggccaaggtcggcgccctcaagctcatcggccgtctcagcgccaccgccagcgagcagatcggagacgagctcgtcgaactcatcccctacctcaccagggccatgcacgagaccaaggcagagatctccaagcaggcccgcaagaccgccatcaaggtctgcgaggcgtgcctcgacaacaaggacatccgtcccttcatccccgacctcgtcggctgcatggcccagcccgacgccgtgcccgagtgcatcaagaagctctcgggcaccacctttgtcgccgaagtcaccggccccgcgctcgccgtcatggtgcctctgctcgcccgtgcgctcaacgagcgtagccagaacgtagagcgccaggccgtcgtcgtcgtcgacaacctctgcaagctcgtgcgcgacccgcacgaggccgccaaattcctccccgaactcactcccggtgtcgagcgaatcgagaagggcgccagcttccccgaggtccgcgagcacgccaagagcgccctcgacacccttactgccgccaccgccgccgtcgacgctagcgctgccaccgaggaccccaagaaggtctttgctcagcagtgcgcagccgccctcgacgccatcctcgccgctgttcaggcttacgtccccgaggagcacgccaacctcaagagcgatgccttcgccatgaccggtctcaactacctctccaagtccatcgctcgcctcgccaacaagcgcatccttcacaccagcgcttgggaggaggtgtacgtgctgccctacctgcgtcgcgtctgcagggacgacgacgccgccaagaccgccactgccgacctgcgcaagacctacatcgagctcgacaaggcgcgcttcggcaactccgaagaggaggacgacgacgaggcgggcgagtgcctctgccgcaccgagttctcgctcgcctacggtggtctgctgctcctcaaccacaccaccctcaagctctaccgcggccaccgctacggcatcgtcgccgccaacggaagcggcaaatctacgctgctcaaggccatgcgcgacggcaaggtcgagggctacccgtcccaggacgaggtgcgcaccctcatggtggagcacagcctgcagggcgaggacggctcgacgcccatcatcgactttatcgccaacgacaagaagctcgtgggcaagacgcgcgagcaggtggccgagaagctgcgcgaggtcggcttcgacgacgagaagcagaagaaccccgtctcctcgctctccggtggttggaagatgaagctcgagctggcgcgtgccatgctttccgatgccgtcgtctacctgctcgacgagccgaccaaccatctggacgtgcagtcgatcgcatggctcgagaacttcctcgtgaccaacaagcagatcaccgtggtcaccgtgtcgcacgactcgggcttcctcgacaacatctgcaccgacatcatccactacgagaagaagaagctgcgctactacaagggcaacctctccgactttgtggccaccaagcccgaggccaaggcgtactactcgctcgccgccaccaccgtcaagttctccttcccgccccccggctcgctcatgggcgtgcgctccaacacgcgcaccatcctcaagatgtccaactgcaccttcacctacccgggcatgaccaagccttcgctgcacgacacgtcgtgtgccatcagcctgtcgagtcgcgtgggtgtgctcggccccaacggtgccggtaagagtacgctgatcaaggtgctcaccggcgagacggtgccgcagcagggcaaggtggagaagcacccgaacctgcgtatcgccatgatggcccagcacgccttccgccatctggagcagcatctggagaagtcggcggtggagtacatcgcatggcgttaccaggacggccacgaccgcgagatgaccgaaaaggcgtcgcgaaagatgaccgacgaggagaaggcgcagatggagacgccgatcaagtcgaccacgggcgagtcgcgcaaggtcgagtacatcgtgggtcgtcagaagctcaagaagtcgtaccagtacgagatcaagtgggtcggctacgagcacaggaacaactcgtggatcccgcgcgagcgcctgctcgagttgggcttcagcaagctcgtgcagcagtttgacgactttgaggcgtcgcgcgagggtgccggttcgcgcgagatcagcgtcaagctcatccgccagcatctcgaggcggtgggtctgcagggcgagattgcgcagcaccatgccgtcggcggctactcgggcggacagaaggtcaaggtggtgctggccgccgccatgtggaacaatccgcaggtgcttgtgctcgacgagccgaccaactacctcgaccgcgatgcgctcggtggactggcgaccgccatccgcgactgggcgggtgccgtggtgatcatctcgcacaacatggagtttgtcggtgccctctgccccgagatctggaacgtggacaacggccgcatcatgtcgcgcaccaagactgcgcttgccgagggagccttcctggacgagatggagaatgcgtcgactcctggcgcctcggtgcccggtacgccgctgcctggaagcacggcggcgtcgcgactgacgtccaaggccggtacgcccgtttcgtccgtggctcctacgccggcaggctcgggcgacgagggcgagcaggatatgtccaagttcaaggccaagaagggcaagaagaagctcacgcgcaacgagaagaaggcgcaggaggagaggaggcgtctgcgtctcagccgctggctcacctacggcggtgagcgagaaccagacaccgacgacgagtagaaccgtcgccgaccacctgcactcggtttctttatttttgcgcatagtcatatagaatagaacagttgtccatttgtc

SEQ ID NO: 12778 - protein, 1097 aa, Oryza sativa
MSGASQALEGLYKAPSAEECYVAAEQLAEYVNSTSLPVLQSEGVLDSLVKASKNKKSGYEREAAAIGLDAIFVKVAGKNAPSPLGAEPWLLDTLPAILELYADKGDVVRQAAETAASSLLALVPPEAAPEFLTVLYEVLGSGSAKWQAKVGALKLIGRLSATASEQIGDELVELIPYLTRAMHETKAEISKQARKTAIKVCEACLDNKDIRPFIPDLVGCMAQPDAVPECIKKLSGTTFVAEVTGPALAVMVPLLARALNERSQNVERQAVVVVDNLCKLVRDPHEAAKFLPELTPGVERIEKGASFPEVREHAKSALDTLTAATAAVDASAATEDPKKVFAQQCAAALDAILAAVQAYVPEEHANLKSDAFAMTGLNYLSKSIARLANKRILHTSAWEEVYVLPYLRRVCRDDDAAKTATADLRKTYIELDKARFGNSEEEDDDEAGECLCRTEFSLAYGGLLLLNHTTLKLYRGHRYGIVAANGSGKSTLLKAMRDGKVEGYPSQDEVRTLMVEHSLQGEDGSTPIIDFIANDKKLVGKTREQVAEKLREVGFDDEKQKNPVSSLSGGWKMKLELARAMLSDAVVYLLDEPTNHLDVQSIAWLENFLVTNKQITVVTVSHDSGFLDNICTDIIHYEKKKLRYYKGNLSDFVATKPEAKAYYSLAATTVKFSFPPPGSLMGVRSNTRTILKMSNCTFTYPGMTKPSLHDTSCAISLSSRVGVLGPNGAGKSTLIKVLTGETVPQQGKVEKHPNLRIAMMAQHAFRHLEQHLEKSAVEYIAWRYQDGHDREMTEKASRKMTDEEKAQMETPIKSTTGESRKVEYIVGRQKLKKSYQYEIKWVGYEHRNNSWIPRERLLELGFSKLVQQFDDFEASREGAGSREISVKLIRQHLEAVGLQGEIAQHHAVGGYSGGQKVKVVLAAAMWNNPQVLVLDEPTNYLDRDALGGLATAIRDWAGAVVIISHNMEFVGALCPEIWNVDNGRIMSRTKTALAEGAFLDEMENASTPGASVPGTPLPGSTAASRLTSKAGTPVSSVAPTPAGSGDEGEQDMSKFKAKKGKKKLTRNEKKAQEERRRLRLSRWLTYGGEREPDTDDE

SEQ ID NO: 12779 - DNA, 3135 bp, Saccharomyces cerevisiae
  CDS (1)..(3135)
atgtctgattcccagcaatccattaaggttctagaagaactattccagaagttatctgttgccactgctgacaacagacacgaaatcgcttctgaagtcgcttctttcttgaatggtaacatcattgaacatgatgttccagaacacttcttcggtgaattggccaagggtatcaaggacaagaagaccgctgctaacgccatgcaagctgttgctcacattgctaaccaatctaacttgtctccatctgttgaaccatacatcgtccaattggttccagctatctgtaccaacgcaggtaacaaggacaaagaaattcaatctgttgcttccgaaactttgatttccatcgttaacgctgttaacccagttgccatcaaagctttgttgccacatttgactaacgctattgtcgaaactaacaaatggcaagaaaagattgctattttggcagctatctctgctatggtcgatgctgctaaggatcaagttgccctaagaatgccagaattgattccagtcttgtctgaaaccatgtgggacaccaagaaggaagtcaaggctgctgctactgccgccatgaccaaggctaccgaaactgttgacaacaaggatattgaacgtttcattccaagtttgattcaatgtattgctgacccaactgaagttccagaaaccgttcatttgttaggtgctactactttcgttgctgaagttactccagctactttgtccatcatggtcccattgttgtccagaggtttgaacgaaagagaaaccggtatcaagcgtaagtctgctgttattattgacaacatgtgtaagttggtcgaagacccacaagttattgctcctttcttgggtaaattgttgccaggtttgaagagtaactttgctaccattgctgacccagaagccagagaagttactttgagagctttgaagactttgagaagagttggtaacgttggtgaagacgatgctattccagaagtttctcacgctggtgacgtttctactactttgcaagtcgttaacgaattgttgaaggacgaaaccgttgctccaagatttaagattgtcgtcgagtacattgccgccattggtgctgatttgatcgatgaaagaatcattgaccaacaagcttggttcacccacatcaccccatacatgactatcttcttgcacgaaaagaaggccaaggacatcttggacgaattcagaaagagagctgtcgacaacattccagttggtccaaacttcgacgacgaagaagacgaaggtgaagacttatgtaactgtgaattctctttggcttatggtgctaaaatcttgttgaacaagacccaattaagattgaagagagccagaagatatggtatctgtggtccaaacggttgtggtaagtccactttaatgagagctattgccaacggtcaagttgatggtttcccaacccaagaagaatgtagaaccgtctacgtcgaacacgacattgatggtactcactctgacacttccgtcttggatttcgttttcgaatctggtgttggtactaaagaagctatcaaggacaaattgattgaattcggtttcaccgatgaaatgattgctatgccaatctctgctttgtctggtggttggaagatgaagttggctctagctagagctgtgttgagaaatgctgatatcttgttgttagatgaaccaactaaccatttggataccgtcaacgttgcttggttagttaactacttgaacacctgtggtatcacttctatcactatttctcacgactccgttttcttagataacgtctgtgaatatattattaactacgaaggtttgaagttgagaaagtacaagggtaactttaccgaattcgttaagaagtgtccagctgctaaggcttacgaagaattatccaacactgatttggaattcaagttcccagaaccaggttacttggaaggtgttaagactaagcaaaaggctattgtcaaggttaccaacatggaattccaatatccaggtacctctaagccacaaatcactgacattaacttccaatgttctttgtcttccagaattgctgtcattggtccaaatggtgctggtaagtctactttgattaacgtcttgactggtgaactattaccaacctctggtgaagtctacacccacgaaaattgtcgtatcgcttacattaagcaacacgcttttgctcatatcgaatctcatttggacaagactccatctgaatatatccaatggagattccaaaccggtgaagatagagaaaccatggacagagctaacagacaaatcaacgaaaacgatgctgaagctatgaacaagatcttcaagattgaaggtacccctagaagaattgccggtatccactccagaagaaagttcaagaacacttacgaatatgaatgttctttcttattgggtgaaaacattggtatgaaatctgaaagatgggttccaatgatgtccgtcgacaacgcttggattccaagaggtgaattggttgaatctcactctaagatggttgctgaagttgatatgaaggaagctttggcttctggtcaattccgtccattaaccagaaaagaaattgaagaacattgttccatgttgggtttggacccagaaattgtttctcactccagaattagaggtttgtctggtggtcaaaaggttaagttggtcttagctgccggtacatggcaaagacctcacttgattgtcttagatgaacctaccaactatctggacagagattctttgggtgctttgtctaaggctttgaaggaatttgaaggtggtgttattatcattactcactctgctgaattcacaaagaacttgactgaagaagtctgggccgtcaaggacggtagaatgactccatctggtcacaactgggttagtggtcaaggtgctggtccaagaatcgaaaagaaggaagacgaagaagataaattcgatgctatgggtaacaagattgccggtggtaagaagaagaagaagttgtcttctgcggaattgagaaagaagaagaaggaaagaatgaagaagaagaaggaattgggtgatgcttacgtttcttctgacgaagaattctaa

SEQ ID NO: 12780 - protein, 1044 aa, Saccharomyces cerevisiae
MSDSQQSIKVLEELFQKLSVATADNRHEIASEVASFLNGNIIEHDVPEHFFGELAKGIKDKKTAANAMQAVAHIANQSNLSPSVEPYIVQLVPAICTNAGNKDKEIQSVASETLISIVNAVNPVAIKALLPHLTNAIVETNKWQEKIAILAAISAMVDAAKDQVALRMPELIPVLSETMWDTKKEVKAAATAAMTKATETVDNKDIERFIPSLIQCIADPTEVPETVHLLGATTFVAEVTPATLSIMVPLLSRGLNERETGIKRKSAVIIDNMCKLVEDPQVIAPFLGKLLPGLKSNFATIADPEAREVTLRALKTLRRVGNVGEDDAIPEVSHAGDVSTTLQVVNELLKDETVAPRFKIVVEYIAAIGADLIDERIIDQQAWFTHITPYMTIFLHEKKAKDILDEFRKRAVDNIPVGPNFDDEEDEGEDLCNCEFSLAYGAKILLNKTQLRLKRARRYGICGPNGCGKSTLMRAIANGQVDGFPTQEECRTVYVEHDIDGTHSDTSVLDFVFESGVGTKEAIKDKLIEFGFTDEMIAMPISALSGGWKMKLALARAVLRNADILLLDEPTNHLDTVNVAWLVNYLNTCGITSITISHDSVFLDNVCEYIINYEGLKLRKYKGNFTEFVKKCPAAKAYEELSNTDLEFKFPEPGYLEGVKTKQKAIVKVTNMEFQYPGTSKPQITDINFQCSLSSRIAVIGPNGAGKSTLINVLTGELLPTSGEVYTHENCRIAYIKQHAFAHIESHLDKTPSEYIQWRFQTGEDRETMDRANRQINENDAEAMNKIFKIEGTPRRIAGIHSRRKFKNTYEYECSFLLGENIGMKSERWVPMMSVDNAWIPRGELVESHSKMVAEVDMKEALASGQFRPLTRKEIEEHCSMLGLDPEIVSHSRIRGLSGGQKVKLVLAAGTWQRPHLIVLDEPTNYLDRDSLGALSKALKEFEGGVIIITHSAEFTKNLTEEVWAVKDGRMTPSGHNWVSGQGAGPRIEKKEDEEDKFDAMGNKIAGGKKKKKLSSAELRKKKKERMKKKKELGDAYVSSDEEF

SEQ ID NO: 12781 - DNA, 3033 bp, Magnaporthe grisea 70-15
  CDS (1)..(3033)
atgtcttccaaggaaaacgcccagtccctcaaggttttggacgagctcatgcagaagctcaccatctccaaggaggctgacgctatcaaggagtcttccaatgctctcgccactttcctgaacggtcgcattgaggactgcgacactcccaccaagaccatcgagaacctcaagaagcagctcggcaacaagaaggatgccgcggttcgcgagaaggctctttgcgccatccaggccatcgcccaacactccaatgtctcgcctcacgtcgagccattcttggttgtccttctgcccagcgtgttcgccgctgccggcgacaagatcacctctgtcaagaacgcagcacttgctgccgcttctgccattgctgaggcaatcaaccccaacgccgtcaaggccacccttcctcacctgattgagtccctccagaacgcccagaagtggcccgaaaagattgctgttctcgacttcatcgagactcttgtcaggaccgcccccgcccagactgcccttcgtgtccccgacctcatccccgtcgttggcgatgctatgtgggacaccaagaaggaggtcaaggagcatgcctacaagatcatggagaagatttgcagcttgattgtcaacagggatatcgagcgcttcattcctgagctcatcaagtgtatcgccaagcccgagaacgtccccgagaccgtccacctgttgggtgccaccactttcgtcacggaggtcactgagcccaccctggccctgatggttcctcttctggagcgtggtcttcaggagcgtgaaactgccatcaagcgtaaggcagctgtcatcgtcgacaacatgtgcaagcttgtcgacgaccccaacatcgtcgctgccttccttccccgcctcatgcccaacctgcagaagaacttcgagaacatggccgaccccgaggctcgtgagaagaccaagcagggtcttgacactcttacccgcgtcggtaacgttgttgacggcaagatccccgagcgccgcaacgacggtgacgttgctaccgttgccgcccacgtccgtgacgctctttccagcgagaaggacgctaaggctgagaagttcgctcccgtcattgagtacattgccgctgttggtggtcagctcgtcgacgagaaggaggttgatgcccctgcctgggctactgccctcaagccttacgtcagcgtcattgttggcgatgccaaggccgacagcgttgtcgagactctccgcaagaaggcttcccccggccttgctgatgccgaggaggaggaggctgacgacgaggagggtgaggacctgtgcaactgcacgtctgagggtttccccaagcagagcgaggtcaagaccgtcttcgtcgagcacgaccttgactctgctgacactgagatgaccaccatcgactggaccatgaagaagctggaggaggccaaggtctcggttacccgcgaggacgtcgtcaagcgcctcaacgagttcggtttcaccgactccatggtttctggtgagatcaccgctctttccggtggttggaagatgaagctggctctgtgccgtgccgtcttcgaggctcctgatattctgttgctcgacgagcccaccaaccacttggacgtgaagaacgtcaagtggcttgaggagtacctccagaactccccttgcacctccatcatcgtgtcgcacgactccagcttcctcgacaacgtctgccagcacatcgttcactacgagcgtttcaagctcaagcgttaccgtggtaacctgaaggagttcgtcaagaagtgcccctcggccaagtcttactacgagctcggtgcctctgagatggagttcaccttccccgagcccggtttcctcgagggtgtcaagaccaaggccaaggccattctccgtgccaccaagatggacttccagtaccctggtacctccaagccccagatcagcgacatcaccttccagtgctctcttggttcccgtattgccgtcattggtcccaacggtgccggaaagtctactctcatcaacgtcctgactggtgagcttatccccactgctggtgagatctaccagcacgagaacatccgtatcgcctacatcaagcagcacgctttcgcccacatcgacaaccacttggacagcactccttccgagtacatccagtggcgtttccagactggtgaggaccgtgagaccatggaccgtgccaacaagatcatcaccgaggaggacgagaaggccatggacaaggtcttcaaggtcgacggtacccaacgccgcgtcatcggcatcaacgcccgtagaaagttcaagaactcgtacgagtacgagtgcacgttcgctctgggtgagaacattggcatgaagaacgagcgctgggtccccatgatgtcggcagacaacgcctggctccctcgttcggagctgctcgcttcccaccagaagatggttgccgaggtcgacatgaaggaggctcttgcctctggtcagttccgtcctctggtccgtaaggagattgagagccactgcgccaactttggtctcgacgccgagctggtttctcactcgcgcatgcgtggtctgtctggtggacagcgtgtcaaggtcgtccttgccgcctgctcgtggcagcgtcctcacttgatcgttcttgatgagcctaccaactacttggaccgtgactctctcggtgccctgtccaaggcgctcaagaagttcgagggtggtgtcatcatcattactcactcgtctgagttcaccaaggacctgactgaggaggtctgggctgtcgttgacggcaagatgacgccttccggccacaactgggtgcagggccagggctctggtccccgcctcaaggccgacgacggcgaggaggaggagaagttcgatgccatgggcaacaagattgtcagcaccaagaaggccaagaagcttaccagcgccgaggcccgtaagaagaagaaggagcgtatggccaggaggaagcgtggtgaggaggttttcagcgacgaggacgagtaa

SEQ ID NO: 12782 - protein, 1010 aa, Magnaporthe grisea 70-15
MSSKENAQSLKVLDELMQKLTISKEADAIKESSNALATFLNGRIEDCDTPTKTIENLKKQLGNKKDAAVREKALCAIQAIAQHSNVSPHVEPFLVVLLPSVFAAAGDKITSVKNAALAAASAIAEAINPNAVKATLPHLIESLQNAQKWPEKIAVLDFIETLVRTAPAQTALRVPDLIPVVGDAMWDTKKEVKEHAYKIMEKICSLIVNRDIERFIPELIKCIAKPENVPETVHLLGATTFVTEVTEPTLALMVPLLERGLQERETAIKRKAAVIVDNMCKLVDDPNIVAAFLPRLMPNLQKNFENMADPEAREKTKQGLDTLTRVGNVVDGKIPERRNDGDVATVAAHVRDALSSEKDAKAEKFAPVIEYIAAVGGQLVDEKEVDAPAWATALKPYVSVIVGDAKADSVVETLRKKASPGLADAEEEEADDEEGEDLCNCTSEGFPKQSEVKTVFVEHDLDSADTEMTTIDWTMKKLEEAKVSVTREDVVKRLNEFGFTDSMVSGEITALSGGWKMKLALCRAVFEAPDILLLDEPTNHLDVKNVKWLEEYLQNSPCTSIIVSHDSSFLDNVCQHIVHYERFKLKRYRGNLKEFVKKCPSAKSYYELGASEMEFTFPEPGFLEGVKTKAKAILRATKMDFQYPGTSKPQISDITFQCSLGSRIAVIGPNGAGKSTLINVLTGELIPTAGEIYQHENIRIAYIKQHAFAHIDNHLDSTPSEYIQWRFQTGEDRETMDRANKIITEEDEKAMDKVFKVDGTQRRVIGINARRKFKNSYEYECTFALGENIGMKNERWVPMMSADNAWLPRSELLASHQKMVAEVDMKEALASGQFRPLVRKEIESHCANFGLDAELVSHSRMRGLSGGQRVKVVLAACSWQRPHLIVLDEPTNYLDRDSLGALSKALKKFEGGVIIITHSSEFTKDLTEEVWAVVDGKMTPSGHNWVQGQGSGPRLKADDGEEEEKFDAMGNKIVSTKKAKKLTSAEARKKKKERMARRKRGEEVFSDEDE

SEQ ID NO: 12783 - DNA, 3138 bp, Gibberella zeae PH-1
  CDS (1)..(3138)
atgcctaccgagaaccagcagtcgatcaaggtcctggacgagcttttccagaagctcaccgtgtccaaggagtcctctgacatcaaggagtcttccaacgagttggcttctttcatcaacggtcgcatcggtgaccaggtcgttcctgataatgttatcgagggcctgaagaagcagctcgccaacaagaaggacgccactgcccgtgagaaggcttgcgttgccatcgaggccatcgcttctcacgccgaggtctccgctgccgtcgagccttacctggttgtcctcctccccgccgtccttgccgctgttggcgacaagatcaccgctgtcaagaatgccgctcagggtgctgttctcgccattgctggcggcatcaacgccaacgctgtcaaggctgccctcccctgcgtcatggagtccatccgaagtgcccagaagtggcccgagaagatggccgctcttgactttgtcgagtacctcgtcaagaactcccctgctcagctcgcctaccgtgttcctgagctcatccctgtcatctccgagtccatgtgggacaccaagaaggaggttaaggagcgtgcttacaagaccatggagcagctttgccagctgattgtcaacaaggatatcgagcgtttcattcctgagctgatcaagtgtatcgccaagcctgagaacgtccctgagaccgttcacttgctcggtgccaccaccttcgttactgaggtccaggagcctactcttgccctcatggttccccttctggatcgtggtctggctgagcgtgacaccgctatcaagcgaaagaccgctgttattgtcgacaacatgtgcaagctcgtcgacgatcccaacgttgtcgctcctttcttgcccaagatgatgccaggtctccagaagaactacgagaacttggctgaccccgaggctcgtgacaagaccaagcaggctcttgacacccttacccgcgttggtgacatcaagaacggcgtcatccctgagcccaccttccccggtgccgtcaacgtcatccagcccaaggttaccgctgctctctcccccaagttcgccaactacgtggagaagatgggccctgtcatcgagtacatctccgccattgctggtcagctcgttgatgagaaggaggtcgagtccatgatctgggtcgacaacctgaaggcttacgtctctgtcatctctggcattgacaacgccgagtccatcgtcgagaacatccgcaaggccgctcttcccggtgctgtcgccgaggctgaggccgaggaggacgaggaggagggtgaggatctttgcaactgtacattctctcttgcctacggtgccaagattcttctcaaccagactcacctccgtctcaagcgtggtcagcgttacggtctttgtggtcccaacggttccggaaagtccaccctcatgcgcgccatcaacaacgagcaggtcgagggtttccccaagcaggacgaggtcaagactgtcttcgtcgagcacgacttggactccgctgatactgagatgaccaccattgactggaccatgaagaagcttgaggaggccggtgtcactaccacccaggctgatgtcgagaagcagctcaacgagttcggtttcaccgagcaaatggttaagggtgagatcagcgccctctctggtggttggaagatgaagcttgctctgtgccgtgctgtcttcgaggctcccgatattctgttgcttgatgagcctaccaaccatttggatgtgaagaacgttaagtggctcgaggagtacctcaagaactccgcttgcacctccatcattgtctctcacgactccggtttccttgacaacgtctgccagcacatcgttcactacgagcgattcaagctcaagcgttacaagggtaacctggctgctttcgtcgcccgcaacccctccgccaagtcctactacgagcttggtgagtccgagatcgagttcagcttccccgagcccggtttccttgagggtgtcaagaccaaggccaaggccattctccgtgccaccaacatgtccttccagtaccctggtacctccaagccccagatcagcgacatctccttccagtgctctctgggctctcgtattgccgttatcggccccaacggtgccggcaagtctactctgatcaacgtcctcactggtgagcttatccctacccagggtgagatctaccagcacgagaacatccgtatcgcctacattaagcagcacgctttcgctcacatcgataaccatctcgacaagactccttccgagtacatccagtggcgattccagactggtgaggatcgtgagaccatggaccgtgccaacaagatcatcaccgaggctgatgagaaggccatggacaaggtcttccgtatcgagggtagccagcgacgtgtcattggtatcaacagccgaagaaagttcaagaactcttacgagtacgagtgttctttcgcccttggtgagaacgttggcatgaagaacgagcgatgggttcccatgatgtctgctgacaacgcctggttgccccgaaacgagcttttggcctctcatcagaagatggttgctgatgtcgatatgaaggaggcccttgcctctggtcagttccgacctctggtccgaaaggagattgagtctcactgcgccaacttcggtctcgacgctgagcttgtttctcactctcgtatgcgtggtctgtccggtggtcagcgtgtcaagactgtccttgccgcttgctcttggcagcgaccccatcttatcgttcttgacgagcctaccaactatcttgaccgtgactctctcggtgctctttccaaggccctgaagaagttcgagggtggtgtcatcatcattactcactctgcggagttcaccaaggacttgactgaggaggtctgggccgtcatggacggcaagatgactccttccggccacaactgggttcagggccagggtgctggtcctcgtctcaaggctgacgatggtgatgaggaggagaagttcgacgccatgggtaacaagattgtcaccaccaagaagaagaagaagaaggagcgtatggcccgccgaaagcgtggtgaggaggtgttcagtgacgaggatgacttgtaa

SEQ ID NO: 12784 - protein, 1045 aa, Gibberella zeae PH-1
MPTENQQSIKVLDELFQKLTVSKESSDIKESSNELASFINGRIGDQVVPDNVIEGLKKQLANKKDATAREKACVAIEAIASHAEVSAAVEPYLVVLLPAVLAAVGDKITAVKNAAQGAVLAIAGGINANAVKAALPCVMESIRSAQKWPEKMAALDFVEYLVKNSPAQLAYRVPELIPVISESMWDTKKEVKERAYKTMEQLCQLIVNKDIERFIPELIKCIAKPENVPETVHLLGATTFVTEVQEPTLALMVPLLDRGLAERDTAIKRKTAVIVDNMCKLVDDPNVVAPFLPKMMPGLQKNYENLADPEARDKTKQALDTLTRVGDIKNGVIPEPTFPGAVNVIQPKVTAALSPKFANYVEKMGPVIEYISAIAGQLVDEKEVESMIWVDNLKAYVSVISGIDNAESIVENIRKAALPGAVAEAEAEEDEEEGEDLCNCTFSLAYGAKILLNQTHLRLKRGQRYGLCGPNGSGKSTLMRAINNEQVEGFPKQDEVKTVFVEHDLDSADTEMTTIDWTMKKLEEAGVTTTQADVEKQLNEFGFTEQMVKGEISALSGGWKMKLALCRAVFEAPDILLLDEPTNHLDVKNVKWLEEYLKNSACTSIIVSHDSGFLDNVCQHIVHYERFKLKRYKGNLAAFVARNPSAKSYYELGESEIEFSFPEPGFLEGVKTKAKAILRATNMSFQYPGTSKPQISDISFQCSLGSRIAVIGPNGAGKSTLINVLTGELIPTQGEIYQHENIRIAYIKQHAFAHIDNHLDKTPSEYIQWRFQTGEDRETMDRANKIITEADEKAMDKVFRIEGSQRRVIGINSRRKFKNSYEYECSFALGENVGMKNERWVPMMSADNAWLPRNELLASHQKMVADVDMKEALASGQFRPLVRKEIESHCANFGLDAELVSHSRMRGLSGGQRVKTVLAACSWQRPHLIVLDEPTNYLDRDSLGALSKALKKFEGGVIIITHSAEFTKDLTEEVWAVMDGKMTPSGHNWVQGQGAGPRLKADDGDEEEKFDAMGNKIVTTKKKKKKERMARRKRGEEVFSDEDDL

SEQ ID NO: 12785 - DNA, 3135 bp, Kluyveromyces lactis NRRL Y-1140
  CDS (1)..(3135)
atgtctgactctgcacaatccgtcaaggttctaaacgaactattcgagaagttgacagttgccactgctgacaacagatctgctattgccaatgaagttgcatcattcttgaacggtaacatcatcgaacatgatgttccagaagaattctttgctaacttgagcaaggccatcaaggacaagaagactgctgctaacgttttggaagctgttgctcacattgcctctgaatctggtttgtctccatctgttgaaccattcattgttaacttggtcccaagcatctgtgacaaggctggtgacaaggacaaggaaatccaagttttggcttccgatgctttgttggctattgctaaggccatcaacccagctgccatcaaggctttcttgccattgttgacttctgctttggattctacttccaaatggcaagaaaaggtttctatcttggctgttatctccgttttggttgacactgctaaggagcaacttggtttgagaatgcctgaattgatcccagctttgtctgaagctatgtgggatactaagaaggaagtcaagcaagctgctaccgctactatcaccaaggctactgaaaccgtcgaaaacaaggatattgaacgtttcattccaaagttgatcgaatgtatcgctgatccaagtgaagttccagaaaccgtccacttgttgggtgccaccactttcgttgctgaagttaccccagctactttgtccatcatggttccattgttgaacagaggtttggctgaaagagaaacttccatcaagcgtaaggctgctgttatcattgataacatgtgtaagttggtcgaagacccacaagtcgttgctccattcttggaaaaattgttgccaggtttgaagaacaacttcgccaccattgctgacccagaagctcgtgaagttactttgagaggtttgaagaccttgagaagagtcggtaacgtcggtgccgacgatgtcttgccagaagtttcccacgctggtgacattgctactaccagatccgttctagacgaattgttgaaggaccaaaaggttgcttccagattcgacccagtcttgatctacattgctgccattgctgctgatttgattgatgaaagaatcatcgatcaacaagcttggttcactcacatcactccttacttcactatcttcgctcacgaaagaactgctaaggaaatcatcgacgaattcagaaagagagccgtcgacaacatcccagttggtccaaacttcgacgacgaagaagatgaaggtgaagacttgtgtaactgtgaattctccttggcttatggtgctaagatcttgttgaacaagactcaattgagattgaagagagctagaagatacggtttgtgtggtcctaacggtgctggtaagtctactttgatgagagctatcgccaacggtcaagttgacggtttcccaactcaagaagaatgtagaaccgtttacgtcgagcacgatatcgatggtactcaagctgacacctccgttgttgacttcgtcttcagcggtaacgtcggtaccaaggatgttatcactgacaagttgagagaattcggtttctccgatgaaatgattgctatgccaattgcttccctatctggtggttggaagatgaagttggctttggctagagctgtgttgaagaacgctgatatcttgttgttggatgaaccaactaaccatttggataccgtcaacgttaactggttggttgaatacttgaacacctgtggtatcacttccatcattgtttcccacgactccggtttcttggacaaggtctgtcaatacattatccattacgaaggtttgaagttgagaaagtacaagggtaacttgtccgaattcgtcaagaagtgcccaactgctaagtcttactacgaattgggtgcctctgaattagaattcagattcccagaaccaggttacttggaaggtgttaagaccaagcaaaaggctatcgtcaaggtttctaacatgactttccaatacccaggtactgctaagccacaaatctctgacatttctttccaatgttctttgtcctcaagaattgctgtcattggtccaaatggtgctggtaagtccactttgattaacgtcttgaccggtgaactgttgccaactgtcggtgaagtttacactcacgagaactgtcgtatcgcttacattaagcaacacgctttcgcccatatcgaatcccacttggacaagactccatccgaatatatccaatggagattccaaactggtgaagatagagaaaccatggacagagctaacagagttatcaacgaagatgatgctgaagctatgaacaagatcttcaagatcgacggtactccaagaagaattgctggtatccacgctagaagaaagttcaagaacacctacgaatacgaatgttccttcttgttaggtgaaaacatcggtatgaagtctgaaagatgggttccaatgatgtctgttgacaacgcttggttgccaagaggtgagttggtcgaatctcactctaagatggttgctgaagttgatatgaaggaagctttggcttctggtcaattcagacctttgactagaaaggaaatcgaagagcactgtgccatgttgggtctagatgctgaattggtttctcactccagaatcagaggtttgtccggtggtcaaaaggttaagttggtcttggctgcttgtacctggcaaagaccccacttgatcgtcttggatgaacctaccaactatttggacagagactctctaggtgctttgtccaaggctttgaaggctttcgaaggtggtgttatcatcattactcactctgctgaattcaccaagaatttgactgaagaagtctgggctgtcaaggatggtagaatgactccatctggtcataactgggttaccggtcaaggttccggtccaagaatcgaaaagaaggaagatgaagaagacaagttcgatgctatgggtaacaagatcgcttccgctaagaagaagactaagttgtcttctgcggaattgagaaagaagaagaaggaaagaatgaagaagaagaaggaattaggtgatgcttacgtctcttctgacgatgaattctaa

SEQ ID NO: 12786 - protein, 1044 aa, Kluyveromyces lactis NRRL Y-1140
MSDSAQSVKVLNELFEKLTVATADNRSAIANEVASFLNGNIIEHDVPEEFFANLSKAIKDKKTAANVLEAVAHIASESGLSPSVEPFIVNLVPSICDKAGDKDKEIQVLASDALLAIAKAINPAAIKAFLPLLTSALDSTSKWQEKVSILAVISVLVDTAKEQLGLRMPELIPALSEAMWDTKKEVKQAATATITKATETVENKDIERFIPKLIECIADPSEVPETVHLLGATTFVAEVTPATLSIMVPLLNRGLAERETSIKRKAAVIIDNMCKLVEDPQVVAPFLEKLLPGLKNNFATIADPEAREVTLRGLKTLRRVGNVGADDVLPEVSHAGDIATTRSVLDELLKDQKVASRFDPVLIYIAAIAADLIDERIIDQQAWFTHITPYFTIFAHERTAKEIIDEFRKRAVDNIPVGPNFDDEEDEGEDLCNCEFSLAYGAKILLNKTQLRLKRARRYGLCGPNGAGKSTLMRAIANGQVDGFPTQEECRTVYVEHDIDGTQADTSVVDFVFSGNVGTKDVITDKLREFGFSDEMIAMPIASLSGGWKMKLALARAVLKNADILLLDEPTNHLDTVNVNWLVEYLNTCGITSIIVSHDSGFLDKVCQYIIHYEGLKLRKYKGNLSEFVKKCPTAKSYYELGASELEFRFPEPGYLEGVKTKQKAIVKVSNMTFQYPGTAKPQISDISFQCSLSSRIAVIGPNGAGKSTLINVLTGELLPTVGEVYTHENCRIAYIKQHAFAHIESHLDKTPSEYIQWRFQTGEDRETMDRANRVINEDDAEAMNKIFKIDGTPRRIAGIHARRKFKNTYEYECSFLLGENIGMKSERWVPMMSVDNAWLPRGELVESHSKMVAEVDMKEALASGQFRPLTRKEIEEHCAMLGLDAELVSHSRIRGLSGGQKVKLVLAACTWQRPHLIVLDEPTNYLDRDSLGALSKALKAFEGGVIIITHSAEFTKNLTEEVWAVKDGRMTPSGHNWVTGQGSGPRIEKKEDEEDKFDAMGNKIASAKKKTKLSSAELRKKKKERMKKKKELGDAYVSSDDEF

SEQ ID NO: 12787 - DNA, 3153 bp, Debaryomyces hansenii CBS767
  CDS (1)..(3153)
atgtctgctgccagtgaatctaaatactctgctgaagtgctttccgaattattaagcaaacttcaagttgctgataataaggaagaagctgctgctaatgttgcttctttcttgaattcgtcgattgtcgaacatgatgttccagaacaattcttccaagatttgaagaaacaaattggtaacaagaaagatgacaagatcagcattgctgctttgtctgcttaccaacacattgcttcatccaacgcattatcaccatctgttgaaccatacgttgtcaatttggttactgatgtttctgctaaggctggtgacaagaacaaggacgttcaagctgctgcctcagatgctttgttcgccatcgctcaagctgttaccccaactgctgtcaaggctttattaccagccttattggacagcttggttaacaccaacaagtggactgaaaagattgccattttaagatctctctcccaattggttgacaccgctaaggcccaagttgctttaagaatgccggaattaattccagtcttatctgaagctatgtgggataccaagaaggaagtcaaggaagctgctaccaacaccatgaccaagtccaccgaaaccattgataacaaggatatcgaaaagtttattccaaagttgatcgaatgtattgccaagccaactgaagttccagaaaccgtccacatcttgggttccaccaccttcgtttccgaagttaccatggctactttatccatcatggccccattattgtctagaggtttagctgaacgtgataccgctatcaagcgtaaggctgctgtcattgttgataacatgtgtaaattagtcgatgatccacaagttgttgctccattcatggataaattattaccagctttaaagtctaacttctccaccatggctgacccagaagcccgtgaagttactaacagagctttgagcaccttaagaagagttggtgatatcaaggaagatgacgttattccagaagtctccaccgccggtgatattccagttaccttaggtgtcttccaagaattattgaagggtaagaacattgcttcaagatttgacccagccttgaactatattgctgccattgctggtgacttgatcgatgaaagagccatcaacccagacacctggatccaaaacttattgccatttgctactattttcttacacgaaaatgaagctaaggaaatcattgaagaattcagaaagagagctattgacaacattccagctccaccatcattcgaagatgaagaagatgaaggtgaagacttatgtaactgtgagttctcgttagcttatggtgctaagatcttgttgaacaagactcaattcagattaaagagaaacagaagatatggtttatgtggtccaaatggtgctggtaagtctaccttgatgagagctattgctaacggtcaagtcgagggtttcccaacccaagaagaatgtaagactgtttacgtcgaacacgatatcgatggtactcacgctgacaccaccgttgcccaattcgttcttgaagatggtgaagtcggtttaaccgaagaagttgttaaagccaaattaaccgaattcaacttctctgacgaaatgatcgccatgccaattcaatccttatctggtggttggaagatgaagttagctttagccagagctgtcttaaagaacgctgatatcttattattggatgaaccaactaaccatttggataccgttaacgttgcttggttagtcaactacttacaaacatgtggtattacttctatcattgtttctcacgattccggtttcttagataatgttactcaatacattatccactacgaaggtttcaagttaagaaagtacaagggtaacttatccgaattcgtcaagaagtgtccatccgctcaatcttactacgaattaggtgcctctgacttagaattcagcttcccagaaccaggtttcttagaaggtgttaagactaagcaaaaggctattgtcaaggtttccaacatgactttccaatacccaggtaccaacaaacctcaaattagagatattaatttccaatgttctttatcttctagaattgccgttattggtccaaatggtgctggtaaatctaccttgattaacgtcttaactggtgaattattaccaactgaaggtgaagtttacgtccatgaaaactgtcgtattgcttacattaaacaacacgctttcgcccatattgataaccatttagacaagactccatctgaatatatccaatggagattccaaactggtgaagatagagaaactatggacagagcctccagacaaatcaacgaagatgatgaaacttctatgaacaagatcttcaagattgaaggtactccaagaagaatcgctggtatccacgccagaagaaagttcaagaactcttacgagtatgaatgttcttggatgttgggtgaaaacatcggtatgaagaacgaaagatgggtcccaatgatgtctgttgataacgcttggttaccaagaggtgaaatcatggaaactcactccaagttagtcgccgaagtcgatatgaaggaagctttagcctctggtcaattcagaccattaaccagaaaagaaatcgaagagcactgtgctatgttgggtttggaaactgaattagtttctcactccagaatcagaggtttatctggtggtcaaaaggttaagttagtcttagctgcttgtacatggcaaagacctcatttaatcgtcttagatgaaccaactaactatttggatcgtgactccttaggtgctttatccaaggctttgaaggctttcgctggtggtattgttatcattactcattctgctgaattcaccaaggacattactgaagaagtgtgggctgtcgtagacggtgtgatgactccatccggtcacaactgggttcaaggtcaaggtgcaggtccaagacttgaaaagaaggaagacgaagaagacaaattcgatgctatgggtaataagattgctgctgctaagaagaagactaagttatcttctgctgaattaagaaagaagaagaaggaaagaatgaagaagaagaaggaattaggtgatgcctacgtttctgaagaagaagatttctaa

SEQ ID NO: 12788 - protein, 1050 aa, Debaryomyces hansenii CBS767
MSAASESKYSAEVLSELLSKLQVADNKEEAAANVASFLNSSIVEHDVPEQFFQDLKKQIGNKKDDKISIAALSAYQHIASSNALSPSVEPYVVNLVTDVSAKAGDKNKDVQAAASDALFAIAQAVTPTAVKALLPALLDSLVNTNKWTEKIAILRSLSQLVDTAKAQVALRMPELIPVLSEAMWDTKKEVKEAATNTMTKSTETIDNKDIEKFIPKLIECIAKPTEVPETVHILGSTTFVSEVTMATLSIMAPLLSRGLAERDTAIKRKAAVIVDNMCKLVDDPQVVAPFMDKLLPALKSNFSTMADPEAREVTNRALSTLRRVGDIKEDDVIPEVSTAGDIPVTLGVFQELLKGKNIASRFDPALNYIAAIAGDLIDERAINPDTWIQNLLPFATIFLHENEAKEIIEEFRKRAIDNIPAPPSFEDEEDEGEDLCNCEFSLAYGAKILLNKTQFRLKRNRRYGLCGPNGAGKSTLMRAIANGQVEGFPTQEECKTVYVEHDIDGTHADTTVAQFVLEDGEVGLTEEVVKAKLTEFNFSDEMIAMPIQSLSGGWKMKLALARAVLKNADILLLDEPTNHLDTVNVAWLVNYLQTCGITSIIVSHDSGFLDNVTQYIIHYEGFKLRKYKGNLSEFVKKCPSAQSYYELGASDLEFSFPEPGFLEGVKTKQKAIVKVSNMTFQYPGTNKPQIRDINFQCSLSSRIAVIGPNGAGKSTLINVLTGELLPTEGEVYVHENCRIAYIKQHAFAHIDNHLDKTPSEYIQWRFQTGEDRETMDRASRQINEDDETSMNKIFKIEGTPRRIAGIHARRKFKNSYEYECSWMLGENIGMKNERWVPMMSVDNAWLPRGEIMETHSKLVAEVDMKEALASGQFRPLTRKEIEEHCAMLGLETELVSHSRIRGLSGGQKVKLVLAACTWQRPHLIVLDEPTNYLDRDSLGALSKALKAFAGGIVIITHSAEFTKDITEEVWAVVDGVMTPSGHNWVQGQGAGPRLEKKEDEEDKFDAMGNKIAAAKKKTKLSSAELRKKKKERMKKKKELGDAYVSEEEDF

SEQ ID NO: 12789 - DNA, 3171 bp, Yarrowia lipolytica CLIB122
  CDS (1)..(3171)
atgagtgctcagaaggaagccgccattacgcacaagacgctctctgagctctttgagaagctctctgtcagcgactctctggagtctcgacttgaggctgccaacaacgttgccacctttgttaaccagggcgacgtgattgagcacgatgttcctaaccagctgctggctgccaccaaggccaagctgaaccagaagaaggaccaggctgccgttctcaacgctctgcagctgctcaactctcttgccacctcctcctccgttgcccccaacgtggagccctaccttgttgaggccatcactgatgtgctcgccaaggtcggtgacaaggacaagcagatccaggacgccgccgccaagaccgccaaggatattgctcagtgcatcactcctcgatccgtcaagttcattctgcccctgatcatcgagtctcttgttaacaccaacaagtggcccgagaaggttgctgctctcgagtgcatttccatcctggtcaccgttgcccgagaccaggttgccctgcgaatgcccgagctcatccccgtcctctccgaggccatgtgggacaccaagaaggaggtcaaggagcaggccaccgccaccatcaccaagtccaccgacaccattgacaacaaggatatcatcaagttcatccccgccctgattgcctgtatctccaagcccaccgaggtccccgagactgtgcacattctcggtgccaccacctttgtgtccgaggtcaccaccgccaccctctccatcatggctcctctgctgtcccgaggtcttgctgagcgagacaccgccatcaagcgaaaggccgccgtcattgtcgataacatgtgtaagctggtcgacgacccccaggttgttgctcccttccttgagaccctttaccccgctctcaagactaactacgccaacattgccgaccccgaggctcgagacgttactctgcgagctctcaacaccctgaagcgagttggtgagattgttgacgacaagatccccgaggtttccaccgccggtgacaccaaggtcaaccttgccatcctcgagaagctgctcgagcccttcaaggtcgacaccaagaagttcggcctcatgatgcagttcattgcctccatctccggtgacctcattgacgagcgtctcacccacgaggccgactgggccgagtctctggttgccttcatggttaccattctccccgagaaggatgctcgaaccgtcattgagtctctccgaaagcaggccatcgccaacatccccggtgccaccaactttgaggaggaggacgacgagggcgaggatctgtgtaactgtgagttctctctggcttacggtgctaagattctgctgaaccgaacccagctgcgactcaagcgaggccgacgatacggtctctgtggtcctaacggtgctggtaagtccaccctgatgcgagccattgccaacggtcaggtcgagggtttccccacccaggaggagtgtcgaactgtcttcgtcgaccacgacattgacggtacccacgccgacaccaacgttgtcgactacgtccgaaagaccgccggtgagtccatcggtactgaggaggaggtccgaaagcagctgcttgacttcctgttcactgacgagatgacccgaatgcccatcacctctctgtctggtggatggaagatgaagctggctcttgccactgccgtcctccgaaaggccgatatcctgctgcttgatgagcctaccaaccatctggataccgtcaacgttgcttggctggtcaactaccttaacacctgtggtatcacctccatcatcgtctcccacgactctggtttcctcgataacgtctgtgagtacatcattcactacgagcgattcaagctccgaaagtacaagggtaacctgtccgagtttgtcaagaaggttccttccgccaagtcttactacgagcttggagcctccgagattaacttctctttccccgagcccggtttcctcgagggtgtcaagaccaagcagaaggctattgtcaaggtccagaacatgaccttccagtaccccggtaccaccaagccccagatccgaaacgtctctttccagtgctctctgtcttctcgaattgccgttatcggtcccaacggtgctggtaagtccactcttatcaacgtcctgaccggtgagctgctccccacctccggtgaggtttacgcccacgagaactgtcgaattgcttacatcaagcagcacgcctttgcccatatcgactcccatcttgactccaccccctctgagtacatccagtggcgattccagaccggtgaggatcgagagaccatggaccgagccaaccgacagatcaccgactccgatgaggctgccatgaacaagatctacaagatcgagggcaccccccgacgagttgctggtgttcacgcccgacgaaagttcaagaactcttacgagtacgagtgttctttcctgctcggtgagaaccttggcatgaagtccgagaagtggatccccatgggttccgtcgacaacgcctggatcccccgatccgagctcatggagtcccactccaagctggttgctgaggttgatatgaaggaggcccttgcttccggacagttccgacctcttaccaagaaggagattgaggcccactgcgccctccttggtctcgagcccgagcttgtctctcactctcgaatccgaggtctgtctggtggtcagaaggtcaagcttgtgcttgccgcctgtacctggcagcgaccccatcttatcgtccttgatgagcctaccaactatctggatcgagactctcttggagctctgtctcgagctatcaagcgattcgagggtggtgttgtcatcattacccattccgccgagttcaccaaggatcttaccgaggaggtctgggccgttatggatggtgtcatgactccttccggccacaactgggtctctggtcagggatctggtccccgacttggaaagaaggagggtgacgaggaggagaagttcgacgccatgggcaacaagattgtgtccgagaagaagaaggccaagctttccgctgccgagctccgaaagaagaagaaggagcgaatgaagcgaaagaaggagcagggtgatgcttacgtctcttccgatgacgacttctaa

SEQ ID NO: 12790 - protein, 1056 aa, Yarrowia lipolytica CLIB122
MSAQKEAAITHKTLSELFEKLSVSDSLESRLEAANNVATFVNQGDVIEHDVPNQLLAATKAKLNQKKDQAAVLNALQLLNSLATSSSVAPNVEPYLVEAITDVLAKVGDKDKQIQDAAAKTAKDIAQCITPRSVKFILPLIIESLVNTNKWPEKVAALECISILVTVARDQVALRMPELIPVLSEAMWDTKKEVKEQATATITKSTDTIDNKDIIKFIPALIACISKPTEVPETVHILGATTFVSEVTTATLSIMAPLLSRGLAERDTAIKRKAAVIVDNMCKLVDDPQVVAPFLETLYPALKTNYANIADPEARDVTLRALNTLKRVGEIVDDKIPEVSTAGDTKVNLAILEKLLEPFKVDTKKFGLMMQFIASISGDLIDERLTHEADWAESLVAFMVTILPEKDARTVIESLRKQAIANIPGATNFEEEDDEGEDLCNCEFSLAYGAKILLNRTQLRLKRGRRYGLCGPNGAGKSTLMRAIANGQVEGFPTQEECRTVFVDHDIDGTHADTNVVDYVRKTAGESIGTEEEVRKQLLDFLFTDEMTRMPITSLSGGWKMKLALATAVLRKADILLLDEPTNHLDTVNVAWLVNYLNTCGITSIIVSHDSGFLDNVCEYIIHYERFKLRKYKGNLSEFVKKVPSAKSYYELGASEINFSFPEPGFLEGVKTKQKAIVKVQNMTFQYPGTTKPQIRNVSFQCSLSSRIAVIGPNGAGKSTLINVLTGELLPTSGEVYAHENCRIAYIKQHAFAHIDSHLDSTPSEYIQWRFQTGEDRETMDRANRQITDSDEAAMNKIYKIEGTPRRVAGVHARRKFKNSYEYECSFLLGENLGMKSEKWIPMGSVDNAWIPRSELMESHSKLVAEVDMKEALASGQFRPLTKKEIEAHCALLGLEPELVSHSRIRGLSGGQKVKLVLAACTWQRPHLIVLDEPTNYLDRDSLGALSRAIKRFEGGVVIITHSAEFTKDLTEEVWAVMDGVMTPSGHNWVSGQGSGPRLGKKEGDEEEKFDAMGNKIVSEKKKAKLSAAELRKKKKERMKRKKEQGDAYVSSDDDF

SEQ ID NO: 12791 - DNA, 3153 bp, Candida albicans SC5314
  CDS (1)..(3153): transl_table=12
atgtctgctgctagtgaatccaaatattctactgaagtgctttccgaattattgagcaaattacaagttgctgataataaggatgaagctgcttccaacatttccacttttttaaactcatctattgttgaacacgatgttccagttgaatttttcgaagatttgaaaaaacaaattcaatctaaagatgctaaagtttctcttgctgctttggatgcttacaaacacattgcttcaaccaacggtttatccccatccgttgaaccatatgttgttgacttggttagtgaagttgccgttaaagctggtgacaaaaacaaggatgttcaaactgctgcttctgatgctttattggccattgcttctgccatcaccccaactgctgtcaaagccatcttaccaaaattgattgacaacttgaccaacaccaacaaatggactgaaaaagttgccatcttgagagctgtttctcaattggttgacactgctaaagctcaaattgctttgagaatgcctgaattgattccagtcttgtctgaatctatgtgggataccaaaaaagaagtcaaagaagccgccactgctaccatgaccaaatccactgaaaccattgacaataaagatattgaaaaattcattcctcaattgatttcttgtattgccaaaccaactgaagttccagaaaccgtccacttgttgggtgctaccacttttgtttctgaagttaccatggccactttgtcgattatggctccattgttgtctagaggtttagctgaaagagacactgctatcaaacgtaaagctgctgttattgttgataacatgtgtaaattggtcgaagatccacaaattgttgctccatttatggacaaattgttgccaggtttgaaaaacaactttgccaacatggctgatccagaagctagagaagttactcaaagagctttgaacactttaagaagagttggtgccgttggtgaaaacgatagcatcccagaagtttctactgctggtgatatcgatgtcactttgaatgaattcaacaaattggttgctgacaaaaaaatcgccaaaagatttgacgttgctttgaactatattgctgctattgctggtgatttggttgatgaaagagaaattcaaccagaagcttggttacaaaatgttttaccatttgccaccattttcttgcacgaaaaggaagctaaagaaatcatcgaagaattcagaaagagagccattgacaacattccacaaccaccatcatttgaagatgaagaagatgaaggtgaagatttatgtaattgtgaattctctttggcttatggtgccaagatcttgttgaacaagacccaattcagattaaagagaaacagaagatatggtttgtgtggtccaaatggtgctggtaaatctactttgatgagagctattgctaacggtcaagttgaaggtttcccaacccaagacgaatgtaaaaccgtttacgttgaacacgatatcgatggtactcacgccgacacaaccgttgttgaattcgtcattgaagatggtgaagttggtttgaccaaagacgttgttgttgacaaattgagagaattcaatttttccgatgaaatgatcaacatgccaattcaatccttatctggtggttggaaaatgaaattggctttggctagagctgtgttgaagaatgccgatatcttgttgttggatgaaccaactaatcatttggataccgtcaatgttgcttggttagtcaactacttgaacacttgtggtattacttccattattgtttcccacgattccggtttcttggacaatgttactcaatacattatccattacgaaggtttcaaattgagaaaatacaagggtaacttgtctgaattcgtcaagaaatgtccatctgctcaatcttattatgaattaggtgcttctgatttggaatttagattcccagaaccaggtttcttggaaggggttaaaactaaacaaaaagctattgttaaagtttctaacatgtcattccaatacccaggtacttctaaaccacaaattcaagacattaacttccaatgttctttatcatctagaattgctgtcattggtccaaatggtgctggtaaatccaccttaattaacgttttgactggtgaattattaccaaccactggtgaagtttacgtccacgaaaattgtcgtattgcttacattaaacaacatgcttttgctcatattgataaccatttggacaaaactccatctgaatatattcaatggagattccaaactggtgaagatagagaaaccatggatagagcctctagacaaatcaatgaagaagatgaacaaaacatgaacaagattttcaaaattgaaggtacaccaagaagaattgctggtattcacgccagaagaaagttcaagaactcttatgaatatgaaatttcttggatgttgggtgaaaacattggtatgaagaatgaaagatgggtaccaatgatgtctgttgacaacacttggttgccaagaggtgaattgatggaaactcacgccaagttggttgctgaagttgatatgaaagaagctttggcttctggtcaattcagaccattaaccagaaaagaaattgaagaacattgtgctatgttgggtttggatgccgaattggtttctcactctagaattagaggtttatctggtggtcaaaaagttaaattggtcttggctgcttgtacttggcaaagacctcatttgattgtcttggatgaaccaaccaattatttggatagagattctttgggtgctttgtccaaagctttgaaagctttcgaaggtggtattgttatcattactcactctgctgaattcaccaaagatttgactgaagaagtctgggccgttttggacggtagaatgactccatctgatcacaattgggtccaaggtcaaggttctggtccaagaattgaaaagaaggatgatgaagaagaagataaattcgatgctatgggtaacaagattgccgctgctaagaagaagaagaagttatcttctgctgaattaagaaagaagaagaaggaaagaatgaagaaaaagaaggaattgggtgatgcttatgtctcatctgatgaagaattctaa

SEQ ID NO: 12792 - protein, 1050 aa, Candida albicans SC5314
MSAASESKYSTEVLSELLSKLQVADNKDEAASNISTFLNSSIVEHDVPVEFFEDLKKQIQSKDAKVSLAALDAYKHIASTNGLSPSVEPYVVDLVSEVAVKAGDKNKDVQTAASDALLAIASAITPTAVKAILPKLIDNLTNTNKWTEKVAILRAVSQLVDTAKAQIALRMPELIPVLSESMWDTKKEVKEAATATMTKSTETIDNKDIEKFIPQLISCIAKPTEVPETVHLLGATTFVSEVTMATLSIMAPLLSRGLAERDTAIKRKAAVIVDNMCKLVEDPQIVAPFMDKLLPGLKNNFANMADPEAREVTQRALNTLRRVGAVGENDSIPEVSTAGDIDVTLNEFNKLVADKKIAKRFDVALNYIAAIAGDLVDEREIQPEAWLQNVLPFATIFLHEKEAKEIIEEFRKRAIDNIPQPPSFEDEEDEGEDLCNCEFSLAYGAKILLNKTQFRLKRNRRYGLCGPNGAGKSTLMRAIANGQVEGFPTQDECKTVYVEHDIDGTHADTTVVEFVIEDGEVGLTKDVVVDKLREFNFSDEMINMPIQSLSGGWKMKLALARAVLKNADILLLDEPTNHLDTVNVAWLVNYLNTCGITSIIVSHDSGFLDNVTQYIIHYEGFKLRKYKGNLSEFVKKCPSAQSYYELGASDLEFRFPEPGFLEGVKTKQKAIVKVSNMSFQYPGTSKPQIQDINFQCSLSSRIAVIGPNGAGKSTLINVLTGELLPTTGEVYVHENCRIAYIKQHAFAHIDNHLDKTPSEYIQWRFQTGEDRETMDRASRQINEEDEQNMNKIFKIEGTPRRIAGIHARRKFKNSYEYEISWMLGENIGMKNERWVPMMSVDNTWLPRGELMETHAKLVAEVDMKEALASGQFRPLTRKEIEEHCAMLGLDAELVSHSRIRGLSGGQKVKLVLAACTWQRPHLIVLDEPTNYLDRDSLGALSKALKAFEGGIVIITHSAEFTKDLTEEVWAVLDGRMTPSDHNWVQGQGSGPRIEKKDDEEEDKFDAMGNKIAAAKKKKKLSSAELRKKKKERMKKKKELGDAYVSSDEEF

SEQ ID NO: 12793 - DNA, 3153 bp, Candida albicans SC5314
  CDS (1)..(3153): transl_table=12
atgtctgctgctagtgaatccaaatattctactgaagtgctttccgaattattgagcaaattacaagttgctgataataaggatgaagctgcttccaacatttccacttttttaaactcatctattgttgaacacgatgttccagttgaatttttcgaagatttgaaaaaacaaattcaatctaaagatgctaaagtttctcttgctgctttggatgcttacaaacacattgcttcaaccaacggtttatccccatccgttgaaccatatgttgttgacttggttagtgaagttgccgttaaagctggtgacaaaaacaaggatgttcaaactgctgcttctgatgctttattggccattgcttctgccatcaccccaactgctgtcaaagccatcttaccaaaattgattgacaacttgaccaacaccaacaaatggactgaaaaagttgccatcttgagagctgtttctcaattggttgacactgctaaagctcaaattgctttgagaatgcctgaattgattccagtcttgtctgaatctatgtgggataccaaaaaagaagtcaaagaagccgccactgctaccatgaccaaatccactgaaaccattgacaataaagatattgaaaaattcattcctcaattgatttcttgtattgccaaaccaactgaagttccagaaaccgtccacttgttgggtgctaccacttttgtttctgaagttaccatggccactttgtcgattatggctccattgttgtctagaggtttagctgaaagagacactgctatcaaacgtaaagctgctgttattgttgataacatgtgtaaattggtcgaagatccacaaattgttgctccatttatggacaaattgttgccaggtttgaaaaacaactttgccaacatggctgatccagaagctagagaagttactcaaagagctttgaacactttaagaagagttggtgccgttggtgaaaacgatagcatcccagaagtttctactgctggtgatatcgatgtcactttgaatgaattcaacaaattggttgctgacaaaaaaatcgccaaaagatttgacgttgctttgaactatattgctgctattgctggtgatttggttgatgaaagagaaattcaaccagaagcttggttacaaaatgttttaccatttgccaccattttcttgcacgaaaaggaagctaaagaaatcatcgaagaattcagaaagagagccattgacaacattccacaaccaccatcatttgaagatgaagaagatgaaggtgaagatttatgtaattgtgaattctctttggcttatggtgccaagatcttgttgaacaagacccaattcagattaaagagaaacagaagatatggtttgtgtggtccaaatggtgctggtaaatctactttgatgagagctattgctaacggtcaagttgaaggtttcccaacccaagacgaatgtaaaaccgtttacgttgaacacgatatcgatggtactcacgccgacacaaccgttgttgaattcgtcattgaagatggtgaagttggtttgaccaaagacgttgttgttgacaaattgagagaattcaatttttccgatgaaatgatcaacatgccaattcaatccttatctggtggttggaaaatgaaattggctttggctagagctgtgttgaagaatgccgatatcttgttgttggatgaaccaactaatcatttggataccgtcaatgttgcttggttagtcaactacttgaacacttgtggtattacttccattattgtttcccacgattccggtttcttggacaatgttactcaatacattatccattacgaaggtttcaaattgagaaaatacaagggtaacttgtctgaattcgtcaagaaatgtccatctgctcaatcttattacgaattaggtgcttctgatttggaatttagattcccagaaccaggtttcttggaaggggttaaaactaaacaaaaagctattgttaaagtttctaacatgtcattccaatacccaggtacttctaaaccacaaattcaagacattaacttccaatgttctttatcatctagaattgctgtcattggtccaaatggtgctggtaaatccaccttaattaacgttttgactggtgaattattaccaaccactggtgaagtttacgtccacgaaaattgtcgtattgcttacattaaacaacatgcttttgctcatattgataaccatttggacaaaactccatctgaatatattcaatggagattccaaactggtgaagatagagaaaccatggatagagcttctagacaaatcaatgaagaagatgaacaaaacatgaacaagattttcaaaattgaaggtacaccaagaagaattgctggtattcacgccagaagaaagttcaagaactcttatgaatatgaaatttcttggatgttgggtgaaaacattggtatgaagaatgaaagatgggtaccaatgatgtctgttgacaacacttggttgccaagaggtgaattgatggaaactcacgccaagttggttgctgaagttgatatgaaagaagctttggcttctggtcaattcagaccattaaccagaaaagaaattgaagaacattgtgctatgttgggtttggatgccgaattggtttctcactctagaattagaggtttatctggtggtcaaaaagttaaattggtcttggctgcttgtacttggcaaagacctcatttgattgttttggatgaaccaaccaattatttggatagagattctttgggtgctttgtctaaagctttgaaagctttcgaaggtggtattgttatcattactcactctgctgaattcaccaaagatttgactgaagaagtctgggctgttttggacggtagaatgactccatctggtcacaattgggtccaaggtcaaggttctggtccaagaattgaaaagaaggatgatgaagaagaagataaattcgatgctatgggtaacaagattgccgctgctaagaagaagaagaagttatcttctgctgaattaagaaagaaaaagaaggaaagaatgaagaagaagaaggaattgggtgatgcttatgtctcatctgatgaagaattctaa

SEQ ID NO: 12794 - protein, 1050 aa, Candida albicans SC5314
MSAASESKYSTEVLSELLSKLQVADNKDEAASNISTFLNSSIVEHDVPVEFFEDLKKQIQSKDAKVSLAALDAYKHIASTNGLSPSVEPYVVDLVSEVAVKAGDKNKDVQTAASDALLAIASAITPTAVKAILPKLIDNLTNTNKWTEKVAILRAVSQLVDTAKAQIALRMPELIPVLSESMWDTKKEVKEAATATMTKSTETIDNKDIEKFIPQLISCIAKPTEVPETVHLLGATTFVSEVTMATLSIMAPLLSRGLAERDTAIKRKAAVIVDNMCKLVEDPQIVAPFMDKLLPGLKNNFANMADPEAREVTQRALNTLRRVGAVGENDSIPEVSTAGDIDVTLNEFNKLVADKKIAKRFDVALNYIAAIAGDLVDEREIQPEAWLQNVLPFATIFLHEKEAKEIIEEFRKRAIDNIPQPPSFEDEEDEGEDLCNCEFSLAYGAKILLNKTQFRLKRNRRYGLCGPNGAGKSTLMRAIANGQVEGFPTQDECKTVYVEHDIDGTHADTTVVEFVIEDGEVGLTKDVVVDKLREFNFSDEMINMPIQSLSGGWKMKLALARAVLKNADILLLDEPTNHLDTVNVAWLVNYLNTCGITSIIVSHDSGFLDNVTQYIIHYEGFKLRKYKGNLSEFVKKCPSAQSYYELGASDLEFRFPEPGFLEGVKTKQKAIVKVSNMSFQYPGTSKPQIQDINFQCSLSSRIAVIGPNGAGKSTLINVLTGELLPTTGEVYVHENCRIAYIKQHAFAHIDNHLDKTPSEYIQWRFQTGEDRETMDRASRQINEEDEQNMNKIFKIEGTPRRIAGIHARRKFKNSYEYEISWMLGENIGMKNERWVPMMSVDNTWLPRGELMETHAKLVAEVDMKEALASGQFRPLTRKEIEEHCAMLGLDAELVSHSRIRGLSGGQKVKLVLAACTWQRPHLIVLDEPTNYLDRDSLGALSKALKAFEGGIVIITHSAEFTKDLTEEVWAVLDGRMTPSGHNWVQGQGSGPRIEKKDDEEEDKFDAMGNKIAAAKKKKKLSSAELRKKKKERMKKKKELGDAYVSSDEEF

SEQ ID NO: 12795 - DNA, 3204 bp, Aspergillus oryzae
  CDS (1)..(3204)
atgcctgctgctgctgcctcctcggttcctgctgtctccagcaaggagaccgctcagtctctctctgtccttgacgacttgctcaagaacctcaacatctcctctactcaggatgaggtcaacgccgctaccgacaacattgctcacctcctcagcggtcctatccctgaacaagccctccccctgaagctcgccgaagatctcaagaagcagctctctaataagaaggatgccaatgcccgccagcgcgcttgcgacgctatccgggccgttgcttcccacgccaccatcgcccccggtgttgagcctcacctcgtgactctcctccgccctgtcctcgctgccgttggtgacaagatgaccaacgtcaaggacgccgctcagagtgccgctattgccattgtcaagggcatcaacggcaatgccgtcaaggccgtcattcctcctattctcgagtccctggagtccgcccagaagtggactgagaagctgtgcgctctcgagtgcctcaactctctcattgagaccgctcccgctcaggtttcttaccgtgtccccgccctgattcctgctgtctccgaggctatgtgggatactaaggccgagatcaagaaggccgcttactccaccatggagaaggtctgcggtctgatcgttaacaaggatatcgagcgtttcattcctgaactcattaagtgtatctccaagcccgagaacgtccccgagaccgttcacttgctcggtgccaccaccttcgtttccgatgtcactggacctaccctcgctatcatggttcccttgcttgaccgtggtcttgtcgagcgtgagactgccatcaagcgtaagtctgctgtcatcgtcgacaacatgtgtaagcttgtcgaggaccctcagatcgtcgctcccttcttgcccaagttgatgcctcgtcttacccacaaccttgacaccctgcccgaccctgaggctcgtggcaagaccgaacaggccttggcaaccctcagccgtgttggtgacgtcaaggatggcaagattcccgagatctccaccgccggtgacatctccactgttgctggtatcctcaaggagatcctctcccccaagttcgacgaacaggtcaagaagtccgaggccatcatcaactacgttgctgccattgctggtcagctcgttgacgagaaggttggcgaggttgagagctggacccagaacgctctcccctacatcaccgccattgtcggtgaggaggaggctaagactgttgctgagaccctccgcaagcgtgcttctcctgatgccgctgctgaggatgcagtcctctccgacgaggaggagggtgaggatctgtgcaactgcacgttctccctggcctatggtgccaagatcttgctgaaccagacccatctccgcctgaagcgtggtcagcgttacggtctcctcggtcccaacggtactggtaagaccactctcatgcgtgctatcaacaacgagcagcttgagggtttccccaagaaggatgaggtcaagactgtctacgttgagcacgacttggattctgccgatactgagcaaaccgtcattggctggaccatgaagaagctccgcgaggttggcctggaccccaagcaggaggaggtcgaagccaagctcgaggagttcggtttcctccgtgagcagctcaacggccccattaccgccctttctggtggttggaagatgaagctggcccttgcccgtgctgtcttcgagaagcctgatatccttctcctggatgagcctaccaaccacttggacgtcaagaacgttgcctggttggagaactacctttgcacgtccccttgcacttccatcattgtctctcacgacagcaagttcttggacaacgttatccagcacgtcattcactacgagcgtaacttcaagcttaagcgttaccgtggtaccctgagcgagttcgtgaagaaggttccttccgcccgctcttactacgagctgggtgcttccgacatggaattcaagttccccgagcccggtttcctggagggtgtcaagaccaaggccaaggctatcatccgtgtctccaacatgtccttccagtaccctggcactcctcgtccccagatttccgatatttccttccaggtgtctttgggatcccgtattgctgtcatcggtcccaacggtgccggtaagtctacactggtcaacgttttgaccggtgagttgatccctaccaccggtgatgtctaccagcacgagaacatccgtatcgcctacatcaagcagcacgctttcgcccacattgataaccacctcgacagcactccctccgagtacatccagtggcgtttccagaccggtgaggaccgtgaaaccatggaccgtgccaacaagattgtcaccgatgaggacgagaaggccatggacaagatctacaagatcgacggtaccccccgtagggtcattggtatccactcccgtcgtaagttcaagaacacttacgagtacgagtgttccttcctgctgggtgacaacatcggcatgaagagcgagaagtggactcccatgatgaccagcgacaacgcctggattccccgtaacgagatcatccagtcccacgccaagatggttgccgaggttgaccagaaggaggcccttgccagcggtcagttccgtcctctggtccgcaaggagatcgaagagcactgcgcccagttcggtctcgatgctgagcttgtttcccactcccgtatgcgcggtctctccggtggtcagcgtgtcaaggttgtccttgccgcctgctcttggcagcgtcctcacgtcatcgtcctggacgagcccaccaactacctggaccgtgactccctgggtgccctttccaaggctatcaagaccttcgagggtggtgttgtcatcattactcactcccgtgagttcactgagaacctcactgaggaagtctgggctgttgttgacggaaagatgactccttccggccacaactgggtccagggtcagggttctggtcctcgtctcaccgagaagaccaacgaggaggacactttcgatgctatgggcaacaagattgaagcccctaagaaggcaaagaagcttacttcaagtgagcagcgcaagaagaagaaggagcgtatggctaggaagaagcgtggtgaggaagtcttctctgatgaggatgatttctaa

SEQ ID NO: 12796 - protein, 1067 aa, Aspergillus oryzae
MPAAAASSVPAVSSKETAQSLSVLDDLLKNLNISSTQDEVNAATDNIAHLLSGPIPEQALPLKLAEDLKKQLSNKKDANARQRACDAIRAVASHATIAPGVEPHLVTLLRPVLAAVGDKMTNVKDAAQSAAIAIVKGINGNAVKAVIPPILESLESAQKWTEKLCALECLNSLIETAPAQVSYRVPALIPAVSEAMWDTKAEIKKAAYSTMEKVCGLIVNKDIERFIPELIKCISKPENVPETVHLLGATTFVSDVTGPTLAIMVPLLDRGLVERETAIKRKSAVIVDNMCKLVEDPQIVAPFLPKLMPRLTHNLDTLPDPEARGKTEQALATLSRVGDVKDGKIPEISTAGDISTVAGILKEILSPKFDEQVKKSEAIINYVAAIAGQLVDEKVGEVESWTQNALPYITAIVGEEEAKTVAETLRKRASPDAAAEDAVLSDEEEGEDLCNCTFSLAYGAKILLNQTHLRLKRGQRYGLLGPNGTGKTTLMRAINNEQLEGFPKKDEVKTVYVEHDLDSADTEQTVIGWTMKKLREVGLDPKQEEVEAKLEEFGFLREQLNGPITALSGGWKMKLALARAVFEKPDILLLDEPTNHLDVKNVAWLENYLCTSPCTSIIVSHDSKFLDNVIQHVIHYERNFKLKRYRGTLSEFVKKVPSARSYYELGASDMEFKFPEPGFLEGVKTKAKAIIRVSNMSFQYPGTPRPQISDISFQVSLGSRIAVIGPNGAGKSTLVNVLTGELIPTTGDVYQHENIRIAYIKQHAFAHIDNHLDSTPSEYIQWRFQTGEDRETMDRANKIVTDEDEKAMDKIYKIDGTPRRVIGIHSRRKFKNTYEYECSFLLGDNIGMKSEKWTPMMTSDNAWIPRNEIIQSHAKMVAEVDQKEALASGQFRPLVRKEIEEHCAQFGLDAELVSHSRMRGLSGGQRVKVVLAACSWQRPHVIVLDEPTNYLDRDSLGALSKAIKTFEGGVVIITHSREFTENLTEEVWAVVDGKMTPSGHNWVQGQGSGPRLTEKTNEEDTFDAMGNKIEAPKKAKKLTSSEQRKKKKERMARKKRGEEVFSDEDDF

SEQ ID NO: 12797 - DNA, 3150 bp, Clavispora lusitaniae
  CDS (1)..(3150): transl_table=12
atgtctgccagtgaatccaagtactctgctgaagtcctttccgagttgttgagcaaattacaagttgctgacaacaaggaagaggccgctgccaacgtttcttctttcttgaactcttccatcattgaacacgacgttccttccgagttctttgccgacttgaagaagcgaatcaacaacaagagtgccgatgttgccgtggctgctttgaccgcatacactcacattgcctctgccaacgacatggctgcttctgttgagccatacattgtccaattggccactgacgttgccaccagaagtggtgacaagaacaaggatgttgctgctgctgctgagaaggctttgttggctattgccactgccatcaccccaactgccatcaaggctttgttgccaggtttgatggagaacttgtcttctaccaacaagtggactgagaaggttgccatcttgaaggctgtctcccaattggttgacactgccaagtctcaaatcgccttgagaatgcctgagttgattcattccttgtccgaggctatgtgggacaccaagaaggaggttaaggaggctgctcacgccaccatgaccaagtccaccgagaccattgacaacaaggatatcgagaagtttatccctaagttgattgagtgtatcgctaacccaactgaagtcccagagaccgtccacgtcttgggtgccaccactttcgtctctgaagtcaccatggccactttgtccatcatggctccattgttgtccagaggtttggctgagcgtgacactgccatcaagagaaaggctgctgttatcgtcgacaacatgtgtaagcttgtggatgacccacaagttgttgctcctttcttgagcaccttgttgccagctttgaacgccaacttctccaccattgctgacccagaagctcgtggtgttacccaaagagctttgaacaccttgagaagagttggtgccgttggtgctgatgacgctatcccagaggtttctaccgctggcgacattccagtcactttgggtgttttcgacgagttggttaaggacaagaagatcgcttccagattcgacgttgccaagacctacatcgccgccattgccggtgacttgattgacgagagagacattcaaccagactcttggttgaagaacatcttgccattcgccaccatcttcttgcacgaggctgacgccaatgaaatcattgaagagttcagaaagagagctgtcgacaacatcccagctcctccagctttcgaggacgaagaagatgacggagaggacttgtgtaactgtgagttctctttggcttacggtgctaagatcttgttgaacaagactcaattcagattgaagagaaacagaagatacggtttgtgtggtcctaacggtgctggtaagtctaccttgatgagagctattgccaacggccaagtcgaaggtttcccatctcaagacgaatgtaaaaccgtttacgtcgagcacgacattgacggtactgacgccgagacctctgttgttgacttcgttcttgccgacggtatggttggtttgaccaatgaagccgctgaggacaagttgagagagttctctttcactgaagaaatgatcaagatgccaatctcttctctttccggtggttggaagatgaagttggctttggccagagctgtgttgaagaacgctgacattttgttgttggatgagccaactaaccatttggacactgtcaacgtcgcttggttggtcaactacttgaagacctgtggtatcacttctatcattgtttcccacgactccggtttcttggacaatgttgttgagtacattatccactacgaaggtttcaagttgagaaagtacgagggtaacttgtctgagttcgtcaagaagtgcccatctgctcaatcttactacgagttgggtgcctctgaagttgaattcagattcccagaaccaggtttcttggagggtgttaagactaagcaaaaggctattgtcaaggtttccaacatgaccttccaatacccaggtacctctaagccacaaatcagagacatcaacttccagtgttcgttgtcttctagaattgctgtcattggtcctaacggtgccggtaagtctaccttgattaacgtcttgactggtgagttgttgccaactgagggtgaagtttacgtgcacgagaactgtcgtatcgcctacattaagcaacacgctttcgcccacatcgataaccacttggacaagactccatctgagtacattcaatggagattccagaccggtgaggacagagagaccatggacagagccaacagacaaatcaacgaggatgacgagaacgccatgaacaagatcttcaagatcgagggtaccccaagaagaattgctggtattcacggtagaagaaagttcaagaacacttacgagtacgagtgttctttcttgttgggtgagaacatcggcatgaagaacgagagatgggttccaatgatgtctgttgacaacgcctggttgccaagaggtgagttggttgagactcactccaagatggttgctgaagtcgacatgaaggaggctttggcttccggtcaattcagaccattgaccagaaaggaaatcgaagagcactgtgccatgttgggtttggacgctgaattggtttctcactctagaatcagaggtttgtctggtggtcaaaaggtcaagttggtcttggctgcttgtacctggcaaagacctcacttgattgtgttggatgagccaaccaactacttggaccgtgactctttgggtgctttgtccaaggctttgaagtctttcgagggtggtattgtcatcattactcactctgctgagttcaccaaggacttgactgaggaagtttgggccgttttggacggtagaatgactccttccggtcacaactgggtccaaggtcaaggtgctggtccaagattggagaagaaggacgacgacgaggaggacaagttcgatgctatgggtaacaagattgcctctgctaagaagaagaagaagttgtcttctgctgagttgagaaagaagaagaaggagagaatgaagaagaagaaggaattgggtgacgcctacgtttcctccgacgaggacttctaa

SEQ ID NO: 12798 - protein, 1049 aa, Clavispora lusitaniae
MSASESKYSAEVLSELLSKLQVADNKEEAAANVSSFLNSSIIEHDVPSEFFADLKKRINNKSADVAVAALTAYTHIASANDMAASVEPYIVQLATDVATRSGDKNKDVAAAAEKALLAIATAITPTAIKALLPGLMENLSSTNKWTEKVAILKAVSQLVDTAKSQIALRMPELIHSLSEAMWDTKKEVKEAAHATMTKSTETIDNKDIEKFIPKLIECIANPTEVPETVHVLGATTFVSEVTMATLSIMAPLLSRGLAERDTAIKRKAAVIVDNMCKLVDDPQVVAPFLSTLLPALNANFSTIADPEARGVTQRALNTLRRVGAVGADDAIPEVSTAGDIPVTLGVFDELVKDKKIASRFDVAKTYIAAIAGDLIDERDIQPDSWLKNILPFATIFLHEADANEIIEEFRKRAVDNIPAPPAFEDEEDDGEDLCNCEFSLAYGAKILLNKTQFRLKRNRRYGLCGPNGAGKSTLMRAIANGQVEGFPSQDECKTVYVEHDIDGTDAETSVVDFVLADGMVGLTNEAAEDKLREFSFTEEMIKMPISSLSGGWKMKLALARAVLKNADILLLDEPTNHLDTVNVAWLVNYLKTCGITSIIVSHDSGFLDNVVEYIIHYEGFKLRKYEGNLSEFVKKCPSAQSYYELGASEVEFRFPEPGFLEGVKTKQKAIVKVSNMTFQYPGTSKPQIRDINFQCSLSSRIAVIGPNGAGKSTLINVLTGELLPTEGEVYVHENCRIAYIKQHAFAHIDNHLDKTPSEYIQWRFQTGEDRETMDRANRQINEDDENAMNKIFKIEGTPRRIAGIHGRRKFKNTYEYECSFLLGENIGMKNERWVPMMSVDNAWLPRGELVETHSKMVAEVDMKEALASGQFRPLTRKEIEEHCAMLGLDAELVSHSRIRGLSGGQKVKLVLAACTWQRPHLIVLDEPTNYLDRDSLGALSKALKSFEGGIVIITHSAEFTKDLTEEVWAVLDGRMTPSGHNWVQGQGAGPRLEKKDDDEEDKFDAMGNKIASAKKKKKLSSAELRKKKKERMKKKKELGDAYVSSDEDF

SEQ ID NO: 12799 - DNA, 3135 bp, Saccharomyces cerevisiae
  CDS (1)..(3135)
atgtctgattcccagcaatccattaaggttctagaagaactattccagaagttatctgttgccactgctgacaacagacacgaaatcgcttctgaagtcgcttctttcttgaatggtaacatcattgaacatgatgttccagaacacttcttcggtgaattggccaagggtatcaaggacaagaagaccgctgctaacgccatgcaagctgttgctcacattgctaaccaatctaacttgtctccatctgttgaaccatacatcgtccaattggttccagctatctgtaccaacgcaggtaacaaggacaaagaaattcaatctgttgcttccgaaactttgatttccatcgttaacgctgttaacccagttgccatcaaagctttgttgccacatttgactaacgctattgtagaaactaacaaatggcaagaaaagattgctattttggcagctttctctgctatggtcgatgctgctaaggatcaagttgccctaagaatgccagaattgattccagtcttgtctgaaaccatgtgggacaccaagaaggaagtcaaggctgctgctactgccgccatgaccaaggctaccgaaactgttgacaacaaggatattgaacgtttcattccaagtttgattcaatgtattgctgacccaactgaagttccagaaaccgttcatttgctaggtgctactactttcgttgctgaagttactccagctactttgtccatcatggtcccattgttgtccagaggtttgaacgaaagagaaaccggtatcaagcgtaagtctgctgttattattgacaacatgtgtaagttggtcgaagacccacaagttattgctcctttcttgggtaaattgttgccaggtttgaagagtaactttgctaccattgctgacccagaagccagagaagttactttgagagctttgaagactttgagaagagttggtaacgttggtgaagacgatgctattccagaactttctcacgctggtgacgtttctactactttgcaagtcgttaacgaattgttgaaggacgaaaccgttgctccaagatttaagattgtcgtcgagtacattgccgccattggtgctgatttgatcgatgaaagaatcattgaccaacaagcttggttcacccacatcaccccatacatgactatcttcttgcacgaaaagaaggccaaggacatcttggacgaattcagaaagagagctgtcgacaacattccagttggtccaaacttcgacgacgaagaagacgaaggtgaagacttatgtaactgtgaattttctttggcttatggtgctaaaatcttgttgaacaagacccaattaagattgaagagagccagaagatatggtatctgtggtccaaacggttgtggtaagtccactttaatgagagctattgccaacggtcaagttgatggtttcccaacccaagaagaatgtagaaccgtctacgtcgaacacgacattgatggtactcactctgacacttccgtcttggatttcgttttcgaatctggtgttggtactaaagaagctatcaaggacaaattgattgaattcggtttcaccgatgaaatgattgctatgccaatctctgctttatctggtggttggaagatgaagttggctctagctagagctgtgttgagaaatgctgatatcttgttgttagatgaaccaactaaccatttggataccgtcaacgttgcttggttagttaactacttgaacacctgtggtatcacttctatcactatttctcacgactccgttttcttagataacgtctgtgaatatattattaactacgaaggtttgaagttgagaaagtacaagggtaactttaccgaattcgttaagaagtgtccagctgctaaggcttacgaagaattatccaacactgatttggaattcaagttcccagaaccaggttacttggaaggtgttaagactaagcaaaaggctattgtcaaggttaccaacatggaattccaatatccaggtacctctaagccacaaatcactgacattaacttccaatgttctttgtcttccagaattgctgtcattggtccaaatggtgctggtaagtctactttgattaacgtcttgactggtgaactattaccaacctctggtgaagtctacacccacgaaaattgtcgtatcgcttacattaagcaacacgcttttgctcatatcgaatctcatttggacaagactccatctgaatatatccaatggagattccaaaccggtgaagatagagaaaccatggacagagctaacagacaaatcaacgaaaacgatgctgaagctatgaacaagatcttcaagattgaaggtacccctagaagaattgccggtatccactccagaagaaagttcaagaacacttacgaatatgaatgttctttcttattgggtgaaaacattggtatgaaatctgaaagatgggttccaatgatgtccgtcgacaacgcttggattccaagaggtgaattggttgaatctcactctaagatggttgctgaagttgatatgaaggaagctttggcttctggtcaattccgtccattaaccagaaaagaaattgaagaacattgttccatgttgggtttggacccagaaattgtttctcactccagaattagaggtttgtctggtggtcaaaaggttaagttggtcttagctgccggtacatggcaaagacctcacttgattgtcttagatgaacctaccaactatctggacagagattctttgggtgctttgtctaaggctttgaaggaatttgaaggtggtgttattatcattactcactctgctgaattcacaaagaacttgactgaagaagtctgggccgtcaaggacggtagaatgactccatctggtcacaactgggttagtggtcaaggtgctggtccaagaatcgaaaagaaggaagacgaagaagataaattcgatgctatgggtaacaagattgccggtggtaagaagaagaagaagttgtcttctgcggaattgagaaagaagaagaaggaaagaatgaagaagaagaaggaattgggtgatgcttacgtttcttctgacgaagaattctaa

SEQ ID NO: 12800 - protein, 1044 aa, Saccharomyces cerevisiae
MSDSQQSIKVLEELFQKLSVATADNRHEIASEVASFLNGNIIEHDVPEHFFGELAKGIKDKKTAANAMQAVAHIANQSNLSPSVEPYIVQLVPAICTNAGNKDKEIQSVASETLISIVNAVNPVAIKALLPHLTNAIVETNKWQEKIAILAAFSAMVDAAKDQVALRMPELIPVLSETMWDTKKEVKAAATAAMTKATETVDNKDIERFIPSLIQCIADPTEVPETVHLLGATTFVAEVTPATLSIMVPLLSRGLNERETGIKRKSAVIIDNMCKLVEDPQVIAPFLGKLLPGLKSNFATIADPEAREVTLRALKTLRRVGNVGEDDAIPELSHAGDVSTTLQVVNELLKDETVAPRFKIVVEYIAAIGADLIDERIIDQQAWFTHITPYMTIFLHEKKAKDILDEFRKRAVDNIPVGPNFDDEEDEGEDLCNCEFSLAYGAKILLNKTQLRLKRARRYGICGPNGCGKSTLMRAIANGQVDGFPTQEECRTVYVEHDIDGTHSDTSVLDFVFESGVGTKEAIKDKLIEFGFTDEMIAMPISALSGGWKMKLALARAVLRNADILLLDEPTNHLDTVNVAWLVNYLNTCGITSITISHDSVFLDNVCEYIINYEGLKLRKYKGNFTEFVKKCPAAKAYEELSNTDLEFKFPEPGYLEGVKTKQKAIVKVTNMEFQYPGTSKPQITDINFQCSLSSRIAVIGPNGAGKSTLINVLTGELLPTSGEVYTHENCRIAYIKQHAFAHIESHLDKTPSEYIQWRFQTGEDRETMDRANRQINENDAEAMNKIFKIEGTPRRIAGIHSRRKFKNTYEYECSFLLGENIGMKSERWVPMMSVDNAWIPRGELVESHSKMVAEVDMKEALASGQFRPLTRKEIEEHCSMLGLDPEIVSHSRIRGLSGGQKVKLVLAAGTWQRPHLIVLDEPTNYLDRDSLGALSKALKEFEGGVIIITHSAEFTKNLTEEVWAVKDGRMTPSGHNWVSGQGAGPRIEKKEDEEDKFDAMGNKIAGGKKKKKLSSAELRKKKKERMKKKKELGDAYVSSDEEF

SEQ ID NO: 12801 - DNA, 3135 bp, Ashbya gossypii
  CDS (1)..(3135)
atgtctgattctgcgcagtctatcaaggttctaggtgaattgttcgagaagttgtctgtggctactgctgagaacagagaagcgaccgccacggaaattgcttcgttcttgaacgggaacatcatcgagcatgacgtgccagaggagttcttcaagaacctcaccaaggcggtgaaggacaagaagaccgcggctgcggctttggagacaattgcccacattgccaacgagaacaacctgtctccatccgtggagccatacatcgtggatctagttccagaggtgtgcgtcaagaccggtgacaaggacaaggatgtgcagtctattgcctccgagaccttgcttgccattgtcaaggcgatcgaccctgtggccatcaaggtcattcttccacatttgaccaagtcgctagttacgaccaacaagtggcaggagaaggtgtccgtcttggcggccatctctgcattggtcgacgcggctaagacccaggttgctttgagaatgcctgaattgatcccagtcttgtctgaggccatgtgggacaccaagaaggaggtcaagcacgccgccactgccaccatgaccaaggctaccgagactgtcgacaacaaggatatcgagcgtttcattcctgagttgatccagtgtattgccgacccatcccaggtctccgagaccgtgcatttgttgggtgccaccaccttcgttgctgaggtcactccagctactctatccatcatggttccattgttgaacagaggtttggctgagagagagacttccatcaagcgtaaggctgccgtcatcatcgacaacatgtgtaagttggtcgaagacccacaggttgttgctcctttcttggagaagttgttgccaggtttgaagaacaacttcgccaccattgctgaccctgaggcccgtgaggttaccttgagaggtttgaagaccttgagaagagtcggtaacgtcagcgacgacgacactttgccagaggtgtctcacgctggtgacatcgtcaccaccagaggtgtcttggatgagttgaccaaggataccccaattgctccaagatttgcgcctgtggtgaactacattgccgccattgctgcagacttgatcgacgagagaatcatcgaccagcaggcttggttcacgcacgtcactccatacatgaccgttttcttccacgagaagcagttcaaggagattattgacgacttcagaaagagagccgttgacaacattccagtcggtccaaacttctacgaccaggaagaccaaggtgaggacttgtgtaactgtgagttctccttggcctacggtgctaagatcttgttgaacaagactcagttgagattgaggagagccagaagatatggtctatgtggtcctaacggtgctggtaagtctaccttgatgagagctatcgccaacggtcaggttgacggtttcccaactcaagatgagtgtagaactgtctacgtcgagcacgacattgacggtactcaggccgacacctctgtcttggacttcgttttccagggtgacgttggcaccagggaggtcatcaccgagaagttgagagagttcggtttctccgacgagatgatcgccatgccaatcatgtccttgtctggtggttggaagatgaagttggctttggccagagctgtgttgaagaacgccgacatcttgttgttggacgagccaactaaccatttggacactgttaacgtcgcttggttggtgaactacttgaacacctgtggtatcacttccatcattgtgtcccacgactctggcttcttggacaatgtctgccagtacatcatccactatgaaggtttgaagttgagaaagtacaagggtaacttgtctgagttcgtcaagaagtgcccaactgctaagtcttactacgagttgggtgcctccgacttggagttcaagttcccagagccaggtttcctagagggtgtcaagaccaagcagaaggctattgtcaaggtctctaacatgtccttccagtacccaggtacctccaagccacaaatcgccgacattaacttccagtgctcgctttcttccagaattgccgtcattggtccaaacggtgccggtaagtctacgttgatcaacgttttgactggtgagctattgccaactactggtgaggtttacacccacgagaactgtagaattgcctacatcaagcagcatgcctttgctcacattgagaaccacttggacaagaccccatctgagtacattcagtggagattccagaccggtgaggacagagagaccatggacagagctaacagacagatcaacgagagcgatgctgagtccatgaacaagatcttcaagatcgacggtactccaagaagaattgctggcatccactccagaagaaagttcaagaacacctacgagtatgaatgttctttcttgttgggtgagaacattggcatgaagtctgagagatgggttccaatgatgtccgtcgacaacgcttggttgccaagaggtgagttgatcgagtctcactccaagatggttgctgaagttgacatgaaggaggctttggcttccggtcagttcagaccattgaccagaaaggagattgaggagcactgtgccatgttgggcttggaggccgagttggtttcccactctagaatcagaggtctatctggtggtcagaaggttaagttggtcttggctgcttgtacgtggcagagacctcacttgatcgtcttggatgagcctaccaactatttggacagagactctctaggtgctttgtccaaggctttgaaggcgttcgagggtggtgttatcatcatcactcactctgctgagttcaccaaggacttgactgaggaagtctgggctgtcaaggacggtatcatgactccttctggccacaactgggtcagcggtcagggttccggtccaagactagagaagaaggaggacgagggcgacaagttcgatgctatgggtaacaagattgctaccggtaacaagaagaagaagttgtcttccgccgagttgagaaagaagaagaaggagagaatgaagaagaagaaggagttgggtgacgcttatgtttcttctgacgatgaattttaa

SEQ ID NO: 12802 - protein, 1044 aa, Ashbya gossypii
MSDSAQSIKVLGELFEKLSVATAENREATATEIASFLNGNIIEHDVPEEFFKNLTKAVKDKKTAAAALETIAHIANENNLSPSVEPYIVDLVPEVCVKTGDKDKDVQSIASETLLAIVKAIDPVAIKVILPHLTKSLVTTNKWQEKVSVLAAISALVDAAKTQVALRMPELIPVLSEAMWDTKKEVKHAATATMTKATETVDNKDIERFIPELIQCIADPSQVSETVHLLGATTFVAEVTPATLSIMVPLLNRGLAERETSIKRKAAVIIDNMCKLVEDPQVVAPFLEKLLPGLKNNFATIADPEAREVTLRGLKTLRRVGNVSDDDTLPEVSHAGDIVTTRGVLDELTKDTPIAPRFAPVVNYIAAIAADLIDERIIDQQAWFTHVTPYMTVFFHEKQFKEIIDDFRKRAVDNIPVGPNFYDQEDQGEDLCNCEFSLAYGAKILLNKTQLRLRRARRYGLCGPNGAGKSTLMRAIANGQVDGFPTQDECRTVYVEHDIDGTQADTSVLDFVFQGDVGTREVITEKLREFGFSDEMIAMPIMSLSGGWKMKLALARAVLKNADILLLDEPTNHLDTVNVAWLVNYLNTCGITSIIVSHDSGFLDNVCQYIIHYEGLKLRKYKGNLSEFVKKCPTAKSYYELGASDLEFKFPEPGFLEGVKTKQKAIVKVSNMSFQYPGTSKPQIADINFQCSLSSRIAVIGPNGAGKSTLINVLTGELLPTTGEVYTHENCRIAYIKQHAFAHIENHLDKTPSEYIQWRFQTGEDRETMDRANRQINESDAESMNKIFKIDGTPRRIAGIHSRRKFKNTYEYECSFLLGENIGMKSERWVPMMSVDNAWLPRGELIESHSKMVAEVDMKEALASGQFRPLTRKEIEEHCAMLGLEAELVSHSRIRGLSGGQKVKLVLAACTWQRPHLIVLDEPTNYLDRDSLGALSKALKAFEGGVIIITHSAEFTKDLTEEVWAVKDGIMTPSGHNWVSGQGSGPRLEKKEDEGDKFDAMGNKIATGNKKKKLSSAELRKKKKERMKKKKELGDAYVSSDDEF

SEQ ID NO: 12803 - DNA, 3150 bp, Candida albicans
  CDS (1)..(3150): transl_table=12
atgtctgctgctagtgaatccaaatattctactgaagtgctttccgaattattgagcaaattacaagttgctgataataaggatgaagctgcttccaacatttccacttttttaaactcatctattgttgaacacgatgttccagttgaatttttcgaagatttgaaaaaacaaattcaatctaaagatgctaaagtttctcttgctgctttggatgcttacaaacacattgcttcaaccaacggtttatccccatccgttgaaccatatgttgttgacttggttagtgaagttgccgttaaagctggtgacaaaaacaaggatgttcaaactgctgcttctgatgctttattggccattgcttctgccatcaccccaactgctgtcaaagccatcttaccaaaattgattgacaacttgaccaacaccaacaaatggactgaaaaagttgccatcttgagagctgtttctcaattggttgacactgctaaagctcaaattgctttgagaatgcctgaattgattccagtcttgtctgaatctatgtgggataccaaaaaagaagtcaaagaagccgccactgctaccatgaccaaatccactgaaaccattgacaataaagatattgaaaaattcattcctcaattgatttcttgtattgccaaaccaactgaagtgccagaaaccgtccacttgttgggtgctaccacttttgtttctgaagttaccatggccactttgtcgattatggctccattgttgtctagaggtttagctgaaagagacactgctatcaaacgtaaagctgctgttattgttgataacatgtgtaaattggtcgaagatccacaaattgttgctccatttatggacaaattgttgccaggtttgaaaaactttgccaacatggctgatccagaagctagagaagttactcaaagagctttgaacactttaagaagagttggtgccgttggtgaaaacgatacgatcccagaagtttctactgctggtgatatcgatgtcactttgaatgaattcaacaaattggttgctgacaaaaaaatcgccaaaagatttgacgttgctttgaactatattgctgctattgctggtgatttggttgatgaaagagaaattcaaccagaagcttggttacaaaatgttttaccatttgccaccattttcttgcacgaaaaggaagctaaagaaatcattgaagaattcagaaagagagccattgacaacattccacaaccaccatcatttgaagatgaagaagatgaaggtgaagatttatgtaattgtgaattctctttggcttatggtgccaagatcttgttgaacaagacccaattcagattaaagagaaacagaagatatggtttgtgtggtccaaatggtgctggtaaatctactttgatgagagctattgctaacggtcaagttgaaggtttcccaacccaagacgaatgtaaaaccgtttacgttgaacacgatatcgatggtactcacgccgacaccaccgttgttgaattcgtcattgaagatggtgaagttggtttgaccaaagacgttgttgttgacaaattgagagaattcaatttctccgatgaaatgatcaacatgccaattcaatccttatctggtggttggaaaatgaaattggctttggctagagctgtgttgaagaatgccgatatcttgttgttggatgaaccaactaaccatttggatactgtcaatgttgcttggttagtcaactacttgaacacttgtggtattacttccattattgtttcccacgattccggtttcttggacaatgttactcaatatattatccattacgaaggtttcaaattaagaaaatacaagggtaacttgtctgaattcgtcaagaaatgtccatctgctcaatcttattacgaattaggtgcttctgatttggaatttagattcccagaaccaggtttcttggaaggggttaaaactaaacaaaaagctattgttaaagtttctaacatgtcattccaatacccaggtacttctaaaccacaaattcaagacattaacttccaatgttctttatcatctagaattgctgtcattggtccaaatggtgctggtaagtccaccttaattaacgttttgactggtgaattattaccaaccactggtgagttttacgtccacgaaaattgtcgtattgcttacattaaacaacatgcttttgctcatattgataaccatttggacaaaactccatctgaatatattcaatggagattccaaactggtgaagatagagaaaccatggatagagcctctagacaaatcaatgaagaagatgaacaaaacatgaacaagattttcaaaattgaaggtacaccaagaagaattgctggtattcacgccagaagaaagttcaagaactcttatgaatatgaaatttcttggatgttgggtgaaaacattggtatgaagaatgaaagatgggtaccaatgatgtctgttgacaacacttggttgccaagaggtgaattgatggaaactcacgccaagttggttgctgaagttgatatgaaagaagctttggcttctggtcaattcagaccattaaccagaaaagaaattgaagaacattgtgctatgttgggtttggatgccgaattggtttctcactctagaattagaggtttatctggtggtcaaaaagttaaattggtcttggctgcttgtacttggcaaagaccccatttgattgttttggatgaaccaaccaattatttggatagagattctttgggtgctttgtctaaagctttgaaagctttcgaaggtggtattgttatcattactcactctgctgaattcaccaaagatttgactgaagaagtctgggctgttttggacggtagaatgactccatctggtcacaattgggtccaaggtcaaggttctggtccaagaattgaaaagaaggatgatgaagaagaagataaattcgatgctatgggtaacaagattgccgctgctaagaagaagaagaagttatcttctgctgaattaagaaagaaaaagaaggaaagaatgaagaagaagaaggaattgggtgatgcttatgtctcatctgatgaagaattctaa

SEQ ID NO: 12804 - protein, 1049 aa, Candida albicans
MSAASESKYSTEVLSELLSKLQVADNKDEAASNISTFLNSSIVEHDVPVEFFEDLKKQIQSKDAKVSLAALDAYKHIASTNGLSPSVEPYVVDLVSEVAVKAGDKNKDVQTAASDALLAIASAITPTAVKAILPKLIDNLTNTNKWTEKVAILRAVSQLVDTAKAQIALRMPELIPVLSESMWDTKKEVKEAATATMTKSTETIDNKDIEKFIPQLISCIAKPTEVPETVHLLGATTFVSEVTMATLSIMAPLLSRGLAERDTAIKRKAAVIVDNMCKLVEDPQIVAPFMDKLLPGLKNFANMADPEAREVTQRALNTLRRVGAVGENDTIPEVSTAGDIDVTLNEFNKLVADKKIAKRFDVALNYIAAIAGDLVDEREIQPEAWLQNVLPFATIFLHEKEAKEIIEEFRKRAIDNIPQPPSFEDEEDEGEDLCNCEFSLAYGAKILLNKTQFRLKRNRRYGLCGPNGAGKSTLMRAIANGQVEGFPTQDECKTVYVEHDIDGTHADTTVVEFVIEDGEVGLTKDVVVDKLREFNFSDEMINMPIQSLSGGWKMKLALARAVLKNADILLLDEPTNHLDTVNVAWLVNYLNTCGITSIIVSHDSGFLDNVTQYIIHYEGFKLRKYKGNLSEFVKKCPSAQSYYELGASDLEFRFPEPGFLEGVKTKQKAIVKVSNMSFQYPGTSKPQIQDINFQCSLSSRIAVIGPNGAGKSTLINVLTGELLPTTGEFYVHENCRIAYIKQHAFAHIDNHLDKTPSEYIQWRFQTGEDRETMDRASRQINEEDEQNMNKIFKIEGTPRRIAGIHARRKFKNSYEYEISWMLGENIGMKNERWVPMMSVDNTWLPRGELMETHAKLVAEVDMKEALASGQFRPLTRKEIEEHCAMLGLDAELVSHSRIRGLSGGQKVKLVLAACTWQRPHLIVLDEPTNYLDRDSLGALSKALKAFEGGIVIITHSAEFTKDLTEEVWAVLDGRMTPSGHNWVQGQGSGPRIEKKDDEEEDKFDAMGNKIAAAKKKKKLSSAELRKKKKERMKKKKELGDAYVSSDEEF

SEQ ID NO: 12805 - DNA, 3138 bp, Candida glabrata
  CDS (1)..(3138)
atgactgactctgaccaatctcttaaagttctagaagagcttttcaagaacctttctgtggctactgctgacaaccgtgtcgaagctgcccaagaggttgcttctttcttgaacggtaacatcatcgaacatgatatcccagaaaagttctttgaggagttggctaaggctgtcaaggacaagaagacttccgctaacttcttggaagccgttgcccacatcgctaacgaagctaacttgtctccatccgtcgagccattcgtcatcactttggtcccagaaatctgcgccaaggccggtgacaaggacaaggatgtccaagctgttgcttccaagactttggtcgccatctccaaggccatcaacccagtcgccatcaaggcttacttgcctcacttgaccaagtccttggaaaccaccaacaagtggcaagaaaaggtctccgtcttggccgccatctccgctcttgttgatgccgctaaggaacaagtcgccctaagaatgcctgaattgatcccagtcttgtctgaaaccatgtgggacaccaagaaggaagtcaaggaggctgctaccgccaccatgaccaaggccaccgagaccgtcgacaacaaggatatcgagcgtttcatccctcaattgatctcctgtatcgctgatccaaagcaagtcccagaaaccgtccacttgctaggtgccaccactttcgtcgctgaagtcaccccagctactttgtccatcatggtcccattgttgtccagaggtctagctgaaagagaaacctctatcaagcgtaaggctgccgtcattatcgacaacatgtgtaagttggtcgaagacccacaagtcgttgctcctttcttggacaagctattgccaggtttgaagaacaactacgccaccattgccgacccagaagctcgtgaagttactttgagaggtctaaagaccttgagaagagtcggtaacgttaccgaggacgatgtcttgccagaaatctcccacgccggtgacatcgaaaccactctaggtgtcatcaacgaattgttgaagggcgaaaacgtcgctccaagattcaagattgtcgttgaatacatcgccgctatggccggtgacttgatcgacgaaagagtcattgaccaacaagcttggttcactcacatcactccatacatgaccatcttcatgcatgaaagaaacgccaaggacgtcttggatgaattcagaaagagagccgtcgacaacatcccagttggtccaaacttcgacgacgaagaagacgaaggtgaagacctatgtaactgtgagttctccttggcttacggtgctaagatcttgttgaacaagacccaattgagactaaagagaggtagaagatacggtctatgtggtccaaacggtgctggtaagtctactttgatgagagccatcgctaacggtcaagtcgacggtttcccaaccccagaagaatgtatgactgtctacgtcgaacacgacattgacggtacccacgctgacacttctgtcttggacttcgtcgtctcctctgaagtcggtaccaaggaagctatcaccgctaagttggttgaattcggtttcactgaagaaatgatcaacatgccaatctcctccttgtccggtggttggaagatgaagttggctctagccagagctgtcttgaagaacgctgatatcctattgttggatgaaccaactaaccatttggataccgtcaacgtcgcttggttggtcaactacctaaacacctgtggtatcacctccgtcattgtctcccacgactccggtttcttggacaatgtctgtcaatacattatccactacgaaggtttgaagttgagaaagtacaagggtaacttgtctgaattcgtcaagaagtgcccaactgctcaatcttactacgaactaggtgcctccgacttggagttcaagttcccagaaccaggttacctagaaggtgttaagaccaagcaaaaggctattgtcaaggtctccaacatgaccttccaatacccaggtacttccaagccacaaatctctgacatctccttccaatgttctttgtcttcaagaattgctgtcattggtccaaacggtgctggtaagtctaccttgattaacgtcttgaccggtgaattgctaccaacctccggtgaagtctacactcacgagaactgtcgtatcgcttacattaagcaacacgctttcgctcacatcgaatcccacttggacaagactccatctgaatatatccaatggagattccaaactggtgaagatagagaaaccatggacagagctaacagacaaatcaacgaaaacgatgctgaagctatgaacaagatcttcaagatcgaaggtaccccaagaagaattgctggtatccacgctagaagaaagttcaagaacacctacgagtacgaatgttctttcttgttgggtgaaaacatcggtatgaagtctgaaagatgggtcccaatgatgtctgttgacaacgcttggattccaagaggtgaattggtcgaatcccactccaagatggttgctgaagttgatatgaaggaagctttggcctccggtcaattccgtcctttgaccagaaaggaaattgaagagcactgtgctatgttgggtctagacgctgaattggtctcccactccagaatcagaggtttgtctggtggtcaaaaggttaagttggtcttggctgcttgttcttggcaaagacctcacttgatcgtcttggatgaacctactaactatttggacagagactccctaggtgctttgtccaaggctttgaaggctttcgaaggtggtgttattatcattactcactctgctgaattcaccaagaacttgactgaagaagtctgggccgtcaaggacggtaagatgactccatccggtcacaactgggtcagcggtcaaggtgctggtccaagaatcgagaagaaggaagacgaagaagacaagttcgatgctatgggtaacaagattgccggtggtaagaagaagaagaagttgtcttctgctgaattgagaaagaagaagaaggagagaatgaagaagaagaaggaattgggtgatgcttacgtttcttccgatgacgaagatttctaa

SEQ ID NO: 12806 - protein, 1045 aa, Candida glabrata
MTDSDQSLKVLEELFKNLSVATADNRVEAAQEVASFLNGNIIEHDIPEKFFEELAKAVKDKKTSANFLEAVAHIANEANLSPSVEPFVITLVPEICAKAGDKDKDVQAVASKTLVAISKAINPVAIKAYLPHLTKSLETTNKWQEKVSVLAAISALVDAAKEQVALRMPELIPVLSETMWDTKKEVKEAATATMTKATETVDNKDIERFIPQLISCIADPKQVPETVHLLGATTFVAEVTPATLSIMVPLLSRGLAERETSIKRKAAVIIDNMCKLVEDPQVVAPFLDKLLPGLKNNYATIADPEAREVTLRGLKTLRRVGNVTEDDVLPEISHAGDIETTLGVINELLKGENVAPRFKIVVEYIAAMAGDLIDERVIDQQAWFTHITPYMTIFMHERNAKDVLDEFRKRAVDNIPVGPNFDDEEDEGEDLCNCEFSLAYGAKILLNKTQLRLKRGRRYGLCGPNGAGKSTLMRAIANGQVDGFPTPEECMTVYVEHDIDGTHADTSVLDFVVSSEVGTKEAITAKLVEFGFTEEMINMPISSLSGGWKMKLALARAVLKNADILLLDEPTNHLDTVNVAWLVNYLNTCGITSVIVSHDSGFLDNVCQYIIHYEGLKLRKYKGNLSEFVKKCPTAQSYYELGASDLEFKFPEPGYLEGVKTKQKAIVKVSNMTFQYPGTSKPQISDISFQCSLSSRIAVIGPNGAGKSTLINVLTGELLPTSGEVYTHENCRIAYIKQHAFAHIESHLDKTPSEYIQWRFQTGEDRETMDRANRQINENDAEAMNKIFKIEGTPRRIAGIHARRKFKNTYEYECSFLLGENIGMKSERWVPMMSVDNAWIPRGELVESHSKMVAEVDMKEALASGQFRPLTRKEIEEHCAMLGLDAELVSHSRIRGLSGGQKVKLVLAACSWQRPHLIVLDEPTNYLDRDSLGALSKALKAFEGGVIIITHSAEFTKNLTEEVWAVKDGKMTPSGHNWVSGQGAGPRIEKKEDEEDKFDAMGNKIAGGKKKKKLSSAELRKKKKERMKKKKELGDAYVSSDDEDF

SEQ ID NO: 12807 - DNA, 3129 bp, Pneumocystis carinii
  CDS (1)..(3129)
atgccagggaatgtagtatctcctaaagttttgatggatttaataccaaaattaaaaatttctatgcaagaaacggataaaaatgaagtaataaaaaattcagagcaacattcatctgtttcatgggatccagatacttgtgaaaacttatatattacgctggaagagcaaattgaatcaaaagatacattagctcgagaacaagccttaaaagcactattattaacattagatgcaacaaataaaagagttgagccgtatctggttcgtttattaccgagggttctgaagcaagttggtttggagaaggtggcagccgtccgaacacaagcatctacggttgctgaagatattattaaaacaatgaatccatatgcagttaaaacaatactttcccatgtcacaaattcgattaaaacatcgggaaaatggatggaaaagatgtgcgcattccgattactggatatgctggttgaaaaggcgccgtgccagatgtcatatagacttccggaattaattccaattttatcagaatctatgtgggatacaagaacagatattaagaatcaagcacgtaaaacgatgacgagtgtttgtacattaatatctaatccggatattgataagtttattccggttcttattgattgtattgcccaaccggaaaaagttccggaaaccattcatacgcttggtgcaacgacatttgttcaagaagtacatgcgtcaacgttgtccattatggttcctttgctttaccggggtttaaatgagcgtgagacaacgattaaacgaaaatccgctgtaattattgacaatatgtgtaaactcgttgaagatccttatattattgcaccatttttaccgaagctgataccaacgcttgaacatattaaagaaacgattggagaccccgaatgtaggtcagtagttaaccgctctttagctacattgattcgtgttggaaatgttaaagaaggaaaaatacccgaggttttgaatatcgctaagccagaaaattgtatggaaacacttctttcaattcttaaagggcaggaactagtaccggtatcggatgtttatttaaattatatttcatgtatagcatctcagcttattgatgagaagaacaatgaagttgttgattgggatgttaacatttctccatatctgcaacctattatactcaaggcagatattaattgtatcattgatcaatttaggaaacgatctatttcgggtttccatagttcttccgctgaatcagaagaggaagaaggagaagatttatgtaattgcgaattttctcttgcatatggtgcaaaaattcttttaaacaggacatccctgaatctcaagcgtggttatagatatggtctttgtgggcctaatggttccggaaagtcaactcttcttcgctctatttttaacggtcaacttgagggttttcctacagaattaaagacagcatatgtcgaacatgatatcgatgatacggaatcaaaaacatctgtttttgattttatagcaaatgatccatcagtcgttgttaagaataaacaggaagtaataagttcgcttttggaacattcttttacggaggatatgctttcaatccctatttccaatctttctggtggatggaagatgaaattagctcttgttcgtgctatgcttcgacaggtcgacattttattgttagatgaacccacgaatcatttggacgtaaagaatgttgcctggctcgagaatttcctaacttcacaaactcatattactagcattattgtttcacacgattctaagttcttggataacgtcgttcaagctatcattcattacgaacattttaaacttaaaaaatatatgggtaatatgagtaaatttattacattagttccatctgctcggtcttatcaagacatttctatgtctgaaattgagttttcatttccagaaccaggttacttggagggagttaagactaagcagcgtgctatttgtcgtatgcgagacatagaatttcaatacgaaggaactagcgagcctcaaattaaaaatgtttcgctccaggtttctttatcatcacgtattgctgttataggtcccaatggtgcaggaaaatctaccttaattaaagttctttgtggtgaacttatcccacaaaaaggtgaagtttggtgccatcctaatcttcgaattgcatatgttgctcaagctgcatttgtacacctgggttctcatgaaaataaaacgccatctgaatatattcaatggagataccgaactgcggaagattccgaaaccatagatagagcctctcgacaattaacagaaaatgatgaacaccttatgaacaagatctttaaaatcaatggaaccagtagaaaaattcaaggaatacattctcgaaggaagcttaaaaactcgtatgaatacgaatgttcatttcttgttggagaaaatgttggagaaaaaaatgaacgatgggtaccattacctagtatgaataatgaatggttaccacgaggagaattgattgaatctcattccaaaatggtcgcagaggttgacatgaaagaagctctaaaatcaggatcttttcgtcctttagttcgtaaagaaattgagaaacattgcgaaagttttggacttgatgcagaaattgttacacattcgagaattaaaggcttatcaggtggtcagaaagttaaacttgtccttgcagctggttcatggttaaaacctcatgttattgttttagacgagcctacgaattatcttgatcgtgattctttaggcgctctttctaaagctcttaaaagtttcgaaggaggtgttgttatcattacacattcagtcgagtttacaaagaatcttactgaagaagtttggagtgtgcaaaatggacaaatgacaccatctgggcataactgggttcaaggtcaaggaacaggacctaggcttcaagaacaagaggaggaggatacgtttgatgcattgggtaataaaattgaggcaaaaaagaaggccaaaaaattaaccagttccgaattaagaaagaagaaaaaggaacgtatggctagacgtaaaaaaggtgaagaagtcttttccgatgaagatgattag

SEQ ID NO: 12808 - protein, 1042 aa, Pneumocystis carinii
MPGNVVSPKVLMDLIPKLKISMQETDKNEVIKNSEQHSSVSWDPDTCENLYITLEEQIESKDTLAREQALKALLLTLDATNKRVEPYLVRLLPRVLKQVGLEKVAAVRTQASTVAEDIIKTMNPYAVKTILSHVTNSIKTSGKWMEKMCAFRLLDMLVEKAPCQMSYRLPELIPILSESMWDTRTDIKNQARKTMTSVCTLISNPDIDKFIPVLIDCIAQPEKVPETIHTLGATTFVQEVHASTLSIMVPLLYRGLNERETTIKRKSAVIIDNMCKLVEDPYIIAPFLPKLIPTLEHIKETIGDPECRSVVNRSLATLIRVGNVKEGKIPEVLNIAKPENCMETLLSILKGQELVPVSDVYLNYISCIASQLIDEKNNEVVDWDVNISPYLQPIILKADINCIIDQFRKRSISGFHSSSAESEEEEGEDLCNCEFSLAYGAKILLNRTSLNLKRGYRYGLCGPNGSGKSTLLRSIFNGQLEGFPTELKTAYVEHDIDDTESKTSVFDFIANDPSVVVKNKQEVISSLLEHSFTEDMLSIPISNLSGGWKMKLALVRAMLRQVDILLLDEPTNHLDVKNVAWLENFLTSQTHITSIIVSHDSKFLDNVVQAIIHYEHFKLKKYMGNMSKFITLVPSARSYQDISMSEIEFSFPEPGYLEGVKTKQRAICRMRDIEFQYEGTSEPQIKNVSLQVSLSSRIAVIGPNGAGKSTLIKVLCGELIPQKGEVWCHPNLRIAYVAQAAFVHLGSHENKTPSEYIQWRYRTAEDSETIDRASRQLTENDEHLMNKIFKINGTSRKIQGIHSRRKLKNSYEYECSFLVGENVGEKNERWVPLPSMNNEWLPRGELIESHSKMVAEVDMKEALKSGSFRPLVRKEIEKHCESFGLDAEIVTHSRIKGLSGGQKVKLVLAAGSWLKPHVIVLDEPTNYLDRDSLGALSKALKSFEGGVVIITHSVEFTKNLTEEVWSVQNGQMTPSGHNWVQGQGTGPRLQEQEEEDTFDALGNKIEAKKKAKKLTSSELRKKKKERMARRKKGEEVFSDEDD

SEQ ID NO: 12809 - DNA, 3144 bp, Schizosaccharomyces pombe
  CDS (1)..(3144)
atgtctgcaaagagtgagaataagcagtcagtcaaagctcttgaagagttgttgaagcaccttactgtctgcgatgccgcagaggaagctgatgctgccaaggctttggcttcttttgtcaacggacccatcgaagagcaagacgcgccttctcaagttttctctgctatttccaagcagttgaacgacaagaacgccactgctcgtgagcgtgtcttgaagggtcttgaggccgttgccaaccatggtagtgttgccgctgatgtcgagccttacttggtcgagttgttgcccgccgtcatcgccaaggttgctgacaagcaaaacgctgtcagagatgctgccattgctgcttctaaggctattgtccgttgcactaccccttatgccgtcaaggccatcgtcccctctgttctcgagtccatccacaccactggtaagtggaatgagaagatgaactctttgcaacttttggatgttctcgttgaggttgctccttcccaattatcctactcccttcctcaaattatccctgttgtttccgagtccatgtgggataccaaggctgaggttaagaagcaatccaaggaaaccatgaccaaggtctgtactttgattgccaacgccgatattgaccgtttcattcctgagcttatcaactgtattgctcaccccgaggaggtccctgagactattcactctttgggtgccactactttcgttactgaagtccaggcccccactttgtctatcatggtccccttgttggcccgtggtttgaatgagcgttccactcccattaagcgtaagactgctgtcattattgacaacatgtccaagcttgtcgaggatcctcaagtcgtcgctcctttcttgcccaagcttttgcctggtttgtaccacatcaaggacaccattggtgaccctgaatgtcgttccgttgttcaacgtgccatcaccactttagagcgtgttggtaacgttgttgacggtaagatccctgaggtttctaccgccgccaaccctgaagtttgtctcgaaactttgaaggctgttctcggtgagatcaaggtccccaccaacgaggaggttattgctaagtacgttgctaacattgctgcccaactcgttgaagagaaggataacgaaaatgagtcctgggttctcaacatcactccttacttgactgccttcattgacgaggcccacattcacaagatcgttgagcaactccgtacccgctctatcgccaagattcctggtggtgcttctcatgctgaggaggaagaggagggtgaggatctttgcaactgtgagttctctcttgcttatggtgccaagattcttcttaaccgtactcgtctccgtcttaagcgtggtcgtcgttatggtctttgcggtcctaacggttccggtaagtctacccttatgcgtgccattgtcaacggtcaagttgaaggtttccctactcatctccgtaccgtctacgttgagcacgatatcgacgagtctgaagccgacactccttccgtcgatttcattctccaagatcccgctgtccccatcaaggaccgtgatgaaattgtcaaggctttgaaggagaactctttcaccgatgaactcattaacatgcctatcggttccctttctggtggttggaagatgaaattggctcttacccgtgctatgttcaagaaccccgatattcttttgcttgatgagcctaccaaccatcttgacgttgtcaatgttgcctggttggagaactttttggttaaccaaaaggatgtttcttccatcattgtctctcacgactctggtttcttggaccacgttgttcaagccattatccactacgagcgtttcaagcttcgtaagtatcttggtaacatgtccgagttcgttaagaaggttccttccgccaagtcctactatgagttgggtgcctccgaaatggaattcaaattccctgaacccggtttcttggaaggtgttaagaccaagcaacgtgctatcatcaaggtccaacacatgtctttccaataccctggtacctcaaagcctcaattgaacgacatttctttccaagtttctctctcttctcgtattgccgttattggtcccaacggtgccggtaaatctaccttgattaaggttcttactggtgaattgttgcccactgttggtgaaatttaccaacacgagaactgccgtatcgcctacgttgcccaagccgctttcactcacttgggtcatcaccctgataagactccctcagaatatatccaatggcgtttccaatctggtgaagatttggaggctatggataaggcttctcgtgtcatcagcgaggctgatgaggaggctatgaagaacaagatcttcaagattgagggaactcaacgtaagattttgggtatccacagccgtcgtaagctcaagaactcttatgagtatgagtgctctttcctcgtcggtgagaacattggcatgaagagtgagcgctgggttcctatgatgtcttccgacaatgcttggttacctcgtggtgaacttatggagactcacgctaagatggttgctgaagttgaccgtgctgaggccttgaagagtggtcaattccgtcccttggtccgtaaggagattgaggagcactgcagccttttgggtcttgatgctgagttggtttctcactctcgtatcaagggtctttctggtggacaaaaggtcaagcttgtcttggctgcttgtacctggttgcgtcctcacgtcatcgttcttgacgagcctaccaactatcttgatcgtgactctcttggtgctctttccaagggtcttaagaactttggtggtggtgtcgttttggtcactcactcccgtgagttcactgaaggtttgactgaggaagtttgggctgtcaacaacggtcacatgactccttccggtcacaactgggtttccggtcaaggttctggtcctcgtatccaagagaaggaggagggcgatacttttgatgctttcggtaacaaaattgaaaaggctaagaaggccaagaagctcactggtgctgagctccgtaagaagaagaaggagcgtatggctcgtcgtaaggctggtcttgaggtcagtgacgatgagctgtaa

SEQ ID NO: 12810 - protein, 1047 aa, Schizosaccharomyces pombe
MSAKSENKQSVKALEELLKHLTVCDAAEEADAAKALASFVNGPIEEQDAPSQVFSAISKQLNDKNATARERVLKGLEAVANHGSVAADVEPYLVELLPAVIAKVADKQNAVRDAAIAASKAIVRCTTPYAVKAIVPSVLESIHTTGKWNEKMNSLQLLDVLVEVAPSQLSYSLPQIIPVVSESMWDTKAEVKKQSKETMTKVCTLIANADIDRFIPELINCIAHPEEVPETIHSLGATTFVTEVQAPTLSIMVPLLARGLNERSTPIKRKTAVIIDNMSKLVEDPQVVAPFLPKLLPGLYHIKDTIGDPECRSVVQRAITTLERVGNVVDGKIPEVSTAANPEVCLETLKAVLGEIKVPTNEEVIAKYVANIAAQLVEEKDNENESWVLNITPYLTAFIDEAHIHKIVEQLRTRSIAKIPGGASHAEEEEEGEDLCNCEFSLAYGAKILLNRTRLRLKRGRRYGLCGPNGSGKSTLMRAIVNGQVEGFPTHLRTVYVEHDIDESEADTPSVDFILQDPAVPIKDRDEIVKALKENSFTDELINMPIGSLSGGWKMKLALTRAMFKNPDILLLDEPTNHLDVVNVAWLENFLVNQKDVSSIIVSHDSGFLDHVVQAIIHYERFKLRKYLGNMSEFVKKVPSAKSYYELGASEMEFKFPEPGFLEGVKTKQRAIIKVQHMSFQYPGTSKPQLNDISFQVSLSSRIAVIGPNGAGKSTLIKVLTGELLPTVGEIYQHENCRIAYVAQAAFTHLGHHPDKTPSEYIQWRFQSGEDLEAMDKASRVISEADEEAMKNKIFKIEGTQRKILGIHSRRKLKNSYEYECSFLVGENIGMKSERWVPMMSSDNAWLPRGELMETHAKMVAEVDRAEALKSGQFRPLVRKEIEEHCSLLGLDAELVSHSRIKGLSGGQKVKLVLAACTWLRPHVIVLDEPTNYLDRDSLGALSKGLKNFGGGVVLVTHSREFTEGLTEEVWAVNNGHMTPSGHNWVSGQGSGPRIQEKEEGDTFDAFGNKIEKAKKAKKLTGAELRKKKKERMARRKAGLEVSDDEL

SEQ ID NO: 12811 - DNA, 26 bp, Artificial sequence
  primer
atgtcagattcacaacaatcaatcac

SEQ ID NO: 12812 - DNA, 27 bp, Artificial sequence
  primer
ttaaaaatcttcatcagaagaaacgta

SEQ ID NO: 12813 - protein, 1128 aa, Artificial sequence
  consensus sequence
  Variant (2)..(4): Xaa in position 2 to 4 is any amino acid
  Variant (6)..(7): Xaa in position 6 to 7 is any amino acid
  Variant (9)..(11): Xaa in position 9 to 11 is any amino acid
  Variant (13)..(29): Xaa in position 13 to 29 is any amino acid
  Variant (30)..(32): Xaa in position 30 to 32 is any or no amino acid
  Variant (34)..(41): Xaa in position 34 to 41 is any amino acid
  Variant (42)..(50): Xaa in position 42 to 50 is any or no amino acid
  Variant (52)..(59): Xaa in position 52 to 59 is any amino acid
  Variant (60)..(64): Xaa in position 60 to 64 is any or no amino acid
  Variant (66)..(69): Xaa in position 66 to 69 is any amino acid
  Variant (71)..(83): Xaa in position 71 to 83 is any amino acid
  Variant (84)..(86): Xaa in position 84 to 86 is any or no amino acid
  Variant (88)..(93): Xaa in position 88 to 93 is any amino acid
  Variant (94)..(100): Xaa in position 94 to 100 is any or no amino acid
  Variant (104)..(105): Xaa in position 104 to 105 is any amino acid
  Variant (107)..(116): Xaa in position 107 to 116 is any amino acid
  Variant (117)..(117): Xaa in position 117 is any or no amino acid
  Variant (119)..(119): Xaa in position 119 is any amino acid
  Variant (121)..(127): Xaa in position 121 to 127 is any amino acid
  Variant (129)..(134): Xaa in position 129 to 134 is any amino acid
  Variant (136)..(140): Xaa in position 136 to 140 is any amino acid
  Variant (142)..(142): Xaa in position 142 is any amino acid
  Variant (144)..(144): Xaa in position 144 is any amino acid
  Variant (146)..(147): Xaa in position 146 to 147 is any amino acid
  Variant (150)..(159): Xaa in position 150 to 159 is any amino acid
  Variant (160)..(160): Xaa in position 160 is any or no amino acid
  Variant (163)..(163): Xaa in position 163 is any amino acid
  Variant (166)..(168): Xaa in position 166 to 168 is any amino acid
  Variant (170)..(174): Xaa in position 170 to 174 is any amino acid
  Variant (177)..(178): Xaa in position 177 to 178 is any amino acid
  Variant (180)..(181): Xaa in position 180 to 181 is any amino acid
  Variant (183)..(185): Xaa in position 183 to 185 is any amino acid
  Variant (187)..(187): Xaa in position 187 is any amino acid
  Variant (193)..(194): Xaa in position 193 to 194 is any amino acid
  Variant (197)..(197): Xaa in position 197 is any amino acid
  Variant (203)..(203): Xaa in position 203 is any amino acid
  Variant (207)..(208): Xaa in position 207 to 208 is any amino acid
  Variant (210)..(214): Xaa in position 210 to 214 is any amino acid
  Variant (216)..(221): Xaa in position 216 to 221 is any amino acid
  Variant (222)..(222): Xaa in position 222 is any or no amino acid
  Variant (227)..(228): Xaa in position 227 to 228 is any amino acid
  Variant (232)..(232): Xaa in position 232 is any amino acid
  Variant (235)..(235): Xaa in position 235 is any amino acid
  Variant (239)..(239): Xaa in position 239 is any amino acid
  Variant (241)..(242): Xaa in position 241 to 242 is any amino acid
  Variant (243)..(243): Xaa in position 243 is any or no amino acid
  Variant (248)..(248): Xaa in position 248 is any amino acid
  Variant (250)..(250): Xaa in position 250 is any amino acid
  Variant (258)..(258): Xaa in position 258 is any amino acid
  Variant (261)..(263): Xaa in position 261 to 263 is any amino acid
  Variant (266)..(267): Xaa in position 266 to 267 is any amino acid
  Variant (269)..(269): Xaa in position 269 is any amino acid
  Variant (273)..(273): Xaa in position 273 is any amino acid
  Variant (277)..(277): Xaa in position 277 is any amino acid
  Variant (280)..(280): Xaa in position 280 is any amino acid
  Variant (282)..(282): Xaa in position 282 is any amino acid
  Variant (287)..(287): Xaa in position 287 is any amino acid
  Variant (291)..(291): Xaa in position 291 is any amino acid
  Variant (299)..(299): Xaa in position 299 is any amino acid
  Variant (302)..(304): Xaa in position 302 to 304 is any amino acid
  Variant (308)..(310): Xaa in position 308 to 310 is any amino acid
  Variant (312)..(312): Xaa in position 312 is any amino acid
  Variant (314)..(314): Xaa in position 314 is any amino acid
  Variant (316)..(322): Xaa in position 316 to 322 is any amino acid
  Variant (323)..(323): Xaa in position 323 is any or no amino acid
  Variant (329)..(334): Xaa in position 329 to 334 is any amino acid
  Variant (336)..(336): Xaa in position 336 is any amino acid
  Variant (339)..(339): Xaa in position 339 is any amino acid
  Variant (343)..(349): Xaa in position 343 to 349 is any amino acid
  Variant (350)..(350): Xaa in position 350 is any or no amino acid
  Variant (353)..(383): Xaa in position 353 to 383 is any amino acid
  Variant (384)..(395): Xaa in position 384 to 395 is any or no amino acid
  Variant (397)..(397): Xaa in position 397 is any amino acid
  Variant (399)..(403): Xaa in position 399 to 403 is any amino acid
  Variant (405)..(405): Xaa in position 405 is any amino acid
  Variant (408)..(414): Xaa in position 408 to 414 is any amino acid
  Variant (416)..(420): Xaa in position 416 to 420 is any amino acid
  Variant (421)..(421): Xaa in position 421 is any or no amino acid
  Variant (423)..(432): Xaa in position 423 to 432 is any amino acid
  Variant (433)..(434): Xaa in position 433 to 434 is any or no amino acid
  Variant (436)..(442): Xaa in position 436 to 442 is any amino acid
  Variant (445)..(458): Xaa in position 445 to 458 is any amino acid
  Variant (459)..(462): Xaa in position 459 to 462 is any or no amino acid
  Variant (464)..(464): Xaa in position 464 is any amino acid
  Variant (473)..(473): Xaa in position 473 is any amino acid
  Variant (486)..(486): Xaa in position 486 is any amino acid
  Variant (488)..(489): Xaa in position 488 to 489 is any amino acid
  Variant (494)..(495): Xaa in position 494 to 495 is any amino acid
  Variant (499)..(499): Xaa in position 499 is any amino acid
  Variant (505)..(505): Xaa in position 505 is any amino acid
  Variant (515)..(515): Xaa in position 515 is any amino acid
  Variant (520)..(520): Xaa in position 520 is any amino acid
  Variant (524)..(524): Xaa in position 524 is any amino acid
  Variant (525)..(526): Xaa in position 525 to 526 is any or no amino acid
  Variant (528)..(529): Xaa in position 528 to 529 is any amino acid
  Variant (532)..(532): Xaa in position 532 is any amino acid
  Variant (537)..(537): Xaa in position 537 is any amino acid
  Variant (539)..(556): Xaa in position 539 to 556 is any amino acid
  Variant (557)..(561): Xaa in position 557 to 561 is any or no amino acid
  Variant (563)..(569): Xaa in position 563 to 569 is any amino acid
  Variant (571)..(571): Xaa in position 571 is any amino acid
  Variant (573)..(574): Xaa in position 573 to 574 is any amino acid
  Variant (576)..(582): Xaa in position 576 to 582 is any amino acid
  Variant (585)..(586): Xaa in position 585 to 586 is any amino acid
  Variant (598)..(598): Xaa in position 598 is any amino acid
  Variant (601)..(605): Xaa in position 601 to 605 is any amino acid
  Variant (619)..(620): Xaa in position 619 to 620 is any amino acid
  Variant (623)..(623): Xaa in position 623 is any amino acid
  Variant (626)..(627): Xaa in position 626 to 627 is any amino acid
  Variant (630)..(634): Xaa in position 630 to 634 is any amino acid
  Variant (635)..(635): Xaa in position 635 is any or no amino acid
  Variant (645)..(645): Xaa in position 645 is any amino acid
  Variant (649)..(649): Xaa in position 649 is any amino acid
  Variant (651)..(653): Xaa in position 651 to 653 is any amino acid
  Variant (659)..(660): Xaa in position 659 to 660 is any amino acid
  Variant (661)..(661): Xaa in position 661 is any or no amino acid
  Variant (664)..(665): Xaa in position 664 to 665 is any amino acid
  Variant (667)..(667): Xaa in position 667 is any amino acid
  Variant (670)..(672): Xaa in position 670 to 672 is any amino acid
  Variant (675)..(677): Xaa in position 675 to 677 is any amino acid
  Variant (679)..(679): Xaa in position 679 is any amino acid
  Variant (681)..(682): Xaa in position 681 to 682 is any amino acid
  Variant (684)..(684): Xaa in position 684 is any amino acid
  Variant (687)..(691): Xaa in position 687 to 691 is any amino acid
  Variant (692)..(692): Xaa in position 692 is any or no amino acid
  Variant (695)..(695): Xaa in position 695 is any amino acid
  Variant (701)..(701): Xaa in position 701 is any amino acid
  Variant (709)..(709): Xaa in position 709 is any amino acid
  Variant (713)..(717): Xaa in position 713 to 717 is any amino acid
  Variant (719)..(719): Xaa in position 719 is any amino acid
  Variant (726)..(726): Xaa in position 726 is any amino acid
  Variant (730)..(731): Xaa in position 730 to 731 is any amino acid
  Variant (733)..(734): Xaa in position 733 to 734 is any amino acid
  Variant (737)..(737): Xaa in position 737 is any amino acid
  Variant (740)..(740): Xaa in position 740 is any amino acid
  Variant (758)..(758): Xaa in position 758 is any amino acid
  Variant (765)..(765): Xaa in position 765 is any amino acid
  Variant (768)..(768): Xaa in position 768 is any amino acid
  Variant (771)..(771): Xaa in position 771 is any amino acid
  Variant (773)..(773): Xaa in position 773 is any amino acid
  Variant (777)..(777): Xaa in position 777 is any amino acid
  Variant (782)..(783): Xaa in position 782 to 783 is any amino acid
  Variant (788)..(788): Xaa in position 788 is any amino acid
  Variant (791)..(792): Xaa in position 791 to 792 is any amino acid
  Variant (819)..(819): Xaa in position 819 is any amino acid
  Variant (821)..(823): Xaa in position 821 to 823 is any amino acid
  Variant (825)..(825): Xaa in position 825 is any amino acid
  Variant (827)..(829): Xaa in position 827 to 829 is any amino acid
  Variant (831)..(831): Xaa in position 831 is any amino acid
  Variant (832)..(833): Xaa in position 832 to 833 is any or no amino acid
  Variant (836)..(836): Xaa in position 836 is any amino acid
  Variant (839)..(839): Xaa in position 839 is any amino acid
  Variant (842)..(842): Xaa in position 842 is any amino acid
  Variant (844)..(846): Xaa in position 844 to 846 is any amino acid
  Variant (849)..(850): Xaa in position 849 to 850 is any amino acid
  Variant (854)..(854): Xaa in position 854 is any amino acid
  Variant (857)..(857): Xaa in position 857 is any amino acid
  Variant (862)..(862): Xaa in position 862 is any amino acid
  Variant (864)..(866): Xaa in position 864 to 866 is any amino acid
  Variant (870)..(870): Xaa in position 870 is any amino acid
  Variant (874)..(874): Xaa in position 874 is any amino acid
  Variant (876)..(876): Xaa in position 876 is any amino acid
  Variant (881)..(881): Xaa in position 881 is any amino acid
  Variant (883)..(883): Xaa in position 883 is any amino acid
  Variant (886)..(886): Xaa in position 886 is any amino acid
  Variant (888)..(888): Xaa in position 888 is any amino acid
  Variant (891)..(891): Xaa in position 891 is any amino acid
  Variant (894)..(896): Xaa in position 894 to 896 is any amino acid
  Variant (897)..(897): Xaa in position 897 is any or no amino acid
  Variant (899)..(899): Xaa in position 899 is any amino acid
  Variant (901)..(901): Xaa in position 901 is any amino acid
  Variant (907)..(907): Xaa in position 907 is any amino acid
  Variant (912)..(912): Xaa in position 912 is any amino acid
  Variant (916)..(916): Xaa in position 916 is any amino acid
  Variant (921)..(921): Xaa in position 921 is any amino acid
  Variant (927)..(927): Xaa in position 927 is any amino acid
  Variant (930)..(932): Xaa in position 930 to 932 is any amino acid
  Variant (935)..(936): Xaa in position 935 to 936 is any amino acid
  Variant (938)..(938): Xaa in position 938 is any amino acid
  Variant (944)..(944): Xaa in position 944 is any amino acid
  Variant (955)..(955): Xaa in position 955 is any amino acid
  Variant (960)..(961): Xaa in position 960 to 961 is any amino acid
  Variant (963)..(963): Xaa in position 963 is any amino acid
  Variant (967)..(967): Xaa in position 967 is any amino acid
  Variant (989)..(989): Xaa in position 989 is any amino acid
  Variant (991)..(991): Xaa in position 991 is any amino acid
  Variant (993)..(993): Xaa in position 993 is any amino acid
  Variant (996)..(997): Xaa in position 996 to 997 is any amino acid
  Variant (1003)..(1003): Xaa in position 1003 is any amino acid
  Variant (1007)..(1008): Xaa in position 1007 to 1008 is any amino acid
  Variant (1017)..(1017): Xaa in position 1017 is any amino acid
  Variant (1020)..(1020): Xaa in position 1020 is any amino acid
  Variant (1021)..(1021): Xaa in position 1021 is any or no amino acid
  Variant (1031)..(1031): Xaa in position 1031 is any amino acid
  Variant (1032)..(1054): Xaa in position 1032 to 1054 is any or no amino acid
  Variant (1058)..(1058): Xaa in position 1058 is any amino acid
  Variant (1062)..(1066): Xaa in position 1062 to 1066 is any amino acid
  Variant (1067)..(1079): Xaa in position 1067 to 1079 is any or no amino acid
  Variant (1081)..(1081): Xaa in position 1081 is any amino acid
  Variant (1083)..(1083): Xaa in position 1083 is any amino acid
  Variant (1087)..(1087): Xaa in position 1087 is any amino acid
  Variant (1092)..(1094): Xaa in position 1092 to 1094 is any amino acid
  Variant (1097)..(1098): Xaa in position 1097 to 1098 is any amino acid
  Variant (1101)..(1103): Xaa in position 1101 to 1103 is any amino acid
  Variant (1105)..(1105): Xaa in position 1105 is any amino acid
  Variant (1113)..(1115): Xaa in position 1113 to 1115 is any amino acid
  Variant (1117)..(1119): Xaa in position 1117 to 1119 is any amino acid
  Variant (1121)..(1121): Xaa in position 1121 is any amino acid
  Variant (1122)..(1122): Xaa in position 1122 is any or no amino acid
  Variant (1124)..(1127): Xaa in position 1124 to 1127 is any amino acid
SXXXLXXLXXXLXXXXXXXXXXXXXXXXXXXXNXXXXXXXXXXXXXXXXXPXXXXXXXXXXXXXKXXXXKXXXXXXXXXXXXXXXXAXXXXXXXXXXXXXVEPXXVXXXXXXXXXXXGXKXXXXXXXAXXXXXXIXXXXXPXAXKXXLPXXXXXXXXXXXKWXEKXXXLXXXXXLVXXAXXQXXXRXPELIPXXSEXMWDTKXEVKXXAXXXXXKXXXXXXXNKDIXXFIPXLIXCIAXPXXXVPETXHXLGATTFVXEVXXXTLXXMXPLLXRGLXERXTXIKRKXAVIXDNMCKLVXDPXXXAPFXXXLXPXLXXXXXXXXDPEARXXXXXXLXTLXRVGXXXXXXXXPEXXXXXXXXXXXXXXXXXXXXXXXXXXXXXXXXXXXXXXXXXXXYXAXXXXXLXDEXXXXXXXWXXXXXXPXXXXXXXXXXXXAXXXXXXXRKXXXXXXXXXXXXXXXXXXEXEGEDLCNCXFSLAYGAKILLNXTXXRLKRXXRYGXCGPNGXGKSTLMRAIXNGQVXGFPXXXEXXTVXVEHDXDXXXXXXXXXXXXXXXXXXXXXXXTXXXXXXXLXEXXFXXXXXXXPIXXLSGGWKMKLALXRAXXXXXDILLLDEPTNHLDXXNVXWLXXYLXXXXXXTSIIVSHDSXFLDXVXXXIIHYEXXXKLXXYXGNXXXFVXXXPXAXXYXELXXXXXXEFXFPEPGXLEGVKTKXKAIXXXXXMXFQYPGTXKPQXXDXXFQXSLXSRIAVIGPNGAGKSTLIXVLTGELXPTXGEXYXHENXRIAYXXQHAFXHIXXHLDKTPSEYIQWRFQTGEDRETMDRAXRXXXEXDXXXMXXXKIXKIXGTXRXXXGIXXRRKXKNXYEYEXSXXXGENXGMKXEXWVPMXSXDNXWXPRXELXXXXHXKXVAEVDXKEALXSGQXFRPLXRKEIEXHCXXXGLXXEXVSHSRXRGLSGGQKVKXVLAAXXWXRPHXIVLDEPTNYLDRDSLGALSKAXKXFXGGXXIITHSXEFTXXLTEEVWAVXDGXXMTPSGHNWVXXXXXXXXXXXXXXXXXXXXXXXXGQGXGPRXXXXXXXXXXXXXXXXXXEXDXFDAXGNKIXXXKKXXKLXXXEXRKKKKERXXXMXXXKXXGXXXXS

SEQ ID NO: 12814 - protein, 62 aa, Artificial sequence
  protein pattern
  Variant (11)..(11): Xaa in position 11 is any amino acid
  Variant (17)..(17): Xaa in position 17 is any amino acid
  Variant (18)..(18): Xaa in position 18 is Ile, Leu or Val
  Variant (20)..(20): Xaa in position 20 is Gln or Thr
  Variant (21)..(21): Xaa in position 21 is any amino acid
  Variant (23)..(24): Xaa in position 23 to 24 is any or no amino acid
  Variant (26)..(26): Xaa in position 26 is any amino acid
  Variant (27)..(28): Xaa in position 27 to 28 is any or no amino acid
  Variant (30)..(30): Xaa in position 30 is Glu or Pro
  Variant (32)..(32): Xaa in position 32 is any amino acid
  Variant (36)..(36): Xaa in position 36 is any amino acid
  Variant (37)..(37): Xaa in position 37 is Ile, Met or Val
  Variant (38)..(38): Xaa in position 38 is any amino acid
  Variant (40)..(40): Xaa in position 40 is any amino acid
  Variant (43)..(43): Xaa in position 43 is any amino acid
  Variant (45)..(45): Xaa in position 45 is Ile or Leu
  Variant (46)..(46): Xaa in position 46 is Asp, Glu or Gly
  Variant (47)..(47): Xaa in position 47 is any amino acid
  Variant (49)..(49): Xaa in position 49 is Leu or Pro
  Variant (50)..(50): Xaa in position 50 is Asp or Glu
  Variant (51)..(51): Xaa in position 51 is any amino acid
  Variant (52)..(52): Xaa in position 52 is Ser or Thr
  Variant (53)..(53): Xaa in position 53 is Ala or Pro
  Variant (54)..(54): Xaa in position 54 is Ser or Val
  Variant (58)..(58): Xaa in position 58 is Ala or Gln
  Variant (61)..(61): Xaa in position 61 is Phe or Tyr
PNGAGKSTLIXVLTGEXXPXXGXXEXXXHXNXRIAXXXQXAFXHXXXHXXXXXXEYIXWRXQ

SEQ ID NO: 12815 - protein, 60 aa, Artificial sequence
  protein pattern
  Variant (3)..(3): Xaa in position 3 is Ala or Ser
  Variant (4)..(4): Xaa in position 4 is any amino acid
  Variant (5)..(5): Xaa in position 5 is Phe or Leu
  Variant (8)..(8): Xaa in position 8 is Asp or Glu
  Variant (9)..(9): Xaa in position 9 is Ala, Pro, Ser or Thr
  Variant (11)..(11): Xaa in position 11 is Ile or Leu
  Variant (17)..(17): Xaa in position 17 is Ile or Met
  Variant (18)..(18): Xaa in position 18 is Lys or Arg
  Variant (25)..(25): Xaa in position 25 is Lys or Arg
  Variant (28)..(28): Xaa in position 28 is any amino acid
  Variant (33)..(33): Xaa in position 33 is Cys or Gly
  Variant (34)..(34): Xaa in position 34 is Ser or Thr
  Variant (36)..(36): Xaa in position 36 is any amino acid
  Variant (40)..(40): Xaa in position 40 is Leu or Val
  Variant (60)..(60): Xaa in position 60 is Lys or Arg
HCXXXGLXXEXVSHSRXXGLSGGQXVKXVLAAXXWXRPHXIVLDEPTNYLDRDSLGALSX

SEQ ID NO: 12816 - protein, 43 aa, Artificial sequence
  protein pattern
  Variant (11)..(12): Xaa in position 11 to 12 is any or no amino acid
  Variant (14)..(18): Xaa in position 14 to 18 is any amino acid
  Variant (19)..(20): Xaa in position 19 to 20 is any or no amino acid
  Variant (34)..(34): Xaa in position 34 is Thr or Val
  Variant (35)..(35): Xaa in position 35 is any amino acid
  Variant (38)..(38): Xaa in position 38 is any amino acid
  Variant (41)..(41): Xaa in position 41 is any amino acid
  Variant (42)..(42): Xaa in position 42 is Glu or Asn
  Variant (43)..(43): Xaa in position 43 is Phe or Tyr
SGGWKMKLALXXAXXXXXXXDILLLDEPTNHLDXXNVXWLXXX

SEQ ID NO: 12817 - protein, 29 aa, Artificial sequence
  protein pattern
  Variant (2)..(2): Xaa in position 2 is Asp, Glu, Ser or Thr
  Variant (9)..(9): Xaa in position 9 is Ala, Asn, Pro, Ser or Thr
  Variant (10)..(10): Xaa in position 10 is Lys or Arg
  Variant (13)..(13): Xaa in position 13 is Ile, Leu or Val
  Variant (14)..(14): Xaa in position 14 is any amino acid
  Variant (15)..(15): Xaa in position 15 is Asp or Asn
  Variant (16)..(16): Xaa in position 16 is Ile or Val
  Variant (17)..(17): Xaa in position 17 is Asn, Ser or Thr
  Variant (20)..(20): Xaa in position 20 is Cys or Val
  Variant (23)..(23): Xaa in position 23 is any or no amino acid
  Variant (25)..(25): Xaa in position 25 is any or no amino acid
MXFQYPGTXXPQXXXXXFQXSLXSXRIAV

SEQ ID NO: 12818 - protein, 23 aa, Artificial sequence
  protein pattern
  Variant (4)..(4): Xaa in position 4 is Ile or Leu
  Variant (5)..(5): Xaa in position 5 is any amino acid
  Variant (10)..(10): Xaa in position 10 is Ala, Cys, Ser or Thr
  Variant (13)..(13): Xaa in position 13 is Ser or Thr
  Variant (16)..(16): Xaa in position 16 is Leu or Met
  Variant (18)..(18): Xaa in position 18 is Ala or Ser
  Variant (20)..(20): Xaa in position 20 is any amino acid
  Variant (22)..(22): Xaa in position 22 is Glu or Gly
RYGXXGPNGXGKXTLXRXIXNXQ

SEQ ID NO: 12819 - protein, 28 aa, Artificial sequence
  protein pattern
  Variant (2)..(3): Xaa in position 2 to 3 is any amino acid
  Variant (5)..(5): Xaa in position 5 is Ile or Val
  Variant (6)..(6): Xaa in position 6 is Asp, Glu or Asn
  Variant (9)..(9): Xaa in position 9 is Pro, Gln or Ser
  Variant (11)..(11): Xaa in position 11 is Lys or Arg
  Variant (12)..(12): Xaa in position 12 is Ile or Val
  Variant (13)..(13): Xaa in position 13 is any amino acid
  Variant (15)..(15): Xaa in position 15 is Ile or Val
  Variant (16)..(16): Xaa in position 16 is any amino acid
  Variant (17)..(17): Xaa in position 17 is Ala, Gly or Ser
  Variant (21)..(21): Xaa in position 21 is Phe or Leu
  Variant (24)..(24): Xaa in position 24 is Ser or Thr
KXXKXXGTXRXXXGXXXRRKXKNXYEYE

SEQ ID NO: 12820 - protein, 42 aa, Artificial sequence
  protein pattern
  Variant (2)..(2): Xaa in position 2 is Ala or Glu
  Variant (5)..(6): Xaa in position 5 to 6 is Ile or Val
  Variant (12)..(12): Xaa in position 12 is any amino acid
  Variant (16)..(16): Xaa in position 16 is Glu or Lys
  Variant (17)..(17): Xaa in position 17 is Asp or Asn
  Variant (18)..(18): Xaa in position 18 is Ile or Leu
  Variant (20)..(20): Xaa in position 20 is any or no amino acid
  Variant (22)..(22): Xaa in position 22 is any or no amino acid
  Variant (25)..(25): Xaa in position 25 is Ala or Ser
  Variant (27)..(27): Xaa in position 27 is any amino acid
  Variant (28)..(28): Xaa in position 28 is Asp or Asn
  Variant (30)..(30): Xaa in position 30 is any amino acid
  Variant (35)..(35): Xaa in position 35 is Asp or Gly
  Variant (40)..(40): Xaa in position 40 is Ala, Gln, Ser or Thr
FXGGXXIITHSXEFTXXXTXEXVWXVXXGXMTPSXHNWVXGQ

SEQ ID NO: 12821 - protein, 23 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is any or no amino acid
  Variant (10)..(10): Xaa in position 10 is any amino acid
  Variant (14)..(14): Xaa in position 14 is any amino acid
  Variant (16)..(16): Xaa in position 16 is Cys, Thr or Val
  Variant (17)..(17): Xaa in position 17 is Glu or Gln
  Variant (18)..(18): Xaa in position 18 is any amino acid
  Variant (20)..(20): Xaa in position 20 is Ile or Val
  Variant (21)..(21): Xaa in position 21 is any amino acid
SXIXXSHDSXFLDXVXXXIXXYE

SEQ ID NO: 12822 - protein, 41 aa, Artificial sequence
  protein pattern
  Variant (3)..(3): Xaa in position 3 is Ala or Ser
  Variant (4)..(4): Xaa in position 4 is any amino acid
  Variant (6)..(7): Xaa in position 6 to 7 is any amino acid
  Variant (9)..(9): Xaa in position 9 is Pro or Ser
  Variant (12)..(12): Xaa in position 12 is Ile or Val
  Variant (14)..(14): Xaa in position 14 is any or no amino acid
  Variant (16)..(16): Xaa in position 16 is any or no amino acid
  Variant (23)..(23): Xaa in position 23 is Ala, Gln, Ser or Thr
  Variant (24)..(24): Xaa in position 24 is Asp or Glu
  Variant (26)..(27): Xaa in position 26 to 27 is any amino acid
  Variant (28)..(28): Xaa in position 28 is Ala, Pro or Ser
  Variant (31)..(31): Xaa in position 31 is Ala or Ser
  Variant (32)..(32): Xaa in position 32 is Ile or Leu
  Variant (34)..(34): Xaa in position 34 is Ala or Val
  Variant (38)..(38): Xaa in position 38 is any amino acid
CIXXPXXVXETXHXLXGATTFVXXVXXXTLXXMXPLLXRGL

SEQ ID NO: 12823 - protein, 26 aa, Artificial sequence
  protein pattern
  Variant (2)..(2): Xaa in position 2 is any amino acid
  Variant (4)..(4): Xaa in position 4 is Asn or Thr
  Variant (5)..(5): Xaa in position 5 is Phe, Leu or Met
  Variant (6)..(6): Xaa in position 6 is any amino acid
  Variant (7)..(7): Xaa in position 7 is Ala or Glu
  Variant (10)..(10): Xaa in position 10 is any or no amino acid
  Variant (12)..(12): Xaa in position 12 is any amino acid
  Variant (13)..(13): Xaa in position 13 is any or no amino acid
  Variant (15)..(15): Xaa in position 15 is Ala, Glu, Ser or Thr
  Variant (17)..(17): Xaa in position 17 is any amino acid
  Variant (18)..(18): Xaa in position 18 is Ala or Ser
  Variant (20)..(20): Xaa in position 20 is any amino acid
  Variant (23)..(23): Xaa in position 23 is Gly, Asn or Ser
  Variant (24)..(24): Xaa in position 24 is Ala, Asn or Thr
  Variant (25)..(25): Xaa in position 25 is Gly, Ser or Thr
  Variant (26)..(26): Xaa in position 26 is Asp or Glu
YXGXXXXFVXKXXPXAXXYXELXXXX

SEQ ID NO: 12824 - protein, 20 aa, Artificial sequence
  protein pattern
  Variant (2)..(2): Xaa in position 2 is any amino acid
  Variant (5)..(5): Xaa in position 5 is any amino acid
  Variant (6)..(6): Xaa in position 6 is any or no amino acid
  Variant (8)..(8): Xaa in position 8 is any or no amino acid
  Variant (11)..(11): Xaa in position 11 is Ala or Thr
  Variant (13)..(13): Xaa in position 13 is Ile or Leu
  Variant (16)..(16): Xaa in position 16 is Gly, Asn or Ser
  Variant (18)..(18): Xaa in position 18 is Ile or Leu
  Variant (19)..(19): Xaa in position 19 is Ile, Leu, Met or Val
  Variant (20)..(20): Xaa in position 20 is Ala, Glu or Gln
WXPMXXSXDNXWXPRXEXXX

SEQ ID NO: 12825 - protein, 41 aa, Artificial sequence
  protein pattern
  Variant (2)..(4): Xaa in position 2 to 4 is any or no amino acid
  Variant (6)..(6): Xaa in position 6 is any amino acid
  Variant (7)..(7): Xaa in position 7 is Ala, Gly or Ser
  Variant (8)..(8): Xaa in position 8 is any amino acid
  Variant (10)..(10): Xaa in position 10 is Leu, Met or Val
  Variant (12)..(12): Xaa in position 12 is Ala, Asp or Glu
  Variant (15)..(16): Xaa in position 15 to 16 is any amino acid
  Variant (17)..(17): Xaa in position 17 is Ile, Leu or Val
  Variant (18)..(18): Xaa in position 18 is Gly or Ser
  Variant (19)..(19): Xaa in position 19 is Asp or Glu
  Variant (20)..(20): Xaa in position 20 is Ala, Ser or Thr
  Variant (25)..(25): Xaa in position 25 is Lys or Arg
  Variant (26)..(26): Xaa in position 26 is any amino acid
  Variant (27)..(27): Xaa in position 27 is Asp, Glu or Gly
  Variant (28)..(28): Xaa in position 28 is Ile or Val
  Variant (30)..(30): Xaa in position 30 is any amino acid
  Variant (31)..(31): Xaa in position 31 is any or no amino acid
  Variant (33)..(35): Xaa in position 33 to 35 is any amino acid
  Variant (36)..(36): Xaa in position 36 is Ile or Met
  Variant (37)..(37): Xaa in position 37 is Glu or Thr
  Variant (38)..(39): Xaa in position 38 to 39 is any amino acid
  Variant (40)..(40): Xaa in position 40 is Cys or Thr
  Variant (41)..(41): Xaa in position 41 is Asp, Glu, Gly, Gln, Ser or Thr
AXXXQXXXRXPXLIXXXXXXMWDTXXXXKXXAXXXXXXXXX

SEQ ID NO: 12826 - protein, 44 aa, Artificial sequence
  protein pattern
  Variant (3)..(3): Xaa in position 3 is Asp, Glu or Ser
  Variant (5)..(5): Xaa in position 5 is Ala, Gly, Pro, Ser or Thr
  Variant (10)..(10): Xaa in position 10 is any or no amino acid
  Variant (12)..(12): Xaa in position 12 is any or no amino acid
  Variant (15)..(15): Xaa in position 15 is Ile or Val
  Variant (19)..(19): Xaa in position 19 is Cys or Ser
  Variant (23)..(23): Xaa in position 23 is Asp or Glu
  Variant (26)..(26): Xaa in position 26 is any amino acid
  Variant (27)..(28): Xaa in position 27 to 28 is Ile or Val
  Variant (32)..(32): Xaa in position 32 is Leu or Met
  Variant (33)..(34): Xaa in position 33 to 34 is any amino acid
  Variant (35)..(35): Xaa in position 35 is Leu or Met
  Variant (36)..(36): Xaa in position 36 is any amino acid
  Variant (38)..(38): Xaa in position 38 is any amino acid
  Variant (40)..(43): Xaa in position 40 to 43 is any amino acid
  Variant (44)..(44): Xaa in position 44 is Ala, Asp, Glu, Asn or Ser
ERXTXIKRKXAXVIXDNMXKLVXDPXXXAPFXXXXXPXLXXXXX

SEQ ID NO: 12827 - protein, 13 aa, Artificial sequence
  protein pattern
  Variant (2)..(2): Xaa in position 2 is Asp or Glu
  Variant (4)..(6): Xaa in position 4 to 6 is any or no amino acid
EXEXXXGEDLCNC

SEQ ID NO: 12828 - protein, 21 aa, Artificial sequence
  protein pattern
  Variant (2)..(2): Xaa in position 2 is Ala, Gln or Ser
  Variant (4)..(4): Xaa in position 4 is Leu or Met
  Variant (7)..(7): Xaa in position 7 is Asp or Glu
  Variant (8)..(8): Xaa in position 8 is Ile or Val
  Variant (10)..(10): Xaa in position 10 is any amino acid
  Variant (15)..(15): Xaa in position 15 is any amino acid
  Variant (18)..(18): Xaa in position 18 is Gln or Ser
  Variant (21)..(21): Xaa in position 21 is Ala or Pro
HXKXVAXXDXKEALXSGXFRX

SEQ ID NO: 12829 - DNA, 855 bp, Saccharomyces cerevisiae
  CDS (1)..(855)
atgttgtggaaagtttctaagatgttcttgggtggcttggtagcgctaacaacaatatcggttgcgaccctttatcactaccaaaatcgcctagtctacccatcatgggctcaaggcgccaggaatcatgttgacactcctgattcccgtggaatcccttatgaaaagctaaccctaattacacaagaccacattaaactcgaggcatgggatatcaagaatgaaaactcaacaagtactgtgttgatcttatgtcccaatgccggtaatattggatactttatactaataattgacattttctatcgtcagtttggaatgagtgtatttatttattcgtatcgtggttatggtaactcagaaggttcacccagcgaaaagggtttgaaattggacgctgattgtgtcatatcgcatttgtcaacggattctttccattcaaagagaaaactagtattgtatggtagatctctaggtggtgctaatgctctttacattgcttcaaaatttcgggatctatgcgatggcgttatactggagaatacatttttgagtattcgaaaagttatcccatatattttcccccttttgaaacgctttacgcttttatgtcacgaaatctggaattcagaaggccttatgggaagctgtagttcagagacgccattcttgtttttaagtggattaaaagatgaaatcgttccacccttccacatgaggaaactgtacgaaacatgtcctagttcgaacaaaaagattttcgaatttccacttggttcacacaatgatactattattcaagatgggtactgggatataataagagattttctaatagagaagggttttatctaa

SEQ ID NO: 12830 - protein, 284 aa, Saccharomyces cerevisiae
MLWKVSKMFLGGLVALTTISVATLYHYQNRLVYPSWAQGARNHVDTPDSRGIPYEKLTLITQDHIKLEAWDIKNENSTSTVLILCPNAGNIGYFILIIDIFYRQFGMSVFIYSYRGYGNSEGSPSEKGLKLDADCVISHLSTDSFHSKRKLVLYGRSLGGANALYIASKFRDLCDGVILENTFLSIRKVIPYIFPLLKRFTLLCHEIWNSEGLMGSCSSETPFLFLSGLKDEIVPPFHMRKLYETCPSSNKKIFEFPLGSHNDTIIQDGYWDIIRDFLIEKGFI

SEQ ID NO: 12831 - DNA, 1575 bp, Oryza sativa
  CDS (152)..(1072)
aactcgaagcatctcgcctcgccgccgccgccgccgcacgcccgacggaagcgagcgcctctctctctctctctcaccggcgacgggatcgacggcggcgggggcggggatggtgggctggctgaaggcgctgtgctacggcgcggggggcatggcggtggtggggctcgcggcgctcgtggcgctgcaggagcgcctcgtctacgtgcccgtgctcccggggatcgcgcgggcgtaccccatcacccccgaccgcctccgcctcatctacgaggacgtctggctccgcgccgccgacggcgtccgcctccactcctggttcatccgccactcccccacctgccgaggtccaactattctgttcttccaagaaaatgctggcaatattgcacatcgtttggactttgttcgactaatgatgcaacgactacagtgcaatgtatttatgctttcttacagagggtatggtgagagtgatggttatccttctcagaagggcatcataaatgatgcacaggctgcacttgatcatctagttcagaggaaggatattgacacatccaggatagttgtttttgggagatcgttaggaggtgctgttggagcagtgcttgcgaaaaacaatcctggcaaggtgtcagctctaatactggaaaacacctttacatctatattggatatggctggtatcatgctacccttcttacgatggttcataggtggcagttcttcaaaaggtccaaaacttctgaactgtgttgttcgctccccatggagtacacttgatatcattgcagaggtcaaacaacccattattttcctttctggattacaagatgaattagttcccccttcacacatgaggttactatatgaaaaagcttttgagcataataagaattgtagatttgttgattttcccaatggcatgcatatggatacctggaattctggaggagaccgttactggaggacaatccaactgtttctggaccaatatgctccagaagtacagagttgtaataccagctgcaaaagtgaaattgctaatgatgatgaagctgaagagtgaccagaacatctggagcggccttctttttttttttcttccaggctccagttttctggtgtgatgcgatttaaatcctgatgaactgaagctcactgcaaacaattaattcaggcaattattctccattcaacctgaagaaggcaaagttgtgaataccttgaggttgctctccatcctagcactacatttgtctctggagctatatatagatttctgagaagacctagcctttgaactgatgattccccctcccccccttgatttaatctgtgatgttgctttgttgaagttttttacaatatactgtagcgcattaccatgtcataatctggcctcggtgtataacagtgtaatgcataggtttttaggctctggttcagcaatttggttttgtgttttttattattggtgttatagatctggttgcctgcttcttaagcctgttataccaaaactgttgcaatatcaataggccatgtcttcaccggcagtaattttttagc

SEQ ID NO: 12832 - protein, 306 aa, Oryza sativa
MAVVGLAALVALQERLVYVPVLPGIARAYPITPDRLRLIYEDVWLRAADGVRLHSWFIRHSPTCRGPTILFFQENAGNIAHRLDFVRLMMQRLQCNVFMLSYRGYGESDGYPSQKGIINDAQAALDHLVQRKDIDTSRIVVFGRSLGGAVGAVLAKNNPGKVSALILENTFTSILDMAGIMLPFLRWFIGGSSSKGPKLLNCVVRSPWSTLDIIAEVKQPIIFLSGLQDELVPPSHMRLLYEKAFEHNKNCRFVDFPNGMHMDTWNSGGDRYWRTIQLFLDQYAPEVQSCNTSCKSEIANDDEAEE

SEQ ID NO: 12833 - DNA, 1763 bp, Glycine max
  CDS (326)..(1276)
accaaggagacgggcccagaagagcggggaaaatgcccactaaatccgtgctgctgctgtctcattaacttatgattatctaggttcctgtctggagatgtatcaatgagtgggattggtttcgtatctgaagcctctaggtgtgcgaccgggaaagggattgggatcgattccgattggctgggtgtttcccgagaaagagaaagaaaaagcggccccaattttttgaaactcaaatcccaatcaatcaatctcttctgtgaactgtgatgcatgcgagttgaaattgaatcgaaggcaaagcgaagaagatcaaagagagagaatggtttcgtatgtgaacatcttgctgtacggcgtgggagggttggtggtggcggggatggcattgctggtggcgtttcaggagaagctggtctacgttccggtgttgcctggcatcaccaagtcctacgccattaacccctctcgcctcagactcatctacgaggacgtctggctccaatcctacgatggcgttcgccttcacgcttggttcatcaagctcttccctaattgccgaggtccgaccattttgttttttcaagaaaatgctggaaatattgctcatcgtcttgaaatggttcgaataatgttgcagcagttacattgcaatgttttcatgctttcttaccgaggttatggagcaagtgacggctatccttctcaacatggaataactaaggatgctcaggctgcattggatcatctttcccaaaggtctgatattgacacatctagaatagttgtgtttggacgatcacttgggggtgcagttggagctgtactaacaaaaaataaccctgacaaggttgctgcactgatacttgaaaatacattcacgtctatattggatatggctggagttttgttaccttttttgaagtggtttattggaggaagctcttcaaatggtcctaaagtactcaattttcttgtacgttctccgtggagtactattgatgttgttggccagatcaaacaacctatcctttttctctctggattgcaagatgagatggtccccccatcacatatgcaaatgctatatgctaaggcagctgctcgaaataatcagtgtctctttgtggattttcctactggcatgcatatggatacttggctggctggtggtgatcagtactggagaacaattcagcagtttcttgagcagcatgccccagagcaaaaggaagacagatcatcccaaaatgcaaatgatattggggcgaggtgattggctggcattaaattatttcaatgatactaattggctaactaaggattcaaacagtttctgccctttgaagttgcagtccgtaaaagcaccctgtgagaagatgcttcctactggaacatgctgcaccacgtcaaggtatattattgaacaattttggttgggttgtggtttccagaacttggaaaatacgcagacaatttgtgcttacccttttcctatattgttcggcacctacattttgggtgtctgatcgaatttgacaaaatgatatgtagaataataattattcacgtaagctatatattatatatatgtagtgtatgtagtatgttcttagtgaatgggttcatgtctttcatactaatgcacgctgctgagacatatttcatctcagttgattgctattttctttaattctcagttgattgctattttcattaatgtcatcttttattgattctttatatagaaagtttgaatgtct

SEQ ID NO: 12834 - protein, 316 aa, Glycine max
MVSYVNILLYGVGGLVVAGMALLVAFQEKLVYVPVLPGITKSYAINPSRLRLIYEDVWLQSYDGVRLHAWFIKLFPNCRGPTILFFQENAGNIAHRLEMVRIMLQQLHCNVFMLSYRGYGASDGYPSQHGITKDAQAALDHLSQRSDIDTSRIVVFGRSLGGAVGAVLTKNNPDKVAALILENTFTSILDMAGVLLPFLKWFIGGSSSNGPKVLNFLVRSPWSTIDVVGQIKQPILFLSGLQDEMVPPSHMQMLYAKAAARNNQCLFVDFPTGMHMDTWLAGGDQYWRTIQQFLEQHAPEQKEDRSSQNANDIGAR

SEQ ID NO: 12835 - DNA, 978 bp, Zea mays
  CDS (1)..(978)
atgggaggaggggagatggcggggtggctgaaggcactggcgtacagcgccgggggcgtagcggtggccggcctagcggcgttggttgcgctgcaggagcgcctcgtctacgtgcccgtgctcccgggtctggcgcgctcgtaccccatcacgcccgcccgcctcggcctcatctacgaggatgtctggctccgtgccgcggacggcgtgcggctccactcctggttcatccgtcactcccccagctaccgaggtccaaccattctgttcttccaagaaaatgctggcaacatcgctcaccgtttggaatttgttcgactaatgatgcagcgactacagtgcaatgtttttatgctttcttatagagggtatggtgagagtgatggttatccttctcagaaagggatcacatatgatgcacaggctgcacttgaccatctagctcagaggaatgacatcgacacaaccaggatagttatctttggaagatctttaggaggtgctgttggagcagttcttgccaaaaacaatcctgacaaggtggccactctaatactggaaaatacatttacatccatactggatatggctggtattatgcttcccttcttaagatggttcataggcgggagctcttctaaaggtccaaaacttttaaactgtgttgttcgctctccatggaatacacttgatattgttggagaggtcaaacaacccattctcttcctttctggattgcaagatgaactagtcccccctccacacatgaagatgttatatgacaaagcttctgatcataacagaaattgcagatttgttgattttcctagtggtatgcatatggatacctggatgtctggaggggaccgctactggaggacaatccaattgttcttggatcaatacgctcctggagtgcagaatcatgatgccagcttcaaaagtgaaattaccgaggatgatgaagctgctgattga

SEQ ID NO: 12836 - protein, 325 aa, Zea mays
MGGGEMAGWLKALAYSAGGVAVAGLAALVALQERLVYVPVLPGLARSYPITPARLGLIYEDVWLRAADGVRLHSWFIRHSPSYRGPTILFFQENAGNIAHRLEFVRLMMQRLQCNVFMLSYRGYGESDGYPSQKGITYDAQAALDHLAQRNDIDTTRIVIFGRSLGGAVGAVLAKNNPDKVATLILENTFTSILDMAGIMLPFLRWFIGGSSSKGPKLLNCVVRSPWNTLDIVGEVKQPILFLSGLQDELVPPPHMKMLYDKASDHNRNCRFVDFPSGMHMDTWMSGGDRYWRTIQLFLDQYAPGVQNHDASFKSEITEDDEAAD

SEQ ID NO: 12837 - DNA, 1204 bp, Triticum aestivum
  CDS (76)..(1032)
aaagagcagcagcgaccgcgcccatcaccaccaccacccgcctgacggagcccttccctcccatcggcggcggagatggtggggtggctcaaggcgctggtgtactgcgcagggggcatggcggtggtgggcctggcggcgctggtggcgctgcaggagcgcctcgtctacgtgcccgtgctccctggcctcccgcgcgcttaccccatcaagccctcgcgcctccgcctcatctacgaggacgtctggctccgcgccgccgacggcgtgcgcctccactcctggttcctccgccactctcccacctgccgaggtccgaccattctgttctttcaggaaaatgccggcaatattgcacatcgtttggaatgcgttcgactaatgatgcagcggctacagtgcaatgtgtttatgctttcttatagagggtatggtgagagcgagggttatccttctcagagtggcatcacaaaagatgcacaggccgcacttgatcatctagttcagaggaaggacattgacacatccaggatagttatctttgggagatctttaggaggtgctgttggagcagttcttgcaaaaaacaatcctgacaaggtgtctgctctaatattggaaaatacttttacatctatattggatatggctggtatcatgctgcccttcttaagatggttcataggcggtagttctgccaaaggcccaaaacttcttaactgcgttgttcgctctccatggagtacacttgatgttgttgcagaggtcaaacaacccattctcttcctttctggattgcaagatgaactggttcccccgtcacacatgaggatgctgtatgacaaagctgttgaacataacaggaattgtaggtttgttgattttcccagtggtatgcatatggatacctggatttctggaggggaccgctactggaggacaatcgaattgtttctggaccaatataccccagaagtacagagttctgatgccagctgcacaagtgaaattgctgatgatggtaattactaattagtatttaccaattcattataacattttcctgcgaatattgttctatcatgttttttcttgtacgtgtagggatacattatgttgtcatatttgtgtatttaactacatagtgtagttttactaatgttaatggcaatactgaatagtgaatacaaccatttgtatcttc

SEQ ID NO: 12838 - protein, 318 aa, Triticum aestivum
MVGWLKALVYCAGGMAVVGLAALVALQERLVYVPVLPGLPRAYPIKPSRLRLIYEDVWLRAADGVRLHSWFLRHSPTCRGPTILFFQENAGNIAHRLECVRLMMQRLQCNVFMLSYRGYGESEGYPSQSGITKDAQAALDHLVQRKDIDTSRIVIFGRSLGGAVGAVLAKNNPDKVSALILENTFTSILDMAGIMLPFLRWFIGGSSAKGPKLLNCVVRSPWSTLDVVAEVKQPILFLSGLQDELVPPSHMRMLYDKAVEHNRNCRFVDFPSGMHMDTWISGGDRYWRTIELFLDQYTPEVQSSDASCTSEIADDGNY

SEQ ID NO: 12839 - DNA, 1204 bp, Triticum aestivum; identical to SEQ ID NO: 12837
  CDS (118)..(1032)

SEQ ID NO: 12840 - protein, 304 aa, Triticum aestivum
MAVVGLAALVALQERLVYVPVLPGLPRAYPIKPSRLRLIYEDVWLRAADGVRLHSWFLRHSPTCRGPTILFFQENAGNIAHRLECVRLMMQRLQCNVFMLSYRGYGESEGYPSQSGITKDAQAALDHLVQRKDIDTSRIVIFGRSLGGAVGAVLAKNNPDKVSALILENTFTSILDMAGIMLPFLRWFIGGSSAKGPKLLNCVVRSPWSTLDVVAEVKQPILFLSGLQDELVPPSHMRMLYDKAVEHNRNCRFVDFPSGMHMDTWISGGDRYWRTIELFLDQYTPEVQSSDASCTSEIADDGNY

SEQ ID NO: 12841 - DNA, 963 bp, Oryza sativa (japonica cultivar-group)
  CDS (1)..(963)
atggtgggctggctgaaggcgctgtgctacggcgcggggggcatggcggtggtggggctcgcggcgctcgtggcgctgcaggagcgcctcgtctacgtgcccgtgctcccggggatcgcgcgggcgtaccccatcacccccgaccgcctccgcctcatctacgaggacgtctggctccgcgccgccgacggcgtccgcctccactcctggttcatccgccactcccccacctgccgaggtccaactattctgttcttccaagaaaatgctggcaatattgcacatcgtttggactttgttcgactaatgatgcaacgactacagtgcaatgtatttatgctttcttacagagggtatggtgagagtgatggttatccttctcagaagggcatcataaatgatgcacaggctgcacttgatcatctagttcagaggaaggatattgacacatccaggatagttgtttttgggagatcgttaggaggtgctgttggagcagtgcttgcgaaaaacaatcctggcaaggtgtcagctctaatactggaaaacacctttacatctatattggatatggctggtatcatgctacccttcttacgatggttcataggtggcagttcttcaaaaggtccaaaacttctgaactgtgttgttcgctccccatggagtacacttgatatcattgcagaggtcaaacaacccattattttcctttctggattacaagatgaattagttcccccttcacacatgaggttactatatgaaaaagcttttgagcataataagaattgtagatttgttgattttcccaatggcatgcatatggatacctggaattctggaggagaccgttactggaggacaatccaactgtttctggaccaatatgctccagaagtacagagttgtaataccagctgcaaaagtgaaattgctaatgatgatgaagctgaagagtga

SEQ ID NO: 12842 - protein, 320 aa, Oryza sativa (japonica cultivar-group)
MVGWLKALCYGAGGMAVVGLAALVALQERLVYVPVLPGIARAYPITPDRLRLIYEDVWLRAADGVRLHSWFIRHSPTCRGPTILFFQENAGNIAHRLDFVRLMMQRLQCNVFMLSYRGYGESDGYPSQKGIINDAQAALDHLVQRKDIDTSRIVVFGRSLGGAVGAVLAKNNPGKVSALILENTFTSILDMAGIMLPFLRWFIGGSSSKGPKLLNCVVRSPWSTLDIIAEVKQPIIFLSGLQDELVPPSHMRLLYEKAFEHNKNCRFVDFPNGMHMDTWNSGGDRYWRTIQLFLDQYAPEVQSCNTSCKSEIANDDEAEE

SEQ ID NO: 12843 - DNA, 927 bp, Arabidopsis thaliana
  CDS (1)..(927)
atggtgacgtacgtgagcgcgttgttctacggattcggagggatagtcgtcgccggagtggcgctgctcgtggctttccaggagaagcttgtgtacgtcccagtgcttccgggtttaagcaagtcttatccgatcactcccgctaggctcaatctcatctacgaagatatttggcttcaatcatccgatggtgtacgtctccacgcttggttcatcaagatgttccctgaatgtcgaggtccaaccattttatttttccaggagaacgctggaaacatcgctcatcgtctggagatggttcgcatcatgatacaaaaattgaagtgcaatgtattcatgctttcatatcgcggctatggggcaagtgaaggctatccttcacaacaaggtatcataaaagatgctcaggctgcattggatcacctttctggaaggactgacattgatacatctagaatagttgtatttggaaggtcccttgggggagctgttggagctgtgcttaccaaaaacaatccagataaggtatctgcattgattctggaaaatactttcacatccattcttgatatggctggcgttttgctgccgttcttgaagtggtttattggaggaagtggtacgaaaagcctgaagcttcttaattttgttgtacgttctccctggaaaacaattgatgctattgctgagatcaaacaaccagtgcttttcctctctggactgcaagatgagatggtccctccatttcacatgaaaatgctgtatgcgaaagcggctgcccgtaaccctcagtgcacatttgtggagtttccaagtgggatgcatatggatacatggctgtctggtggtgaagtttactggaaaacaaacttgcaatttctcgaaaagtatgcgcctgagaaaaggaaagaagatacaggaaggtaa

SEQ ID NO: 12844 - protein, 308 aa, Arabidopsis thaliana
MVTYVSALFYGFGGIVVAGVALLVAFQEKLVYVPVLPGLSKSYPITPARLNLIYEDIWLQSSDGVRLHAWFIKMFPECRGPTILFFQENAGNIAHRLEMVRIMIQKLKCNVFMLSYRGYGASEGYPSQQGIIKDAQAALDHLSGRTDIDTSRIVVFGRSLGGAVGAVLTKNNPDKVSALILENTFTSILDMAGVLLPFLKWFIGGSGTKSLKLLNFVVRSPWKTIDAIAEIKQPVLFLSGLQDEMVPPFHMKMLYAKAAARNPQCTFVEFPSGMHMDTWLSGGEVYWKTNLQFLEKYAPEKRKEDTGR

SEQ ID NO: 12845 - DNA, 792 bp, Magnaporthe grisea 70-15
  CDS (1)..(792)
atgccgccgaattctcgaacccaagtctcacggcccagccaattcaacattaaagatttcgaagagctcatgatcccgacgcccgacggcgagaaactttcggccttttacatccgcggttctcgaaacggacgcaactcgaacgtcaccattatcatgttccacggcaatgcgggcaacattggccatagactacccatcgcaagacatttggtggagcttatgggctgcaacgttttcatgctcgagtaccgcggctacggcttgtcaaccggcactgcggacgagtcggggcttatgattgatgctcagaccgggctggactacctcagggatcgtcccgagacgaggaagcaccggctggtggtttacgggcaaagcctgggtggttccgtggccattcggctggtgagcaagaaccaggctgcgggggatattgttggtctgattctggaaaacacattcctcagcatgcgcaaactcatcccctctgtcatcccgccgaccaagtattttgccttcctctgccaccaggtttggccttccgatgtagcgataccaaacatcaccaaggtgcccatcctgtttctgagtggacagcaggatgagattgttcctccatcgcacatgcgccagctatatgagctctctgcggccccgaataagatatggaaaccattacccaacggggaccacaactcgagcgtcttggaggacgggtattttgacgccatctcggactttgttgcctcggttgcatcggaaccaccccgtctgagtgagaagatatga

SEQ ID NO: 12846 - protein, 263 aa, Magnaporthe grisea 70-15
MPPNSRTQVSRPSQFNIKDFEELMIPTPDGEKLSAFYIRGSRNGRNSNVTIIMFHGNAGNIGHRLPIARHLVELMGCNVFMLEYRGYGLSTGTADESGLMIDAQTGLDYLRDRPETRKHRLVVYGQSLGGSVAIRLVSKNQAAGDIVGLILENTFLSMRKLIPSVIPPTKYFAFLCHQVWPSDVAIPNITKVPILFLSGQQDEIVPPSHMRQLYELSAAPNKIWKPLPNGDHNSSVLEDGYFDAISDFVASVASEPPRLSEKI

SEQ ID NO: 12847 - DNA, 1209 bp, Gibberella zeae PH-1
  CDS (1)..(1209)
atgtcgagctccaactctcccgcctcgcaatcttccaacaattacgtcgagcagaccgtctcggtcttgagctcggttgccagctacatgcgtctgcccgcgttggcttcaacggtacgtactcccaaattgctcgcgctgaaaagccaaagccaaaaccaaaggccaagaccacagtccagtccagacactgacatcaatgcgcttcttcacagggtatcgctgccgtcctcacctcgttattatactttaagcaaaagtccgtatactactcctctcgtctccatctccatctccatctccgttcctgtcttcttcctctccctgcctcctttccattactgctcgacccgcatcatcatcttgccgagacccgcgctaaccacctgcattagggctctcatttacccgagcaatattcctgcaaattctcgctcagacgtccccaaaccctccgactttggcctctcaaatttcgaagaactttacataccgaccgacgatggcgagaagctctcagctttctacatccgtggccctcgcggccacaagaactcaaacatcaccattttgatgttccatggcaatgctggcaacattggccaccggttacccatcgctcgcatgatcattaactacattggctgcaatgtctttatgctcgagtatagagggtacggttcttcgactggtcagcctgacgagtcgggtctaaatattgacgcgcagactggtcttaactacctgcggcagcgggccgagacacgcgatcacaagctcatggtttacgggcagagtctgggtggcgccgttgccatcaagcttgtttccaagaaccaggaagcgggtgatatcgctggtctgatcctcgagaatacatttctctccatccggaagctcatcccttccgtcgtgcctcccgctaagtaccttaccctgctatgccaccaagtctggcccagtgagtcggttctacccaacatcacaaaggtgcctacgctcttcatcagtggcttgcaggatgagattgtcccgccaaaacacatgaaacagttatacgagatttctgcagcgcccaccaagcggtggaagcccctccctgctggcgaccataattctagtgtcctcgaagaaggctactttgaggccatgtcagacttcattgccgaagtgacggatgaccaagagaaagaaaagacacgttcgtag

SEQ ID NO: 12848 - protein, 402 aa, Gibberella zeae PH-1
MSSSNSPASQSSNNYVEQTVSVLSSVASYMRLPALASTVRTPKLLALKSQSQNQRPRPQSSPDTDINALLHRVSLPSSPRYYTLSKSPYTTPLVSISISISVPVFFLSLPPFHYCSTRIIILPRPALTTCIRALIYPSNIPANSRSDVPKPSDFGLSNFEELYIPTDDGEKLSAFYIRGPRGHKNSNITILMFHGNAGNIGHRLPIARMIINYIGCNVFMLEYRGYGSSTGQPDESGLNIDAQTGLNYLRQRAETRDHKLMVYGQSLGGAVAIKLVSKNQEAGDIAGLILENTFLSIRKLIPSVVPPAKYLTLLCHQVWPSESVLPNITKVPTLFISGLQDEIVPPKHMKQLYEISAAPTKRWKPLPAGDHNSSVLEEGYFEAMSDFIAEVTDDQEKEKTRS

SEQ ID NO: 12849 - DNA, 873 bp, Candida glabrata CBS 138
  CDS (1)..(873)
atgctctatcgaacattcaagatgatattcggtggtgtactagcactgggcactatatctgttactgcagtttatctggtgcagaacaagctagtgtatccgtcatgggcccaaggtgctcgtgagtacgtggacacgcctgcttcgaagaatatcccttataaggaggttacgctgaccaccaaggatggtattgagctgcaagcatgggatatcaggaacgaagagacaaaatctaaatctacagtgctcatactatgccctaatgcaggcaatattgggtattttatacctatcatagacatattctactctcagtttggcctcaatgtgtttatatactcatacaggggctatggttactcaaaaggtacacctagtgaagaaggtttaaagatagatgcagatcgtgtgatgtcctacttggctactgatgatttccataaaacaaagaaacttatactgtatggaagatcactaggtggtgccaatgctatctacattgcatcaaaattctcgcaattgtgtgatgcagttatcctggagaatactttcctcagtattaggaaagttataccttatatctttccatggatatcaaggtttgcatttatgtgccatgaagtatggaactctgaagaagacatgcctcattgcaattctgagattccttacttatttctaagcgggttagaggatgaaatagtaccccctgagcatatgaaggacttatacgacatatgtccgagcggcagtaagcagatttatgagttcccctttggaacacacaacactactattattcaggatggatactgggaaattgtacggaaatttctagaagataacaagtttattgagccagctcaatga

SEQ ID NO: 12850 - protein, 290 aa, Candida glabrata CBS 138
MLYRTFKMIFGGVLALGTISVTAVYLVQNKLVYPSWAQGAREYVDTPASKNIPYKEVTLTTKDGIELQAWDIRNEETKSKSTVLILCPNAGNIGYFIPIIDIFYSQFGLNVFIYSYRGYGYSKGTPSEEGLKIDADRVMSYLATDDFHKTKKLILYGRSLGGANAIYIASKFSQLCDAVILENTFLSIRKVIPYIFPWISRFAFMCHEVWNSEEDMPHCNSEIPYLFLSGLEDEIVPPEHMKDLYDICPSGSKQIYEFPFGTHNTTIIQDGYWEIVRKFLEDNKFIEPAQ

SEQ ID NO: 12851 - DNA, 861 bp, Kluyveromyces lactis NRRL Y-1140
  CDS (1)..(861)
atgcatttatacaaaattgggaaaatggtactcggaagcgcagctgtcattgtttctgcttcactgggcgctctatatttgtaccaaaacaagcttatatacccatcttgggcacaaggtgctagagaccatgtagatacgccagatcaatacggtttgccttatgaagatctcactttaacgacttcggatggtgttctattgaaagcatttgatataaggaatgaaaattcgactgcaaccatgcttgttctttgccccaatgcggggaatataggatatttcctgcccgttgctaggtttctctataatgagtttaatttgtccatttttttgtattcctatcgtggatatgggttatcaacagggttcccatcggagagaggattgaagatagacgcagataccgtcatggaccatttgacaaacagtgaatttcataaatcaaggaagctaatactttatgggaggtcccttggtggcgctaatgccatttatcttgctagaaaatttaccgatatctgcgatgccattatcctagaaaatactttcctgtccattcgcaaagttatcccatacgttttcccaatgctgaagaatgtggcattcatgtgtcatgaagtctgggattctgaacaggaaattgtcaacatacaagatgatactttacctttcttgtttcttgctggtttaagagatgagattgtcccaccccctcatatgaaattattgtataaactatgtccctcgagctgcaaaagatttattgagttccctatcggttcccataacgacacgataatacaagatgggtattgggttgtcgttaaagagttcttacaaaaacataacttgatatag

SEQ ID NO: 12852 - protein, 286 aa, Kluyveromyces lactis NRRL Y-1140
MHLYKIGKMVLGSAAVIVSASLGALYLYQNKLIYPSWAQGARDHVDTPDQYGLPYEDLTLTTSDGVLLKAFDIRNENSTATMLVLCPNAGNIGYFLPVARFLYNEFNLSIFLYSYRGYGLSTGFPSERGLKIDADTVMDHLTNSEFHKSRKLILYGRSLGGANAIYLARKFTDICDAIILENTFLSIRKVIPYVFPMLKNVAFMCHEVWDSEQEIVNIQDDTLPFLFLAGLRDEIVPPPHMKLLYKLCPSSCKRFIEFPIGSHNDTIIQDGYWVVVKEFLQKHNLI

SEQ ID NO: 12853 - DNA, 861 bp, Debaryomyces hansenii CBS767
  CDS (1)..(861)
atggctcaaatagtattatcaataggtgtgagtttgtttgtaggattatattcttatcaatccagcttaatatatcctgcatcgttgaatgatgggcatggatattgtgcaactccagatgaatatggaatgccaggttatgaattagtgaacttaaaaacagaagatggggaaaatttacaatgttacctgttaaagcagaataaggaatcacccacttatagtaacaagacgatagtagtactttcgccaaatgctggtaatattgggcatgcattgccaattgtatcgatgttttattcaaatttcggatataacgtgttcatatattcttatcgtggatatggcaaatctacaggcaagccatcagagaagggactaaagcttgatgcgcaaagaataatgcaatatttgacaatagaagatgaacagtatcaacaatcttctatagtattgtacggaagatcgctaggaggtgccgttggtatttatatcgcttctacaatggctccacatatcaagggtattatattggaaaacacgtttttatcaattaggaaaactgttcctcatatttttccgatgcttagatatcttgctgtgttgattcatcaagtttgggatctggaaaaattagtcagtacaattccttccaacatacctctcttaatgctaagtgcaagaaaggatgaaattgttccgccagagcatatggatcggattttttcattatcaaaaagtgatgataaaataatgtacaagtttgaaaattcgctgcataatgatacggttattcagtctgggtattgggagaagattcatgacttcgtcgataacaaagtaaacactgtttcccattag

SEQ ID NO: 12854 - protein, 286 aa, Debaryomyces hansenii CBS767
MAQIVLSIGVSLFVGLYSYQSSLIYPASLNDGHGYCATPDEYGMPGYELVNLKTEDGENLQCYLLKQNKESPTYSNKTIVVLSPNAGNIGHALPIVSMFYSNFGYNVFIYSYRGYGKSTGKPSEKGLKLDAQRIMQYLTIEDEQYQQSSIVLYGRSLGGAVGIYIASTMAPHIKGIILENTFLSIRKTVPHIFPMLRYLAVLIHQVWDLEKLVSTIPSNIPLLMLSARKDEIVPPEHMDRIFSLSKSDDKIMYKFENSLHNDTVIQSGYWEKIHDFVDNKVNTVSH

SEQ ID NO: 12855 - DNA, 1107 bp, Yarrowia lipolytica CLIB122
  CDS (1)..(1107)
atgaaagatgcactccaacgcactttgtgtaacttggcatctccatcatcacctccacacatcacccaacggcggacttttgacccaattggcaagctgtcgacccccaaaccccgccatcgactctctgctgtgtcacgtgaccgcacatctcgtcttctgcgccccctgatgacctcttccatccagcggtacgccttttatctgtttgggctgggtgccgccatcacggcgtttgtggctgctgggctgtacattttccagtccaagctcatctatccgtcaaatttccccgccgggtctcgaacacacgtggacacgcccgattctcagggcatgccgtcatacaaagatgtgacgattgagactgccgacggcgagaagatcaaggcgtttgtggttctgcacgacgagtcggagcccaactatgtgcccaagacggttcttctcctgtgtcccaatgccgggaacatggggcatgctctgcccattgtgcggctgttctaccaacagatgggctacaatgcggtgattttttcgtaccgaggatatggcttgagtacaggcacggccagcgaagtgggcatcaagacggacgcccgggcgctgtacaactatctgcagacccatccgcaaatcaaaaacacctctctggtgctgtatgggcgctctctgggcggcgcagtggccatttacatggcgtcgcagtttggcggctccgagggctccatcatcaagggtctgattcttgaaaacacctttctgagcatccccaagctcattgggtacgtgcttccgttcgcggcgccttttgcccgactctgccaccagaaatgggagtcggagaaactgatgcccctcatcaacccgcaaatccccacaatgttcctgtcggggctccgagacgaaatagtgccgcctccacacatgaagggactcattggcatgtgtccggccgacgtcaaggtcgtcgagtactttgctaacggaacccacaatgataccattgtccaacccgagtactgggagaagctcgttatgtttatccgaaaatatgtggtcccgattgagtctcacgaaaaggagaaggaagagcatctgcactaa

SEQ ID NO: 12856 - protein, 368 aa, Yarrowia lipolytica CLIB122
MKDALQRTLCNLASPSSPPHITQRRTFDPIGKLSTPKPRHRLSAVSRDRTSRLLRPLMTSSIQRYAFYLFGLGAAITAFVAAGLYIFQSKLIYPSNFPAGSRTHVDTPDSQGMPSYKDVTIETADGEKIKAFVVLHDESEPNYVPKTVLLLCPNAGNMGHALPIVRLFYQQMGYNAVIFSYRGYGLSTGTASEVGIKTDARALYNYLQTHPQIKNTSLVLYGRSLGGAVAIYMASQFGGSEGSIIKGLILENTFLSIPKLIGYVLPFAAPFARLCHQKWESEKLMPLINPQIPTMFLSGLRDEIVPPPHMKGLIGMCPADVKVVEYFANGTHNDTIVQPEYWEKLVMFIRKYVVPIESHEKEKEEHLH

SEQ ID NO: 12857 - DNA, 861 bp, Aspergillus nidulans FGSC A4
  CDS (1)..(861)
atgtgcagcgagttaatttatccccgaaatatccccgcagatgcacgtacgaatgtgcccaagcctcgccaatttggtatcgaggactacgaagagcttcagctacgtactccggacggcgaaagcttgcatgcttactttattcgtgctccccgcaaacgagtagaccagaatcttactgtgttaatgtttcacggcaatgcgggtaatgtgggccatcggattccaattgcgaaaataatgcaagactacctgggctgccatgttttgatgttggagtatcgtggttacggtttatccaccggcgtgccggacgaacatggactaaagattgacgctcagacagcgctcgatcacttgcgactaagaggagagacggcaaattcacggattgttgtatatggacagagccttgggggagccgtggccataaaccttgtcgcaaacaacgaagacaagggcagtatctccggtttgatcctcgagaatacctttctgagcatccgcaagttgatcccaaggcatgttcccagttccatctcagcttctaatatctgcacaatgataacaatatccagcgttttccctcccgctcgataccttgctcgtttctgccatcagacatggacgagcgaggaagttctgccgaagataacaaagactcctatactttttctgagtggactgcaagacgagattgtgccgccatcgaacatgacgcaattgttcgccatctgtaactccaagcgcaaagtgtggcgaactcttcccaacggtgcacacaatgacagtgtcgcagagccagattactttgagcatattcactcctttgtcactgaagaggtcctcaagcataactga

SEQ ID NO: 12858 - protein, 286 aa, Aspergillus nidulans FGSC A4
MCSELIYPRNIPADARTNVPKPRQFGIEDYEELQLRTPDGESLHAYFIRAPRKRVDQNLTVLMFHGNAGNVGHRIPIAKIMQDYLGCHVLMLEYRGYGLSTGVPDEHGLKIDAQTALDHLRLRGETANSRIVVYGQSLGGAVAINLVANNEDKGSISGLILENTFLSIRKLIPRHVPSSISASNICTMITISSVFPPARYLARFCHQTWTSEEVLPKITKTPILFLSGLQDEIVPPSNMTQLFAICNSKRKVWRTLPNGAHNDSVAEPDYFEHIHSFVTEEVLKHN

SEQ ID NO: 12859 - DNA, 891 bp, Candida albicans SC5314
  CDS (1)..(891): transl_table=12
atgttctcaactgcttacaagtttgctaaaatgattgcccaagctggattatctttaggtgttgttgctttaattggattgtatacttatcagaataacttgatttatccagcctcattgaatgacggacatgggtattgtgcgactccagatgaatacaacatgccgtatgaattaatcaatttacctactgaagatggagagttattacaatgttatctgttgaaacaagatccccatagcccctcgtattctaataagacaattttgatactatcacctaatgctggaaacattggtcatgccttgcccattgtatctatattttacaagaaatttggttataatgtgtttatttacagttatagaggctatggcaaatcaacaggaagcccatcagaaaagggattgaaaatggatgccgatagagtaatgcaatacttgacaaaggaagatagtcagtatcaacaatcgtctattatattatacggaagatctttgggaggtgcagttgctatatacattgctgctactaaaacatcttctattcatgccatgatattggaaaacacattcttgtctattagaaaaacagtgccacatgcttttccattgttaaagtatgtggctggatttgtacaccaaacctgggatctggagagtttagtacccttaatctcaccgaaagtccccgtgttattgttgtcggcaagaaaagatgaaattgtacctccactgcacatggatcgaatttacgagttgctcaaaagtgaaagcaagggaatgtttgaatttgagaattcgagtcacaacgacactgttgtacaagaaggctactgggatagagtacattcttttataaaaaataaggtaaaccctgtagggttttaa

SEQ ID NO: 12860 - protein, 296 aa, Candida albicans SC5314
MFSTAYKFAKMIAQAGLSLGVVALIGLYTYQNNLIYPASLNDGHGYCATPDEYNMPYELINLPTEDGELLQCYSLKQDPHSPSYSNKTILILSPNAGNIGHALPIVSIFYKKFGYNVFIYSYRGYGKSTGSPSEKGLKMDADRVMQYLTKEDSQYQQSSIILYGRSLGGAVAIYIAATKTSSIHAMILENTFLSIRKTVPHAFPLLKYVAGFVHQTWDSESLVPLISPKVPVLLLSARKDEIVPPSHMDRIYELLKSESKGMFEFENSSHNDTVVQEGYWDRVHSFIKNKVNPVGF

SEQ ID NO: 12861 - DNA, 1152 bp, Ustilago maydis 521
  CDS (1)..(1152)
atgggctacatgccttcgtttggctcgttggtccgtgtggtgggtggattacttgccgtcagtctcatctcgaccgctggactgctgtatcgctatcagacatcgctcatctacccggcctccttcccaccaggctccaaggccgaagtcaacactccagacgagtatgatctgccctacatcgaagaggagctcatcacacccgattcgcaacggctgcgcatctttgtgatgctccagggcaccaaactcgcacctcgccgatcgacgcccaagatccaggctgtggaggatgaaaagtcgtcattgcagcaggtcgagagaaagtcgaccgcaaatcacacaggcatcacaccgatagacgtggtcgatgccgagttggcgagcagcaggccgacagtgctgtttctgcatgccaatgcgggcaacatgggtcacaggctgcctctagcagccgtatttttcaaacgcttcggctgcaatgtcattatgctcagctatagaggctacggtttctccaccggctcgcccaacgaacgcgggatcaagattgacacgcaaaccacgctcgactacatccgctcgcacccagcgctttcatccacagttctcgtagcgtacggtcaaagcatcggaggagcagtagccatcgacctggccgctcgcaatccggcctcggttcacgctctcatcctcgaaaacacgtttctcagcatccccgaactcatcccgcacgtcctgccgcccgtacgaccttttgcgttcttgtgcagagaattctggaactccggtgttgccatctcgaacatttcgcacaaggtaccgacgctcttcctctcgggtcgacaggacgagctggtgccaccatcacatatggacgccctttttgcaaagtgcagcagcaacatcaagatcaaaaaggagtttgcagacggaacgcacaacgacacgtgtatcaaaccgcaatactttgagacaatcggagagttcctactgcagcatgtggtggggttggtccgcgacaaggcagcgttagccgcagtggagaccgagacgcacgagcagatggtcgaggacaagcaggagacggcgacgaggcccaagttggcgagcagccgaaacaagaccagcttcccgatgcacccacattga

SEQ ID NO: 12862 - protein, 383 aa, Ustilago maydis 521
MGYMPSFGSLVRVVGGLLAVSLISTAGLLYRYQTSLIYPASFPPGSKAEVNTPDEYDLPYIEEELITPDSQRLRIFVMLQGTKLAPRRSTPKIQAVEDEKSSLQQVERKSTANHTGITPIDVVDAELASSRPTVLFLHANAGNMGHRLPLAAVFFKRFGCNVIMLSYRGYGFSTGSPNERGIKIDTQTTLDYIRSHPALSSTVLVAYGQSIGGAVAIDLAARNPASVHALILENTFLSIPELIPHVLPPVRPFAFLCREFWNSGVAISNISHKVPTLFLSGRQDELVPPSHMDALFAKCSSNIKIKKEFADGTHNDTCIKPQYFETIGEFLLQHVVGLVRDKAALAAVETETHEQMVEDKQETATRPKLASSRNKTSFPMHPH

SEQ ID NO: 12863 - DNA, 936 bp, Aspergillus oryzae
  CDS (1)..(936)
atgtccgagtctccgccgcccccaccgtcttggagcatcaccaacatggccaacagtgccgctcagtacctaaggctgccggttttggcatcatctggtttggcagttgttgccagtggtcttttgtatttcaaacaaaatgagttgatctatcctcgcaatgttcctaccgatgcgcgcacctttgtaccgaagccccgacagtttggggtcaacaattacgaagaactccagattcctacgccggatggcgaatcattacatgccctcttccttcgtccctctaagaaaggtcttgccggtgatattactgtcttgatgttccatggaaatgccgggaatattggtcatcggattccgattgcaagggtcttgcttgatatactaggttgcaatgtgcttatgctggagtatcgcggctacgggctctcgaccggcgtcccggacgaagcagggctaaaaattgatgcccaaactggactcgactatatccgacaacgagcggagactagcaataacaaggttatagtttacgggcaaagtctaggaggagcggtcgcgatcaatcttgtggctgagaaccaagataagggtgacattggaggcctaatccttgaaaatacttttttgagtattcgcaagctgattccgacggtttttcctcccgcccggtaccttgctcgcttttgtcaccaatattggactagtgaagaggtcctacccaaaatcactaaagtccccattctgttccttagcggattgaaggacgaaatcgtccccccatcaaatatgactcagctctttgctatttgccaatcggaacgcaaagtatggcgcactttgccgaacggtgcccacaatgacagcgttgctgaaccaggctacttcgagcatattcattcctttatcaaggaagaagtcatcgatcaggactga

SEQ ID NO: 12864 - protein, 311 aa, Aspergillus oryzae
MSESPPPPPSWSITNMANSAAQYLRLPVLASSGLAVVASGLLYFKQNELIYPRNVPTDARTFVPKPRQFGVNNYEELQIPTPDGESLHALFLRPSKKGLAGDITVLMFHGNAGNIGHRIPIARVLLDILGCNVLMLEYRGYGLSTGVPDEAGLKIDAQTGLDYIRQRAETSNNKVIVYGQSLGGAVAINLVAENQDKGDIGGLILENTFLSIRKLIPTVFPPARYLARFCHQYWTSEEVLPKITKVPILFLSGLKDEIVPPSNMTQLFAICQSERKVWRTLPNGAHNDSVAEPGYFEHIHSFIKEEVIDQD

SEQ ID NO: 12865 - DNA, 900 bp, Schizosaccharomyces pombe
  CDS (1)..(900)
atggcaggttcattgtcttccgccatcttcaatgttctcaaatacagtggtatggcttccttagccgttaccctcattgctttgggcttcttgtacaagtaccaaaagaccctcgtttatcccagtgcctttcctcagggttctcgtgagaacgttccaacacccaaggaattcaacatggagtatgagcgtatcgagttgaggacccgtgacaaagtcactttggattcttatttaatgctacaatccgagtctcctgaatctcgtcccaccttactctactttcatgctaatgccggtaacatgggtcatcgtcttcccatcgctcgtgtattctattctgctctcaatatgaacgtcttcatcatttcctaccgtggttacggaaagagcaccggctctcctagcgaagctggtttaaaaattgactcccaaaccgctttggagtaccttatggaacatcccatttgttccaaaacaaaaatcgtcgtctatggtcaatctattggtggtgccgttgctatcgctctcaccgccaaaaatcaagatcgcatttctgctttgattcttgagaatacctttacttccatcaaggacatgattcccaccgtctttccctacggtggctccatcattagtcgcttttgcacagaaatatggtcaagtcaggacgagattagaaaaattaagaaattgccagtgctctttctttctggtgaaaaggatgaaatcgtccctcctcctcaaatggtccttttgtttggtttgtgcggtagtgctaagaaaaagtttcacagctttccaaaatgtactcataatgacacatgcctcggagatggttattttcaagtgattgctgactttctcgctgaaaatgatatcaacacacctgcttcttaa

SEQ ID NO: 12866 - protein, 299 aa, Schizosaccharomyces pombe
MAGSLSSAIFNVLKYSGMASLAVTLIALGFLYKYQKTLVYPSAFPQGSRENVPTPKEFNMEYERIELRTRDKVTLDSYLMLQSESPESRPTLLYFHANAGNMGHRLPIARVFYSALNMNVFIISYRGYGKSTGSPSEAGLKIDSQTALEYLMEHPICSKTKIVVYGQSIGGAVAIALTAKNQDRISALILENTFTSIKDMIPTVFPYGGSIISRFCTEIWSSQDEIRKIKKLPVLFLSGEKDEIVPPPQMVLLFGLCGSAKKKFHSFPKCTHNDTCLGDGYFQVIADFLAENDINTPAS

SEQ ID NO: 12867 - DNA, 927 bp, Brassica napus
  CDS (1)..(927)
atggtgacgtacgtgagcgcgttgttctacggagtaggagggatagtcgtcgccggcgtggggctgctcgttgccttccaggagaagctcgtctacgtccctgttctccccggcttatccaagtcgtatcccatcactcccgccaggctcaatctcatctacgaggacgtctggcttcgatcctccgatggcgtgcgcctccactcttggttcatcaaagtgttccccgattgtcgaggtccaaccattctatttttccaggagaatgctggaaatattgcacatcgtctagagatggttcgcatcatgatacagaaattgaagtgtaatgtattcatgctttcatatcgtggctatggggaaagtgagggttatccgtcacagcatggaatcataaaagatgctcaggctgcgttggatcacctttctcaaagggcagacattgatacttctagaatagttgtatttggaaggtcccttggaggagctgttggagctgtgcttaccaaaaataatcccgaaaaggtatctgcgttgattctggaaaatacattcacatccattcttgatatggctggtgttttgctgcccttcttgaagtggtttattggaggaagtggtactaaaagcctgaaacttcttaattttgttgtacgctccccctggaagacaattgatactattggtgaggtcaaacaacctgtacttttcctctctggactgaaagatgagatggtccctccgtttcacatgaaaatgctgtatgcgaaagcggctacccgtaactcgcaatgcacctttgtggaatttccaagcgggatgcatatggatacatggctgactggtggtgacgtctactggagaacggtcatgcagttccttgcaaagcatgcgcctgaggagaggaaagccgatacaggaacgtaa

SEQ ID NO: 12868 - protein, 308 aa, Brassica napus
MVTYVSALFYGVGGIVVAGVGLLVAFQEKLVYVPVLPGLSKSYPITPARLNLIYEDVWLRSSDGVRLHSWFIKVFPDCRGPTILFFQENAGNIAHRLEMVRIMIQKLKCNVFMLSYRGYGESEGYPSQHGIIKDAQAALDHLSQRADIDTSRIVVFGRSLGGAVGAVLTKNNPEKVSALILENTFTSILDMAGVLLPFLKWFIGGSGTKSLKLLNFVVRSPWKTIDTIGEVKQPVLFLSGLKDEMVPPFHMKMLYAKAATRNSQCTFVEFPSGMHMDTWLTGGDVYWRTVMQFLAKHAPEERKADTGT

SEQ ID NO: 12869 - DNA, 960 bp, Triticum aestivum
  CDS (1)..(960)
atggtggggtggctcaaggcgctggtgtacggcgcagggggcatggcggtggtgggcctggcggcgctggtggcgctgcaggagcgcctcgtctacgtgcccgtgctccctggcctcccgcgcgcttaccccatcaagccctcgcgcctccgcctcatctacgaggacgtctggctccgcgccgccgacggcgtgcgcctccactcctggttcctccgccactctcccacctgccgaggtccgaccattctgttcttccaggaaaatgctggcaatattgcacatcgtttggaatgcgttcgactaatgatgcagcggctacagtgcaatgtgtttatgctttcttatagagggtatggtgagagcgaaggttatccttctcagagtggcatcacaaaagatgcacaggccgcacttgatcatctacttcagaggaaggacattgacacatccaggatagttatctttgggagatctttaggaggtgctgttggagcagttcttgcaaaaaacaatcctgacaaggtgtctgctctaatattggaaaatacgtttacatctatattggatatggctggtatcatgctgcccttcttaagatggttcataggcggtagttctgccaaaggcccaaaacttcttaactgcgttgttcgctctccatggagtacacttgatgttgttgcagaggtcaaacagcccattctcttcctttctggattgcaagatgaactggttcccccttcacacatgaggatgctgtatgacaaagctgttgaacataacaggaattgtaggtttgttgattttctcaatggtatgcatatggatacctggatttctggaggggaccgctactggaggacaatcgaattgtttctggaccaatattccccagaagtacagagttctgatgccagctgcacaagtgaaattgctgatgatgataaagctgcataa

SEQ ID NO: 12870 - protein, 319 aa, Triticum aestivum
MVGWLKALVYGAGGMAVVGLAALVALQERLVYVPVLPGLPRAYPIKPSRLRLIYEDVWLRAADGVRLHSWFLRHSPTCRGPTILFFQENAGNIAHRLECVRLMMQRLQCNVFMLSYRGYGESEGYPSQSGITKDAQAALDHLLQRKDIDTSRIVIFGRSLGGAVGAVLAKNNPDKVSALILENTFTSILDMAGIMLPFLRWFIGGSSAKGPKLLNCVVRSPWSTLDVVAEVKQPILFLSGLQDELVPPSHMRMLYDKAVEHNRNCRFVDFLNGMHMDTWISGGDRYWRTIELFLDQYSPEVQSSDASCTSEIADDDKAA

SEQ ID NO: 12871 - DNA, 951 bp, Linum usitatissimum
  CDS (1)..(951)
atggtgtcctacttcaacgtgttgctctacggcgtcggcggaatagtattcgccggaatggccttgcttgtcgcctttcaagagcgcctcgtctacgtccccgtcgtccccggtctcaccaagtcctacccgattactcccgcccgcctccgtctcacttacgaggacgtctggctcagatcctccgatggcgtccgccttcatgcctggtttattaagctcttcccggactgcagaggtccaaccatccttttcttccaggaaaatgcaggaaatattgctcatcgtcttgaaatggtccgcataatgttacagaagttgcagtgcaatgtgttcatgctttcttaccgtggttacggagcaagtgatgggtttccttcccaacatggaattacaaaggatgctgaggctgctttggatcatctttgtcaacggagtgatattgatacctcgagaattgttgtgtttgggaggtcacttggaggtgctgttggggccctacttacgaaaagcaaccctgataaggttgctggtctcatactggaaaatacatttacgtccattctggatatggcaggagttctccttccctttctgaagtgggttatcggaggatctggggagaaaggtgttaaaattcttaattttgttgtacgttctccttggagcaccattgatgtaattggacaggttaagcgaccaatcctattcctgtcaggtttgcaagatgaaatggttcctccatcccatatgcagatgctttatggtaaagcagctgctcacaacaaggaatgtttgttcgtggaatttccttccggcatgcacatggatacctggttagccggtggggatcattattgggaaacagttcagatgttcctcgaaaaatatgctccgaggaatgatgtaactgattcttcttctagcattagtcatgatttcgaaggatga

SEQ ID NO: 12872 - protein, 316 aa, Linum usitatissimum
MVSYFNVLLYGVGGIVFAGMALLVAFQERLVYVPVVPGLTKSYPITPARLRLTYEDVWLRSSDGVRLHAWFIKLFPDCRGPTILFFQENAGNIAHRLEMVRIMLQKLQCNVFMLSYRGYGASDGFPSQHGITKDAEAALDHLCQRSDIDTSRIVVFGRSLGGAVGALLTKSNPDKVAGLILENTFTSILDMAGVLLPFLKWVIGGSGEKGVKILNFVVRSPWSTIDVIGQVKRPILFLSGLQDEMVPPSHMQMLYGKAAAHNKECLFVEFPSGMHMDTWLAGGDHYWETVQMFLEKYAPRNDVTDSSSSISHDFEG

SEQ ID NO: 12873 - DNA, 1428 bp, Brassica napus
  CDS (89)..(1012)
ccggtcgacatttcgttggattcgattacattcggcctctgctcagctacgagcagacggatagagagagagagagagagagggaacaatggcgtacgtgagcgcgttgttctacggagtaggagggatagtcgtcgccggcgtggcgctgctcgttgccttccaggagaagctcgtctacgtcccggttctccccggtttatccaagtcatatcccatcactcccgccaggctcaatctcatctacgaggacgtctggcttcgatcctccgatggcgtgcgcctccactcttggttcatcaaaatgttccccgattgtcgaggtccaaccattctatttttccaggagaatgctggaaatattgctcatcgtctagagatggttcgcatcatgatacaaaaattgaagtgtaatgtattcatgctttcatatcgcggctatggggaaagtgagggttatccgtcacagcatggaatcataaaagatgctcaggctgcgttggatcacctttctcaaaggacagacattgatacttctagaatagttgtatttggaaggtcccttggaggagctgttggagctgtgcttaccaaaaacaatcctgaaaaggtatctgcattgattctggaaaacactttcacatccattcttgatatggctggtgttttgctgcccttcttgaagtggtttattggaggaagtggtactaaaagcctgaaacttcttaattttgttgtacgctccccctggaagacaattgatgctattggtgaggtcaaacaacctgtacttttcctctctggactgcaagatgagatggtccctccgtttcacatgaaaatgctgtatgctaaagcggctacccgtaactctcagtgcacatttgtggaatttccgagtgggatgcatatggatacatggctgactgggggtgacgtctactggagaacggtcatgcagttccttgcaaagcatgcgcctgaggagaggaaagccgatacaggaacgtaactagctgacgaagctgtgtgtttagaggaagtttcaactcagttggctcctactgcaacctgaaacattagtatctttataagcatatgtgtgtgtgtgtgggtatgttgcattatgggagtggcagatacaatttgtactgagagtaagatgctggataagggagcctgtgggagatggcaaatgtacgttaatcatatgcatttttgcgttgtttcagttttgctttcgtctgtttttttggggggttttttttagtcaatttttttggttatttaacggttggttggtggcttctcttatgatacttaccattccctctaaaggataattgccctgtagatgattgagaaagtgcaaagacactggttatatgattaaaatctcaaatttgttgtttgaaaaaaaaaaaaaaa

SEQ ID NO: 12874 - protein, 307 aa, Brassica napus
MAYVSALFYGVGGIVVAGVALLVAFQEKLVYVPVLPGLSKSYPITPARLNLIYEDVWLRSSDGVRLHSWFIKMFPDCRGPTILFFQENAGNIAHRLEMVRIMIQKLKCNVFMLSYRGYGESEGYPSQHGIIKDAQAALDHLSQRTDIDTSRIVVFGRSLGGAVGAVLTKNNPEKVSALILENTFTSILDMAGVLLPFLKWFIGGSGTKSLKLLNFVVRSPWKTIDAIGEVKQPVLFLSGLQDEMVPPFHMKMLYAKAATRNSQCTFVEFPSGMHMDTWLTGGDVYWRTVMQFLAKHAPEERKADTGT

SEQ ID NO: 12875 - DNA, 26 bp, Artificial sequence
  primer
atgttgtggaaagtttctaagatgtt

SEQ ID NO: 12876 - DNA, 27 bp, Artificial sequence
  primer
ttagataaaacccttctctattagaaa

SEQ ID NO: 12877 - protein, 344 aa, Artificial sequence
  consensus sequence
  Variant (2)..(4): Xaa in position 2 to 4 is any amino acid
  Variant (6)..(6): Xaa in position 6 is any amino acid
  Variant (7)..(7): Xaa in position 7 is any or no amino acid
  Variant (9)..(9): Xaa in position 9 is any amino acid
  Variant (11)..(21): Xaa in position 11 to 21 is any amino acid
  Variant (22)..(24): Xaa in position 22 to 24 is any or no amino acid
  Variant (26)..(31): Xaa in position 26 to 31 is any amino acid
  Variant (32)..(32): Xaa in position 32 is any or no amino acid
  Variant (35)..(37): Xaa in position 35 to 37 is any amino acid
  Variant (39)..(41): Xaa in position 39 to 41 is any amino acid
  Variant (44)..(45): Xaa in position 44 to 45 is any amino acid
  Variant (47)..(58): Xaa in position 47 to 58 is any amino acid
  Variant (59)..(105): Xaa in position 59 to 105 is any or no amino acid
  Variant (107)..(107): Xaa in position 107 is any amino acid
  Variant (109)..(112): Xaa in position 109 to 112 is any amino acid
  Variant (118)..(118): Xaa in position 118 is any amino acid
  Variant (120)..(120): Xaa in position 120 is any amino acid
  Variant (122)..(133): Xaa in position 122 to 133 is any amino acid
  Variant (137)..(138): Xaa in position 137 to 138 is any amino acid
  Variant (145)..(145): Xaa in position 145 is any amino acid
  Variant (147)..(147): Xaa in position 147 is any amino acid
  Variant (149)..(149): Xaa in position 149 is any amino acid
  Variant (151)..(153): Xaa in position 151 to 153 is any amino acid
  Variant (155)..(157): Xaa in position 155 to 157 is any amino acid
  Variant (160)..(165): Xaa in position 160 to 165 is any amino acid
  Variant (167)..(180): Xaa in position 167 to 180 is any amino acid
  Variant (181)..(181): Xaa in position 181 is any or no amino acid
  Variant (183)..(183): Xaa in position 183 is any amino acid
  Variant (190)..(204): Xaa in position 190 to 204 is any amino acid
  Variant (205)..(208): Xaa in position 205 to 208 is any or no amino acid
  Variant (215)..(215): Xaa in position 215 is any amino acid
  Variant (218)..(225): Xaa in position 218 to 225 is any amino acid
  Variant (226)..(244): Xaa in position 226 to 244 is any or no amino acid
  Variant (246)..(257): Xaa in position 246 to 257 is any amino acid
  Variant (258)..(269): Xaa in position 258 to 269 is any or no amino acid
  Variant (271)..(281): Xaa in position 271 to 281 is any amino acid
  Variant (282)..(284): Xaa in position 282 to 284 is any or no amino acid
  Variant (286)..(286): Xaa in position 286 is any amino acid
  Variant (292)..(293): Xaa in position 292 to 293 is any amino acid
  Variant (296)..(296): Xaa in position 296 is any amino acid
  Variant (300)..(300): Xaa in position 300 is any amino acid
  Variant (303)..(304): Xaa in position 303 to 304 is any amino acid
  Variant (306)..(318): Xaa in position 306 to 318 is any amino acid
  Variant (319)..(320): Xaa in position 319 to 320 is any or no amino acid
  Variant (322)..(323): Xaa in position 322 to 323 is any amino acid
  Variant (325)..(325): Xaa in position 325 is any amino acid
  Variant (327)..(327): Xaa in position 327 is any amino acid
  Variant (330)..(333): Xaa in position 330 to 333 is any amino acid
  Variant (335)..(336): Xaa in position 335 to 336 is any amino acid
  Variant (338)..(343): Xaa in position 338 to 343 is any amino acid
LXXXQXXLXYXXXXXXXXXXXXXXPXXXXXXXYEXXXLXXXDGXXLXXXXXXXXXXXXXXXXXXXXXXXXXXXXXXXXXXXXXXXXXXXXXXXXXXXXXXXXXXXTXLXXXXNAGNIXHXLXXXXXXXXXXXXNVFXXSYRGYGXSXGXPXXXGXXXDAXXXXXXLXXXXXXXXXXXXXXXGXSLGGAVXXXXXXXXXXXXXXXXXXXILENTFXSIXXXXXXXXXXXXXXXXXXXXXXXXXXXPXXXXXXXXXXXXXXXXXXXXXXXXWXXXXXXXXXXXXXXPXLFLSGXXDEXVPPXHMXXLXXXXXXXXXXXXXXXFXXGXHXDTXXXXGXXYXXXXXXF

SEQ ID NO: 12878 - protein, 53 aa, Artificial sequence
  protein pattern
  Variant (6)..(6): Xaa in position 6 is Ala or Gly
  Variant (7)..(7): Xaa in position 7 is His or Tyr
  Variant (8)..(8): Xaa in position 8 is any amino acid
  Variant (9)..(9): Xaa in position 9 is Ile or Leu
  Variant (10)..(11): Xaa in position 10 to 11 is any amino acid
  Variant (12)..(12): Xaa in position 12 is Ala, Ile or Val
  Variant (13)..(13): Xaa in position 13 is Asp, Arg or Ser
  Variant (14)..(14): Xaa in position 14 is any amino acid
  Variant (15)..(15): Xaa in position 15 is Phe, Ile, Leu or Met
  Variant (16)..(18): Xaa in position 16 to 18 is any amino acid
  Variant (19)..(19): Xaa in position 19 is Phe, Ile, Leu or Met
  Variant (20)..(21): Xaa in position 20 to 21 is any amino acid
  Variant (22)..(22): Xaa in position 22 is Asn or Ser
  Variant (23)..(23): Xaa in position 23 is Ile or Val
  Variant (24)..(24): Xaa in position 24 is Phe or Leu
  Variant (25)..(25): Xaa in position 25 is Ile, Leu or Met
  Variant (26)..(26): Xaa in position 26 is any amino acid
  Variant (27)..(27): Xaa in position 27 is Glu or Ser
  Variant (33)..(33): Xaa in position 33 is any amino acid
  Variant (35)..(35): Xaa in position 35 is any amino acid
  Variant (37)..(37): Xaa in position 37 is any amino acid
  Variant (38)..(38): Xaa in position 38 is Ala or Pro
  Variant (39)..(39): Xaa in position 39 is Asp or Ser
  Variant (40)..(40): Xaa in position 40 is Glu or Gln
  Variant (41)..(41): Xaa in position 41 is any amino acid
  Variant (43)..(43): Xaa in position 43 is Ile or Leu
  Variant (44)..(45): Xaa in position 44 to 45 is any amino acid
  Variant (48)..(48): Xaa in position 48 is Asp, Glu or Gln
  Variant (49)..(49): Xaa in position 49 is any amino acid
  Variant (50)..(50): Xaa in position 50 is Ala, Gly, Ile or Val
  Variant (51)..(51): Xaa in position 51 is Ile, Leu or Met
  Variant (52)..(52): Xaa in position 52 is Asp, Asn, Gln or Ser
  Variant (53)..(53): Xaa in position 53 is His or Tyr
NAGNIXXXXXXXXXXXXXXXXXXXXXXYRGYGXSXGXXXXXGXXXDAXXXXXX

SEQ ID NO: 12879 - protein, 25 aa, Artificial sequence
  protein pattern
  Variant (2)..(3): Xaa in position 2 to 3 is any amino acid
  Variant (8)..(9): Xaa in position 8 to 9 is any amino acid
  Variant (12)..(12): Xaa in position 12 is Ile, Leu or Met
  Variant (16)..(17): Xaa in position 16 to 17 is any amino acid
  Variant (19)..(20): Xaa in position 19 to 20 is any amino acid
  Variant (22)..(22): Xaa in position 22 is any amino acid
  Variant (23)..(23): Xaa in position 23 is Ala, Asp, Glu or Gly
  Variant (24)..(24): Xaa in position 24 is any amino acid
  Variant (25)..(25): Xaa in position 25 is Ala, Cys or Ser
PXXFLSGXXDEXVPPXXMXXLXXXX

SEQ ID NO: 12880 - protein, 18 aa, Artificial sequence
  protein pattern
  Variant (7)..(7): Xaa in position 7 is any amino acid
  Variant (10)..(10): Xaa in position 10 is any amino acid
  Variant (11)..(11): Xaa in position 11 is Asp or Lys
  Variant (12)..(12): Xaa in position 12 is Leu, Met or Val
  Variant (13)..(13): Xaa in position 13 is Ala or Ile
  Variant (14)..(14): Xaa in position 14 is Gly or Pro
  Variant (15)..(16): Xaa in position 15 to 16 is any amino acid
  Variant (17)..(17): Xaa in position 17 is Phe, Leu or Val
ILENTFXSIXXXXXXXXP

SEQ ID NO: 12881 - protein, 16 aa, Artificial sequence
  protein pattern
  Variant (2)..(3): Xaa in position 2 to 3 is any or no amino acid
  Variant (5)..(5): Xaa in position 5 is Gln or Arg
  Variant (7)..(7): Xaa in position 7 is Ile or Leu
  Variant (11)..(11): Xaa in position 11 is Asn or Val
  Variant (12)..(12): Xaa in position 12 is Ala or Gly
  Variant (13)..(13): Xaa in position 13 is Ala, Ile or Leu
  Variant (14)..(14): Xaa in position 14 is any amino acid
  Variant (15)..(15): Xaa in position 15 is Ile, Leu or Met
  Variant (16)..(16): Xaa in position 16 is Ala, Thr or Val
VXXGXSXGGAXXXXXX

SEQ ID NO: 12882 - protein, 20 aa, Artificial sequence
  protein pattern
  Variant (2)..(2): Xaa in position 2 is any or no amino acid
  Variant (4)..(5): Xaa in position 4 to 5 is any amino acid
  Variant (6)..(6): Xaa in position 6 is any or no amino acid
  Variant (8)..(8): Xaa in position 8 is any amino acid
  Variant (9)..(9): Xaa in position 9 is Ala, Ser or Thr
  Variant (10)..(10): Xaa in position 10 is any amino acid
  Variant (12)..(14): Xaa in position 12 to 14 is any amino acid
  Variant (16)..(17): Xaa in position 16 to 17 is any amino acid
  Variant (18)..(18): Xaa in position 18 is Phe, Trp or Tyr
  Variant (19)..(19): Xaa in position 19 is any amino acid
  Variant (20)..(20): Xaa in position 20 is Ile, Leu or Met
YXEXXXLXXXDXXXLXXXXX

SEQ ID NO: 12883 - DNA, 1026 bp, Saccharomyces cerevisiae
  CDS (1)..(1026)
atgagactgccagaaatctccatttggaaagtgatactactacttcatttgtttgctctacaagaatttcaacttgtctccgctgcaaatttgccctctttatcaagtagtacaaaggcagcagatagttctagtaaaggcagctcttcagccaagacaaccacgtccttaggcaaaagctcagtaaccagtaaggatgtttcgtcaagtcataatgtcacttcaagcactaaaatgcccaaaatcaccacgagcgctagtacaagcttatacaccaactctagtttatggagcaacaacagtgtaatatcaacttcatctattacaccttccagcgtttatatcccggttacggacggaaataaattcttatatcaggctcatcatcctaacggtactgtgttcattgcatttgctggctgtttaggtgcaattctactatcactgacgggtgcatggattgcattgaatataaagtcatggcgaagtgctagaaaggaaaataagctgagaaatctagaaaatcaataccaacacgatcctttctacttccaaacaaacattaatgacgacgaaagtgaaacatcttcccattctgacgacagtgacatatcagaaaaagttctgaaaaataactcatctcgtatgagtttgtatactctaggatccacttctgttttgaatcttttgaacaataaaacagatgccaacgataacttcagatcatctatgtttatttcacccaccgaaattctgcaatctgatgccaacaactctaatacatggtctcaaagcaatgagagtgctatatatgattccttgtccagtactccaagggaacctggtgctacccaaatactgggaaagtttacagacagcactaatccattcaattatacatcatacaatttaagtcccgactctgaagaccgctctactccaaaatcaaatgttagtcagggtaaagtaaagaagtaccgtcctcccagtgttcatctggatcaactgctcgacggtaaggaataa

SEQ ID NO: 12884 - protein, 341 aa, Saccharomyces cerevisiae
MRLPEISIWKVILLLHLFALQEFQLVSAANLPSLSSSTKAADSSSKGSSSAKTTTSLGKSSVTSKDVSSSHNVTSSTKMPKITTSASTSLYTNSSLWSNNSVISTSSITPSSVYIPVTDGNKFLYQAHHPNGTVFIAFAGCLGAILLSLTGAWIALNIKSWRSARKENKLRNLENQYQHDPFYFQTNINDDESETSSHSDDSDISEKVLKNNSSRMSLYTLGSTSVLNLLNNKTDANDNFRSSMFISPTEILQSDANNSNTWSQSNESAIYDSLSSTPREPGATQILGKFTDSTNPFNYTSYNLSPDSEDRSTPKSNVSQGKVKKYRPPSVHLDQLLDGKE

SEQ ID NO: 12885 - DNA, 1074 bp, Candida glabrata CBS 138
  CDS (1)..(1074)
atgaaatcttcacaagttacacagatatttttgctcatagcatccttcctagtctcgtctgttgacgccgttgtggttgcaacacagccttcccaccacttgcatatgagagggttgccaaaactggtgacaacaagtgaaacaccaactccaacttctacagaagagcctagtacatcctcaacctcagacaactcagagagctctgaaactgaaggatcatccacagaaattacaagcacttccgaatcctccatttattctgaatctgtaacagcatctagcacaacaagcgatactgattcagaaacatccagcacgacaagctatacttcctataccccatcaactacttctgtttccgttggcccaatatatattccaagtgcacaaaataacaagtatgtttatcatgctacacatccatctggtaccgtttttaccgcctttggtagttgtctagcatttattgctctagttcttgtgttagtttggatagcattaactctacggtcttggaaaaatgcaagaaaagaataccaaattagagaacgggaaaataaatatcagcttgatccttactacttccaaaatggtgacaaggatgattattctagtagtgactctgatgttgcaagtgatatatctgaaaagattctgaagaagaaagcttcaaggatgagtttgtatagcttaggaggtggctcggcgtttaatcttttgagctccgaaaagcttgacactaaaccaccagcaccaccatcaaacaatccacgtttatctatgttcatttctcccactgaaatactaaaaaacgagggtaatacatggagtacagatagctcggcattcaattcattaactagcactcctcgtgagcaatctgttgccaatataatagtgccccaaaatggtctcaataaactgggtgacccacctttcacagggaaaaacctaagtaatatggacatatcgtctacacctggtgtggcaataccaaaacctaatgggaatcaaaaaagaggtagacctccgagcgctcatttagatgaccttctcgacggcatccaataa

SEQ ID NO: 12886 - protein, 357 aa, Candida glabrata CBS 138
MKSSQVTQIFLLIASFLVSSVDAVVVATQPSHHLHMRGLPKLVTTSETPTPTSTEEPSTSSTSDNSESSETEGSSTEITSTSESSIYSESVTASSTTSDTDSETSSTTSYTSYTPSTTSVSVGPIYIPSAQNNKYVYHATHPSGTVFTAFGSCLAFIALVLVLVWIALTLRSWKNARKEYQIRERENKYQLDPYYFQNGDKDDYSSSDSDVASDISEKILKKKASRMSLYSLGGGSAFNLLSSEKLDTKPPAPPSNNPRLSMFISPTEILKNEGNTWSTDSSAFNSLTSTPREQSVANIIVPQNGLNKLGDPPFTGKNLSNMDISSTPGVAIPKPNGNQKRGRPPSAHLDDLLDGIQ

SEQ ID NO: 12887 - DNA, 25 bp, Artificial sequence
  primer
atgagactgccagaaatctccattt

SEQ ID NO: 12888 - DNA, 24 bp, Artificial sequence
  primer
ttattccttaccgtcgagcagttg

SEQ ID NO: 12889 - DNA, 1941 bp, Saccharomyces cerevisiae
  CDS (1)..(1941)
atgattggtgcctttaagaggaaccgtggaagttctcagtcttttgcgaaggaatgtcaaccttctacgttaaaagccaaccttgaagtggcaaaagaacttccattctcagatcgtcgcgatttcgaggatgccactcaaggttacatcggctccttatctgatgagcaaataatcggccctgacggcggtgtagtatggtgtatgaaatcttatggctttttggagcctgagacgcccgcaaatactgttaaccctagcttgtggagacaagcgcagctgaatgccattcatggcctatttaaaatcactgacaacgtttaccaggttagaggactagatatctctaatatgactataatcgaaggtaatacttctttgataatcattgatacgctttttaccacagagactgcccaagagtcgcttaaactttactatagacatcgtcctcagaaacctgtgcgtaccgtaatatatacgcatagccattcggaccactatggaggagttaaaggaattgtcaaggaagcagatgtgaaatccggagaggtgcaaataatagccccagttggcttcatggaaagtgttgtagcagaaaacattctggcagggaatgcgatgcatcgacgttcccaatatcagtttggtatgttactttctcccagtgttaagggtcatgttgattgtgggatagggaaagctgcctctcacggaacagttacactgattgcaccaactattattatagaagagcccgtcgaagaacggacaattgatggtgtagattttgtttttcagcttgcacctggatcggaagcgccttcggaaatgctcatttatatgccacaacagcgtgtgctcaacatggcagaagatgtgacacatcatatgcataacttgtatgctcttcgaggtgttgaagtacgcgacggcaaccaatgggctaaatacatcgatgcagctcgagttgctttcggtagcaaaacggacgttttaattgcccagcatcactggcccactacagggcaaatgcggatcaatgaattgctgaagaagcagcgggatatgtataaattcattcatgaccaaacacttcgattgcttaatcagggatataccagtagagatatcgccgaaactcttcgtatgccatccagtcttgagcaagaatggtcaacacgaggttactacggcactttgagtcacaatgtaaaggctgtgtatcaaaaatacctggggtggtatgatgcaaatccggctaacctaaaccctttgccacccgtagcctatgcaaagaaagcagtcgagtatatgggcggcgctgatgctgtattggcacgggcttataaagatttccagaaaggagagtttcgttgggttgcaagcgttgttaatcaattggttttcgctgacccaaataaccatcaagctcgtgagctctgtgctgacgcattggaacagctggggtatcaagcagaagccagcacgtggcgcaacgcttaccttgtaggcgccatggagttgcgccaaggtgtaccaaaaagacgaagtactggtaagcgcaacaatattgccgttttgaataacgaaatgttttttgactttcttgctgtgagattgaacgctacgaaagcagaaggtaaaattatcgttagtaattggtgtttcattaattcaaatgaacggttcgtgatcactctcgaaaactgtgccctgacctacattcagggctggcagacagatgcagatgcaacaattactctcaaaagaactacatttgaagctttattggccaatgaaattactatggttgattttttaagatcaaaagaagtcgaaatagagggtaatcgactcagaattgaagagctgttgaagttgtttgacgacttcgaccagtcctttcccgtcgttgagcctatggggggaagcacttga

SEQ ID NO: 12890 - protein, 646 aa, Saccharomyces cerevisiae
MIGAFKRNRGSSQSFAKECQPSTLKANLEVAKELPFSDRRDFEDATQGYIGSLSDEQIIGPDGGVVWCMKSYGFLEPETPANTVNPSLWRQAQLNAIHGLFKITDNVYQVRGLDISNMTIIEGNTSLIIIDTLFTTETAQESLKLYYRHRPQKPVRTVIYTHSHSDHYGGVKGIVKEADVKSGEVQIIAPVGFMESVVAENILAGNAMHRRSQYQFGMLLSPSVKGHVDCGIGKAASHGTVTLIAPTIIIEEPVEERTIDGVDFVFQLAPGSEAPSEMLIYMPQQRVLNMAEDVTHHMHNLYALRGVEVRDGNQWAKYIDAARVAFGSKTDVLIAQHHWPTTGQMRINELLKKQRDMYKFIHDQTLRLLNQGYTSRDIAETLRMPSSLEQEWSTRGYYGTLSHNVKAVYQKYLGWYDANPANLNPLPPVAYAKKAVEYMGGADAVLARAYKDFQKGEFRWVASVVNQLVFADPNNHQARELCADALEQLGYQAEASTWRNAYLVGAMELRQGVPKRRSTGKRNNIAVLNNEMFFDFLAVRLNATKAEGKIIVSNWCFINSNERFVITLENCALTYIQGWQTDADATITLKRTTFEALLANEITMVDFLRSKEVEIEGNRLRIEELLKLFDDFDQSFPVVEPMGGST

SEQ ID NO: 12891 - DNA, 1977 bp, Pseudomonas aeruginosa PAO1
  CDS (1)..(1977): transl_table=11
atgagccgtctgcttgcactcctggcgctcgccccgctgctcgccggcgccgccgaaaccaccgcgcccaaaccgcccagtgccttcaccgtcgaggcccagcggcgggtcgaagcggaattgcccttcgccgaccgcgccgacttcgagcgcgccgaccgcggcctgatccggcgcccggagcggttactcatccgcaaccccgacggcagcgtcgcctggcagctcggtggctacgacttcctcctcgacggcaagcctcgcgacagcatcaatcccagcctgcaacgccaggccctgctcaatctcaagtacggcttgttcgaggttgccgagggtatctaccaggtgcgcggcttcgacctggccaacatcaccttcatccgcggcgacagcggctggatcgtggtcgacaccctgaccaccccggccaccgccagggcggcctacgaactggtcagccgcgagctgggcgagaggccgatccgtacggtgatctacagccacgcccacgccgatcactttggaggcgtgcgcggtctggtagagccacagcaggtcgccagcggcgcggtgcagatcatcgctccggccggcttcatggaggcggcgatcaaggagaacgtcctggccggcaacgccatgatgcgccgcgccacctaccagtacggcacgcaactgcccaaggggccgcaggggcaggtcgacatggccatcggcaagggattggcgcgcggaccgctgagcctgctggcgccgacccgcctgatcgaaggcgagggcgaggacctggtgctggacggcgtgccgttcaccttccagaacacgccgggcaccgagtcgccggcggagatgaacatctggctgccgcggcagaaggccctgctgatggccgagaacgtggtcggtaccctgcacaacctgtacaccctgcgcggcgccgaggtacgtgatgcgctgggctggagcaagtacatcaaccaggcgctgcatcgtttcggcaggcaggccgaggtgatgttcgcggtgcacaactggccgcgctggggcaacgcggagatcgtcgaggtgctggagaagcagcgcgacctgtacggctacctgcacgaccagaccctgcacctggccaaccagggcgtgaccatcggccaggtgcacaaccgcctgcgcctgccgcccagcctcgaccaggaatggtacgaccgcggctaccacggctcggtcagccataacgcacgggccgtgctgaaccgctacctgggctactacgacggcaacccggcgaccctcgacccgctcagcccggaggactcggcgggccgctacgtggaatacatgggcggcgccgagcgcctgttggagcaagcgcgggcgtcgtacgccaggggcgaataccgttgggtggtcgaggtggtcaacaggctggtcttcgccgagccggataatcgggccgcgcgcgagctgcaggccgacgccctggagcaactcggctaccaggcggagaacgccggctggcgcaacagctacctcagcgccgcctacgaactgcgccacggcgtaccgcgcgaccagccgacgatgaaggccggcagcgccgatgccctggcggcgatggacaccggcctgctgttcgactatctcggcgtgcgcctggacgccggcgctgcggagggcaaggcgctgagcatcaacctgcgcctgccggacatcggtgagaactacctgctggaactgaagaactcgcacctgaacaacctgcgcggcgtgcagagcgaggacgccgggcagaccgtgagcatcgaccgcgccgatctcaaccggctgctgctcaaagaggtatcggcggtacgcctggtcttcgagggcaagctgaagagttccggcaatccgctgttgctggggcaactgttcggcatgctcggcgacttcgacttctggttcgatatcgtcacgccggcggcgaagtccgaaggctga

SEQ ID NO: 12892 - protein, 658 aa, Pseudomonas aeruginosa PAO1
MSRLLALLALAPLLAGAAETTAPKPPSAFTVEAQRRVEAELPFADRADFERADRGLIRRPERLLIRNPDGSVAWQLGGYDFLLDGKPRDSINPSLQRQALLNLKYGLFEVAEGIYQVRGFDLANITFIRGDSGWIVVDTLTTPATARAAYELVSRELGERPIRTVIYSHAHADHFGGVRGLVEPQQVASGAVQIIAPAGFMEAAIKENVLAGNAMMRRATYQYGTQLPKGPQGQVDMAIGKGLARGPLSLLAPTRLIEGEGEDLVLDGVPFTFQNTPGTESPAEMNIWLPRQKALLMAENVVGTLHNLYTLRGAEVRDALGWSKYINQALHRFGRQAEVMFAVHNWPRWGNAEIVEVLEKQRDLYGYLHDQTLHLANQGVTIGQVHNRLRLPPSLDQEWYDRGYHGSVSHNARAVLNRYLGYYDGNPATLDPLSPEDSAGRYVEYMGGAERLLEQARASYARGEYRWVVEVVNRLVFAEPDNRAARELQADALEQLGYQAENAGWRNSYLSAAYELRHGVPRDQPTMKAGSADALAAMDTGLLFDYLGVRLDAGAAEGKALSINLRLPDIGENYLLELKNSHLNNLRGVQSEDAGQTVSIDRADLNRLLLKEVSAVRLVFEGKLKSSGNPLLLGQLFGMLGDFDFWFDIVTPAAKSEG

SEQ ID NO: 12893 - DNA, 1998 bp, Escherichia coli O157:H7 EDL933
  CDS (1)..(1998): transl_table=11
  misc_feature (969)..(969): s is g or c
atggagatttatatgaataactctcggttattccgtttgagcaggattgttattgcgttaactgccgccagcggcatgatggtaaataccgctaacgcgaaagaggaagcgaaagccgccactcaatatacccaacaggttaatcagaattacgccaaatcattaccgtttagcgatcgtcaggattttgacgatgcccagcgtggatttatcgccccgctgctggatgaaggtattctgcgtgatgcgaacggtaaagtttactaccgcgcagacgattacaaatttgatattaatgccgctgcgccggaaaccgtaaaccccagcctgtggcgtcagtcgcagatcaacggcatttctggcctgttcaaagtcaccgataaaatgtatcaggtgcgcggccaggatatctctaacattacgttcgttgagggggagaaaggcattattgtcatcgacccgctggtgacgccgcctgccgcaaaagccgcacttgacctttacttccagcatcgtccgcaaaaaccgattgttgccgttatctacactcacagccacaccgaccactatggtggcgtgaaaggcattatctctgaagccgatgttaaatccggcaaagttcaggtgattgcccctgctggctttatggacgaagccatcagcgaaaacgtgctggcgggtaacatcatgagccgccgtgcgctctactcttacggtctgttactgccgcacaacgcgcaaggcaacgtgggtaatggccttggcgtgacgctggcaacgggcgacccgagcattattgcaccgactaaaactatcgtcagaactggcgagaagatgattatcgacggcctggagtttgacttcctgatgaccccaggtagcgaagcgccagccgaaatgcacttctatattccggccctgaaagccctgtgtaccgccgagaacgccacgcataccctgcacaacttstacactctgcgcggcgcgaaaacccgcgataccagcaagtggaccgagtacctgaacgaaacgctggatatgtggggtaacgacgcggaagtactgtttatgccgcacacatggccggtctggggcaataagcatatcaatgattatattggtaaatatcgcgatactatcacgttcattcacgaccagaccctgcacctggcgaaccagggctacaccatgaatgaaatcggcgacatgattaagctgccgcctgcacttgccaataactgggccagccgtggctattacggttctgtcagccacaacgcccgcgcggtgtataacttctatcttggctattacgacggtaacccggctaacctgcatccgtatggtcaggtagagatgggcaaacgttacgtgaaagcgctgggcggctctgcccgtgtcatcaacctggcgcaagaagcgaataagcaaggtgattaccgctggtcggcagaactactgaaacaggtgattgccgccaacccgggtgaccaggtggcgaagaatctgcaagcgaataactttgaacagctgggctatcaggccgagtccgccacatggcgcggtttctacctgaccggcgcgaaagagctgcgcgaaggggtgcataagttcagccacggcaccaccggttccccggacaccattcgcggaatgtcggtcgaaatgctgttcgactttatggccgttcgcctcgatagcgcgaaagctgcgggtaaaaatatcagcctgaacttcaatatgagcaacggcgataacctcaacctgacgctgaacgatagcgtgcttaactaccgtaaaacactgcaaccgcaagccgacgcctctttctacatcagccgtgaagatctgcacgccgtgctgaccggacaggcaaaaatggcggatctggtgaaagcgaagaaagccaaaattattggcaatggcgcgaaactggaagaaattatcgcctgtctggataatttcgatttgtgggtgaatatcgtaaccccaaattaa

SEQ ID NO: 12894 - protein, 665 aa, Escherichia coli O157:H7 EDL933
  misc_feature (323)..(323): The Xaa at location 323 stands for Leu, or Phe.
MEIYMNNSRLFRLSRIVIALTAASGMMVNTANAKEEAKAATQYTQQVNQNYAKSLPFSDRQDFDDAQRGFIAPLLDEGILRDANGKVYYRADDYKFDINAAAPETVNPSLWRQSQINGISGLFKVTDKMYQVRGQDISNITFVEGEKGIIVIDPLVTPPAAKAALDLYFQHRPQKPIVAVIYTHSHTDHYGGVKGIISEADVKSGKVQVIAPAGFMDEAISENVLAGNIMSRRALYSYGLLLPHNAQGNVGNGLGVTLATGDPSIIAPTKTIVRTGEKMIIDGLEFDFLMTPGSEAPAEMHFYIPALKALCTAENATHTLHNXYTLRGAKTRDTSKWTEYLNETLDMWGNDAEVLFMPHTWPVWGNKHINDYIGKYRDTITFIHDQTLHLANQGYTMNEIGDMIKLPPALANNWASRGYYGSVSHNARAVYNFYLGYYDGNPANLHPYGQVEMGKRYVKALGGSARVINLAQEANKQGDYRWSAELLKQVIAANPGDQVAKNLQANNFEQLGYQAESATWRGFYLTGAKELREGVHKFSHGTTGSPDTIRGMSVEMLFDFMAVRLDSAKAAGKNISLNFNMSNGDNLNLTLNDSVLNYRKTLQPQADASFYISREDLHAVLTGQAKMADLVKAKKAKIIGNGAKLEEIIACLDNFDLWVNIVTPN

SEQ ID NO: 12895 - DNA, 1905 bp, Mycobacterium tuberculosis CDC1551
  CDS (1)..(1905): transl_table=11
gtgcaccgtagtagtggcaatgtagtgccgatggaacacaaacctcccactgccgtcatccaggcggcacacggtgaacactcgttaccgttgcatgacacaacggatttcgacgacgccgatcgcggattcattgccgcgctgtccccgtgtgtgatcaaggctgccgatggtcgcgtggtgtgggacaacgacgcgtactcgtttctcgacggtgccgcgccgacatcggtgcatcccagcctgtggcggcaatcccagctgaccgcgaaacagggcctctaccaggtggtgccgggcatctatcaggtccgcggattcgatatctccaatatcagcttcgttgagggtgacactgggctgatcgtcatcgacccgttggtgtccaccgaggtggccgccgccgcgctggacttgtatcgcgcccaccgcggagccgaccgccccgtggtcgcggtcatctacacccacagccatgtcgatcatttcggtggggtgctcggcgtcaccacccaggccgacgtggacgcgggaaaggtggcggtgctggcgccggaggggttcaccgcgcacgccgtgcaggaaaacatctacgccggctcggcgatgatgcgccgtgcgggctacatgtacggcaccgtgttggcgcgcggtctccgggggcacgtcggctgcggcctcgggcagacactgtcgaccggtgaggtttcgctcgtcgtgccgacggtcgacatcaccgagaccggggagacccacaccatcgacggggtggagatcgagttccagatggccccgggcaccgaggcccctgcggagatgcacttctatttcccgcgcttccgcgcgttgtgcatggccgaaaacgccacgcataacctgcacaacctgctgaccctgcgcggcgccttggtgcgcgatccgcgcgcctggtcgggctatctcaccgaggcgattgacacctttgccgaccgaaccgacgtggtgttcgcctcgcaccactggccgacgtggggacgcgagaagatcgtcgagttcttgtcgcaacagcgcgacatgtattcatatctgcacgatcagacgctgcggctgctgaaccagggctacaccggtgtggagatcgccgagatgttccagctgccaccggcgctgcagcgggcatggcacacccacggctactacgggtcggtcagccataacgtgaaggcgatctatcagcgttacatgggctggtttgacggtaacccgggctggttgtggccgcatccgcccgaggcgctggcgccgcgttatgtcgacgcgttgggtggcatcgaccgagtgctggagctggcccgcgaagccttcgacgcaggtgatttccgttgggcggcaacgcttctcgaccatgcggtgttcgccgacagcgagcacgctgcggcccgcgggctctatgccgacaccctggagcagctggcctacggcgcggagtgtgcgacctggcgcaatttctttctgaccggggccgccgagctgcgcgacgggaacccgggcagctccgggcaagtcccggcgcccacgtttttcgcccagctgacgccggaccaaatctttgacgtcctggcgatcagcatcaatggcccacgcgcatgggacctcgacctggccatcgatttcaccttcaccgagccggatgtcaactatcggctcacgctgcgcaacggcgtgttgatacatcgcaagcttcccgccgatccggcgacggcgaacgcgacggtgacggtgggcgacaaggttcggttggtcgccgcggcgctgggcgatatcagctcacccggtttcgaggtgttcggcgaccggacggtgctgcagacattcttgagcgtcctcgaccggcccgattcggccttcaacatcgtgacgccgtag

SEQ ID NO: 12896 - protein, 634 aa, Mycobacterium tuberculosis CDC1551
MHRSSGNVVPMEHKPPTAVIQAAHGEHSLPLHDTTDFDDADRGFIAALSPCVIKAADGRVVWDNDAYSFLDGAAPTSVHPSLWRQSQLTAKQGLYQVVPGIYQVRGFDISNISFVEGDTGLIVIDPLVSTEVAAAALDLYRAHRGADRPVVAVIYTHSHVDHFGGVLGVTTQADVDAGKVAVLAPEGFTAHAVQENIYAGSAMMRRAGYMYGTVLARGLRGHVGCGLGQTLSTGEVSLVVPTVDITETGETHTIDGVEIEFQMAPGTEAPAEMHFYFPRFRALCMAENATHNLHNLLTLRGALVRDPRAWSGYLTEAIDTFADRTDVVFASHHWPTWGREKIVEFLSQQRDMYSYLHDQTLRLLNQGYTGVEIAEMFQLPPALQRAWHTHGYYGSVSHNVKAIYQRYMGWFDGNPGWLWPHPPEALAPRYVDALGGIDRVLELAREAFDAGDFRWAATLLDHAVFADSEHAAARGLYADTLEQLAYGAECATWRNFFLTGAAELRDGNPGSSGQVPAPTFFAQLTPDQIFDVLAISINGPRAWDLDLAIDFTFTEPDVNYRLTLRNGVLIHRKLPADPATANATVTVGDKVRLVAAALGDISSPGFEVFGDRTVLQTFLSVLDRPDSAFNIVTP

SEQ ID NO: 12897 - DNA, 1944 bp, Caulobacter crescentus CB15
  CDS (1)..(1944): transl_table=11
atgttcgcggtcagcgtgttggccttgatcctggcggcgggcgcggcccgggcgggcgagccggccacgccgaccaccgccgagcgtcagaaagccttcgcccagacccttccgctgaacgaccggcaggacttcgagttcgccgacaaggggttcctgggcacgcgggcggatccgatcatccggcgcgccgacgggcaggcggcctggaacctcgccgcctacgacttcctgaaggccgagccgccggcgacggtgaaccccagtctctggcgtcaggcgcagctgctgtccaagcacgggctgtatcaggtgtcggaccgcgtctatcaggtgcgcggcttcgacatttccaacatcaccttcgtgcgcggcgacacgggctggatcgtgatcgatcccctgaccatgcaggagacggcccgggccgcgctcgagctggtcaacgagaagctgggcaagctgccggtcacggcggtggtctatacccacagccacagcgaccacttcggcggggttcgcggcgtggtcgacgaggccgacgtcaagagcggcaaggtcccgatcgtcgcgcccaagggcttcatggaagaggtcgccgccgagaacatcctggccggcaacgccatgagccgacgggcccagtaccagttcggcgtcatgttgccgccgggcgtcgagggccagatcaccgccggcatcggccagaacatcgcccgcggctcgatcaccctgatcccgccgacggtcatcatcgaccataccggccaggaactgaccctggatggggtcaaggttcgcttccagtacacgccctcgaccgaggccccggccgagatgaatctctatttcccggacctgcgcatcctggacatggccgagaacgccaatgtctcgatgcacaacatcctgactccgcgtggagccctggtgcgagacgccaaggcctgggctgatggtctgaccgaggcgctgcgcctgtttggggacaactccgacatcatgatcaccagccacggctggccgcgctttggcggggcggtggtcaaggatttcctggccgaccaccgagacgcctacaagtatctgcacgatcagacggtgcggatgatgaaccgcggcatgaccggcgacgagatcgccgcgaagatccaactgcccccggccctggccaggaactggttcaatcgcggctactatggctcgatgagcttcaacagccgggccgtctatcagcgctatatgggctggtacgacgccaatcccgcacatctgatcccggcgccgccggccgactccggcaagcgctatgtggcggccatgggcggcgcggccaaggtcaaggcgctggccggcgaggccgccgccaagggtgactatggctgggcggccagcttgctgaaccacgcagtcatggccgacgacggcgacaaggaggccaagcgtctgctggccggtgtctacgaccagctcggctaccagaccgagaacgcgctgtggcggaacatgtacctgacggccgcagacgaactgcgcggcggggttcgcaagttgccaccgtccatgacgccgctggacatgatcgccgcgctggaaagccagatgatcttcgacgtcctggccatccgcctcaatgccgagaaggccggcgacgcgcggctgcggatggtgttcgccttccccgatcgcaacgagcggttcctggtcgaggttcgcaacggcgtgctggtggctcaaccctcgaagggcggggaaggggcggacgccaccctgactgtcgatcgggccgtgttcctggagtcgttgttcggcggaacctcgctattgcccaagatcctgaagggcgaggtcaagctggagggtgatcgcgcggcgatgagccggctggcgggttggtttgacaccttcccctccgacttcccgattgtaacgcgcccgaactaa

SEQ ID NO: 12898 - protein, 647 aa, Caulobacter crescentus CB15
MFAVSVLALILAAGAARAGEPATPTTAERQKAFAQTLPLNDRQDFEFADKGFLGTRADPIIRRADGQAAWNLAAYDFLKAEPPATVNPSLWRQAQLLSKHGLYQVSDRVYQVRGFDISNITFVRGDTGWIVIDPLTMQETARAALELVNEKLGKLPVTAVVYTHSHSDHFGGVRGVVDEADVKSGKVPIVAPKGFMEEVAAENILAGNAMSRRAQYQFGVMLPPGVEGQITAGIGQNIARGSITLIPPTVIIDHTGQELTLDGVKVRFQYTPSTEAPAEMNLYFPDLRILDMAENANVSMHNILTPRGALVRDAKAWADGLTEALRLFGDNSDIMITSHGWPRFGGAVVKDFLADHRDAYKYLHDQTVRMMNRGMTGDEIAAKIQLPPALARNWFNRGYYGSMSFNSRAVYQRYMGWYDANPAHLIPAPPADSGKRYVAAMGGAAKVKALAGEAAAKGDYGWAASLLNHAVMADDGDKEAKRLLAGVYDQLGYQTENALWRNMYLTAADELRGGVRKLPPSMTPLDMIAALESQMIFDVLAIRLNAEKAGDARLRMVFAFPDRNERFLVEVRNGVLVAQPSKGGEGADATLTVDRAVFLESLFGGTSLLPKILKGEVKLEGDRAAMSRLAGWFDTFPSDFPIVTRPN

SEQ ID NO: 12899 - DNA, 1902 bp, Listeria monocytogenes EGD-e
  CDS (1)..(1902): transl_table=11
atgacaaaaaaagtcttaccaaaagaagcgtccgaatttacaaagaaagtgaatgagaaagtaaaaaaatctttaccatttgagaacacgaaagattttgatgatgctaaaaaaggttttattggaacttgggatcatgtaaaagtagatactgaagatggccatgcagtttgggatttggaggattataagtttattgaaggagaagcacctgattctgttaacccaagtttgtggcgtatcgctcagcttaatatgacaaatggtttattcaaagtaacggaccgcgtttatcaagtacgtgggtttgatatgtcgaatactacgattatggaaggcgatactggtcttgtaattacggatacattaatgtcggttgaaactgctcgtgcggcgcttgatctatactatgagcatcgtccaaaaaaacctattaaggcgattatttatacccattcccatgccgatcattacggcggtgtagcgggtcttattagcaaagaagatgtagcctctggaaaagtggcacttattgggccagaaggatttatggaagctgcggtcagtgaaaatatttttgctggaaacgcgatgattcgtcgtgcagaatatatgtatggtagccgcttgtcacgcggggaattaggtcaagtagatgctggtcttggtaaaacagcttctaaaggtcatatgtccttgcttgctccaaatgatactatcacgtttgatcacgaaaaacgtgttgttgatgggattgaagtggaattcttgatggctccaaatacagaagctccttcagaacatatgatgtatttcccacaatttaaactacttaatatcgcagaagatgccgttcataacttgcataacattttaacattacgtggtgcgcaaattcgtgacgcttatgagtggtggaaagatattgacaaagcaattcgtgcctttggcgataaatatgaagtttgtatcggtcaacatcactggccaacgtgggggaatgaagaaattaatgatatgcttattcaccaacgtgacgcttataaatatatgcatgaccaaacgcttcattttattaataaaggattaactgctattgaagtagctgaagctgtgaaattccctcctgcactagaagaaaaatggtatttacgaggctactacggtacgcttaaccatgatgttaaagcgatttatcaattttatcttgggtggtatgacggaaatcctgctgacctttatccgctacctccagaagatgttgcgaaaaaatacgttgagtttatgggtggcgttgatgaagtattgaaaaaagcgcgtgtatcctatgaagcgggtgaatatcgctgggttgcggaagttgtcaaacatgcggttttcgcagatggagaaaacggagaagcaagagctcttcttgcagatgcgttagaacaacttggctatcaatctgagtctggaccatggcgtaatgtatttttagctggtgcggatgaactgagaaattctgtcccagatgaagttatttctggtgttacactggatattgtggagggtatgccgtttaacttgattttagattacatgggtattcgtttaaatggggaaagatccattggtaaacgtatctccatgaactggaaattaacagatgttgatgagaattatcatttacttgtaaataattcagtacttatttatcgtgaaggtgaagtagacgataaagctgatttaactttaactactactcgtgatacatttaatcatatcttcggtggtgtgaaaagctttgaagcagcatttgctgaccaaacagctaaactagaaggagacgtgaagaaatttggggagtttgcttccttgttagatgaatttaatcctgtcttcaatattgttacaccttaa

SEQ ID NO: 12900 - protein, 633 aa, Listeria monocytogenes EGD-e
MTKKVLPKEASEFTKKVNEKVKKSLPFENTKDFDDAKKGFIGTWDHVKVDTEDGHAVWDLEDYKFIEGEAPDSVNPSLWRIAQLNMTNGLFKVTDRVYQVRGFDMSNTTIMEGDTGLVITDTLMSVETARAALDLYYEHRPKKPIKAIIYTHSHADHYGGVAGLISKEDVASGKVALIGPEGFMEAAVSENIFAGNAMIRRAEYMYGSRLSRGELGQVDAGLGKTASKGHMSLLAPNDTITFDHEKRVVDGIEVEFLMAPNTEAPSEHMMYFPQFKLLNIAEDAVHNLHNILTLRGAQIRDAYEWWKDIDKAIRAFGDKYEVCIGQHHWPTWGNEEINDMLIHQRDAYKYMHDQTLHFINKGLTAIEVAEAVKFPPALEEKWYLRGYYGTLNHDVKAIYQFYLGWYDGNPADLYPLPPEDVAKKYVEFMGGVDEVLKKARVSYEAGEYRWVAEVVKHAVFADGENGEARALLADALEQLGYQSESGPWRNVFLAGADELRNSVPDEVISGVTLDIVEGMPFNLILDYMGIRLNGERSIGKRISMNWKLTDVDENYHLLVNNSVLIYREGEVDDKADLTLTTTRDTFNHIFGGVKSFEAAFADQTAKLEGDVKKFGEFASLLDEFNPVFNIVTP

SEQ ID NO: 12901 - DNA, 1947 bp, Streptomyces coelicolor A3(2)
  CDS (1)..(1947): transl_table=11
atgaatccgatgaaccggcgcggcttcgtcgccgctgccgcgggcgccgccgcggcgaccgtgcccctgagcgcgcaggcggccgaggcgtcgcccggccggggtccctccgggacaccgactcccacccacaccggcgatctcccctacgacgaccgaaccgacttcgccgacgccgaccgcggattcgtcgccgcgtacaccggtggacttatcaccacgccctccggcggcaccgcctgggaccccgacgcctaccgcttcctcacggacgccgccgagaccgcgcccacgacggtcgatccgagcctctggcgccaggccaggctcctgtcccgccaggggctctacgaggtcacgcaccggatctaccaggtccgcggcctggacctggccaacatgaccgtcgtcgagggcgacaccggcatcatcgtcatagaccctctgacctccgcggagaccgcggccgcggcgctccggctctaccgtgcgcaccgcgggaaccgcccggtcagggccctgatctacacccacccccacgtcgaccacttcggcggctgccggggcgtcctgcccgacggcaccgaggacgttcccgtactcgcgccgcggggcttcatggagcacgcggtcagcgagaacgtctacgccggtcccgccatgtcccgccgtgcgggctacatgtacggcaccaacctgcccacggacgccgccggccaggtcggctgcggactcgggctggcggtgtccaccggcaccatcggcctgataccgcccacccggtacatcgagaccaccgggcaggaggccaccctcgacggggtgaggttccgtttccagatgactccgggtacggagtgccaggaggagatgaacgtcctccttcccgacctgcgagccgtgtgcatggccgagaacgccacccacacgatgcacaacatcctgacgctgcgcggcgcccaggtccgcgacgcgcacgcctgggcgggatacctgacggagtcgatcggtctgtgcacgggcacggccgacgtggcgttcgcctcccaccactggcccacctggggcaacgacgacatcgtcgccctgctcacccggcagcgggacctctacggctatctgcacgaccagaccgtccgcctgatcaacaagggcctcaacggcaccgagatcgcggaaagcctgcgccttccgccgcagttggagcaggtgtgggccaaccgcggctactacggctcactcagccacaacgtcaaggccgtctaccagcgttacatgggctggttcgacgccaatccggcgcacctgtgggaacatccgccggccgaggaggcacggcggtgggtcgagtcgctcggcggacaggccgccgtgcgtgcacgcgcccggcactacagcgagcggggcgacctgcgcttcgccgtgacgctcctcaaccacgccgtcttcaacgacccgtccgacaccagggcgaagcagcagctcgccacgctctacatccgcctgggccgggccgcggagaacgcggtgtggcgcaacttcttcctcaccggtgcccaggagctcgtgcacggagccgagccggctcccaagcccacctcgggaccggatctgcaccgggcactgacggtcggacagctcatcgacggtctggccgtacgcgtcaacgggcccgacgcgtggtcgctgcggctggcgctcgactggcacatcggcgacacctactggcaccttcggctcgccaacggcgtcctcacctggaccagcgacgcgagccccgaccccgacgcggggctgaccatgacgatgaccagggcgcagctcctcgcggtgctcgccggcaagggcaccgacggcgtcaccatgacgggcgacggcacgcagctggtgcggctcctgtcggtcctggacactgcggaccaccgcttcccggtggtcactccctga

SEQ ID NO: 12902 - protein, 648 aa, Streptomyces coelicolor A3(2)
MNPMNRRGFVAAAAGAAAATVPLSAQAAEASPGRGPSGTPTPTHTGDLPYDDRTDFADADRGFVAAYTGGLITTPSGGTAWDPDAYRFLTDAAETAPTTVDPSLWRQARLLSRQGLYEVTHRIYQVRGLDLANMTVVEGDTGIIVIDPLTSAETAAAALRLYRAHRGNRPVRALIYTHPHVDHFGGCRGVLPDGTEDVPVLAPRGFMEHAVSENVYAGPAMSRRAGYMYGTNLPTDAAGQVGCGLGLAVSTGTIGLIPPTRYIETTGQEATLDGVRFRFQMTPGTECQEEMNVLLPDLRAVCMAENATHTMHNILTLRGAQVRDAHAWAGYLTESIGLCTGTADVAFASHHWPTWGNDDIVALLTRQRDLYGYLHDQTVRLINKGLNGTEIAESLRLPPQLEQVWANRGYYGSLSHNVKAVYQRYMGWFDANPAHLWEHPPAEEARRWVESLGGQAAVRARARHYSERGDLRFAVTLLNHAVFNDPSDTRAKQQLATLYIRLGRAAENAVWRNFFLTGAQELVHGAEPAPKPTSGPDLHRALTVGQLIDGLAVRVNGPDAWSLRLALDWHIGDTYWHLRLANGVLTWTSDASPDPDAGLTMTMTRAQLLAVLAGKGTDGVTMTGDGTQLVRLLSVLDTADHRFPVVTP

SEQ ID NO: 12903 - DNA, 1854 bp, Shewanella oneidensis MR-1
  CDS (1)..(1854): transl_table=11
gtgcaaaaaactttgccatttaataacaaacaagattttgaggacgctcaacgaggctttattgctaaacctgaaactctgactattaaggatgacaagggcaatgtcgtttgggatctggagcaatataagacttatataggcctcgataaggttgcaccgaatactgtcaaccccagcctgtggcgtaatgcccagctcaatatgcagtacggcttattcaaagtgactgataagatttatcagattcgtgggtttgatctttcaaatattacctttattgagggggaaaagggctgggttgttttcgatccgcttatttctccagaaaccgccaaagctgcacttgcttttattaacaagacgttgggagagcgtccagtgactgcagtggtttatagtcattctcatgtggaccattacggcggtgctgctgggttatttgcttcgccagatgaagtgttgagaaataaggtcgaaatcattgctccagagggatttactgagcacgcagtttctgaaaacgttatcgcgggtaatgccatggctcgtcgtgctatctatatgtatggagctttattaccccgtaatcctcaagggggagtcaatggtggtttagggcaaacgacttcaacaggaataccttctttactgctgccaactaaattaattgaaaaaacagaggaagaggtcaccgtagatggagttcgcatggtgttccagttgacacctggcactgaggcccctgctgagatgaacacttggttccccgatagcaaggctctttggatggcagaaaataccactagcactatgcacaatattctcactttaaggggagctcaggttcgtgactctctgaagtgggcaagcttcctcaatgaaacaattgaaatttggggctctcaggcagaagttaaattccagagccatcattggccacgttggggaaacacctatattgttgattatttcaagaagcagcgggatctatataaatacatccacgaccagtcagtacgcctgatgaacatgggttacactggcgaagagatctcggagcaaattgttttgccccctgagctcaatgacttctggccgaaccgtggctattacggtaccttgcgtcacaacagtcgcgccgtttatcaacgctatatgggttggtactctggcaacccttcggatttggacaatctaccacctgaaatggtcggtcccaaatatatcgagtttatgggcggcgaaaaggaggtattgataaaagccaaagcttcctttgataagggtgaatatcgttgggtcgcagaagtgctcaagcatctagtttttgctaatccagacaataaagagggcaagctcttgcttgctgatgcgttggaacagctgggctatcaggccgagtctggcccatggcgctcagtctatctgcaaggcgcttatgagttacgtaatggcgttccttccggtggtggcactgtgactgctacaccagataccattcgtgcaatgaccccaactatgttgtttgagtatctgtctgtgcgtatcaatccagaaaaggctgctggtaaaaagatgatcatcaacatgaatttcactgacatcggcgagaaacataccctgagtctggaaaacgctgtgcttaatcatacgacacgctatgcaactaagcctgatgtaactattaccttaagcaaaaaagtgatggatgatattcagctcggtcaggtcacgttggagcaaaagattgccagcggtgatattaagattgaaggggatcagcagaagtttaacgacttcttcagcatgcttgataagttcaacttctggttcaacatcgttaccccatga

SEQ ID NO: 12904 - protein, 617 aa, Shewanella oneidensis MR-1
MQKTLPFNNKQDFEDAQRGFIAKPETLTIKDDKGNVVWDLEQYKTYIGLDKVAPNTVNPSLWRNAQLNMQYGLFKVTDKIYQIRGFDLSNITFIEGEKGWVVFDPLISPETAKAALAFINKTLGERPVTAVVYSHSHVDHYGGAAGLFASPDEVLRNKVEIIAPEGFTEHAVSENVIAGNAMARRAIYMYGALLPRNPQGGVNGGLGQTTSTGIPSLLLPTKLIEKTEEEVTVDGVRMVFQLTPGTEAPAEMNTWFPDSKALWMAENTTSTMHNILTLRGAQVRDSLKWASFLNETIEIWGSQAEVKFQSHHWPRWGNTYIVDYFKKQRDLYKYIHDQSVRLMNMGYTGEEISEQIVLPPELNDFWPNRGYYGTLRHNSRAVYQRYMGWYSGNPSDLDNLPPEMVGPKYIEFMGGEKEVLIKAKASFDKGEYRWVAEVLKHLVFANPDNKEGKLLLADALEQLGYQAESGPWRSVYLQGAYELRNGVPSGGGTVTATPDTIRAMTPTMLFEYLSVRINPEKAAGKKMIINMNFTDIGEKHTLSLENAVLNHTTRYATKPDVTITLSKKVMDDIQLGQVTLEQKIASGDIKIEGDQQKFNDFFSMLDKFNFWFNIVTP

SEQ ID NO: 12905 - DNA, 1992 bp, Shewanella oneidensis MR-1
  CDS (1)..(1992): transl_table=11
atgcaaaaatctttaatgacaatcagtattatcgccagcttctccttaagcgcagtggccgctgaacacgagcatgagcacatcagcctgcactatcaagggaagcctgccaccaaacaaaccatagaggtaaacaaagccacggcagccacccttaactttgccgataaaaaagcctttgaagagttctctaaaaatcttattgctgagctcgatgaaccaacagcggcgatattacgggccgatttcagctttattggcgataaaacccctgacacggtcaacccgtcactgtatcgccaagctcagttgaatatggtgtctaacggcttatacaaggtcaccgatgggatttatcaagtgcgtggcaccgacttagccaacttaacccttatccgcggtaaaacgggttggatcctttatgacgtgctgctgaccaaagaagcggcaaaattatccctcgaatttgcgcttaaacacttgcccgagggcaataacttacccgtagtcgcaatgatttattcccacagtcatggagatcattttggtggctcccgcgccatcaaagatatgttcccaaacgtcaaagtctatggttccaataacatcaccaaagaaattgttgacgaaaacgtactcgcaggaaatgccatgagccgccgcgccgcttatcaatatggcgcaacgttagagcgcaacgagcaaggcattgtcgatgctgcacttgccaaaggcttatccaaaggcgaagtcacctacgttaaacccgatgtcaccttaaatgccaaagacaagtgggaaacactcaccattgatggtatcgacatggtgtttatggatgcctcaggcacagaagccgcctcggaaatggccacctatattccctcaatgaaagcattgtggaccgcagagctcacctaccacggcatgcacaacatttataccttacgcggggcaaaagttcgagatgcgataaaatggtctaaggatatcaatgaattactgaaccattttggtaatgatgcacaggttatattcactgcccactcagcacccgtctttggtaatgcagatgtcaatgcctacttaagaatgcaaagggataactatggcctagtccataatcaaaccctgcgtttagccaataatggcgtaggtattcaagatattggcgatgcgattcaaaccactatccctaagaccgtgcgcgatacttggtacaccaatggttaccacggcacctacagccataatgccaaagccgtatacaacatgtaccttggctatttcgatatgaatcccgccaacttaaacccactaccgacaaaggatgaatcggccaaatttgttgagtacatgggcggtgctaaagccgtattgaaacacgccaaagccgactatgcccaaggcgaataccgttttgtggccaccgcactcaataaagtcgtgatggcagaacctaataacacagaggcaagacaattacttgccgatacctatgagcaactgggttatcaagcggagggcgctggctggcgcaatatttatctgacgggtgcccaagagttacgagcaggaatccagcccggcgcacctaaatcggcctcagcagatattttaggtgaaatggatatctcgaccctgtttgactttctcgcagtaagagttgatagcatcaaagctgcagagcttgggctattaaggcttaatgtgatcaccccagacaccaaagaaacactctatgttgagctaagcaatggtaatttaagcaatattcaagttgataaaccgatggaggcagataccaatctttatattgataaacgttatattaccggtattttactcggtaaaacgacccttaaagatttactggctaacggcagtgcgaaactggaaggcgataaaaccgcttttggtaaaatcatgtcgaccttagtccagttcgatgccaactttgaaattgtcccgctaccaccaacagcaaaataa

SEQ ID NO: 12906 - protein, 663 aa, Shewanella oneidensis MR-1
MQKSLMTISIIASFSLSAVAAEHEHEHISLHYQGKPATKQTIEVNKATAATLNFADKKAFEEFSKNLIAELDEPTAAILRADFSFIGDKTPDTVNPSLYRQAQLNMVSNGLYKVTDGIYQVRGTDLANLTLIRGKTGWILYDVLLTKEAAKLSLEFALKHLPEGNNLPVVAMIYSHSHGDHFGGSRAIKDMFPNVKVYGSNNITKEIVDENVLAGNAMSRRAAYQYGATLERNEQGIVDAALAKGLSKGEVTYVKPDVTLNAKDKWETLTIDGIDMVFMDASGTEAASEMATYIPSMKALWTAELTYHGMHNIYTLRGAKVRDAIKWSKDINELLNHFGNDAQVIFTAHSAPVFGNADVNAYLRMQRDNYGLVHNQTLRLANNGVGIQDIGDAIQTTIPKTVRDTWYTNGYHGTYSHNAKAVYNMYLGYFDMNPANLNPLPTKDESAKFVEYMGGAKAVLKHAKADYAQGEYRFVATALNKVVMAEPNNTEARQLLADTYEQLGYQAEGAGWRNIYLTGAQELRAGIQPGAPKSASADILGEMDISTLFDFLAVRVDSIKAAELGLLRLNVITPDTKETLYVELSNGNLSNIQVDKPMEADTNLYIDKRYITGILLGKTTLKDLLANGSAKLEGDKTAFGKIMSTLVQFDANFEIVPLPPTAK

SEQ ID NO: 12907 - DNA, 1962 bp, Pseudomonas putida KT2440
  CDS (1)..(1962): transl_table=11
atgcgcttttcactgtcgatgctggcgcttgccctgctggccccccttccgagcctgggcgcaacagcggccaaggatgccaccgcggccaccctggccagcaaccagcagtggctgcaacggttgcctttcgaggatcgcgtcgattacgaaacagcccggcgtgggctggtcgagcggttcaacgggccagtcgccacggccgatggcaagacggtgtggaacctggcccagtatgcttttctggaaccggcgcaatcccctgccacggtaaacccgagcttgtggcgcatcgctcagttgaacaacatcgccgggctgttcaaggtcaccgagggcatctaccagcttcgcggtctggacctggccaacatgaccatcgtcgaagggaaggacgggctgattgtgcttgacccgctgcttgccgtggagactgccaaggcgggcctcgaactgtacttcaagcaccgcccgcgcaagccggtgaccacggtgatctacacccacccgcacgtcgaccatttcggcggcgtgcgcggggtgatcaacgaggcggacgtcaaggctggcaaagtccaggtcatcgcgcccgaggggttcttcgaacatgccatcggcgaaaacgtgctggccggaccggccatgaaacgccgcgcccagtacatgtacggcgcccccctgccccgtgggccgcgaggccaggtggatgccggactgggcaagggcgtgccggccaatgccactgtcagcctcatcgcgccgacgctcgaaatcagccaaccgctgcaacgcatgaccctgagcggcgtggaggtggagttccagctgaccccgggcaccgaggcgccggcggaaatgaacatttatttcccggcgctcagggcactgtgcatggccgagaacgccacccatgtgcagcacaacgtactgacgctgcgcggggccctggtgcgcgatccgaaagtgtgggcccattacctggaccaatcgctggtgcgctacggcgagcaggccgaggtggtgttcgcccagcatcactggcccacttggggtggtgcggccatccgcgactacctggccgaccagcgcgatatgtatgccttcatcgacagccagaccttgcgcctgatcaatcagggccagacccccatggaaattgcccagaccctggccagcctgccgccgcgcctggcaagcaaatggtacagccgcgactactacggctcgcttagccataacgtcagggccgtctatcaacgctacatggggttctacgacggcaacccggccaacctcgacccattgccaccgcaagcggccggcaagcgttacgtggcggcgatggggggtgccgatcaggtgctgacccaggcccgccaggccttcgccgagggcgactatcgctgggtggcgcaattggccaaccacctggtattcgccgagccagacaacaccgaggcccgcgaactgcaggccgacgcgctggagcaactgggttaccagagtgagaacgccacctggcgcaatgcctacctcagtggcgcgcaggaattgcgctcaggcgttgccgccggtgcgggtagcggcggcaacgccgatgacatggtgcgggccctgacacccagcctgtttttcgactacctgggtgttcgggtgaatgcctacaacgctgccgatagcaacctgaccatcaactggcggttttccgacctggacgaagactacgccctcaccctgcgcaacggcgtcctcacccaccgcgacctggcgcgccacgccaaggccgatgtagaggtcatcatgcgcaaacagacactggacagcattgccttgaagcagacaggctttctcaaggaagccacagcaggggcaatcgaaatcaaaggcgagcgggtgaagttcctgcaattcatgggggggctggaagaggctgattcgcgcttcaatatcgtcacgccctga

SEQ ID NO: 12908 - protein, 653 aa, Pseudomonas putida KT2440
MRFSLSMLALALLAPLPSLGATAAKDATAATLASNQQWLQRLPFEDRVDYETARRGLVERFNGPVATADGKTVWNLAQYAFLEPAQSPATVNPSLWRIAQLNNIAGLFKVTEGIYQLRGLDLANMTIVEGKDGLIVLDPLLAVETAKAGLELYFKHRPRKPVTTVIYTHPHVDHFGGVRGVINEADVKAGKVQVIAPEGFFEHAIGENVLAGPAMKRRAQYMYGAPLPRGPRGQVDAGLGKGVPANATVSLIAPTLEISQPLQRMTLSGVEVEFQLTPGTEAPAEMNIYFPALRALCMAENATHVQHNVLTLRGALVRDPKVWAHYLDQSLVRYGEQAEVVFAQHHWPTWGGAAIRDYLADQRDMYAFIDSQTLRLINQGQTPMEIAQTLASLPPRLASKWYSRDYYGSLSHNVRAVYQRYMGFYDGNPANLDPLPPQAAGKRYVAAMGGADQVLTQARQAFAEGDYRWVAQLANHLVFAEPDNTEARELQADALEQLGYQSENATWRNAYLSGAQELRSGVAAGAGSGGNADDMVRALTPSLFFDYLGVRVNAYNAADSNLTINWRFSDLDEDYALTLRNGVLTHRDLARHAKADVEVIMRKQTLDSIALKQTGFLKEATAGAIEIKGERVKFLQFMGGLEEADSRFNIVTP

SEQ ID NO: 12909 - DNA, 1998 bp, Escherichia coli CFT073
  CDS (1)..(1998): transl_table=11
  misc_feature (1983)..(1983): m is a or c
atggagatttatatgaataactctcggttattccgtttgagcaggattgttattgcgttcactgccgccagcggcatgatgataaataccgcttacgcaacagatgaagcgaaagccgccactcaatatacccaacaggttaatcagaattacgccaaatcattaccgtttagcgatcgtcaggattttgacgatgcccagcgtggatttatcgctccgctgctggatgaaggtattctgcgtgatgcgaacggtaaaatttactaccgcgcgaatgattacaaatttgatattaatgccgctgcgccggaaaccgtaaaccccagcctgtggcgtcagtcgcagatcaacggcatttcaggcctgttcaaagtcaccgataaaatgtatcaggtgcgcggccaggatatctctaacattacgttcgttgagggcgagaaaggcattattgttattgacccactggtgacgccacctgccgcaaaagccgcacttgacctttacttccagcatcgcccgcaaaaacccattattgccgttatctatacccacagccacgccgaccactatggcggcgtgaaaggcatcatctctgaagccgatgttaaatccggaaaagttcaggtgattgctccagctggctttatggacgaagccatcagcgaaaacgtgctggcgggtaacatcatgagccgccgtgcgctctactcttacggtctgttactgccgcacaacgcgcaaggcaatgtgggtaatggccttggcgtgacgctggcaacgggcgacccgagcattattgcaccgactaaaactatcgtgagaactggcgagaagatgattatcgacggcctggagtttgacttcctgatgaccccaggtagcgaagcgccagcggaaatgcacttctatattccggccctgaaagccctgtgtaccgccgagaatgccacgcataccctgcacaacttctacaccctgcgcggcgcgaaaacccgcgacaccagcaagtggaccgagtatctgaacgaaacattggatatgtggggtaacgacgcggaagtactgtttatgccgcacacctggccggtttggggcaataagcatatcaatgattatattggtaaatatcgcgatactatcaagtacattcacgaccagaccctgcacctggcgaaccagggctacaccatgaatgaaatcggcgacatgattaagctgccgcctgcgcttgccaataactgggccagccgcggctattacggttctgtcagccacaacgcccgcgcggtatataacttctatcttggctattacgacggtaacccggctaacctgcatccgtatggtcaggtggagatgggtaaacgttacgtgcaggcgctgggcggttctgcccgcgtcatcaacctggcgcaagaagcgaacaagcaaggtgattatcgctggtcggcagaactgctgaaacaggtgattgctgccaacccgggtgaccaggtcgcgaagaatctgcaagcgaataactttgaacagctgggctatcaggccgagtccgccacatggcgcggtttctacctgaccggcgcgaaagagctgcgcgaaggggtgcataagttcagccacggcaccaccggttccccggacaccattcgtgggatgtcggtcgaaatgctgttcgactttatgtccgttcgcctcgatagcgcgaaagccgcgggtaaaaatatcagcctgaacttcaatatgagcaacggcgataacctcaacctgacgctgaacgatagcgtgcttaactaccgtaaaacactgcaaccgcaagctgacgcctctttttacatcagccgtgaagatctgcacgccgtgctgaccggacaggcaaaaatggccgatctggtgaaagcgaagaaagccaaaattattggcaatggcgcgaaactggaagaaattatcgcctgtctggataatttcgatttgtgggtgaatatmgtaaccccaaattaa

SEQ ID NO: 12910 - protein, 665 aa, Escherichia coli CFT073
MEIYMNNSRLFRLSRIVIAFTAASGMMINTAYATDEAKAATQYTQQVNQNYAKSLPFSDRQDFDDAQRGFIAPLLDEGILRDANGKIYYRANDYKFDINAAAPETVNPSLWRQSQINGISGLFKVTDKMYQVRGQDISNITFVEGEKGIIVIDPLVTPPAAKAALDLYFQHRPQKPIIAVIYTHSHADHYGGVKGIISEADVKSGKVQVIAPAGFMDEAISENVLAGNIMSRRALYSYGLLLPHNAQGNVGNGLGVTLATGDPSIIAPTKTIVRTGEKMIIDGLEFDFLMTPGSEAPAEMHFYIPALKALCTAENATHTLHNFYTLRGAKTRDTSKWTEYLNETLDMWGNDAEVLFMPHTWPVWGNKHINDYIGKYRDTIKYIHDQTLHLANQGYTMNEIGDMIKLPPALANNWASRGYYGSVSHNARAVYNFYLGYYDGNPANLHPYGQVEMGKRYVQALGGSARVINLAQEANKQGDYRWSAELLKQVIAANPGDQVAKNLQANNFEQLGYQAESATWRGFYLTGAKELREGVHKFSHGTTGSPDTIRGMSVEMLFDFMSVRLDSAKAAGKNISLNFNMSNGDNLNLTLNDSVLNYRKTLQPQADASFYISREDLHAVLTGQAKMADLVKAKKAKIIGNGAKLEEIIACLDNFDLWVNIVTPN

SEQ ID NO: 12911 - DNA, 2025 bp, Vibrio vulnificus CMCP6
  CDS (1)..(2025): transl_table=11
atgaatatccgctttgtaccctcaacccttacccttgctttgatggtttcttttggcgcatcggcggactacgccagcttagaaaactatcaaggtaagccagcaacggcccacacaaaacaagccaacgctgaactggcaaaacagttgccttggcatgatatctcggcgtttgagcgcactcagcgtgggcttattgccgaattcggtagccatcaagccggtgaactcaagcagcgctttcactatatggcagaaatgaacgtagagcagttgccagagacggtgaatccgtcgatttggcgtcaaggcatgctcaactacgttgccggcggcttgtatgaagtgacggatggggtttatcaaatccgtggtgctgatctctcgaatatgaccatttaccgcaccaacaatggctacgtgattcacgatccactattgtcacgcgaagcggcggcagcggcgtgggaatttgccaaacagcatcttcctaaagtgaagggtggccacaaaatcaccggcatgatctactcgcatatgcacgctgatcatttcggtggttcaagaagcattattgattctggcgattttgttaaaggtgcgccgatctacgcaccgaaagatttcattaaagagctggcggatgaaaacatcatcgcgggtacggccatgagtcgtcgtgctaactatcaatacggcaccactctcgataacaataccaaaggcatcgtggataatgcgcttggcttaggcacctctcgtggtgaaatcacgttggtggcgccaacacaagaaatccaacctcgcgaaaaagagctgaccattgatgggctcaagttccacgcgatcaacatgccgggcgcagaagccccagcagaaatggtgctttatgttcctaagtatcgctctctcaataccgcagagctgacttacgatggcatgcataacatctacactttccgtggtgcgaaagtacgcgattccttggcgtggaccaaatacctcaccgagctgaaactgcgttttgtcgacagcggtttggtggacaacattcacgccgcgcactcagcgccagtgtggaatgatccgcacactgaagtgaatgagatttcacaatacatgaccctgcagcgcgacaactatgggtttattcataaccagtcgatgcgcttagcaaatcatggcgtgaccattcacgatgtgggccgtgagattgagaaaattgtgcctcaaacgcaaaaagaaacctggcacaccaatggttaccatggctcctacagccataacgctcgagctgtggtgaacttgtatcttggctatcacgatatgaacccggtgaacacgaacccactggcgactcaggataaatcgtgcgtttacgtcgaagccgctggcgcacaaacgctatacaaagcggggcaaacacacttcgccaaaggggaatatcagcaagcatcgcagctatttaacgacttggttcagtgtgacccgaacaatatccaataccgttttgcgttagctgacagctttgaacagcaaggctaccagtcggaaactatggcgtggcgcaactcgtatctgcaaggcgcggttgagttgagaaccggagaaattcgtccatcgatcaaagcagcatcggccgatgtgattgccaacaccccaacgggtatgttccttgatttcttagcggtgaagctcaacgcgacgaaagcagagcaagcggggctggatttccgctttggtgtatcacatccagagctgaaagagcattactacggtgaagtgtccaacgcgaacatggccaatattcaagtggataagttaccgaataccgatgtgactctaagcatcagtaagagcgacttaacgcaaattgtactaggtaaaacaacgttagataagctagtgaaagaaggaaaggcaaacctgaaaggggatgcccaactgataaaagcactgtcggaatgtttagatgagtttgatggcttgtttgagattcttccaatgccgaataaaaaagcatag

SEQ ID NO: 12912 - protein, 674 aa, Vibrio vulnificus CMCP6
MNIRFVPSTLTLALMVSFGASADYASLENYQGKPATAHTKQANAELAKQLPWHDISAFERTQRGLIAEFGSHQAGELKQRFHYMAEMNVEQLPETVNPSIWRQGMLNYVAGGLYEVTDGVYQIRGADLSNMTIYRTNNGYVIHDPLLSREAAAAAWEFAKQHLPKVKGGHKITGMIYSHMHADHFGGSRSIIDSGDFVKGAPIYAPKDFIKELADENIIAGTAMSRRANYQYGTTLDNNTKGIVDNALGLGTSRGEITLVAPTQEIQPREKELTIDGLKFHAINMPGAEAPAEMVLYVPKYRSLNTAELTYDGMHNIYTFRGAKVRDSLAWTKYLTELKLRFVDSGLVDNIHAAHSAPVWNDPHTEVNEISQYMTLQRDNYGFIHNQSMRLANHGVTIHDVGREIEKIVPQTQKETWHTNGYHGSYSHNARAVVNLYLGYHDMNPVNTNPLATQDKSCVYVEAAGAQTLYKAGQTHFAKGEYQQASQLFNDLVQCDPNNIQYRFALADSFEQQGYQSETMAWRNSYLQGAVELRTGEIRPSIKAASADVIANTPTGMFLDFLAVKLNATKAEQAGLDFRFGVSHPELKEHYYGEVSNANMANIQVDKLPNTDVTLSISKSDLTQIVLGKTTLDKLVKEGKANLKGDAQLIKALSECLDEFDGLFEILPMPNKKA

SEQ ID NO: 12913 - DNA, 1962 bp, Vibrio vulnificus CMCP6
  CDS (1)..(1962): transl_table=11
atgaaaccactctctttgtatatcgcgctcgcgctcacgtcaggggccgttctggccgaacccatcccatctaaaccggcgacacaagccacgattgaagccaatcaggcggtgtatcaagcgttaaattttaaggatgaaaccgattttaagaatgcccaacgaggtttgatcgccaaacaagatgtggtcatcatcaaaaacgccaatggcgatgtggtgtgggatctggaagcgtacaagcagttcatctcgctagaaaataaagcgccagatagcgtgaaccccagtttatggcgtaacgcgcagctcaatatgatcaatggtctgtttgaggtgactgagggcatttatcaggtgcgcgcttacgatctttccaacatcacctttattaaaggggataaagggtggatcgtcttcgacccgttgatttcccaagaaaccgctaaagcggcgctggagtttgttaacgctcagcttggtgagcgcccagtgacggcggtgatctactcgcacagtcacattgaccactttggtggggttcgcggcatcgtgaatgaagaagatgtgaaagcgggcaaggtggagatcattgcctcacacggcttcacggaacatgcagtgtcagaaaacgtgattgcaggcaatgcgatgggccgacgcgcgatctatatgtatggtgctttgctgccgcgcaatgaacgtggcggggtcaacggtggcttaggccaaaccacgtcaacgggcttaccaaccttgattgtccccacccgtattattgaaaaaaccggtgaagagctgacggtggatggcgtgcgcatggtgttccaatacaccccaggcacggaagcaccaaccgaaatcaatacttggttcccagacaaaaaagcgttgtggatggcagagaactccaccaacaccatgcacaacatcctcacgttgcgcggagcgcaggtgcgtgatgcgctcaagtggtcctcttacctcaacgaaaccattgaaatgtggggtgatgaggtggaagtgaaattccaaagtcaccactggccaatgtggggcagcaaagagattgttgcttactttaaaggccagcgtgatatgtacaagtacacgcacgaccaaaccgtacgcttgatgaaccaagggtacatcggctctgaaatctcggaagtgattcaattcccagaggagttggagaagaactggagtacacgcggttactacggcaccttgcgccacaacagccgagcggtttatcagcgctacatgggttggtattctggtaatccttccgatctcaacaacttaccgccaaccaacgcagcggtgaaatacgttgagtacatgggcggcgaaagcgcaaccatcgacaaggcgcaagcggatttcgataaaggcaactaccgctgggtggcggaagtgctcaaacatgttgtttttgctaacccacaaagtaagcgtggcaaagcgttgctcgccgatacttacgagcagttggggtatcaagcggaatctggcccttggcgctcggtctacttgcaaggggcttatgagctaagaaacgggacgcccaaagcgggaggcaccaatacggcctcgcccgacatcatcaaaaacatgccgccagagatgttgtttgattacctagcggtgcgcattttgccagaaaaagccgcgggtaaaaccttcgccatcaacatcaatttcaccgatttagatgagcagtacaccttgtatgtggaaaactcggtgctcaaccacacgcgtaagcaagcgaaaaaagccgacgtgacgttgaatttgaccaaggcgactttagacgatgttcagcttggcaacattaccttggagaaagcaattgctgatggtgatgtgcaactaaaaggcaatacgcaggtgtttaaagactttgttggcatgctggataagtttgatttctggttcaacattgtgacgccatag

SEQ ID NO: 12914 - protein, 653 aa, Vibrio vulnificus CMCP6
MKPLSLYIALALTSGAVLAEPIPSKPATQATIEANQAVYQALNFKDETDFKNAQRGLIAKQDVVIIKNANGDVVWDLEAYKQFISLENKAPDSVNPSLWRNAQLNMINGLFEVTEGIYQVRAYDLSNITFIKGDKGWIVFDPLISQETAKAALEFVNAQLGERPVTAVIYSHSHIDHFGGVRGIVNEEDVKAGKVEIIASHGFTEHAVSENVIAGNAMGRRAIYMYGALLPRNERGGVNGGLGQTTSTGLPTLIVPTRIIEKTGEELTVDGVRMVFQYTPGTEAPTEINTWFPDKKALWMAENSTNTMHNILTLRGAQVRDALKWSSYLNETIEMWGDEVEVKFQSHHWPMWGSKEIVAYFKGQRDMYKYTHDQTVRLMNQGYIGSEISEVIQFPEELEKNWSTRGYYGTLRHNSRAVYQRYMGWYSGNPSDLNNLPPTNAAVKYVEYMGGESATIDKAQADFDKGNYRWVAEVLKHVVFANPQSKRGKALLADTYEQLGYQAESGPWRSVYLQGAYELRNGTPKAGGTNTASPDIIKNMPPEMLFDYLAVRILPEKAAGKTFAININFTDLDEQYTLYVENSVLNHTRKQAKKADVTLNLTKATLDDVQLGNITLEKAIADGDVQLKGNTQVFKDFVGMLDKFDFWFNIVTP

SEQ ID NO: 12915 - DNA, 1968 bp, Vibrio vulnificus CMCP6
  CDS (1)..(1968): transl_table=11
atgaaacgacaaaaatcgattgtatcgctagcgattatcgccactctattcccagctctaacgttcgctgccccaaccagcagcgagcctaaacaagcttcttcgttcaccatcgagaaaaacaaccaactcaaaagctacctcgacttcgccaatcaaagtgattttgaagatgcctcacgcggttacattgctacttggccagaaaaaaccatcaaagacgccaaaggcaatgtgatttgggacttcagcaaatacgactttgttgaacaagagaagaacattcaaaccgtcaacccttcactgctgcgccaagcaaaactgaacaacatcgatggcttgttcaaagtgaaagagggcatttaccaagtacgcggttttgatctctcggtgatgacctttatccgcggtgacaaaggttgggtcgtgatcgacccactcatttcaccagaaaccgccgcggcagggctgaaattgctgcgtgacaaagtggaagatgcgccggtaacgggcgtgattttcacccactcacacgttgaccactttggtggcatccttggcatcaccagccaaaaagcgattgatgctggtaaagtcgatattcttgcgccagagggctttttctctcactcgattgccgagaacttgatggcaggcaacaccatgtcgcgtcgcgcttcttacatgtatggcaacctgcttgaagcgagcagccaagggcaagtggatggcggtttgggtaaaaccacctcatccggagcgcctggcatcgtgaaaccaacgcacattgccaatatcaccgggcagaaaatggcggtcgatggtgtggaactggaagtgatcatggcgcaggaatccgaagctccgtcagaatttatgttctacttcccacaatacaaaaccatgatggcggcggaagtaatgacgcacaccatccacaacatctcgacactgcgcggcgcgaaaacacgtgatgcttcttcttgggctgaatacattgaccaagcgctgaaaacttacggtgacaaagccgataccatgatcgcctctcaccactggccaacctttggcaaagagaagatccaaactcagcttgagaaaacgcgcgacatgtacaagtttgtccatgaccaaaccctgcgtctcgccaacaaaggctatacaccaaatgagatttcagcagaaattaccctgccagattcgctaggcaaagaatggtacaaccgcggttactacggcacggtatcgcacaatgctcgcgcgacgtacgacttctactttggtgcatggtgggatggcaacccagccaacctaaacccgctgacaccaagtgaacaaggcgcaaaatacgttgaagcgatgggcggggaagagaaagtgatagaactggctgagcaagcagtgaaaaacggtgaataccgctgggcggtgacactgcttaacaacgtgactttctccaacccaaacaatatggacgctcgctacttagaagcggatgcaatggagcaattgggttatcaggcggaatctggcccttggcgtaactactatcttggcggtgcgaaagagctgcgccaaggcatcaaacccgtcgcaacgccagacacggccgcaattgctaagaatatgccgtttgatcagttcatgaagtatctcggcgtgacggtaaaacctgacgcggcgaatggcctcgatatcaaagtgaacatcaatgtcaaaggcgacggccaatactcgatggagctgagcaactcggtattgaaatcgtactctggtagccaatttgataatgcggatttgaccattaacttaacccgccaagcgtttgagaaaatgctgaccaagcaagcgacactgcaagatcaggtcaaagccggtgagtttagtgtttcaaaccaagcgcagttccaaacgctgatgtcggtctttgataaattcgacatgtggttcggtgtggtaacaccataa

SEQ ID NO: 12916 - protein, 655 aa, Vibrio vulnificus CMCP6
MKRQKSIVSLAIIATLFPALTFAAPTSSEPKQASSFTIEKNNQLKSYLDFANQSDFEDASRGYIATWPEKTIKDAKGNVIWDFSKYDFVEQEKNIQTVNPSLLRQAKLNNIDGLFKVKEGIYQVRGFDLSVMTFIRGDKGWVVIDPLISPETAAAGLKLLRDKVEDAPVTGVIFTHSHVDHFGGILGITSQKAIDAGKVDILAPEGFFSHSIAENLMAGNTMSRRASYMYGNLLEASSQGQVDGGLGKTTSSGAPGIVKPTHIANITGQKMAVDGVELEVIMAQESEAPSEFMFYFPQYKTMMAAEVMTHTIHNISTLRGAKTRDASSWAEYIDQALKTYGDKADTMIASHHWPTFGKEKIQTQLEKTRDMYKFVHDQTLRLANKGYTPNEISAEITLPDSLGKEWYNRGYYGTVSHNARATYDFYFGAWWDGNPANLNPLTPSEQGAKYVEAMGGEEKVIELAEQAVKNGEYRWAVTLLNNVTFSNPNNMDARYLEADAMEQLGYQAESGPWRNYYLGGAKELRQGIKPVATPDTAAIAKNMPFDQFMKYLGVTVKPDAANGLDIKVNINVKGDGQYSMELSNSVLKSYSGSQFDNADLTINLTRQAFEKMLTKQATLQDQVKAGEFSVSNQAQFQTLMSVFDKFDMWFGVVTP

SEQ ID NO: 12917 - DNA, 2145 bp, Bradyrhizobium japonicum USDA 110
  CDS (1)..(2145): transl_table=11
gtgggagagggcggcttcgcgaagcgaagccgggtgaggggttctcaccgcgagtccccatcacaagtgagtttgcggagacaacccctcatccggcgcttcgcgccaccttctcccacaagggagaagagaaggacgcctgtgcggcctccgccaatgatggcaatcacccgcgagatgcggttagatgcgcgcaacaggccggaggaaaccaaaatgactgaactcagccgctcgcccaaggacgcgacgccgtccgtcatcgcgcagcaaacggcgatgctgaatgcgctgccgttttccgacgcgcgggatttcgacgatgccgcgcgcggctttctcggcacgatcgagaatgcggcgatcaccaacccgcaggggcggacggtctggagcctcgagccctacggctttctctcggccgacgaagcgccacccacggtcaatcccagcctgtggcggcagtcgcgcctcaacatgcagcatgggctgttcgaggtggtgcccggcgtctaccaggtgcgcgggctcgacatcgccaacatgacgctgatcgagggcgacagcggcgtcatcgtcgtggacacgctgacctcgatcgaaggcgcgcgcgccgcgctcgatctctatttcaggcatcgcggcatgaagccggtggccgccgtcatcttcacccatacccacaccgaccattggggcggcgcacgcggcgtgctggaggaggatgcgctggctaccggtgccgtgccgatcatcgcgccgaacctgttcatggagcacgccgtctccgagaacatcatcgcggggccagcaatgctgcgccgggcgcaatatcagttcggcccgttcctcgccaagggcgtgcgtgggcaggtcgattgcgggctcggcaagtcgatggcggcgggttcggtcgcgctgctgcgcccgaccgatctgatcatggcgaccggcgaaaggcgcgtgatcgacggcgtcgaattcgaattccagatggcgccgaatagcgaggcgccggcggagatgcacttcttcattccgcgctacaagctgttgaacctcgcggaaaactgcacccacaatttccacaatctgctgccgttccgcggcgccgacgtgcgcgatgcgctggcctggtcgaaatacctgggcgaggccctgcggctgtgggacggcaaggcggaggcgatgtgcggccagcatcactggccggtgtggggccgcgagcgcatcggcatcatgatccggcagcagcgcgatctctacaagttcgcgcatgaccagaccatccgcttgatgaaccatggcctgaccgccgccgagatcgccgaaacgatccagctgccgaagagcctggagggcgcctggcacggccgtggctattacggccacattcgccacaatgtgaaggcgatctaccagaaatatctcggctggtacgacgccaatccggtcaatctcgatccgctgccgccggtcgcctcgggcaagaaatatgtcgagtacatgggcggcgccgacgcgattctcgcgcgcgctcggacggacttcgacaagggcgaattccgcttcgtcgcgcaggcgctcggccatctcgtcttcgccgagcctgacaacgcggcggcacgtcacctgctggccgatacgctggagcagctcggctacgccgccgagagcgcgacctggcgcaacgcctatctgttcggcgcccaggagttgcgccagggcatgccgaaggccccaccgcgcccgccgatgccgcgcgagacgctggcggcgctgcgcaccgagcagctctgggacgtgctcggtatccgcctcaacggcccgaaggcggaaggcaagcacatcgtgctgaactggcgcttctccgacaccggcgagatcttcgtgctcaacctggaaaactgcgcgctcacctatagcgagggcgtgcaggcggaaaacgccgacgcgagcttcacgctggcgcgcgcgacgctcgacgaggtgatcgcgaagctgacgagctttccggaggcggtcgccgccggcaaggtccagctcgccggcaacccgatgcggctggccgagctgatgggcctgatggacgagtttccacgcatgttcgagatcgtggagccgaagcgggcggtggtggggtag

SEQ ID NO: 12918 - protein, 714 aa, Bradyrhizobium japonicum USDA 110
MGEGGFAKRSRVRGSHRESPSQVSLRRQPLIRRFAPPSPTREKRRTPVRPPPMMAITREMRLDARNRPEETKMTELSRSPKDATPSVIAQQTAMLNALPFSDARDFDDAARGFLGTIENAAITNPQGRTVWSLEPYGFLSADEAPPTVNPSLWRQSRLNMQHGLFEVVPGVYQVRGLDIANMTLIEGDSGVIVVDTLTSIEGARAALDLYFRHRGMKPVAAVIFTHTHTDHWGGARGVLEEDALATGAVPIIAPNLFMEHAVSENIIAGPAMLRRAQYQFGPFLAKGVRGQVDCGLGKSMAAGSVALLRPTDLIMATGERRVIDGVEFEFQMAPNSEAPAEMHFFIPRYKLLNLAENCTHNFHNLLPFRGADVRDALAWSKYLGEALRLWDGKAEAMCGQHHWPVWGRERIGIMIRQQRDLYKFAHDQTIRLMNHGLTAAEIAETIQLPKSLEGAWHGRGYYGHIRHNVKAIYQKYLGWYDANPVNLDPLPPVASGKKYVEYMGGADAILARARTDFDKGEFRFVAQALGHLVFAEPDNAAARHLLADTLEQLGYAAESATWRNAYLFGAQELRQGMPKAPPRPPMPRETLAALRTEQLWDVLGIRLNGPKAEGKHIVLNWRFSDTGEIFVLNLENCALTYSEGVQAENADASFTLARATLDEVIAKLTSFPEAVAAGKVQLAGNPMRLAELMGLMDEFPRMFEIVEPKRAVVG

SEQ ID NO: 12919 - DNA, 1980 bp, Salmonella enterica subsp. enterica serovar Typhi Ty2
  CDS (1)..(1980): transl_table=11
atgagacttaagtcgatcgttaaaagttttgcgctggcggggctactctcttccactgcgctgacacctttatttgcccaggaagccccaaaaggtgccactgcttcaaccaagcaagctaacaatgcgctttataaccaacttcctttctctgataacaccgatttcacgaatgcccataaaggctttattgctgatttacctgcagaggtgattaagggagagcaagggaatgtcatctggaatccacagcagtacgctttcataaaagaaggggaaaaatctcctgacactgttaaccctagtctgtggcgtcagtcccaactaatcaatatcagtggcttgtttgaagtaacagacggcgtctaccagattcgtaaccttgatttatccaacatgacgattatcgaaggtaaagaggggattacggttgtcgatccgctggtttctgcggaaacagccaaagccggtatggatttgtatttcaaaaaccgtggcaataagcctgttgtcgccatcatttatactcatagccatgttgaccactatggtggtgtgcgtggcgttgtcgatgaagcggacgtgaaatccggcaaggtgaaagtgtatgcgcctgctggctttatggaggcagcagtagccgagaatattatggccggcaacgtgatgagccgccgtgccagctatatgtatggcaacctcctgaaaccagatgcctccggccaggttggcgccggactggggacgaccacctctgcggggacggtgacactgattgcgcccactaatatcattgataaagacggccagaaagaagtgattgatggcctgacttacgactttatgctggcccctggttcggaagccccttcggaaatgctgtggttcatcgaagagaagaaactcatcgaagccgcagaggacgtcactcacaccctgcataacacttactcgctacgcggcgcaaaaattcgtgagccgttgccgtggtcgaaatatatcaacgaagctatagtgcgttggggtgacaaagctgaaattattatggcccagcaccactggccgacttggggtaacgagaatgttgttggtctgctgaaaagccagcgagacctgtatcgttatatcaatgaccagactctgcgtatggccaatgaaggtctgactcgcgacgaaatagcggccaacttcaaactaccggatagcctggcaaaaacctgggccaaccgcggctattacggctccatcagccatgacgtaaaagcaacgtatgtgctgtatctcggttggttcgatggcaatccggcaacccttgatgagctgccacccgaagaagcggctaagaaatttgttgaatatatgggcggtgccgatgcgattcttcagaaagccaaagcagactttgaccaggggaactaccgttgggttgctcaggtggtgagtaaggtcgtgtttgccgatccaaataaccagaatgcacgtaaccttgaagccgatgcgttggaacaattggggtatcaggctgaatctggtccatggcgtaacttctacctgaccggtgcgcaggagctgcgtaacggtgtggttaaaggtccgacgccaaatacagcaagtccggataccgttcgggcaatgacccctgaaatgttcttcgatttcctggctgtacatatcaacggtgaaaaagcgggtaatgcccgggcggtgtttaatattgaccttggcagcgacggcggaaagtacaagcttgagctggaaaatggcgtgctgaaccacacggctaatgctgaagcgaaagacgctgatgccacgattactctgaaccgtgacacgctgaataaaattatcctgaaggaagaaactctgaagcaggctcaagataaaggagaagtcaacgttaccggtaatgctgcgaaactggatgagatgctgggctatatggacaagtttgagttctggttcaatatagttacaccataa

SEQ ID NO: 12920 - protein, 659 aa, Salmonella enterica subsp. enterica serovar Typhi Ty2
MRLKSIVKSFALAGLLSSTALTPLFAQEAPKGATASTKQANNALYNQLPFSDNTDFTNAHKGFIADLPAEVIKGEQGNVIWNPQQYAFIKEGEKSPDTVNPSLWRQSQLINISGLFEVTDGVYQIRNLDLSNMTIIEGKEGITVVDPLVSAETAKAGMDLYFKNRGNKPVVAIIYTHSHVDHYGGVRGVVDEADVKSGKVKVYAPAGFMEAAVAENIMAGNVMSRRASYMYGNLLKPDASGQVGAGLGTTTSAGTVTLIAPTNIIDKDGQKEVIDGLTYDFMLAPGSEAPSEMLWFIEEKKLIEAAEDVTHTLHNTYSLRGAKIREPLPWSKYINEAIVRWGDKAEIIMAQHHWPTWGNENVVGLLKSQRDLYRYINDQTLRMANEGLTRDEIAANFKLPDSLAKTWANRGYYGSISHDVKATYVLYLGWFDGNPATLDELPPEEAAKKFVEYMGGADAILQKAKADFDQGNYRWVAQVVSKVVFADPNNQNARNLEADALEQLGYQAESGPWRNFYLTGAQELRNGVVKGPTPNTASPDTVRAMTPEMFFDFLAVHINGEKAGNARAVFNIDLGSDGGKYKLELENGVLNHTANAEAKDADATITLNRDTLNKIILKEETLKQAQDKGEVNVTGNAAKLDEMLGYMDKFEFWFNIVTP

SEQ ID NO: 12921 - DNA, 1881 bp, Mycobacterium bovis AF2122/97
  CDS (1)..(1881): transl_table=11
gtgccgatggaacacaaacctcccactgccgtcatccaggcggcacacggtgaacactcgttaccgttgcatgacacaacggatttcgacgacgccgatcgcggattcattgccgcgctgtccccgtgtgtgatcaaggctgccgatggtcgcgtggtgtgggacaacgacgcgtactcgtttctcgacggtgccgcgccgacatcggtgcatcccagcctgtggcggcaatcccagctgaccgcgaaacagggcctctaccaggtggtgccgggcatctatcaggtccgcggattcgatatctccaatatcagcttcgttgagggtgacactgggctgatcgtcatcgacccgttggtgtccaccgaggtggccgccgccgcgctggacttgtatcgcgcccaccgcggagccgaccgccccgtggtcgcggtcatctacacccacagccatgtcgatcatttcggtggggtgctcggcggcaccacccaggccgacgtggacgcgggaaaggtggcggtgctggcgccggaggggttcaccgcgcacgccgtgcaggaaaacatctacgccggctcggcgatgatgcgccgtgcgggctacatgtacggcaccgtgttggcgcgcggtctccgggggcacgtcggctgcggcctcgggcagacactgtcgaccggtgaggtttcgctcgtcgtgccgacggtcgacatcaccgagaccggggagacccacaccatcgacggggtggagatcgagttccagatggccccgggcaccgaggcccctgcggagatgcacttctatttcccgcgcttccgcgcgttgtgcatggccgaaaacgccacgcataacctgcacaacctgctgaccctgcgcggcgccttggtgcgcgatccgcgcgcctggtcgggctatctcaccgaggcgattgacacctttgccgaccgaaccgacgtggtgttcgcctcgcaccactggccgacgtggggacgcgagaagatcgtcgagttcttgtcgcaacagcgcgacatgcattcatatctgcacgatcagacgctgcggctgctgaaccagggctacaccggtgtggagatcgccgagatgttccagctgccaccggcgctgcagcgggcatggcacacccacggctactacgggtcggtcagccataacgtgaaggcgatctatcagcgttacatgggctggtttgacggtaacccgggctggttgtggccgcatccgcccgaggcgctggcgccgcgttatgtcgacgcgttgggtggcatcgaccgagtgctggagctggcccgcgaagccttcgacgcaggtgatttccgttgggcggcaacgcttctcgaccatgcggtgttcgccgacagcgagcacgctgcggcccgcgggctctatgccgacaccctggagcagctggcctacggcgcggagtgtgcgacctggcgcaatttctttctgaccggggccgccgagctgcgcgacgggaacccgggcagctccgggcaagtcccggcgcccacgtttttcgcccagctgacgccggaccaaatctttgacgtcctggcgatcagcatcaatggcccacgcgcatgggacctcgacctggccatcgatttcaccttcaccgagccggatgtcaactatcggctcacgctgcgcaacggcgtgttgatacatcgcaagcttcccgccgatccggcgacggcgaacgcgacggtgacggtgggcgacaaggttcggttggtcgccgcggcgctgggcgatatcagctcacccggtttcgaggtgttcggcgaccggacggtgctgcagacattcttgagcgtcctcgaccggcccgattcggccttcaacatcgtgacgccgtag

SEQ ID NO: 12922 - protein, 626 aa, Mycobacterium bovis AF2122/97
MPMEHKPPTAVIQAAHGEHSLPLHDTTDFDDADRGFIAALSPCVIKAADGRVVWDNDAYSFLDGAAPTSVHPSLWRQSQLTAKQGLYQVVPGIYQVRGFDISNISFVEGDTGLIVIDPLVSTEVAAAALDLYRAHRGADRPVVAVIYTHSHVDHFGGVLGGTTQADVDAGKVAVLAPEGFTAHAVQENIYAGSAMMRRAGYMYGTVLARGLRGHVGCGLGQTLSTGEVSLVVPTVDITETGETHTIDGVEIEFQMAPGTEAPAEMHFYFPRFRALCMAENATHNLHNLLTLRGALVRDPRAWSGYLTEAIDTFADRTDVVFASHHWPTWGREKIVEFLSQQRDMHSYLHDQTLRLLNQGYTGVEIAEMFQLPPALQRAWHTHGYYGSVSHNVKAIYQRYMGWFDGNPGWLWPHPPEALAPRYVDALGGIDRVLELAREAFDAGDFRWAATLLDHAVFADSEHAAARGLYADTLEQLAYGAECATWRNFFLTGAAELRDGNPGSSGQVPAPTFFAQLTPDQIFDVLAISINGPRAWDLDLAIDFTFTEPDVNYRLTLRNGVLIHRKLPADPATANATVTVGDKVRLVAAALGDISSPGFEVFGDRTVLQTFLSVLDRPDSAFNIVTP

SEQ ID NO: 12923 - DNA, 2124 bp, Synechococcus sp. WH 8102
  CDS (1)..(2124): transl_table=11
atggccataacaaccaagttactgattgctggagcgagtgcacttatcccgctcctcagtcttcccgccacggcgctggcagctggcggaggagcaattctttccgatccaggcgccgcccacggaaagcattttcatccgaagggcaagggggccagtgcggctaccgtcgaactctggctaaagaacaaaggcgctcttcctttcgatgacacccgcgatttcgatgaagcaaaaaagggatttattgcagcacccccctacaagcaaatccttaaagacgatggaacggttgtctgggatatggagagctacgaatggctgctcaacggaaaggattttgagagcattcacccctcccttcaacggcaagcagtactcaacatggcctatggattgtatgaggtcgttccagatcgcatctatcaagtgcgtggttacgacctagccaatatctctttcattaagggggatcgaggctggatcgtcttcgacccactcacggccaaagaaactgctcgcgcagccctcgacctcatcaatgatcagctaggcgaacggcctgtcactgctgttgtaatttcccattcccacgcagatcacttcggcggaattcggggagttgtcgatgaaaaagatgtactcagtggaaaagttccggtgattgctcctgtgggcttcatggaccatgccgttagtgagaatgtctatgcaggcaacgcgatgaaccgtcgcctcttttaccaatatggtgttttattgtctcgcagcccattcggacatgttgatcaatccattgacgagaacaccgctgctggaacgacgggcctaattccaccttctcgcatcatcagcaagccgatcgagcggctaaccgttgatggcatcgagatggagtttcagaacactcctggcactgaagccccagcggagatgaacacctggttccctcagttcaaaacattctgggctgcagaaaatattaccggcaccattcacaacatttatacactgcgtggtgccttgatccgcgaccccctggagtggagcaagaagattaatgaggctctctttcgatatgggaccaaagccgatgtgatgttcgcctcacacagctggccacgctggggcaatgtgcgcattcaggaagtgatgcgggtgcagcgagatgcctatgcccatctcaacaacaatgtgcttcatcacgccaataaaggcgtgatgattaatgagattcacaatgtttataccctcccagagagcctgaaacagcagtgggcagctcacagctatcacgggtctgaagagcacaacagccgtgctgtgatcaaccgctatttggggtattgggacgccaaccccacaacactgacaccgctttcgccgtctgattcagccccgctctacgtggaaatgatgggaggtgcaacaccaatcctcaccaaagcaaaggcactcatcaaggccggacagtaccttctcgcgacagaaattctcaacaagctgatctacgcccagcctattaacaccacagccaaggatctgctcgctgatgccttcgaacagatcgggtaccaaaaagaaagtccaagcgtgcataacagctttctagctgccgcgttggagcttcgctctggcatcccctctggtgccattcccaaaacatcaggcccagacatgatcaaagccatgtccacccagctatggcttgatttcctagggatccgcctggatccgggtcaaaccgcgggaaaggccttccgcatcaatttgatcaccccagacaacgaggaacggtttgcaatcgagctgagcaacgacgccctcacaagcatccagggttacgtagggcagaatcccgatttaacgatcacgatcaaacgcgagcaacttgagcgcctgatgaccggcagcgccgattttgatcagctggttaaggaaggggtcatgcagcttgatggcagccgggctgtggcagacaacttgcgctccatgcttgtgcagttcacaccagacttcgaaattcttcctggcacaacacctgccggcagcaatcagggagtcgatgtcaacccagcacaaccgctgcgtcaatcagagccagccgatacggcaggtggctga

SEQ ID NO: 12924 - protein, 707 aa, Synechococcus sp. WH 8102
MAITTKLLIAGASALIPLLSLPATALAAGGGAILSDPGAAHGKHFHPKGKGASAATVELWLKNKGALPFDDTRDFDEAKKGFIAAPPYKQILKDDGTVVWDMESYEWLLNGKDFESIHPSLQRQAVLNMAYGLYEVVPDRIYQVRGYDLANISFIKGDRGWIVFDPLTAKETARAALDLINDQLGERPVTAVVISHSHADHFGGIRGVVDEKDVLSGKVPVIAPVGFMDHAVSENVYAGNAMNRRLFYQYGVLLSRSPFGHVDQSIDENTAAGTTGLIPPSRIISKPIERLTVDGIEMEFQNTPGTEAPAEMNTWFPQFKTFWAAENITGTIHNIYTLRGALIRDPLEWSKKINEALFRYGTKADVMFASHSWPRWGNVRIQEVMRVQRDAYAHLNNNVLHHANKGVMINEIHNVYTLPESLKQQWAAHSYHGSEEHNSRAVINRYLGYWDANPTTLTPLSPSDSAPLYVEMMGGATPILTKAKALIKAGQYLLATEILNKLIYAQPINTTAKDLLADAFEQIGYQKESPSVHNSFLAAALELRSGIPSGAIPKTSGPDMIKAMSTQLWLDFLGIRLDPGQTAGKAFRINLITPDNEERFAIELSNDALTSIQGYVGQNPDLTITIKREQLERLMTGSADFDQLVKEGVMQLDGSRAVADNLRSMLVQFTPDFEILPGTTPAGSNQGVDVNPAQPLRQSEPADTAGG

SEQ ID NO: 12925 - DNA, 2025 bp, Vibrio vulnificus YJ016
  CDS (1)..(2025): transl_table=11
atgaatatccgctttgtaccctcaacccttacccttgctttgatggtttcttttggcgcatcggcggactacgccagcttagaaaactatcaaggtaagccagcaacggcccacacaaaacaagccaacgctgaactggcaaaacagttgccttggcatgatacctcggcgtttgagcgcactcagcgtgggcttattgccgaattcggcagccatcaagctggtgaactcaagcagcgttttcactatatggcagaaatgaacgtagagcagttgccagagacggtgaatccgtcgatttggcgtcaaggcatgctcaactacgttgccggcggcttgtatgaagtgacggatggggtttatcaaatccgtggtgctgatctctcgaatatgaccatttaccgcaccaacaatggctacgtgattcacgatccactattgtcacgcgaagcggcggcagcggcgtgggaatttgccaaacagcatcttcctaaagtgaagggtggccacaaaatcaccggtatgatctactcgcatatgcacgttgaccattttggaggctctcgcggcattctcgactcgggtgattttgctaaaggtgcaccgatctacgcaccgaaagatttcattaaagagctggcggatgaaaacatcatcgcgggtacggccatgagtcgtcgtgccaactatcaatacggcaccactctcgataacaataccaaaggcatcgtggataatgcgcttggcttaggcacctctcgtggtgaaatcacgttggtggcgccaacacaagaaatccaacctcgcgaaaaagagctgaccattgatgggctcaagttccacgcgatcaacatgccgggcgcagaagctccagcagaaatcgtgctttatgttcctaagtatcgctctctcaataccgctgagctgacttacgatggcatgcataacatctacactttccgtggtgcgaaagtacgcgattccttggcgtggaccaaatacctcaccgagctgaaactgcgttttgtcgacagcggtttggtggacaacattcacgccgcgcactcagcgccagtgtggaatgatccgaacactgaggtgaatgagatttcacaatacatgaccctgcagcgcgataactatggcttcattcataaccagtcgatgcgtttagcaaatcatggcgtgaccattcacgatgtgggccgtgagattgagaaaattgtgcctcaaacgcaaaaagaaacctggcacactaatggttaccatggctcttacagccataatgctcgagctgtggtgaacttgtatcttggctatcacgatatgaacccggtgaacacgaacccactggcgactcaggataaatcgtgcgtttacgtcgaagccgctggcgcacaaacgctatacaaagcggggcaaacacacttcgccaaaggggaatatcagcaagcatcgcaactgtttaacgacttagttcagtgtgacccgaacaatatccaataccgttttgccttagcagacagctttgaacagcaaggctaccagtcggaaaccatggcgtggcgtaactcgtatctgcaaggcgcggttgagttgagaaccggagaaattcgtccatcgatcaaagcggcatcggccgatgtgattgccaacaccccaacgggtatgtttcttgatttcttagcggtgaaactaaacgcgacgaaagcagagcaagcgggtctggatttccgctttggtgtatcacatccagagctgaaagagcattactacggtgaagtgtccaacgcgaacatggccaatattcaagtggataagttaccgaataccgatgtgactctcagcatcagtaagagcgacttaacgcaaattgtactaggtaaaacaacgttagataagctagtgaaagaaggaaaggcaaacctgaaaggggatgcccaactgataaaagcattgtcggaatgtttagatgagtttgatggcttgtttgagattcttccaatgccgaataaaaaagcatag

SEQ ID NO: 12926 - protein, 674 aa, Vibrio vulnificus YJ016
MNIRFVPSTLTLALMVSFGASADYASLENYQGKPATAHTKQANAELAKQLPWHDTSAFERTQRGLIAEFGSHQAGELKQRFHYMAEMNVEQLPETVNPSIWRQGMLNYVAGGLYEVTDGVYQIRGADLSNMTIYRTNNGYVIHDPLLSREAAAAAWEFAKQHLPKVKGGHKITGMIYSHMHVDHFGGSRGILDSGDFAKGAPIYAPKDFIKELADENIIAGTAMSRRANYQYGTTLDNNTKGIVDNALGLGTSRGEITLVAPTQEIQPREKELTIDGLKFHAINMPGAEAPAEIVLYVPKYRSLNTAELTYDGMHNIYTFRGAKVRDSLAWTKYLTELKLRFVDSGLVDNIHAAHSAPVWNDPNTEVNEISQYMTLQRDNYGFIHNQSMRLANHGVTIHDVGREIEKIVPQTQKETWHTNGYHGSYSHNARAVVNLYLGYHDMNPVNTNPLATQDKSCVYVEAAGAQTLYKAGQTHFAKGEYQQASQLFNDLVQCDPNNIQYRFALADSFEQQGYQSETMAWRNSYLQGAVELRTGEIRPSIKAASADVIANTPTGMFLDFLAVKLNATKAEQAGLDFRFGVSHPELKEHYYGEVSNANMANIQVDKLPNTDVTLSISKSDLTQIVLGKTTLDKLVKEGKANLKGDAQLIKALSECLDEFDGLFEILPMPNKKA

SEQ ID NO: 12927 - DNA, 1968 bp, Vibrio vulnificus YJ016
  CDS (1)..(1968): transl_table=11
atgacaatgaaaccactctctttgtatatcgcgctcgcgctcacgtcaggggccgttctggccgaacccatcccatctaaaccggcgacacaagccacgattgaagccaatcaggcggtgtatcaagcgttaaattttaaggatgaaaccgattttaagaatgcccaacgaggtttgatcgccaaacaagatgtggtcaccatcaaaaacgccaatggcgatgtggtgtgggatctggaagcgtacaagcagttcatctcgttagaaaataaagcgccagatagcgtgaaccccagtttatggcgtaacgcgcagctcaatatgatcaatggtctgtttgaggtgactgagggcatttatcaggtgcgcgcttacgatctttccaacatcacctttattaaaggggacaaagggtggatcgtcttcgacccgttgatttcccaagaaaccgctaaagcggcgctggagtttgttaatgctcagcttggtgagcgccaagtgacggcggtggtctattcgcacagtcatattgaccactttggtggggttcgcggcatcgtgaatgaagaagatgtgaaagcgggcaaggtggagatcattgcctcacacggcttcacggaacatgcagtgtcagaaaacgtgattgcaggcaatgcaatgggccgacgcgctatctatatgtatggtgctttgctgccgcgcaatgaacgtggcggggtcaatggcggcttaggccaaaccacgtcaacgggcttaccaaccttgattgtccccacccgtattattgaaaaaaccggtgaagagctgacggtggatggcgtgcgcatggtgttccaatacaccccaggcacggaagcaccaaccgaaatcaatacttggttcccagacaaaaaagcgttgtggatggcagaaaactccaccaacaccatgcacaacatcctcacgttgcgcggagcgcaggtgcgtgatgcgctcaagtggtcctcttacctcaacgaaaccattgaaatgtggggcgatgaggtggaagtgaaattccaaagtcaccactggccaatgtggggcagcaaagagattgttgcttactttaaaggccagcgcgatatgtacaagtacacgcacgaccaaaccgtacgcttgatgaaccaagggtacatcggctctgaaatctcggaagtgattcaattccctgaggagttggagaagaactggagtacacgcggttactacggcaccttacgccacaacagccgggcggtttatcagcgctacatgggttggtattcaggcaacccttccgatctcaacaacttaccgccaaccaacgcagcggtgaaatacgttgagtacatgggcggcgaaagtgcaaccatcgacaaggcgcaagcggatttcgataaaggcaactaccgctgggtggcagaagtgctcaaacatgtcgtgtttgctaacccacaaagtaagcgcggcaaagcgttgctcgccgatacttacgagcagttggggtatcaagcggaatctggcccgtggcgctcggtttacttgcaaggggcttatgagctgagaaacgggacgcccaaagcgggaggcaccaatacggcctcgcccgacatcatcaaaaacatgccgccagagatgttgtttgattacctagcggtgcgcattttgccagaaaaagccgcgggtaaaaccttcgccatcaatatcaatttcaccgacttagatgagcagtacaccttgtatgtggaaaactcggtgctcaatcacacgcgtaagcaagcgaaaaaagccgacgtgacgttgaatttgaccaaggcgactttagacgatgttcagcttggcaacattaccttggagaaagcaattgctgatggtgacgtgcaactcaaaggcaataggcaggtgtttaaagactttgttggcatgctggataagtttgatttctggttcaacattgtgacgccatag

SEQ ID NO: 12928 - protein, 655 aa, Vibrio vulnificus YJ016
MTMKPLSLYIALALTSGAVLAEPIPSKPATQATIEANQAVYQALNFKDETDFKNAQRGLIAKQDVVTIKNANGDVVWDLEAYKQFISLENKAPDSVNPSLWRNAQLNMINGLFEVTEGIYQVRAYDLSNITFIKGDKGWIVFDPLISQETAKAALEFVNAQLGERQVTAVVYSHSHIDHFGGVRGIVNEEDVKAGKVEIIASHGFTEHAVSENVIAGNAMGRRAIYMYGALLPRNERGGVNGGLGQTTSTGLPTLIVPTRIIEKTGEELTVDGVRMVFQYTPGTEAPTEINTWFPDKKALWMAENSTNTMHNILTLRGAQVRDALKWSSYLNETIEMWGDEVEVKFQSHHWPMWGSKEIVAYFKGQRDMYKYTHDQTVRLMNQGYIGSEISEVIQFPEELEKNWSTRGYYGTLRHNSRAVYQRYMGWYSGNPSDLNNLPPTNAAVKYVEYMGGESATIDKAQADFDKGNYRWVAEVLKHVVFANPQSKRGKALLADTYEQLGYQAESGPWRSVYLQGAYELRNGTPKAGGTNTASPDIIKNMPPEMLFDYLAVRILPEKAAGKTFAININFTDLDEQYTLYVENSVLNHTRKQAKKADVTLNLTKATLDDVQLGNITLEKAIADGDVQLKGNRQVFKDFVGMLDKFDFWFNIVTP

SEQ ID NO: 12929 - DNA, 1968 bp, Vibrio vulnificus YJ016
  CDS (1)..(1968): transl_table=11
atgaaacgacaaaaatcgattgtatcgctagcgattatcgccactctattcccagctctaacgttcgctgccccaaccagcagcgagcctaaacaagcttcttcgttcaccatcgagaaaaacaaccaactcaaaagctacctcgacttcgccaatcaaagtgattttgaagatgcctcacgcggttacattgctacttggccagaaaaaaccatcaaagacgccaaaggcaatgtgatttgggacttcagcaaatacgactttgttgaacaagagaagaacattcaaaccgtcaacccttcactgctgcgccaagcaaaactgaacaacatcgatggcttgttcaaagtaaaagagggcatttaccaagtacgcggttttgatctctcggtgatgacctttatccgcggtgacaaaggttgggtcgtgatcgacccactcatttcaccagaaaccgccgcggcagggctgaaattgctgcgtgacaaagtggaagatgcgccggtaacgggcgtgattttcacccactcacacgttgaccactttggtggcatccttggcatcaccagccaagaagcgattgatgctggtaaagtcgatattcttgcgccagagggctttttctctcactcgattgccgagaacttgatggcgggcaacaccatgtcgcgtcgcgcttcttacatgtatggcaacctgcttgaagcgagcagccaagggcaagtggacggcggtttgggtaaaaccacctcatccggtgcgccaggcatcgttaagccaacgcacattgccaatatcaccgggcagaaaatggcggtcgatggtgtggaactggaagtgatcatggcgcaggaatccgaagcgccgtcggaatttatgttctacttcccacaatacaaaaccatgatggcggcggaagtgatgacgcacaccatccacaacatctcgacactgcgcggcgcgaaaacgcgtgatgcttcttcttgggctgaatacattgaccaagcgctgaaaacttacggtgacaaagccgataccatgatcgcctctcaccactggccaacctttggcaaagagaagatccaaactcagcttgagaaaacgcgcgacatgtacaagtttgtccatgaccaaaccctgcgtctcgccaacaaaggctatacgccaaatgagatttcagcagaaattaccctgccagattcgctaggcaaagaatggtacaaccgcggttactacggcacggtatcgcacaatgctcgcgcgacgtacgacttctactttggtgcatggtgggatggcaacccagccaacctaaacccgctgacaccaagtgaacaaggcgcaaaatacgttgaagcgatgggcggtgaagagaaagtgattgagctggctgaacaagcggtgaaaaacggtgaatatcgctgggcagtgacactgcttaacaacgtgactttctccaacccagacaatatggacgctcgctacttagaagcggacgcgatggagcaattgggttatcaggcggaatcaggcccttggcgtaactactatcttggcggtgcgaaagagctgcgccaaggcatcaaaccagtcgcaacgccagacacggccgcaattgctaagaatatgccgtttgatcagttcatgaagtacctcggcgtgacggtaaaacctgacgcggcgaatggcctcgatatcaaagtgaacatcaatgtcaaaggcgacggccaatactcgatggagctgagcaactcggtattgaaatcgtactctggtagccagtttgataacgcggatttgaccattaacttaacccgccaagcgtttgagaaaatgctgaccaagcaagcgacactgcaagatcaggtcaaagccggtgagtttagtgtttcaaaccaagcgcagttccaaacactgatgtcagtctttgataaattcgacatgtggttcggtgtggtaacaccctaa

SEQ ID NO: 12930 - protein, 655 aa, Vibrio vulnificus YJ016
MKRQKSIVSLAIIATLFPALTFAAPTSSEPKQASSFTIEKNNQLKSYLDFANQSDFEDASRGYIATWPEKTIKDAKGNVIWDFSKYDFVEQEKNIQTVNPSLLRQAKLNNIDGLFKVKEGIYQVRGFDLSVMTFIRGDKGWVVIDPLISPETAAAGLKLLRDKVEDAPVTGVIFTHSHVDHFGGILGITSQEAIDAGKVDILAPEGFFSHSIAENLMAGNTMSRRASYMYGNLLEASSQGQVDGGLGKTTSSGAPGIVKPTHIANITGQKMAVDGVELEVIMAQESEAPSEFMFYFPQYKTMMAAEVMTHTIHNISTLRGAKTRDASSWAEYIDQALKTYGDKADTMIASHHWPTFGKEKIQTQLEKTRDMYKFVHDQTLRLANKGYTPNEISAEITLPDSLGKEWYNRGYYGTVSHNARATYDFYFGAWWDGNPANLNPLTPSEQGAKYVEAMGGEEKVIELAEQAVKNGEYRWAVTLLNNVTFSNPDNMDARYLEADAMEQLGYQAESGPWRNYYLGGAKELRQGIKPVATPDTAAIAKNMPFDQFMKYLGVTVKPDAANGLDIKVNINVKGDGQYSMELSNSVLKSYSGSQFDNADLTINLTRQAFEKMLTKQATLQDQVKAGEFSVSNQAQFQTLMSVFDKFDMWFGVVTP

SEQ ID NO: 12931 - DNA, 1947 bp, Rhodopseudomonas palustris CGA009
  CDS (1)..(1947): transl_table=11
atgagcgagaccaccacgatcgcgaacgacgcaactgcgccgaaggacgcctccgcctcggtgaccgcgcgccacgaggccgtgctggacgagctgccgttctccgatacgaccgatttcgacgacgccgcgcgtggctttctcggcagcatcgaccacgccgcgatcagttcggcgcagggccggacggtgtggagtctcgaaccctatcggtttctccagaaagagattgcgccggcaaccgtcgatccgagcctatggcggcaatcgcggctgaacatgcagcacggactgttcgaggtcgtgccgggcgtgtaccaggtccgcggcttcgatatcgccaacatgacgctgatcgagagcgacaatggcgtgatcgtggtcgacaccctgacctcgatcgaaggagcccgcgcggcaatgcagctctatgcccgccaccgcggcgacaggccggtggtggcggtgattttcactcacacccacgccgatcattggggcggcgcgcgcggcgtgctcgacgacgccacgctcgcgagtggtcgggtgccgatcatcgcgcccgacctgttcatggagcacgccgtctccgagaacatcatcgccgggccggcgatgttgcggcgcgcgcagtatcagttcgggccgctgctcgccaagggatcgcgcggccatgtcgattgcggactcggcaagacgatggccgcgggcactgccgcgctgctgcggccgaccgacctgatcaaggcgaccggcgacacccgccgcatcgatggcgtcgacttcgaattccagatggcgccgaactccgaagcgccggcggagatgcacttctacgttccgcgctacaagctgctcaacctcgccgagaactgcacgcacaacttccataatctgctgccgttccgcggcgccgacgtgcgcgatgcgctggcgtggtccggctatctcggcgaggccttgcggctctggggcggcaaggccgaggtgatgtgcggccagcaccattggccggtgtggggcaccgaacggatcgacctgatgatccggcagcagcgtgacctctacaaattcgcccacgaccagacgctgcggctgatgaaccacggcctcaccgccgccgagatcgccgaaaccatccgcctgccgaagagcctcgatggcgcctggcacgcccgcggctattacggccatatccgccacaacgtgaaggcgatctatcagaagtatctcggctggtacgacgccaacccggccaatctcgatccgctgccgccggtggacgccggcaagaagtatgtcgactacatgggcggcgcggaggcgctgctggcgaaggcgcgcgccgatttcgcccgcggcgagttccgcttcgtggcgcaggcactcagccatttggtgtttgccgatccagacaaccaggacggccggctgctgctggccgatacgttcgaacagctcggttaccaatccgagagcgcgacctggcgcaacgcctatctgttcggcgcacaggaactgcgccacggcatgccgaagatgccgacgcggcccgggatgccgcgcgagacgctgtcggcgctgaagacctcacagatctgggacgttcttggcgtccggctcaacggaccgaaggccgagggcaagaccatcgtgttgaactggcagttcaccgacaccggcgaacactgggtgctgacgctggagaactgcgcgctgacctatctggccggcacgcaatcggccacggccgatgccggctttgtgctggcgcgaagcctgctcgacgaggtgatcgccaagcagacctcgtttcccgaggcggtgatggccggcaagatcaaggtcagcggcaatccgatgaagctcgccgagctgatggcgctgatggacgaattcccgcggatgttcgagatcgtcgaacctaaaagagcagccgtgacctga

SEQ ID NO: 12932 - protein, 648 aa, Rhodopseudomonas palustris CGA009
MSETTTIANDATAPKDASASVTARHEAVLDELPFSDTTDFDDAARGFLGSIDHAAISSAQGRTVWSLEPYRFLQKEIAPATVDPSLWRQSRLNMQHGLFEVVPGVYQVRGFDIANMTLIESDNGVIVVDTLTSIEGARAAMQLYARHRGDRPVVAVIFTHTHADHWGGARGVLDDATLASGRVPIIAPDLFMEHAVSENIIAGPAMLRRAQYQFGPLLAKGSRGHVDCGLGKTMAAGTAALLRPTDLIKATGDTRRIDGVDFEFQMAPNSEAPAEMHFYVPRYKLLNLAENCTHNFHNLLPFRGADVRDALAWSGYLGEALRLWGGKAEVMCGQHHWPVWGTERIDLMIRQQRDLYKFAHDQTLRLMNHGLTAAEIAETIRLPKSLDGAWHARGYYGHIRHNVKAIYQKYLGWYDANPANLDPLPPVDAGKKYVDYMGGAEALLAKARADFARGEFRFVAQALSHLVFADPDNQDGRLLLADTFEQLGYQSESATWRNAYLFGAQELRHGMPKMPTRPGMPRETLSALKTSQIWDVLGVRLNGPKAEGKTIVLNWQFTDTGEHWVLTLENCALTYLAGTQSATADAGFVLARSLLDEVIAKQTSFPEAVMAGKIKVSGNPMKLAELMALMDEFPRMFEIVEPKRAAVT

SEQ ID NO: 12933 - DNA, 1986 bp, Rhodopseudomonas palustris CGA009
  CDS (1)..(1986): transl_table=11
atggcacgaattataccgtcgatgatacttgctaccaccgcggcgctgtcgctgctggctgcaccgctggctgcccagcccaacgacgccgagccggcgacgcggtcggcgaacgaggtggtgaacaagtccctgcctcttgccgatcgcgccgatttcgaggacgcgcagcgcggcctgatcgcctcgctgcccgatggcgtggtccccggaccggcgggggcgccggccgcgtgggacctcaagccgtacgacttcctcaagggcgatcagccctccgcgacggtcaatcccagcctgtggcggcaggcgcagctcaacctcgccagcgggctgtttcaggtggccgagcgggtctatcaggtccgcgggctcgacatcgcgaatgtcacgatcgtcgagggcgacaccggcctgatcatcaccgacaccacgttgacggtgcagaccgccaaggcggcactcgatctgtactaccagcaccggcccaagaagccggtggtggcgctgatctacacccacagccacatcgaccatttcggcggcgcccgcgggttgatcgacgaggccgatgccgccagcggcaaggtcaaggtgatcgcgccgaccggcttcttggaacatgcggtcgccgagaacgtcatcgccggcaatgcgatgagccgccgcgcgcaattccagttcggaacgcagctcccggtcggtgagcgcggtcaggtcgatgccggcctcggcaaggcgctggccaagggcacggtgtcgctgatcgcgccgaacgacctgatcaaacagccctatgagacccgcagcatcgacggcgtcgagatcgaattccacctggtgccggagtcggaggcgccttcggagatgatctcgtactatccccagttcaaggtgctgaacatggcggaggacaccacccacaccctgcacaatctctataccctgcgcggcgccgcgatccgcgacggccggctgtggtcgaaatacatcggcgaggcgatcgagcgctatggcgacaagaccgacgtggtgatcgcccagcacaactggccggtgtggggccgtgaccgcgtcgtcggctatctgaagaagcagcgcgacgtctacaagttcatccacgaccagagcgtgcggctgctcaatcacggcctgacgccgaccgagatcgccgagcggttgacgctgccaccgtcgctgacgagcgagttcgccgcgcgcggctattacggctcggtcagccacaacgccaaggcggtgtatcagttctatctcggctggtacgacgccaacccggccgatctcaatccgctgccgcgcgccgagcaggccaagaaggagatcgactatatgggtggtgccgctgcggtgctggcgcgcgcccgggacgactacaaggctgggcaatatcgctgggtggcgacggtggccagcaagctggtgtttgccgatcccgccaacaccgaagcccgcgcgctcggtgccgacgcgctggagcagctcggctatcaggccgaagcctcgacctggcgcaacgcctatctgctcggcgcgcaggaactgcgcaacggtctgatcaagaccgattcggtcacctccaatcccgatctgctcaagggcgtgtcgatcgatctggcgttcgacttcctggcggtgcggctgaacgcggcgaaggccgagggcaagcacatcgtggtgaactggaccttcaccgacctgaaggagacctacaccatgaacctggagaattcggcgctgacccacatctccggcaagctgtccgacaacgccgacgtcagcgtcaccctgaaccgcgccaccttcgatgcgatctcgctgaagcagcgcggcttcctcggcgcggtgctgagcggcgacctctgggtcagcggcaatccgctgaagctgcgcgaactgttcggcctgttcgaagacttctcaccgaacttcgaagtgatcgagccggtcaaggcgaaggtggagtag

SEQ ID NO: 12934 - protein, 661 aa, Rhodopseudomonas palustris CGA009
MARIIPSMILATTAALSLLAAPLAAQPNDAEPATRSANEVVNKSLPLADRADFEDAQRGLIASLPDGVVPGPAGAPAAWDLKPYDFLKGDQPSATVNPSLWRQAQLNLASGLFQVAERVYQVRGLDIANVTIVEGDTGLIITDTTLTVQTAKAALDLYYQHRPKKPVVALIYTHSHIDHFGGARGLIDEADAASGKVKVIAPTGFLEHAVAENVIAGNAMSRRAQFQFGTQLPVGERGQVDAGLGKALAKGTVSLIAPNDLIKQPYETRSIDGVEIEFHLVPESEAPSEMISYYPQFKVLNMAEDTTHTLHNLYTLRGAAIRDGRLWSKYIGEAIERYGDKTDVVIAQHNWPVWGRDRVVGYLKKQRDVYKFIHDQSVRLLNHGLTPTEIAERLTLPPSLTSEFAARGYYGSVSHNAKAVYQFYLGWYDANPADLNPLPRAEQAKKEIDYMGGAAAVLARARDDYKAGQYRWVATVASKLVFADPANTEARALGADALEQLGYQAEASTWRNAYLLGAQELRNGLIKTDSVTSNPDLLKGVSIDLAFDFLAVRLNAAKAEGKHIVVNWTFTDLKETYTMNLENSALTHISGKLSDNADVSVTLNRATFDAISLKQRGFLGAVLSGDLWVSGNPLKLRELFGLFEDFSPNFEVIEPVKAKVE

SEQ ID NO: 12935 - DNA, 1875 bp, Mycobacterium avium subsp. paratuberculosis K-10
  CDS (1)..(1875): transl_table=11
atggaccacaaacctcccagcccggtaatcgaggcggcccatcgcgcatgcgtgctgccgttttccgacgacgcggatttccgcgacgccgatcgtggattcatcgccgcgttgtcgccgtgcgtggtgcggggcgccgacggccgcgtggtgttcgacaacgacgcctacgccttcctggacgggcccgcgcccacgtcggtgcatcccagcctgtggcggcagtccacgctggccgccaaacacggcctctacgaagtggttccgggcatctatcaggttcgcggccttgacatctccaacgtcacgttcgtggaaaccgacaccggcatcatcgtcatcgatccgctggtgtccaccgaggtggccgcggcggcgctgacgctgtaccgcacgcatcgcggcggcgaccggcccgtggtcgcggtgatctacacccacagccacgtcgaccatttcggcggcgtcctgggcgtcaccacccaggccgacgtcgatgccggccgggtggaggtgctggcgccggagggtttcgtcgaacatgcggtgcaggagaacgtctacgccggcccggcgatgctgcgccgcgccacctacatgtacgggacgctgctgccgcgcgggccccgcgaccatgtgggctgtgggctcgggcaggccgcctccatgggcgaggtggccctcatcgtgccgacagtcgacatccgcgagacgggggagacacacacgatcgacggcgtcgagatcgagttccagatggcgcccggcaccgaggcgcccgccgaaatgcatttctacttcccgcaattccgcgccctgtgcatggccgagaacgccacccacaacctgcacaacctgctgaccctgcgcggcgcgctggtgcgcgacccgcgcgcctggtccggctacctcaccgaggccatcgacaccttcgccgaccgcgccgacgtcgtgttcgcctcccatcactggccgacgtgggggcgggacggcatcgtcgaattcctgtcgctgcagcgcgacctgtacgcgtatctgcacgaccagacactgcgcctgctcaaccagggtcacaccggtgtcgagatcgccgaaatgttccggctgccaccggctctcgagcgggcctggcacgcgcgggggtactacgggtcggtcagccacaacgtcaaggcgatctaccagcgctacatgggctggttcgacggcaacccggcccggctgtggccccatccccccgaggcgctggggccccgctatgtggctgcgatgggcggcatcgaccgggtcgtcgacctcgcccagcaggcgttcgactccggtgattaccgttgggcagcaacccttttggaccacgcgatgttcaccgacggtgagcacgccggcgcccgcgagctctacgccgacacgctcgagcagctggcctacggcgcagagaacgcgacctggcgcaacttcttcctcagcggggcaacggagctgcgcgacggcaatttcggcaccgccgggcaggtcacctcgcccaccatgcttgcccagctgacgccggagcagatcttcgacggcctggccatccgggtcaacgggccacgcagctggggcctcgacatcaccgtcgatgttacccttgccgacacggcggtcaaccatcggctcgcgctgcgcaacggcgtgctggtgcaacgcaaggtgccggcggatcccgcgacggcgaccgttacggtgcggctggccaacaagattcggctgctggcgttggcggcgggggacttcgcctcgccgggtctggagctcaccggcgatcggggtgcgctgcaggcgttggtgggagcgctcgacgcgccggacccggacttcaacatcgtcacgccgtag

SEQ ID NO: 12936 - protein, 624 aa, Mycobacterium avium subsp. paratuberculosis K-10
MDHKPPSPVIEAAHRACVLPFSDDADFRDADRGFIAALSPCVVRGADGRVVFDNDAYAFLDGPAPTSVHPSLWRQSTLAAKHGLYEVVPGIYQVRGLDISNVTFVETDTGIIVIDPLVSTEVAAAALTLYRTHRGGDRPVVAVIYTHSHVDHFGGVLGVTTQADVDAGRVEVLAPEGFVEHAVQENVYAGPAMLRRATYMYGTLLPRGPRDHVGCGLGQAASMGEVALIVPTVDIRETGETHTIDGVEIEFQMAPGTEAPAEMHFYFPQFRALCMAENATHNLHNLLTLRGALVRDPRAWSGYLTEAIDTFADRADVVFASHHWPTWGRDGIVEFLSLQRDLYAYLHDQTLRLLNQGHTGVEIAEMFRLPPALERAWHARGYYGSVSHNVKAIYQRYMGWFDGNPARLWPHPPEALGPRYVAAMGGIDRVVDLAQQAFDSGDYRWAATLLDHAMFTDGEHAGARELYADTLEQLAYGAENATWRNFFLSGATELRDGNFGTAGQVTSPTMLAQLTPEQIFDGLAIRVNGPRSWGLDITVDVTLADTAVNHRLALRNGVLVQRKVPADPATATVTVRLANKIRLLALAAGDFASPGLELTGDRGALQALVGALDAPDPDFNIVTP

SEQ ID NO: 12937 - DNA, 1878 bp, Mycobacterium sp. JLS
  CDS (1)..(1878): transl_table=11
atggactcgaagccaccgagtgacgccatccaagcggcccaccggcatcacctgagcaccctgccgttcaccgacagagcggatttcgacgacgccgaccgcgggttcatcgccgcgctcgagccgtgcgtggtcgccgcggccgacgggcgggtggtgtgggacaacgacgtctacgcgttcctcgacggggaggcgccggcgtcggtgcaccccagcctgtggcggcagtcccaactcgccgccaaacaggggctgtacgaagtggtcgagggcatctaccaggtccgcggcctcgacctgtcgaacatcacattcgtcgagggggacaccggcgtcatcgtcatcgacccgctgatctcgaccgagaccgcggccgcggcgttggcgctctaccgccagcaccgcggcgatcgtgcggtgaccgctgtcatctacacccacagtcacgtcgaccacttcggcggcgtgctcggcgtaacctcccaggccgacgtcgatgccggcaaggtggccgtgctggcgccggagggtttcgtcgaacacgcggtgcaggagaacgtctatgccggcaccgcaatggcccgccgggccacgtacatgtacgggacgctgttggcgcgcggaccgcggggccagctgggatgtggcttggggcaacagacttcgacgggtgaggtcgccttggtcgtgcccacgctcgacatccgcgagacgggcgaggcgcacacgatcgacggtgtcgagatcgagttccagatggcgcccgggaccgaggcgcctgccgagatgcacttctacttcccgcgctaccgcgcgctgtgcatggccgagaacgcaacgcacaacctgcacaacctgctcacgctgcgcggggccctggtacgcgatccgcacgcgtggtcgggctacctcaccgaggcgatcgacaccttcgccgacaaggccgacgtcgtgttcgcctcccatcactggccgacctggggccgcgaccgcatcaccgaatacctgtcgctgcaacgcgatatgtacgcctacctgcacgaccagacgctgcgcatgctcaaccaggggcacacgggcatcgagatcgccgagcagttccagatgccacccgcgctggagcgggcctggcacacccacggctactacggttcggtcagccacaacgtcaaggcggtctaccagcgctacatgggctggttcgacggcaaccccggccgactgtgggcgcacccgccggaggcgctggccgcccggtacgccgaggccctcggcggcgtcgaccgggtggtcgagctggccaggaaagcctgcgacgagggtgacttccgctgggcggcaacgctgctcgatcacgccgtgttcgccgaccagaatcacaccgaggcccggcaactctacgccgacactctcgagcagctggcctacggcgcggagaacggggtgtggcgcaacttcttcctgtccggggccgccgaactgcgcgacggcaacttcggcaccgcggtccagtccacgtcaccgaccctgctgagcgaactgactccggcgcagatgttcgacagcctcgccatcagcatcaacggcccccgcgcctgggatctcgacgtggcggtggacgtgacgttcctcgacaccggcgacaactaccggctgacgctgcgcaacggagtcctggtgcaccgcaaggtctctgccgacgagtcgagtgtgcaggccacgatccggctggcgaacaaggtgcggttgctggcctacgccgcgggcgacaccacgtcgccgggcgtcgagatcaccggtgacgaggcggcgctggcgaacatcgtgggggtgctcgaccgcccggaccccgctttcgacatcgtcatgccgtag

SEQ ID NO: 12938 - protein, 625 aa, Mycobacterium sp. JLS
MDSKPPSDAIQAAHRHHLSTLPFTDRADFDDADRGFIAALEPCVVAAADGRVVWDNDVYAFLDGEAPASVHPSLWRQSQLAAKQGLYEVVEGIYQVRGLDLSNITFVEGDTGVIVIDPLISTETAAAALALYRQHRGDRAVTAVIYTHSHVDHFGGVLGVTSQADVDAGKVAVLAPEGFVEHAVQENVYAGTAMARRATYMYGTLLARGPRGQLGCGLGQQTSTGEVALVVPTLDIRETGEAHTIDGVEIEFQMAPGTEAPAEMHFYFPRYRALCMAENATHNLHNLLTLRGALVRDPHAWSGYLTEAIDTFADKADVVFASHHWPTWGRDRITEYLSLQRDMYAYLHDQTLRMLNQGHTGIEIAEQFQMPPALERAWHTHGYYGSVSHNVKAVYQRYMGWFDGNPGRLWAHPPEALAARYAEALGGVDRVVELARKACDEGDFRWAATLLDHAVFADQNHTEARQLYADTLEQLAYGAENGVWRNFFLSGAAELRDGNFGTAVQSTSPTLLSELTPAQMFDSLAISINGPRAWDLDVAVDVTFLDTGDNYRLTLRNGVLVHRKVSADESSVQATIRLANKVRLLAYAAGDTTSPGVEITGDEAALANIVGVLDRPDPAFDIVMP

SEQ ID NO: 12939 - DNA, 1866 bp, Bradyrhizobium sp. ORS278
  CDS (1)..(1866): transl_table=11
atgctcgcggcactgccgttcgatgacacgaccgatttcgacgatgccgcgcgcggcttcctcggcacgatcgatcaggccaaggtgacgacgtcgcaaggccgcagcgtctggagtctcgaaccctacgctttcctggaggcggaggaggcgccgccgaccgtcaatccgagcctgtggcggcaggcgaagctgaacatgcatcacggcctgttcgaggtcgtccccggcgtctaccaggtgcgcgggctcgacatcgccaacatgacgctgatcgagggcgataccggcgtgatcgtcgtggatacgctgacctccatcgagggcgcgcgtgccgcgctcgagctctatcatcagcaccgcggcaccaggccggtgacggcggtgatgttcacgcatacccacaccgatcattggggcggcgcgcgcggcgtcgtcgatgaggacgcggtgaccggcggccgcgtgccgctgatcgcgccgaacctgttcatagagcatgcggtgtccgagaacatcatcgcagggcccgcgatgctgcgccgggcgcagtatcagttcgggccgctgctggcgaaagggccgaagggccacgtcgattgcggtctcggcaagacaatggctgcgggaagcgtcgcgctgctgcggccgaccgacctgatcatggcaaccggcgacacccggaccatcgacggcgtgaccttcgaattccagatggcgccgaacagcgaggcgccggccgagatgcatttctatgtgccgcgctacaggctgttgaacctcgccgagaactgcacgcataatttccacaatctgctgccgttccgcggcgccgatgtgcgcgatgcgctggcctggtcgaaatatctcggcgaggcgctgcaattgtggggcggcaaggcggaggtgatgtgcggccagcatcactggccggcgtggggcgcgagtcgcgtcgacagcatgatccgcgagcagcgcgacctctacaagttcgcgcacgatcagaccttgcggctgatgaatcatggcctgaccgccagcgagatcgccgagcagatcaggctgccgaagagcctcgaaggtgcctggcatgcgcgcggctattacggacatatccggcacaatgtgaaggcgatctatcagaaatatctcggctggtacgacgccaatccggtcaatctcgatccgctgccgccggtcgaggccggacgcaaatatgtcgagtacatggggggcgcggaggcgttgctggcgcgggcgcgcgcggatttcgccaggggcgagctccgcttcgtcgcgcaggccgtcggtcacctcgtgttcgccgagcccgacaatgtcgaggctcgtatgttgctcgccgatacgctggagcaactcggctacgccgcggagagtgcgacctggcgcaacgcctatctgttcggcgcgcaggagcttcgccacggcatgccggaggttccggcgcgcccgggcatgccgcgcgagaccttggcggcgctgcgcaccgagcagttgtgggacgtgctcggcgtccgcctgaacgggccgaaagcggagggcaagcatatcgtgctgaactggaccttcaccgacaccggcgagcgcttcgtgctgacgctacagaactgtgcgctcacctacgcggtcggcgttcaggcctccacggccgacgccggcttcaccctggcgcgcgcgacactcgacgagatcatcgccaaggcaacgacctttccggaggccgtcgccgccggaaagatcagctttgccggcaacccgatgcggctcgccgagctgatgtcgttgatggacgaattcccgcgcatgttcgagatcgtcgagccgaaacgcgccaggatgacgtag

SEQ ID NO: 12940 - protein, 621 aa, Bradyrhizobium sp. ORS278
MLAALPFDDTTDFDDAARGFLGTIDQAKVTTSQGRSVWSLEPYAFLEAEEAPPTVNPSLWRQAKLNMHHGLFEVVPGVYQVRGLDIANMTLIEGDTGVIVVDTLTSIEGARAALELYHQHRGTRPVTAVMFTHTHTDHWGGARGVVDEDAVTGGRVPLIAPNLFIEHAVSENIIAGPAMLRRAQYQFGPLLAKGPKGHVDCGLGKTMAAGSVALLRPTDLIMATGDTRTIDGVTFEFQMAPNSEAPAEMHFYVPRYRLLNLAENCTHNFHNLLPFRGADVRDALAWSKYLGEALQLWGGKAEVMCGQHHWPAWGASRVDSMIREQRDLYKFAHDQTLRLMNHGLTASEIAEQIRLPKSLEGAWHARGYYGHIRHNVKAIYQKYLGWYDANPVNLDPLPPVEAGRKYVEYMGGAEALLARARADFARGELRFVAQAVGHLVFAEPDNVEARMLLADTLEQLGYAAESATWRNAYLFGAQELRHGMPEVPARPGMPRETLAALRTEQLWDVLGVRLNGPKAEGKHIVLNWTFTDTGERFVLTLQNCALTYAVGVQASTADAGFTLARATLDEIIAKATTFPEAVAAGKISFAGNPMRLAELMSLMDEFPRMFEIVEPKRARMT

SEQ ID NO: 12941 - DNA, 1902 bp, Listeria monocytogenes str. 4b F2365
  CDS (1)..(1902): transl_table=11
atgacaaaaaaagtcttaccaaaagaagcgtctgaatttacaaagaaagtgaatgagaaagtaaaaaaagctttaccatttgagaacacgaaagattttgaagatgcaaagaaaggctttattggcacttgggatcatgtaaaagttgatacggaagatggccatgcagtttgggatttggatgattataagtttatcgaaggagaagcacctgattctgttaacccaagtttgtggcgtatcgctcaacttaatatgacaaatggtttattcaaagtaacggaccgggtttatcaagtacgcggctttgatatgtcgaatacgacgattatggaaggcgatactggccttgtcattacagatacattaatgtcggttgaaactgcccgtgcggcgcttgaattatactttgagcatcgtccgaaaaaacctattaaggcgattatttatacgcattcccatgccgatcattacggcggtgtagcgggtctaattagcaaagaagatgtaacctctggaaaagtggcacttattggacctgaaggctttatggaagcggcggtcagcgaaaatatttttgctggaaatgcaatgattcgtcgtgcggaatttatgtatggtagccgtttgtcacgcggggaattaggtcaagtggatgcaggacttggtaaaacagcgtccaaaggccacatgtccttacttgctccaaatgatactattacgtttgatcatgaaaaacgcgtggttgatgggattgaagtggaattcttaatggcgccgaatacagaagctccatcagaacatatgatgtatttcccgcaatttaaactacttaatattgcagaagatgctgttcataacttgcataacattttaacattacgtggtgcgcaaattcgtgacgcttacgagtggtggaaagatattgacaaagcgattcgtgcgtttggtgataaatatgaagtttgtatcggtcaacatcactggccaacgtggggtaatgaagagattaatgacatgcttattcaccaacgtgacgcttataaatatatgcatgaccaaacgcttcattttattaataaaggattaactgccattgaagtggctgaagctgtgaaattccctcctgaactagaagaaaaatggtatttacgaggatactacggcacgcttaaccatgatgttaaagcgatttatcaattttatcttggttggtataacggaaatcctgctgacctttatccgctacctccagaagatgtggcgaaaaaatacgtcgagttcatgggtggcgttgatgaagtagtgaaaaaagcgcgtgtatcctatgaagcgggtgaatatcgctgggttgcggaagttgtcaaacatgcggttttcgcagacggagaaaacggagaagcaagagctcttcttgcagatgcgttagaacaacttggctatcaatctgagtccggaccatggcgtaatgtatttttagccggagcagacgaactgagaaattctgtcccagatgaagttatttctggtgttacactggatattgtagaaggtatgccgtttaacttgattttagattacatgggtattcgtttaaatggggaaagatccatcggtaaacgtatctccatgaactggaaattaacagatgttgatgagaattatcatttacttgtaaataattccgtacttatttatcgtgaaggtgaagtagacgataaagctgatttaactttaactactactcgtgatacatttaatcatattttcggtggtgtgaaaagctttgaagcagcatttgctgaccaaacagctaaattagaaggagacgcgaagaaatttggggagtttgcttccttgttagatgaatttaatcctgtcttcaatattgttacaccttaa

SEQ ID NO: 12942 - protein, 633 aa, Listeria monocytogenes str. 4b F2365
MTKKVLPKEASEFTKKVNEKVKKALPFENTKDFEDAKKGFIGTWDHVKVDTEDGHAVWDLDDYKFIEGEAPDSVNPSLWRIAQLNMTNGLFKVTDRVYQVRGFDMSNTTIMEGDTGLVITDTLMSVETARAALELYFEHRPKKPIKAIIYTHSHADHYGGVAGLISKEDVTSGKVALIGPEGFMEAAVSENIFAGNAMIRRAEFMYGSRLSRGELGQVDAGLGKTASKGHMSLLAPNDTITFDHEKRVVDGIEVEFLMAPNTEAPSEHMMYFPQFKLLNIAEDAVHNLHNILTLRGAQIRDAYEWWKDIDKAIRAFGDKYEVCIGQHHWPTWGNEEINDMLIHQRDAYKYMHDQTLHFINKGLTAIEVAEAVKFPPELEEKWYLRGYYGTLNHDVKAIYQFYLGWYNGNPADLYPLPPEDVAKKYVEFMGGVDEVVKKARVSYEAGEYRWVAEVVKHAVFADGENGEARALLADALEQLGYQSESGPWRNVFLAGADELRNSVPDEVISGVTLDIVEGMPFNLILDYMGIRLNGERSIGKRISMNWKLTDVDENYHLLVNNSVLIYREGEVDDKADLTLTTTRDTFNHIFGGVKSFEAAFADQTAKLEGDAKKFGEFASLLDEFNPVFNIVTP

SEQ ID NO: 12943 - DNA, 2061 bp, Silicibacter pomeroyi DSS-3
  CDS (1)..(2061): transl_table=11
ttgaaaaacttactggccaatttgaccgcaaccgccgtcatagcagcgtctgcgtcagtggcgctgtcgcaagaggcgtctcacttcgacccgaagggcaagcctccatcacaggaaacaatcgcaattatcgaggcgttgcgcgggtctctgcctttcgaagatgagcgcgactttgaggaagcccgaaaggggttcatcgcgaagccagattttacccagatcatggccgaaaaaggaaacgtggcctgggacatcgggagctacgattttcttctgcagggcgaggatttcgacacgatccacccgtcgcttcagcggcaggccgttctgaacatgtcttatggcctctatgaggtgatgcctgaccgcatttatcaggtgcgcggcttcgaccttgccaacttcaccgtggtcaagggtgacaccggctggatcgttttcgacccgttgactgcgaaggagaccgcggcggccgccctcaagctcgtgaacgatacgctgggtgaaaggccagtgaccggtgtggtctactcgcacagccacgccgatcatttcggcggtgtgcgcggggtggtggcagaagacgatgtgcgcgagggcctcgttcccatcatcgcaccggttggcttcatggatcacgcggtggcggaaaatgtctatgccggcaatgcgatgaaccggcgccttttctatcaatatggcgtcctgttgccgcgtagcccgttcgggcacgtggatcagtccatcggcaaaaacacggcagccggcaatctggggctgatcgctccgacggtggtcatcgaagacgacatcaaggaacttacggtcgacggcgtgcgaatggtgttccagaacacgcccgggaccgaagcgccggccgaaatgaatacctacttcccggatttcaaggcgttctgggcagctgaaaacatcaccggtaccatccacaatatctacacgttgcggggcgccctggtccgggatgcgctcgaatggtcacgtcagatcaacgccgcgctttatctgttcgggcaggatgcggaggtcatgtttgcatcccactcctggccgcggtgggggaacgagcgcatccaggaagtcatgcgcgcacagagggatacatatgcaaacctcaacaatggcgtgcttcatcttgccaaccagggcgtaacgatcaacgagatgcacaacgagtacagcgtgcccgaaagcctgcaacaacagtggtcggcccgaagctatcacgggtcggtcgagcacaacagccgcgcggtgatcaaccgttatcttggctattgggacgcaaatccggccacgctgattccgctgtcgccgtcggagtctgcgccgttattcgtcgagatgatgggcggcgcgggtccgatcatggcacgtggccaggacctttacgattccggcaagtacaagcttgcgcaagaaattctgaacaagctggtctatgccgaaccggaaaaccaggaagcaaaggatcttctcgcggacgtcttcgagcagatcggttaccagcaggaaagccccagtgtccggaattcgttccttgcgggtgcgtatgaacttcgcaacggcattccgtccggtgcgtcaccgaaatcctccgggccggacatggtccgggctatggatacctatctctggctcgatttccttggcgtgcgactggacagtgcaaaggcgggcgaccggtcgttcacgatcaacatgatcacgccggacaatggagaaaagttcgtgatcgagctttccaatggaactctgaccaatcttcaaggctatcttgcggatgaccctgacctgacgatggttctgaaccgatccgatcttgaaccggtgatgatggggatggcgacgatcgaggatcagatcgcagctggaaaggtcgcacttgccggagacaccggtatcattgacgagttgaaagcgatgcttgttcagtttgatcttggcttcgagatcctaccgggaacaggcgagcaagatctcacgcctgaagcaaatgcctttcaacagcctgagccggcggacacatctggcggttaa

SEQ ID NO: 12944 - protein, 686 aa, Silicibacter pomeroyi DSS-3
MKNLLANLTATAVIAASASVALSQEASHFDPKGKPPSQETIAIIEALRGSLPFEDERDFEEARKGFIAKPDFTQIMAEKGNVAWDIGSYDFLLQGEDFDTIHPSLQRQAVLNMSYGLYEVMPDRIYQVRGFDLANFTVVKGDTGWIVFDPLTAKETAAAALKLVNDTLGERPVTGVVYSHSHADHFGGVRGVVAEDDVREGLVPIIAPVGFMDHAVAENVYAGNAMNRRLFYQYGVLLPRSPFGHVDQSIGKNTAAGNLGLIAPTVVIEDDIKELTVDGVRMVFQNTPGTEAPAEMNTYFPDFKAFWAAENITGTIHNIYTLRGALVRDALEWSRQINAALYLFGQDAEVMFASHSWPRWGNERIQEVMRAQRDTYANLNNGVLHLANQGVTINEMHNEYSVPESLQQQWSARSYHGSVEHNSRAVINRYLGYWDANPATLIPLSPSESAPLFVEMMGGAGPIMARGQDLYDSGKYKLAQEILNKLVYAEPENQEAKDLLADVFEQIGYQQESPSVRNSFLAGAYELRNGIPSGASPKSSGPDMVRAMDTYLWLDFLGVRLDSAKAGDRSFTINMITPDNGEKFVIELSNGTLTNLQGYLADDPDLTMVLNRSDLEPVMMGMATIEDQIAAGKVALAGDTGIIDELKAMLVQFDLGFEILPGTGEQDLTPEANAFQQPEPADTSGG

SEQ ID NO: 12945 - DNA, 2043 bp, Colwellia psychrerythraea 34H
  CDS (1)..(2043): transl_table=11
atgattagaaaattagtttgtataacaatgacttccgtctttattagtggaacgttttccaccgcctttgccgcaagcagtagcggagaaataaaaacaagcgatccaagtaagcattttgatgtaaaaggtaaaatgccatcaaaattcaccattgaattacaagagggacagcgtaaaagtctaccctttgaagacaaacgtgattttgaagaagcaaaaagaggctttattgctgcgccaaaatataaacagattatggcagaagctggtcacgtagcatgggacatgggaagttatgagtttctacttaaagagggccagaacttcgacagcatgcacccttcactacagcgtcaagctacgcttaatatggcctatggcttgtatgaagtattgcctgggaaaatataccaagtacgtggttatgatctagccaatattagttttattaaaggtgataccggctggattatttttgatccactaacgactaaagaaacggcttcagccgcgcttaaattcattaatgaacaacttggcgaaagacctgttgttgccgttgtttattctcactctcatggagaccattttggtggcgctcgtggtgttgttgatgaagccgatgttaaaagcggtaaggtaaaagttattgcatcaacaggttttatgcatcatgcagtttccgagaacgtaatggccggtaatgccatgactcgacgattattctttcaatatggtgctcttctgccccgcagtccatttggtcatgttgatcaatccattggtaaaaacattgcaagcggcaatgctggcttgcttgcgccgaatgtcattattgaaaaagactttgagaccatgaccgttgatggtatcaaaatggtcttccaaaatacccctggcaccgaagcaccagccgaaatgaatacctggttcccagagatgaaagcgttctgggcagccgaaaacatcacaggcaccattcataatatttatactctacgtggggcattagtgcgtgatgcactggaatggtcaaaacaaatcaatgtagcactatacaagtttggccaagatgctgatgttatgtttgcatcacacagttggccacgctggggaaatgagcgtattcaggaagttatgcgtacccaacgtgatacttatgcccacctaaataaccaagttttgcatttggctaacgaaggtgtaacggttaaccaagttcacaatgtttataaattgcctgatagcttacgtaaccaatggtcagcacatagctaccatggctctgaagaacataatagccgtgcggttattaaccgttacttaggctattgggatgctaatcctgcgacattgatgcctttgtctcctgaagactcatctcccttgtatgttgaaatgatgggtggtgctaagaaaataatgaagaaaggtaaagagctgcatgatcaggggaaatattttcacgccatcgaaattctaaataagttagtttatgccgaacctaacaaccagcctgcaaaagatttactggccgacgtatatgaacaaataggttatcaaaaagagagcccgagcgttcgcaacagcttcctagctgcagcttacgaattacgccatggtatgccaagcggtgcatccccctcagcggctggacctgatgtaattcgtggtatgtctaccgcgttatggttggactttttagccgtacgtttagacgttagtaaaacggaaggtaagcatttcaccattaactttgttactccagataatgatgagaaatacttggttgaactcagcaattctgctctaaccaatattgaaggtattcagtcgccaaaagctgacctaaccataaccatgaatcgcactgaacttaatgatgtgatgatgggcatggcaacccttgatgataaaattaaggcaggtaaagcaaagttaaaaggcaataaaaagccttatgacgaactgaaaaacatgttgactactttcagtatagattttgaattgatacctggcaccttgcctagtgctaaatag

SEQ ID NO: 12946 - protein, 680 aa, Colwellia psychrerythraea 34H
MIRKLVCITMTSVFISGTFSTAFAASSSGEIKTSDPSKHFDVKGKMPSKFTIELQEGQRKSLPFEDKRDFEEAKRGFIAAPKYKQIMAEAGHVAWDMGSYEFLLKEGQNFDSMHPSLQRQATLNMAYGLYEVLPGKIYQVRGYDLANISFIKGDTGWIIFDPLTTKETASAALKFINEQLGERPVVAVVYSHSHGDHFGGARGVVDEADVKSGKVKVIASTGFMHHAVSENVMAGNAMTRRLFFQYGALLPRSPFGHVDQSIGKNIASGNAGLLAPNVIIEKDFETMTVDGIKMVFQNTPGTEAPAEMNTWFPEMKAFWAAENITGTIHNIYTLRGALVRDALEWSKQINVALYKFGQDADVMFASHSWPRWGNERIQEVMRTQRDTYAHLNNQVLHLANEGVTVNQVHNVYKLPDSLRNQWSAHSYHGSEEHNSRAVINRYLGYWDANPATLMPLSPEDSSPLYVEMMGGAKKIMKKGKELHDQGKYFHAIEILNKLVYAEPNNQPAKDLLADVYEQIGYQKESPSVRNSFLAAAYELRHGMPSGASPSAAGPDVIRGMSTALWLDFLAVRLDVSKTEGKHFTINFVTPDNDEKYLVELSNSALTNIEGIQSPKADLTITMNRTELNDVMMGMATLDDKIKAGKAKLKGNKKPYDELKNMLTTFSIDFELIPGTLPSAK

SEQ ID NO: 12947 - DNA, 1962 bp, Ralstonia eutropha JMP134
  CDS (1)..(1962): transl_table=11
atgatttatcgatacgcagcgctcgctgctgctgccatgtgcctgttggggccggtacacgcggccgaaggtccgaaggcggcgacggctgccacagcaaaggccaacgccgcggtcctgcagcagttgccgtttgccaaccggcaggatttcgaggatgcgcagcgcggcttcctcggtacgctggacagcaacgaaatccgcgatgcgcaggggcgcgtggtctggtcgcttgatacgtacgcatttctgcgcgatgccagagcaccggacacggtcaacccgagcctgtggcgtcaggcccagctcaacatgaacaacggcttgttccgggtcactgaccgcatttaccaggtgcgcggactcgacatctcgaacatgacgatcatcgagggcgataccgggctgatcatcatcgacccgcttacctcgaaggaaacggcgcacgcggcgctggatctttactacaagcatcgaccgaagaagcccgtggcggcagtgatctacacccatagccatggtgaccacttcgggggcgtgaagggcgtgaccaccgacgaggaggtgaaggctggccgcgtgaaggtgctggcacctgaaggtttcatggaggaggcagtcagcgagaacgtcttcgcgggcaatgcaatggggcgccgcgcgcagtacatgtacggtgtcaacctgccgagggcggccaacggccatgtcgactcgggcctgggcaaagcggtgtcccgcggcaccatcacgctgatcgcgccgaccgacctgatcgcgaagaccggagagacgcgcacgatcgacggcgtgcagatcgagttcctgatggcgcccggcaccgaggcgccggccgagatgctgatgtacttcccgcagtggaaggcgctgtgcacggccgaggacgctacccacaacatgcataacctgtacaccatccgcggcgcacaggtgcgcgacgccaaccagtggtggcgcgcgctggacgagaccatcgaccgcttcggcggccgtaccgaggtcctgttcgcgcagcaccactggccgaagtggggccagcagaacatcgtgacgtacctgggcaaccagcgtgatggctacaagtacatccacgaccagtcgctgcgcctggccaaccagggcttcacgccggccgagatcggcgagcgcgtgaagctgccaccgtcgctggcgagccagtgggacctgcgtgactactacggcacggtgaaccacaacgccaaggcggtctaccagcgctacctcggctggtatgacgccaatccggccaacctctatccgcttccgcccgaagaatcggcccggcactatgttcagttcatgggcggggccgacaaggtgatcgaacaggcgagggcttcatttgcgcgtggcgagtaccgctgggtggccgaagtcatgaagcaggtcgtgtttgcggacccgtccaaccaggtggcgcgcaatctcgaagcggacgccctcgagcagcttggctaccagaccgaatcggccacgtggcgcagcgctttcctgagcggtgcgcaggaactgcgcaatggcctatcgaaggattcaggcgcgcgcacctccagccccgatgtgctgaatgccatgaccgacaccatgctgctggattacctggcgatccgcctgaatggcgagcgcgcggcgggccagaagctcgccatcaactgggtccagcccgatacggccaagcgctacgcactgactgtggataacggcgtgttccggtacaaggccgatgcccagcaccagaacccgcaggtgacgctgagcatccctcgcatggcgctgatgggggtgcttgccggccagaccacgctgtcggccgaggtgcaagccggacgcgcgcgtgtcgacggcgatgccggcgcgctgcgcacgtgggtggggctgatggacaagttcgacaccaacttcgccatcgtgacgccctga

SEQ ID NO: 12948 - protein, 653 aa, Ralstonia eutropha JMP134
MIYRYAALAAAAMCLLGPVHAAEGPKAATAATAKANAAVLQQLPFANRQDFEDAQRGFLGTLDSNEIRDAQGRVVWSLDTYAFLRDARAPDTVNPSLWRQAQLNMNNGLFRVTDRIYQVRGLDISNMTIIEGDTGLIIIDPLTSKETAHAALDLYYKHRPKKPVAAVIYTHSHGDHFGGVKGVTTDEEVKAGRVKVLAPEGFMEEAVSENVFAGNAMGRRAQYMYGVNLPRAANGHVDSGLGKAVSRGTITLIAPTDLIAKTGETRTIDGVQIEFLMAPGTEAPAEMLMYFPQWKALCTAEDATHNMHNLYTIRGAQVRDANQWWRALDETIDRFGGRTEVLFAQHHWPKWGQQNIVTYLGNQRDGYKYIHDQSLRLANQGFTPAEIGERVKLPPSLASQWDLRDYYGTVNHNAKAVYQRYLGWYDANPANLYPLPPEESARHYVQFMGGADKVIEQARASFARGEYRWVAEVMKQVVFADPSNQVARNLEADALEQLGYQTESATWRSAFLSGAQELRNGLSKDSGARTSSPDVLNAMTDTMLLDYLAIRLNGERAAGQKLAINWVQPDTAKRYALTVDNGVFRYKADAQHQNPQVTLSIPRMALMGVLAGQTTLSAEVQAGRARVDGDAGALRTWVGLMDKFDTNFAIVTP

SEQ ID NO: 12949 - DNA, 1968 bp, Pseudomonas fluorescens PfO-1
  CDS (1)..(1968): transl_table=11
atgaaaccgaccctctacacgatccttgccctgacgctggtgtccctcgccggctgcgacaacaagcccagcgtcgcagccggcgacgccacgcccgccacggccgcggtgatccaggcgtcgatcaagggcctggacctcagcgacaaccgtgacatggaagatgcccagcgcggtttcatcgcccggcccaccggcaagatccttggcgctgacggcaatgtcctgatcgatttcgatgcgtaccgcttcgtcgaaggccaggcgccgaccaccgtcaacccgagcctgtggcgacacgcgatgctcaacgcacagatcggcctgttcaaggtccgcgagggcatttaccagttgcgtggtttcgacatcgccaacatgacgctgatcgacgggcaaaccggctggatcgtggtcgacccgctgacctcccgggaatccgccgccgcagcgctggccttcgctcgcgagcatctgggcaacaagcctgtcaccgcgatcattttcacccacgaccatgccgaccatttcggcggtgtgctgggcatcacttcggccagcgaagtggcccagcgcaacattcccatcgtcgcgcccgccgggttcatggaggaagccaccagcgaaaacattctggcggggccggcgatggcgcggcgttcgatgtatcagttcggcaagaacctgacgccgggcgccaccggcattgtcgacaccgggctgggcaagaacgttgcgtacggcagcatgggcatcctgccgccaacgcagatcatcgaccagccgatccagccgctggtgctcgacggcgtcagcttcgtgttccacaacatgcccggcgcggaggccccggccgagctgaccttttcgatccccgcgctcaaggcatacggcggtgcggagctgctgacgcagaccatgcacaacctgctgccgatccgtggcgccaaggtccgcgatgcgctgcgctggtccgactacatgcaaatcgccctcgacgagctgggcgacaccgaggtctatttcggtcagcacaactggccgatctggggcaacgagcggatccgcgaattcatcaccaaacaccgcgacgtctacaaatacctgcacgaccagaccgtgcgcctgatgaacgccggctacacccccaacgagatcgccgacaagatccagctgccggattcgctggcctcgtacttcggcactcgcggctattacggcgacctgcgccacaacgtcaaggcgatctaccagctgtacctgggcgcctacgacggcaaccccgcgcacttgaatccgctggtgcccaaggagtcggcaaagcgctacgtcgaattgatgggaggtaacgccaaggtggtcgaagccgcgcgcgtggcctatgacaagggcgaatatcgctgggtcgccgagctcctggatcaggccgtgctggccaaacccgacgacaccgccgccaaggaactgctggcccgcgcgtacgaacagatgggctatcaggcggaatcggcaacctggcgcaacagttacctgaccgctgccatggagctgcgcaacggccccccggccaagggcgtcaaacgctccgacctgatcgaactgatgaagcagacgcccaccgaacgcttcctcgaagccatggccgcgagcctcgacgggccggcggcggatggcaagaactggaccttcaatctggtgctgaccgatacgaatgaatcgttcgtgctgtggatcgagaacgccgtgctgcactaccgaaaaggcccgacggcggcgaacgccaacgcaacgctgagtgtcaccaaggacctgttcgtccaactgctgggcggcaccgccgggctgaaggaggcattcacctccgatgatctgaaggtggatggcagcaaggtcgatctcgtgagatttctggggctgttggaaaaggcgccggggaattttgcgatagtcgcccgggcaggaaactga

SEQ ID NO: 12950 - protein, 655 aa, Pseudomonas fluorescens PfO-1
MKPTLYTILALTLVSLAGCDNKPSVAAGDATPATAAVIQASIKGLDLSDNRDMEDAQRGFIARPTGKILGADGNVLIDFDAYRFVEGQAPTTVNPSLWRHAMLNAQIGLFKVREGIYQLRGFDIANMTLIDGQTGWIVVDPLTSRESAAAALAFAREHLGNKPVTAIIFTHDHADHFGGVLGITSASEVAQRNIPIVAPAGFMEEATSENILAGPAMARRSMYQFGKNLTPGATGIVDTGLGKNVAYGSMGILPPTQIIDQPIQPLVLDGVSFVFHNMPGAEAPAELTFSIPALKAYGGAELLTQTMHNLLPIRGAKVRDALRWSDYMQIALDELGDTEVYFGQHNWPIWGNERIREFITKHRDVYKYLHDQTVRLMNAGYTPNEIADKIQLPDSLASYFGTRGYYGDLRHNVKAIYQLYLGAYDGNPAHLNPLVPKESAKRYVELMGGNAKVVEAARVAYDKGEYRWVAELLDQAVLAKPDDTAAKELLARAYEQMGYQAESATWRNSYLTAAMELRNGPPAKGVKRSDLIELMKQTPTERFLEAMAASLDGPAADGKNWTFNLVLTDTNESFVLWIENAVLHYRKGPTAANANATLSVTKDLFVQLLGGTAGLKEAFTSDDLKVDGSKVDLVRFLGLLEKAPGNFAIVARAGN

SEQ ID NO: 12951 - DNA, 1938 bp, Novosphingobium aromaticivorans DSM 12444
  CDS (1)..(1938): transl_table=11
atgcctgaacttcacgtccgccacgccttgctggcagccgccgccttgctcgccgcgccgcagcaggtttccgccgaggcaccaacagacgcgacccgcaaggccaacgccgccgcgcttgcggacctgcccatggccgaccgacaggacttcgacttcgcccagcggggtttcgtggccacactgaacgacccggtgatccgcgatgcagccggcaatccggtgtgggacaccaccgccctgtcctttgcccgcggcgaggctcccgccacagtcaatcccagcctctggcgacacgcacaggtgctcggcaaggcgggcctgttcaaggttacggaccggatctggcaggtccgcggtttcgacgtcgcgaacgtcaccttcgtgcgcggagacaagggctggatcgtgatcgatcccctgaccgccactgaaaccgcggccgccgcctatcgcctcatctccgaaaaggtggcgaagctgccggtcacggcgatgatctacacccacagccacgtcgatcacttcggcggcgcgggcgcattcgcgcaggtcctcgaaaaggacgccccgatcctcgcgccgcagggcttcacccgcgctgccgtcagcgagaacgtgatcgccggccctgccatgggacgccgcgccggctaccagttcggcatcggcctgcccaaggggcctgaaggctcgctcggctcaggcatcggcatgggcgttgcggcgggcggtcgcagcctggttccgccaacgcgcgagattgccgaaaccggcaccgaactggtgctcgatggcgtgcgcatccgttttcaggtgaccccggggaccgaggcgccggccgaaatgaacttcggcttccccgactggaaggtcgccgacctggccgagaacgccaacgcctcgcagcacaacattctcaccccgcgcggcgcggtgatccgcgatgccaaggcctgggcgcaaggcctgaccgaggcgatcgacttcttcggcggatcggaagtgctcatcaccagccacggctggccccgcttcggcgccggcgcgatcgcggactacctggccaagcatcgcgatgcctatgcctatcttcacgaccagaccgtgcggctgatgaacaagggcctgaccggccccgaaatcgccgcgaagctgaccctgccgcccgccctcgcgcgggaatggtacgaccggccctactacggctcctacagcttcaattcgcgggcggtctatcagttctacatgggctggtacgacggcaaccccgcgcacctcgccccccttccccccgaggaaggcggcaagcgttatgtcgaggcgatgggcggaagcgccagggtgcgcgcggtggcgcaggaagcctttgcgaaaggcgactatgcctgggccgccgaactgctcaaccgcgcggtctttgccgatggcgccgacgcggatgcgaaggcgcttctcgcccgaacctatcgccagctcgcctaccagagcgagaacgccctgtggcgcaacatgtacctgaccggcgccggggaactcgagaacggcgtcgccgcacaggacccgaccggcggcgccagcctcgtcagccaattgccgccgaccgacctgttcgacgtgctcgccgtcaggatcgaccccgcgaaagtgggcgatggcaaggtgtcgctcggcttcgtctttcccgacaaggcgcagcagcacacggtaacggtcgcgaacggcgtcctcgtccaccgtccgggcctgcgcgacggacggcaggcgacgctgaccgtgcgctacgccgaccttctggccgcgctgttcgcgggcaagccgctcgcggcgaagattgcctcgggcgaggccacgatcgaaggcgatccggcagtcttcgcccgcctaaccggctggctcgacaagccggaccccactttcgcgatcgtcacgccctga

SEQ ID NO: 12952 - protein, 645 aa, Novosphingobium aromaticivorans DSM 12444
MPELHVRHALLAAAALLAAPQQVSAEAPTDATRKANAAALADLPMADRQDFDFAQRGFVATLNDPVIRDAAGNPVWDTTALSFARGEAPATVNPSLWRHAQVLGKAGLFKVTDRIWQVRGFDVANVTFVRGDKGWIVIDPLTATETAAAAYRLISEKVAKLPVTAMIYTHSHVDHFGGAGAFAQVLEKDAPILAPQGFTRAAVSENVIAGPAMGRRAGYQFGIGLPKGPEGSLGSGIGMGVAAGGRSLVPPTREIAETGTELVLDGVRIRFQVTPGTEAPAEMNFGFPDWKVADLAENANASQHNILTPRGAVIRDAKAWAQGLTEAIDFFGGSEVLITSHGWPRFGAGAIADYLAKHRDAYAYLHDQTVRLMNKGLTGPEIAAKLTLPPALAREWYDRPYYGSYSFNSRAVYQFYMGWYDGNPAHLAPLPPEEGGKRYVEAMGGSARVRAVAQEAFAKGDYAWAAELLNRAVFADGADADAKALLARTYRQLAYQSENALWRNMYLTGAGELENGVAAQDPTGGASLVSQLPPTDLFDVLAVRIDPAKVGDGKVSLGFVFPDKAQQHTVTVANGVLVHRPGLRDGRQATLTVRYADLLAALFAGKPLAAKIASGEATIEGDPAVFARLTGWLDKPDPTFAIVTP

SEQ ID NO: 12953 - DNA, 1974 bp, Ralstonia metallidurans CH34
  CDS (1)..(1974): transl_table=11
atgcgcattgcccgcttgaccgcccttgcttccgccgcgctgacgatgtccgtcgcactcgccggcccgaatcccgctactccgctgaccgagcaatcgaacgccgcatggctgcgcaagctgccgttcgccgaccgtgccgacttcgaagatgccaagcgcgggctcgtggcgcgcttccccgagccgacgatcaagagcgccgacggcaagacagcgtgggacttcggcgcgtatgccttcgaatcggcggcggacgccccgcccaccgttaacccgagcctctggcgactggcgcaactgaataacgaagctggcctgttcaaggtggctgaccgcgtctatcaggtgcgcggcgccgacctggcaaacatgaacatcgtcgaaggcgacaccggcctgatcatcatcgataccttgctcacggcggaaaccgcccgggccgcgctcgacctttattacgcgcaccgtccgcgcaaacccgtgctggccgtgatctatacgcacagccacgccgatcatttcggcggggtacgtggcatcgtcagcgaggacgacgtgaaatccggcaaggtcgagatcctggcgccgaatggcttcatggacgaagccgtcagcgaaaatgtgctggcaggcggcgcgatgggccgacgggcgcagtacatgtacggcaccaacctgccgaagaacgccacgggccaggtcgataccggcctgggcaaagccactgcgcgcggcaccatcacgctgctggcgcccacgtcgtcgatcaccaagccgatcgagacgcgccggatcgacggcatcgacttcgaattccagctcaccccgggcaccgaggcgccggcggagatgaacatctatctgccgcagttccgcacgctttgcatcgccgaaaacgcggtgcgcacccagcacaacctgctgacgctgcgcggcgcgcaggtgcgcgacgccaaggcatggtcttacttcctgagccaatcgctattgcgctacggcgatcggaccgatgtgctgatcggccagcatcactggcccacctggggccacgcacgcatcgtcgagatgctgtccgaccagcgcgacatgtacgcctacctgaacgaccagaccctgcggctgctgaaccagggcctgaccccgctcgagatcgccgacacgctcaaaacgctgcccgagccactggccagcaagtggtatgcacgggactactacggatcggtcagccataacgtacgcgcggtctaccagcgctacctgggcttctacgatggcaacccggcgcacctgaacccgctgccgcccgagcaaacggccaggaagaccatcgaatggatgggcggcgccgatgccgtgctggccaaggcccgcgaggcctatgcacatggcgactaccgctgggtggcgcagatcggcaatgacctggtcttcgccgatccatcgaacgccgcggcgcgcgcgctgcaggccgatgcgctggaacagcttggctaccagagcgagaacgccacgtggcgcaacatctacctgaccggcgctcaggaacttcgcgatggcgtgcccaagctgcagggcagctcgctcggctcggccgatctcgtgcgcgcgctgacggtgccgaacttcttcgactatctggccgtgcgcctgaacgcggacaaggccgccggcaaggccatgacgctgaactggcagttcacggacctgaaccagcgctacgcgatgacgctgcgcaacagcgcgctgacctacgtggccgatgcccagcacgcgcagccgaccgccacggtcacgctgaccaaggccacgctcgacaagatcagcctgaagcagctcaccctgccgcaggccatgcagtcgggcgcgatccgcatcgatggcaacccgcaggccgtggcgggcctgttcgccatgctcgacacgttcgacccggccttcaatatcgtcacgccgcacggataccagaagtaa

SEQ ID NO: 12954 - protein, 657 aa, Ralstonia metallidurans CH34
MRIARLTALASAALTMSVALAGPNPATPLTEQSNAAWLRKLPFADRADFEDAKRGLVARFPEPTIKSADGKTAWDFGAYAFESAADAPPTVNPSLWRLAQLNNEAGLFKVADRVYQVRGADLANMNIVEGDTGLIIIDTLLTAETARAALDLYYAHRPRKPVLAVIYTHSHADHFGGVRGIVSEDDVKSGKVEILAPNGFMDEAVSENVLAGGAMGRRAQYMYGTNLPKNATGQVDTGLGKATARGTITLLAPTSSITKPIETRRIDGIDFEFQLTPGTEAPAEMNIYLPQFRTLCIAENAVRTQHNLLTLRGAQVRDAKAWSYFLSQSLLRYGDRTDVLIGQHHWPTWGHARIVEMLSDQRDMYAYLNDQTLRLLNQGLTPLEIADTLKTLPEPLASKWYARDYYGSVSHNVRAVYQRYLGFYDGNPAHLNPLPPEQTARKTIEWMGGADAVLAKAREAYAHGDYRWVAQIGNDLVFADPSNAAARALQADALEQLGYQSENATWRNIYLTGAQELRDGVPKLQGSSLGSADLVRALTVPNFFDYLAVRLNADKAAGKAMTLNWQFTDLNQRYAMTLRNSALTYVADAQHAQPTATVTLTKATLDKISLKQLTLPQAMQSGAIRIDGNPQAVAGLFAMLDTFDPAFNIVTPHGYQK

SEQ ID NO: 12955 - DNA, 1983 bp, Ralstonia metallidurans CH34
  CDS (1)..(1983): transl_table=11
atgaagaacagccgatttcgcgcgagcgtcgtgacgctcgtctccgccgcggtgctctcccagttcggcgcggcctatgcccaggacgcgcggaaggacgccactagcgcgacaaaggccgccaaccagaagctcctcagcgaattgcctttctcggatcgttccgatttcgatgacgcgcaccgcggctttgtcgcaccactgccgaacacggtgatcaaggggtcgtcgggtaacgccatctggaacccgaaccagtacgcctttatcaaggaaggttcccaggcaccgggcacggtcaacccgagcctctggcgtcaggctcaactgatcaacatcagcggcctgttccaggtgaccgatggcatctatcaggttcggaatcaggacctgtcgaacatgaccatcatcgagggcaaggaaggcatcacggtggtcgaccccctcgtctcggaagaaacagccaaggtcgcaatcgatctctactatgccaatcgtggccgcaagcccgtgaaggcggtgatctacacacacagccacgttgaccactatggcggcgtgcgtggcgtgatcagccaggacgacgtcacctccgggaaggtcaagatctacgcgcctgagggcttcctggaagccgcggtggcggagaacgtgatggccggcaatgccatgagccgccgcgccagctacatgtacggcaatctgctgcccgccgatgaaaagggccaggtcggcgccggtctcggcaccacgacctcggccggcaccgtcacgctgttgtctccgacggacacgatcaccaagaccggtgaaaagcgcgtcatcgacggcctgacctacgagttcctgatggctcctggctcggaagctccggccgagatgctgtggtacatcgaggaaaagcgcgcgatctccgcagccgaggattgcacacacacgctgcacaacacgtattcgctgcgcggcgccaagatccgcgagccgctgccctggtcgaagtacctgaatcaggcgctgaccatgtggggcgccaaggcagatgtcatgttcgcccagcaccactggccgagtttcggccagaagaacgtggtacacctgctgcgccagcagcgcgacctgtatcgctacatcaatgacgagacgctgcgcctggccaaccagggcgagacgatggtcgagatcgcggacaagttcaagctgccgcccgatctcgccaacatgtgggccaaccgtggctactacggctcagtcagccacgacgtgaaggctacctacgtcctttacctcggctggttcaatggcaaccccgccacgctggacgaactgacgccggtggaagccagcaagcgctacgtcgagttcatgggcggcgccaatgccgtgctgtcgaaggccaagcaggcgtacgacaagggtgagtatcgctgggtggcccaggtggtcaatcacgtggtgtttgccgacccgtcgaacaaggcggccaagaacctccaggccgacgcgctcgagcaactgggctaccaggccgaatccggcccgtggcgcaacttctacctgaccggtgccaaggaattgcgcgaaggcgtgaagaagctgcccacgccgaacaccgcgagcggcgatacggtgaaggccatgacgccggagatgttcttcgactatctcagcgttcgcgtgaaccgcgccaaggcggccaatgcgaagatcgcgctgaatgtcgacttcggcaaggaaggcggcaagtatctgctcgaacttgagaacggcgtgctcaaccacacggcaggcgttgaatccgcaaacgctgatgcctccgtggcaatgtcacgcgacacgctgaacggcatcatcctgcaacagacgaagctggccgacgcgatcaagaacggatcggcgaaggtcactggcaatcaggccaagctcgacgaactggtgagctacctcgacaacttcgagttctggttcaatatcgtcacgccgtaa

SEQ ID NO: 12956 - protein, 660 aa, Ralstonia metallidurans CH34
MKNSRFRASVVTLVSAAVLSQFGAAYAQDARKDATSATKAANQKLLSELPFSDRSDFDDAHRGFVAPLPNTVIKGSSGNAIWNPNQYAFIKEGSQAPGTVNPSLWRQAQLINISGLFQVTDGIYQVRNQDLSNMTIIEGKEGITVVDPLVSEETAKVAIDLYYANRGRKPVKAVIYTHSHVDHYGGVRGVISQDDVTSGKVKIYAPEGFLEAAVAENVMAGNAMSRRASYMYGNLLPADEKGQVGAGLGTTTSAGTVTLLSPTDTITKTGEKRVIDGLTYEFLMAPGSEAPAEMLWYIEEKRAISAAEDCTHTLHNTYSLRGAKIREPLPWSKYLNQALTMWGAKADVMFAQHHWPSFGQKNVVHLLRQQRDLYRYINDETLRLANQGETMVEIADKFKLPPDLANMWANRGYYGSVSHDVKATYVLYLGWFNGNPATLDELTPVEASKRYVEFMGGANAVLSKAKQAYDKGEYRWVAQVVNHVVFADPSNKAAKNLQADALEQLGYQAESGPWRNFYLTGAKELREGVKKLPTPNTASGDTVKAMTPEMFFDYLSVRVNRAKAANAKIALNVDFGKEGGKYLLELENGVLNHTAGVESANADASVAMSRDTLNGIILQQTKLADAIKNGSAKVTGNQAKLDELVSYLDNFEFWFNIVTP

SEQ ID NO: 12957 - DNA, 1989 bp, Ralstonia metallidurans CH34
  CDS (1)..(1989): transl_table=11
atgcaatgcaagaccgccgcgtttcacgcggccatttccgtgctggtgggcagcctgttcccgatgagcgccatggccgcgcccaccgagtccattgccaccaacgacgcaacggccgccacgcgcgatgccaatgcggacgtcctgaagcgcctgcctttcgccaaccggcaggacttcgaagatgcccaacgtggctgggtcggatcgctcgacagtggcgagatccgcaatgccgatggtcgcgtggtctggaacctcgacgcctatgccttcctgcgtgacgatgcctcacccgcctcggtcaatccgagcctctggcgccaggcgcagctcaacctgaagcacggcctgttcaaggtcaccgaccgcatctatcaggtacgtggcttcgacctctcgaacatgaccatcgtcgagggcgacagtggccttatcgtgatcgatccgctcctgaccgccgaaaccgcccgcgcggcgatcgacgtctactacaagtaccgtccgaagaagcccatcgtcgcggtgatctactcacacagccacgtggaccacttcggcggcgtgaagggcgtggtcagtcaggatgacgtcaagtcgggcaaggtgaagatctacgcgcccgaaggctttatggaagaggccatcagcgagaacatcttcgccggcaatgccatgagccgccgcgcgcagtacatgtacggcgccctgctgccaaagggcccgcaggggcaggtggacgccggcctcggcaagaccgtttcgctcggcacgatcacactgattccgcccaccgacctgatcggcaagaccggcgaaacccgcacgatcgacggcgtgcggatcgaattccagatggctcccggctccgaggcgccggccgagatgctgatgtacttcccgcagtggcgggcactgtgcgcggcagaggacgccacgcataacctgcacaacctctacaccatccgcggcgcccaggtgcgcgacgccaaccagtggtggcgcgcgctcgacgagaccatcgaccgctacggcaaccgcactgacgtcatcttcgcgcagcaccactggccaaagtggggccagcagagcattaccggcttcctctcgcggcagcgcgacgcctacaagttcatccacgaccagacactgcgcctggccaaccagggctacacgatgaccgaggtaggcgagcgcgtgaagctgccgccgtctctggccagccaatgggaccttcgcgactactacggcacggtgaatcacaacgccaaggccgtctaccagcggtacctcggctggtacagcggtgacccggccgacctgcacccgctgccaccggaagagtccgcgcaacgctacgtgcagtacatgggcggcgccgacaagatcctcgctcaggccagcaagtcgtacgcccaaggcgattaccgctgggtggcgcaggtggtcaagcacgtggtctacgccgatccgtcgaacctggcggcccgcaagctcgaggccgacgcgcttgaacagctcggctaccagaccgaggccgcaagctggcgcagtgcctatctggtgggcgcctacgagttgcgcaatggtgtgcccaagctgcagggcacccagactgccagcccagacatgatcggggccatgaccgacacgatgttcctggacttcctggccgtgcgtctcaatggcgagcgcgccgccggccacgacctgaagttcaactgggtacaacccgatactggcaagcgctatgcgctgtcggtggaaaacggtgtcttcctctataagccggagcgccagttcgacgacgccggtgccacgttgacgatgccgcgcagcgcgctgatcggctcgctgctgggccagaccacgctgcccgcggaactctcggccgggcgcgccaaggtggacggcgatccggctgtactgaagtcatggatgggaatgctggacaagttcgacccgcagttcaatatcgtgacgccttga

SEQ ID NO: 12958 - protein, 662 aa, Ralstonia metallidurans CH34
MQCKTAAFHAAISVLVGSLFPMSAMAAPTESIATNDATAATRDANADVLKRLPFANRQDFEDAQRGWVGSLDSGEIRNADGRVVWNLDAYAFLRDDASPASVNPSLWRQAQLNLKHGLFKVTDRIYQVRGFDLSNMTIVEGDSGLIVIDPLLTAETARAAIDVYYKYRPKKPIVAVIYSHSHVDHFGGVKGVVSQDDVKSGKVKIYAPEGFMEEAISENIFAGNAMSRRAQYMYGALLPKGPQGQVDAGLGKTVSLGTITLIPPTDLIGKTGETRTIDGVRIEFQMAPGSEAPAEMLMYFPQWRALCAAEDATHNLHNLYTIRGAQVRDANQWWRALDETIDRYGNRTDVIFAQHHWPKWGQQSITGFLSRQRDAYKFIHDQTLRLANQGYTMTEVGERVKLPPSLASQWDLRDYYGTVNHNAKAVYQRYLGWYSGDPADLHPLPPEESAQRYVQYMGGADKILAQASKSYAQGDYRWVAQVVKHVVYADPSNLAARKLEADALEQLGYQTEAASWRSAYLVGAYELRNGVPKLQGTQTASPDMIGAMTDTMFLDFLAVRLNGERAAGHDLKFNWVQPDTGKRYALSVENGVFLYKPERQFDDAGATLTMPRSALIGSLLGQTTLPAELSAGRAKVDGDPAVLKSWMGMLDKFDPQFNIVTP

SEQ ID NO: 12959 - DNA, 2076 bp, Acidobacteria bacterium Ellin345
  CDS (1)..(2076): transl_table=11
atgcaaaatcccagactctcacctttggcgattcttgtagtcgtagccgcagccctgggaagcgtaagagtgatagatgcgcaggaaacacggcatttcaatcccaagggaaagccgccttcgcagtacacggtccaagcacaacaggagcagagaagagttctccctctcgccgataggcaagattttgacgaagcgaaacgtggctttattgcagcgccctcctaccgcaagatcatgaatgacaagggcgatgtggcctggaacatggataactggagctttcttctcagcggaacggattacgacaccatccatccttcgctgcagcgccaagcgacgctcaacatggagtacggccttttcgaggtagtcccgggcatttaccaggtacgcggattcgaccttgcaaacatctccttcatcaaaggcaagaccggatggatcgtgatcgatccgctgaccgtgaaagaaacctcgagggctgctctcaagttcgtaaacgaaaagcttggagcaaggcccgttgtagccgtcatcatctcgcactctcacggtgatcattttggcggtgtacgcggtgttgtcgatccggacgcgctcgcggctggcaaggtgcagatcatcgcacccaagggcttcatgtacgagtcgatctcggagaacctcttcggcggcaatgcaatgacgcgccgcaagtcctacacctacgctgacctcgtgccagctagcccctacggtcatgtcgatcaggcgattggaaagggcgttgccagcggcgatgtcggcattcttccgcccacgaagctaatcgagcagccgatcgaggagatgacgatcgacggcgtcaggatgcagtttcagaacacacctggcaccgaggcgcccgccgagatgaacacgtggttccccgacttcaaagccttctgggcagccgagaacatcgtcgccggtcagcacaacatcctcacactgcgtggcgcgcaggtgagagatgcgctggcatggtcgaaattcatcaacgaagctctgtaccgtttcggcgaccaggccgaggtgatgttcgcctcgcatagctggccgcgctggggcaaagacaggattcaggaagtaatgcgaggccagcgggacatgtatgcaaatctgaataaccaggttatgcatctcgctaacacgggcgtgacgatcaatcagatccacaacgtctatcaaccgcccaagagcttgcagcagctgtggtacacgcacgcttatcacgggtcctacgagcacaacagccgcgcggtcatccagcgttattttggctattgggatttgaacccagcaactctagtgccgctctcgcccgaagactccgcgcccctctatgtagagatgatgggaggtgcggacaaaattattgccaaaggtcgcgagctgtacgatgcgggcaaataccgttacgcaatggaaatcctaaataagctggtttacgcgcaacccgataaccagacggccaaagaccttctagccgataactacgaacagctcggctatcaaagcgagagcgtcgccctgcgcaacggttacctgtcgggagccaaagagctgcgagatggaatcattgccgtcaagaccgcaaaagcgggcagccctgatttcgtgcgtggcaccagtaccgaacttttcctgaactatcttggaatccagatggacagccgtaaggctgagggaatgaagttcaagattaaccttgagacaccggacaacggcgagaaattcgtggtcgaaatgagcaatgcaacgctgaccaccatcgccggttaccaggcaaaggatgccgatctgaccctcactattgaccgacgtgaactggaagacgtgatgatcgggaacgccaagttgaccgacaaggtcgccgccgggaaggcaaaaatggtgggcaacccccaggttcttgcgcagctagcttcaaccatggtgcagttcgataactggttcgaggttctgcctggcacaaagcgcaaaggctctgaggccccgaagcaagaactgttcttggatgacgctcggtttgagccgttaccagaggaataa

SEQ ID NO: 12960 - protein, 691 aa, Acidobacteria bacterium Ellin345
MQNPRLSPLAILVVVAAALGSVRVIDAQETRHFNPKGKPPSQYTVQAQQEQRRVLPLADRQDFDEAKRGFIAAPSYRKIMNDKGDVAWNMDNWSFLLSGTDYDTIHPSLQRQATLNMEYGLFEVVPGIYQVRGFDLANISFIKGKTGWIVIDPLTVKETSRAALKFVNEKLGARPVVAVIISHSHGDHFGGVRGVVDPDALAAGKVQIIAPKGFMYESISENLFGGNAMTRRKSYTYADLVPASPYGHVDQAIGKGVASGDVGILPPTKLIEQPIEEMTIDGVRMQFQNTPGTEAPAEMNTWFPDFKAFWAAENIVAGQHNILTLRGAQVRDALAWSKFINEALYRFGDQAEVMFASHSWPRWGKDRIQEVMRGQRDMYANLNNQVMHLANTGVTINQIHNVYQPPKSLQQLWYTHAYHGSYEHNSRAVIQRYFGYWDLNPATLVPLSPEDSAPLYVEMMGGADKIIAKGRELYDAGKYRYAMEILNKLVYAQPDNQTAKDLLADNYEQLGYQSESVALRNGYLSGAKELRDGIIAVKTAKAGSPDFVRGTSTELFLNYLGIQMDSRKAEGMKFKINLETPDNGEKFVVEMSNATLTTIAGYQAKDADLTLTIDRRELEDVMIGNAKLTDKVAAGKAKMVGNPQVLAQLASTMVQFDNWFEVLPGTKRKGSEAPKQELFLDDARFEPLPEE

SEQ ID NO: 12961 - DNA, 1809 bp, Rhodococcus sp. RHA1
  CDS (1)..(1809): transl_table=11
atgacacccgatttctcggacaccaccgatttcgaggacgccgaccgcggtttcgtcgaccgcctcgacccctgcaccgtcacgagtggggacggtcgcgtggtgtgggacatgcaggagtattcgttcctgaacggtgactgcccggacaccgcccacccgagcctgtggcgtcagtcgcaactgtgcgcgaagaacggtctgtacgaagtcaccgagggcatctaccagctacgcggaatcgacctgtccaacatgacgatcgtcgagggcgagactggcgtcctggtgatcgacccgctgatctcgcaggaaacggcggccgccgcgctcgcgctgtaccggaaaaaccgtggcgaccggcccgtcaccggagtcatctatacgcactcccacatcgatcacttcggtggcgtcgtcggcgttctcccggacggtcgcggcgacgtcccgatcctcgcccccgaaggtttcctcgaacacgcggtatccgagaacgtctatgccggaacggcaatgggccggcgcgccacctacatgtacggaccgctgctccccaagggcccgcgcgggcacctcggggcggggctcggaacgaacacctcggcgggtcggcccggactgatccccccgaccgtcgacatcacccacaccggccaggaggagaccgtcgacggcatccggatcgtctttcaggtgacgccgggaacggaggcgcccgccgagatgaacttcctgttccccgaccaccgggcactgtgtatggcggagaacgccacccacaatctgcacaatctcctcacgctgcggggcgcgctggtccgggacccccgcgcctggtcgcggtacctcgaccaggcgatcgagatgttcgacagcggctacgacgtcgcattcgcctcccaccactggccgacgtggggtcgcgaccgggtggtgacattcctgtcgcagcagcgcgacctgtaccagtacctgcacgaccagaccctgcggatgctcaacaccgggatgacgggaaccgagatcgccgaggacttcccgcttccgcctgccctcgaatccgcctggcacgcacgcggttactacggctcggtgagccacaacgtaaaagcgatctaccagcggtacatgggctggttcgacggcaacccgacgtcgctgtggcagcacccgccggagaacgtcgcgacacggtacgtcgagtgcatgggcggccagagcgaggtccgggccaaggctcaacggtatttcgacgacggcgacttccggttcgccgccgaactctcgaagcatgcggtgttcgccgacccgtcggacagcgacgcgaaagaactgcttgcccgcacgtacgaacaactcggattcggtgcggagaacgcgacgtggcgcaacttctacctcacgggcgcactcgaactgcgcggcggcatcgtcgccccgccgctcagcgacctcggcgcagacatgctgagcgccctgacgatcgagcagatcttcgactccgtcgccctccgcatcaatggcccacgtgcctgggacaagtccctcgtcgcggagtggcacttcaccgaacccgaagcgcactaccggacgtcgctgtccaacggtgcgctcatccagacggtcgcgccgaggaccacgacgcaaccggacgtctccttgaccctgacgaagatgcagttgctcggactgttcgccggcaaggggctggagggcatcgaggtgacgggtgacccgtcgaaactcctggtcctcacggaactcctcgacgcacccgacagcgcgttcccgatcgtcacgccgtag

SEQ ID NO: 12962 - protein, 602 aa, Rhodococcus sp. RHA1
MTPDFSDTTDFEDADRGFVDRLDPCTVTSGDGRVVWDMQEYSFLNGDCPDTAHPSLWRQSQLCAKNGLYEVTEGIYQLRGIDLSNMTIVEGETGVLVIDPLISQETAAAALALYRKNRGDRPVTGVIYTHSHIDHFGGVVGVLPDGRGDVPILAPEGFLEHAVSENVYAGTAMGRRATYMYGPLLPKGPRGHLGAGLGTNTSAGRPGLIPPTVDITHTGQEETVDGIRIVFQVTPGTEAPAEMNFLFPDHRALCMAENATHNLHNLLTLRGALVRDPRAWSRYLDQAIEMFDSGYDVAFASHHWPTWGRDRVVTFLSQQRDLYQYLHDQTLRMLNTGMTGTEIAEDFPLPPALESAWHARGYYGSVSHNVKAIYQRYMGWFDGNPTSLWQHPPENVATRYVECMGGQSEVRAKAQRYFDDGDFRFAAELSKHAVFADPSDSDAKELLARTYEQLGFGAENATWRNFYLTGALELRGGIVAPPLSDLGADMLSALTIEQIFDSVALRINGPRAWDKSLVAEWHFTEPEAHYRTSLSNGALIQTVAPRTTTQPDVSLTLTKMQLLGLFAGKGLEGIEVTGDPSKLLVLTELLDAPDSAFPIVTP

SEQ ID NO: 12963 - DNA, 1956 bp, Shewanella sp. MR-4
  CDS (1)..(1956): transl_table=11
atgaagttagtaacaacattagttatagcagcgatggtttcttccggggtcagtgcggcagagtcaaaacctgctactcaggcaacgatagacgcaaataactcggtcaaacaatccttgccttttagtgataaaaaagactttgagaacgctcagaaaggtcttattgcgaaacaagatgtcgtgaccattaagaacgaacaaggagatgtcgtctgggatctagaacagtacaaaaagtatatcgacctcaacaatcctgcccctgatagtgtcaacccaagcctgtggcgtaacgcacagctgaacatgatcaatggtctatttgaagtcaccgatggtatctatcaggtccgcggctatgatctcagtaacatcacttttatcaaaggtaaaacgggttggattgtctttgatcctcttatctcccaagaaacggctaaagcagccttagattttgtcaatgaaaaactcggtaagcgtcccgtcgtggctgtggtttatagccatagtcatattgaccattttggtggtgtacgcggcattgtcgatgaaaaggacgttaaggccggtaaggtcaaaattatcgcctcgcatggattcaccgagcatgcggtttctgaaaacgtcatcgccggtaatgctatgggacgccgtgcaattttcatgtacggcgctttattgcctcgaaatgaatttggtggtgtgaacggtggtctgggccaaaccacttcaacaggtttagccacactcatcgaacctacggatatcatcgagaaaaccggcgatgaaatgacggttgatggggtcaaaatggttttccaatatacgcctggcaccgaagcgccaacggaaatgaacacttggtttccagataaaaaggcgctgtggatggccgaaaactcaaccaataccatgcataacattctgacgttgcgcggcgcgcaagttcgcgacgccttgaaatggtctggttatttacaggataccattgagatgtggggaggggacgttaaggtcaagttccaaagccaccattggccgatttggggaaatgctgacattgttgagtactttaagaagcagcgtgacatctataaatatacccatgaccaaacagtacgcttaatgaaccagggctacacgggtgaagaaatatcagaaatcattaccttgccaaaatcattagaaaataactggaatactcgcggctattacggaacgcttcgccataacagtcgtgccgtctatcaacgctacatgggttggtacgatggtaatccctcagatctgaacaatttgccacctacggatgccgcggtgaaatacgttgagtatatggggggggagaaagcggcaattgataaagcgcaggcagacttcgataaaggtaactatcgttgggttgccgaagtgcttaagcatgtcgtctttgcgaatccacagagtcaacaaggcaaggcactgctggcagatgcttacgagcagttaggttatcagtccgaatcgggtccttggcgctccgtctacctgcaaggtgcttatgagttaagaaatggcgccccttcggctggcggagttcagactgcatcgcccgacattatcaaaaatatgccgcctgagatgctgtttgattatctcgcggtacgtattttacccgaaaaagcagaaggtaagaattttgcaataaatctgaactttacagatttaaatgagaaatacaccttgtatctggaggactcagtactcattcatactaagaaacaatccgataaaccaaacgtgacgctcacactgaaaaaatcagtattggatgacgtgcagctgggtaatatcaccttggaaaaagcgattgcgaatggggatattcaattgaatggggataaagaagtgttcaaggatttcgttggaatgctggataacttcaatttctggttcaatattgtcactccttag

SEQ ID NO: 12964 - protein, 651 aa, Shewanella sp. MR-4
MKLVTTLVIAAMVSSGVSAAESKPATQATIDANNSVKQSLPFSDKKDFENAQKGLIAKQDVVTIKNEQGDVVWDLEQYKKYIDLNNPAPDSVNPSLWRNAQLNMINGLFEVTDGIYQVRGYDLSNITFIKGKTGWIVFDPLISQETAKAALDFVNEKLGKRPVVAVVYSHSHIDHFGGVRGIVDEKDVKAGKVKIIASHGFTEHAVSENVIAGNAMGRRAIFMYGALLPRNEFGGVNGGLGQTTSTGLATLIEPTDIIEKTGDEMTVDGVKMVFQYTPGTEAPTEMNTWFPDKKALWMAENSTNTMHNILTLRGAQVRDALKWSGYLQDTIEMWGGDVKVKFQSHHWPIWGNADIVEYFKKQRDIYKYTHDQTVRLMNQGYTGEEISEIITLPKSLENNWNTRGYYGTLRHNSRAVYQRYMGWYDGNPSDLNNLPPTDAAVKYVEYMGGEKAAIDKAQADFDKGNYRWVAEVLKHVVFANPQSQQGKALLADAYEQLGYQSESGPWRSVYLQGAYELRNGAPSAGGVQTASPDIIKNMPPEMLFDYLAVRILPEKAEGKNFAINLNFTDLNEKYTLYLEDSVLIHTKKQSDKPNVTLTLKKSVLDDVQLGNITLEKAIANGDIQLNGDKEVFKDFVGMLDNFNFWFNIVTP

SEQ ID NO: 12965 - DNA, 1956 bp, Shewanella sp. MR-7
  CDS (1)..(1956): transl_table=11
atgaagttagtgacaacattagttatagcagcgatggtttcttccggggtcagtgcggcagagtcaaaacctgctactcaggcaacaatagacgcaaataactcggtcaaacaatccttgccttttagtgataaaaaagactttgagaacgctcagaaaggtcttattgcgaaacaagatgtcgtgaccattaagaacgaacaaggagatgtcgtctgggatctagaacagtacaaaaagtatatcgacctcaacaatcctgcccccgatagtgtcaacccaagcctgtggcgtaacgcacagctgaacatgatcaatggtctatttgaagtcaccgatggtatctatcaggtccgcggctatgatctcagtaacatcacttttatcaaaggtaaaacgggttggattgtctttgatcctcttatctcccaagaaacggctaaagcagccttagattttgtcaatgaaaaactcggtaagcgtcccgtcgtggctgtagtttatagccatagtcatattgaccattttggtggtgtacgcggcattgtcgatgaaaaggacgttaaggctggtaaggtcaaaattatcgcctcgcatggattcaccgagcatgcggtttctgaaaacgtcatcgccggtaatgctatgggacgccgtgcaattttcatgtacggcgccttattgcctcgaaatgaatttggtggtgtgaacggtggtctgggccaaaccacttcaacaggtttagccacactcatcgaacctacggatatcatcgagaaaaccggcgatgaaatgacggttgatggggtcaaaatggttttccaatatacgcctggcaccgaagcgccaacggaaatgaacacttggtttccagataaaaaggcgctgtggatggccgaaaactcaaccaataccatgcataacattctgacgttgcgcggcgcgcaagttcgcgacgccttgaaatggtctggttatttacaggataccattgagatgtggggaggggacgttaaggtcaagttccaaagccaccattggccgatttggggaaatgctgacattgtggagtactttaagaagcagcgtgacatctataaatatacccatgaccaaacagtacgcttaatgaaccagggctacacgggtgaagaaatatcagaaatcattaccttgccaaaatcattagaaaataactggaatactcgcggctattacggaacgcttcgccataacagtcgtgccgtctatcaacgctacatgggttggtacgatggtaatccctcagatctgaacaatttgccacctacggatgccgcggtgaaatacgttgagtatatggggggggagaaagcggctattgataaagcgcaggcagacttcgataaaggtaactatcgttgggttgccgaagtgcttaagcatgtcgtctttgcgaatccacagagtcaacaaggcaaggcactactggcagatgcttacgagcagttaggttatcagtccgaatcgggtccttggcgctccgtctacctgcaaggtgcttatgagttaagaaatggcgccccttcggctggcggagttcagactgcatcgcccgacattatcaaaaatatgccgcctgagatgctgtttgattatctcgcggtacgtattttacccgaaaaagcagaaggtaagaattttgcgataaatctgaactttacagatttaaatgagaaatacaccttgtatctggaggactcagtactcattcatactaagaaacaatccgataaaccaaacgtgacgctcacactgaaaaaatcagtattggatgacgtgcagctgggtaatatcaccttggaaaaagcgattgcgaatggggttattcaattgaatggggataaagaagtgttcaaggatttcgttggaatgctggataacttcaatttctggttcaatattgtcactccttag

SEQ ID NO: 12966 - protein, 651 aa, Shewanella sp. MR-7
MKLVTTLVIAAMVSSGVSAAESKPATQATIDANNSVKQSLPFSDKKDFENAQKGLIAKQDVVTIKNEQGDVVWDLEQYKKYIDLNNPAPDSVNPSLWRNAQLNMINGLFEVTDGIYQVRGYDLSNITFIKGKTGWIVFDPLISQETAKAALDFVNEKLGKRPVVAVVYSHSHIDHFGGVRGIVDEKDVKAGKVKIIASHGFTEHAVSENVIAGNAMGRRAIFMYGALLPRNEFGGVNGGLGQTTSTGLATLIEPTDIIEKTGDEMTVDGVKMVFQYTPGTEAPTEMNTWFPDKKALWMAENSTNTMHNILTLRGAQVRDALKWSGYLQDTIEMWGGDVKVKFQSHHWPIWGNADIVEYFKKQRDIYKYTHDQTVRLMNQGYTGEEISEIITLPKSLENNWNTRGYYGTLRHNSRAVYQRYMGWYDGNPSDLNNLPPTDAAVKYVEYMGGEKAAIDKAQADFDKGNYRWVAEVLKHVVFANPQSQQGKALLADAYEQLGYQSESGPWRSVYLQGAYELRNGAPSAGGVQTASPDIIKNMPPEMLFDYLAVRILPEKAEGKNFAINLNFTDLNEKYTLYLEDSVLIHTKKQSDKPNVTLTLKKSVLDDVQLGNITLEKAIANGVIQLNGDKEVFKDFVGMLDNFNFWFNIVTP

SEQ ID NO: 12967 - DNA, 1953 bp, Hyphomonas neptunium ATCC 15444
  CDS (1)..(1953): transl_table=11
atgcgccgttacattctggtgggcgttgcggccctgttggcgcccgcaataacagctgtggccgaaaccggcacagccacgcaggcgacgatcgaggccaatcgcgccttttcagaggggctgccctgggacgacacgactgaagcggagctgtctgatcgcggctttgttgccacgcgggaagaccccatcattctgggagccgatggcgaagctgtgtttgatctcaacgcctatgatttcacggctggcccagccgccgagacgatgaaccccagcctctggcgccatctcagcctgctgaagaagcacgggctttatgaggtgacgccgggcatctggcaggtgcgcgggtttgacctgtcggtgatgagcatcatagagggcgagacaggcttcatcattgttgatccgttgacggtaacggaatcggcagcggcggcgtttgagctggtgaagcagcatctgggcgacaagccgatccatgcggtgatctatacccacagccatgctgatcattttggcggggtcaaaggcatcgtaacggttgaggatgtggccgctggcaaggttcagatcatcgcgccggacggcttcatggaacatgcggtcagcgagaatctgattgcgggcggcgcgatgagccggagggcgaatttccagttcggatcgcgcctggagcccggcccggcggggcagggcggcgccggcatcggcaccggcattccccgcggcacgatgagccttattccgcccacccattcgatcacggaaaccggcgagacgatggtgatcgacgggatcgagatcgagttccagctgacgcccggcaccgaggcgccggctgagctgaacttctacctgccgcaactgcgcgcgctatgcctggcggagaacgccaatgcgacgatgcacaatgtgttgccgccgcgcgggtcgctcgtgcgcgatgccaaggcgtgggcggattatctgaccgagtcgattgcgctctatgcggacaagaccgacgtgatgttcgtgtcccatggctggccgcgctgggggcaggcggaggtgaccgagttcatgagccatcaccgcgacgcgtacaaattcctgcatgaccagaccatccgcctgatgaacaagggctataccgcgagcgagattgccgaagtgatcgcgctgcccgaaagcctctcaagcaaatggtacaatcgcggctattacggcacgatggcgcacaattcgaaggcggtctatcagcgctatctcggctggtatgatggcaacccggcaaacctcaatgcctggccgccggaagaagcgggcaagcgctatgtagccgccatgggcggcgcagcgaaggcgctggctgtggcgcagtcggcctataacgcgggcgactatcgctgggcggcgcaggtggcgagccatatcgtgtttgccgatgatacggacgcgagcgcgcgcgaagtgctggccaaggcattcgagcagatggggtatcaagccgaggggtctctttggcggaacatgtatctcaccggcgcggccgaggcacgggaaacgccggcggatcgtcagatcacgaccgtttcgccggacatgatcggcgcgatcaccacgccgcaggtgttcgacatgctggccatccgtgtcgatccggcaaaggctgaggggatcgatacctcggtggcgttcgtgttcccggatcgggaggagacccggcgcgtttcgttgcgcaattcggtgctggtgcatgaggagggcgtgaccgggcctgtggcggccactgtcaccattccgcgcccggcatttctggccatgctgtttgccgggcagacgccggctgcactgatggaggcaggcatcatgaaggtggagggcgaagcgggcgcgacggccgcgctgatgtctgccttcgagcctgcagacacgggcccccctttcgagattgtcacgccataa

SEQ ID NO: 12968 - protein, 650 aa, Hyphomonas neptunium ATCC 15444
MRRYILVGVAALLAPAITAVAETGTATQATIEANRAFSEGLPWDDTTEAELSDRGFVATREDPIILGADGEAVFDLNAYDFTAGPAAETMNPSLWRHLSLLKKHGLYEVTPGIWQVRGFDLSVMSIIEGETGFIIVDPLTVTESAAAAFELVKQHLGDKPIHAVIYTHSHADHFGGVKGIVTVEDVAAGKVQIIAPDGFMEHAVSENLIAGGAMSRRANFQFGSRLEPGPAGQGGAGIGTGIPRGTMSLIPPTHSITETGETMVIDGIEIEFQLTPGTEAPAELNFYLPQLRALCLAENANATMHNVLPPRGSLVRDAKAWADYLTESIALYADKTDVMFVSHGWPRWGQAEVTEFMSHHRDAYKFLHDQTIRLMNKGYTASEIAEVIALPESLSSKWYNRGYYGTMAHNSKAVYQRYLGWYDGNPANLNAWPPEEAGKRYVAAMGGAAKALAVAQSAYNAGDYRWAAQVASHIVFADDTDASAREVLAKAFEQMGYQAEGSLWRNMYLTGAAEARETPADRQITTVSPDMIGAITTPQVFDMLAIRVDPAKAEGIDTSVAFVFPDREETRRVSLRNSVLVHEEGVTGPVAATVTIPRPAFLAMLFAGQTPAALMEAGIMKVEGEAGATAALMSAFEPADTGPPFEIVTP

SEQ ID NO: 12969 - DNA, 1977 bp, Pseudomonas aeruginosa UCBPP-PA14
  CDS (1)..(1977): transl_table=11
atgagccgtctgctcgcactcctggcgctcgccccgctactcgccggcgccgccgaaccctccgcgtccaagccgcccagcgccttcaccgtcgaggcccagcggcgggtcgaagcggaattgccgttcgccgaccgtgccgacttcgagcgcgccgaacgcggcctgatccggcgcccggagcgggtgctcatccgcaaccccgacggcagcgtcgcctggcagctcggcggctacgacttcctcctcgacggcaagccccgcgacagcatcaatcccagcctgcaacgccaggccctgctcaatctcaagtacggcctgttcgaggttgccgagggtatctaccaggtgcgcggcttcgacctggccaacatcaccttcatccgcggcgacagcggctggatcgtggtcgacaccctgaccaccccggccaccgccagggcggcctacgagctggtcagccgcgagctgggcgagaggccgatccgtacggtgatctacagccacgcccacgccgatcactttggaggcgtgcgcggtctggtcgagccgcagcaggtcgccagcggcgcggtgcagatcatcgctccggccggcttcatggaggcggcgatcaaggagaacgtcctggccggcaacgccatgatgcgccgcgccacctaccagtacggcacgcaactgcccaaggggccgcaggggcaggtcgacatggccatcggcaagggattggcgcgcggaccgctgagcctgctggcgccgacccgcctgatcgaaggcgagggcgaggacctggtgctggacggcgtgccgttcaccttccagaacacgccgggcaccgagtcgccggcggagatgaacatctggctgccgcggcagaaggccctgctgatggccgagaacgtggtcggtaccctgcacaacctgtataccctgcggggcgccgaggtacgtgatgcgctgggctggagcaagtacatcaaccaggcgctgcatcgtttcggcaggcaggccgaggtgatgttcgcagtgcacaactggccgcgctggggcaacgcggagatcgtcgaggtgctggaaaagcagcgtgacctgtacggcttcctgcacgaccagaccctgcacctggccaaccagggcgtgaccatcggccaggtgcacaaccgcctgcgcctgccgcccagcctcgaccaggaatggtacgaccgcggctaccacggctcggtcagccataacgcacgggccgtgctgaaccgctacctgggctactacgacggcaacccggcgagcctcgacccgctcagcccggaggactcggcgggccgctacgtggaatacatgggcggcgccgagcgcctgctggagcaagcgcgggcgtcgtacgccaggggcgagtaccgctgggtggtcgaggtggtcaacaggctggtcttcgccgagccggataaccgggccgcgcgcgagctgcaggccgatgccctggagcagctcggctaccaggcggagaacgccggctggcgcaacagctacctcagcgccgcctacgaactgcgccacggcgtaccgcgcgaccagccgacgatgaaggccggcagcgccgatgccctggcggcgatggacaccggcctgctgttcgactatctcggcgtgcgcctggacgccggcgctgcggaaggcaaggcgctgagcatcaacctgcgcctgccggacatcggcgagaactacctgctggaactgaagaactcgcacctgaacaacctgcgcggcgtgcagagcgaggacgccgggcagaccgtgagcatcgaccgcgccgatctcaaccggctgctgctcaaggaggtatcggcggtacgcctggtcttcgagggcaaactgaagagttccggcaatccgctgttgctggggcaactgttcggcatgctcggcgacttcgacttctggttcgatatcgtcacgccggcggcgaagtccgaaggctga

SEQ ID NO: 12970 - protein, 658 aa, Pseudomonas aeruginosa UCBPP-PA14
MSRLLALLALAPLLAGAAEPSASKPPSAFTVEAQRRVEAELPFADRADFERAERGLIRRPERVLIRNPDGSVAWQLGGYDFLLDGKPRDSINPSLQRQALLNLKYGLFEVAEGIYQVRGFDLANITFIRGDSGWIVVDTLTTPATARAAYELVSRELGERPIRTVIYSHAHADHFGGVRGLVEPQQVASGAVQIIAPAGFMEAAIKENVLAGNAMMRRATYQYGTQLPKGPQGQVDMAIGKGLARGPLSLLAPTRLIEGEGEDLVLDGVPFTFQNTPGTESPAEMNIWLPRQKALLMAENVVGTLHNLYTLRGAEVRDALGWSKYINQALHRFGRQAEVMFAVHNWPRWGNAEIVEVLEKQRDLYGFLHDQTLHLANQGVTIGQVHNRLRLPPSLDQEWYDRGYHGSVSHNARAVLNRYLGYYDGNPASLDPLSPEDSAGRYVEYMGGAERLLEQARASYARGEYRWVVEVVNRLVFAEPDNRAARELQADALEQLGYQAENAGWRNSYLSAAYELRHGVPRDQPTMKAGSADALAAMDTGLLFDYLGVRLDAGAAEGKALSINLRLPDIGENYLLELKNSHLNNLRGVQSEDAGQTVSIDRADLNRLLLKEVSAVRLVFEGKLKSSGNPLLLGQLFGMLGDFDFWFDIVTPAAKSEG

SEQ ID NO: 12971 - DNA, 1875 bp, Mycobacterium avium 104
  CDS (1)..(1875): transl_table=11
atggaccacaaacctcccagcccggtaatcgaggcggcccatcacgcatgcgtgctgccgttttccgacgacgcggatttccgcgacgccgatcgtggattcatcgccgcgttgtcgccgtgcgtggtgcggggcgccgacggccgcgtggtgttcgacaacgacgcctacgccttcctggacgggcccgcgcccacgtcggtgcatcccagcctgtggcggcagtccacgctggccgccaaacacggcctctacgaagtggttccgggcatctatcaggttcgcggccttgacatctccaacgtcacgttcgtggaaaccgacaccggcatcatcgtcatcgatccgctggtgtccaccgaggtggccgcggcggcgctgacgctgtaccgcacgcatcgcggcggcgaccggcccgtggtcgcggtgatctacacccacagccacgtcgaccatttcggcggcgtcctgggcgtcgccacccaagccgacgtcgatgccggccgggtggcggtgctggcgccggagggtttcgtcgaacatgcggtgcaggagaacgtctacgccggcccggcgatgctgcgccgcgccacctacatgtacgggacgctgctgccgcgcgggctctttgaccatgtgggctgtgggctcgggcaggccgcctccatgggcgaagtggccctcatcgtgccgaccgtcgacatccgcgagacgggggagacacacacgatcgacggcgtcgagatcgagttccagatggcgcccggcaccgaggcgcccgccgaaatgcatttctacttcccgcaattccgcgccctgtgcatggccgagaacgccacccacaacctgcacaacctgctgaccctgcgcggcgcgctggtgcgcgacccgcgcgcctggtccggctacctcaccgaggccatcgacaccttcgccgaccgcgccgacgtcgtattcgcctcccatcactggccgacgtgggggcgggacggcatcgtcgaattcctgtcgctgcagcgcgacctgtacgcgtatctgcacgaccagacactgcgcctgctcaaccagggtcacaccggtgtcgagatcgccgaaatgttccggctgccaccggctctcgagcgggcctggcacgcgcgggggtactacgggtcggtcagccacaacgtcaaggcgatctaccagcgctacatgggctggttcgacggcaacccggcccggctgtggccccatccacccgaggcgctggggccccgctatgtcgctgcgatgggcggcatcgaccgggtcgtcgacctcgcccagcaggcattcgactccggtgattaccgttgggcggcaacccttttggaccacgcgatgttcaccgacggtgagcacgtcggcgcccgcgagctctacgccgacacgctcgagcagctggcctacggcgcggagaacgcgacctggcgcaacttcttcctcagcggggcaacggagctgcgcgacggcaatttcggcaccgccgggcaggtcacctcgcccaccatgcttgcccagctgaccccggagcagatcttcgacggcctggccatccgggtcaacgggccacgcagctggggcctcgacatcaccgtcgacgtcacccttgccgacacggcggtcaaccatcggctcgccctgcgcaacggcgtgctggtgcaacgcaaggtgccggcggatcccacgaccgcgaccgttacggtgcggctggccaacaagattcggctactggcgttggcggcgggggacttcgcctcgccgggtctggagctcaccggcgatcggggtgcgctgcagtcgttggtgggagcgctcgacgcgccggaccccgatttcaacatcgtcacgccgtag

SEQ ID NO: 12972 - protein, 624 aa, Mycobacterium avium 104
MDHKPPSPVIEAAHHACVLPFSDDADFRDADRGFIAALSPCVVRGADGRVVFDNDAYAFLDGPAPTSVHPSLWRQSTLAAKHGLYEVVPGIYQVRGLDISNVTFVETDTGIIVIDPLVSTEVAAAALTLYRTHRGGDRPVVAVIYTHSHVDHFGGVLGVATQADVDAGRVAVLAPEGFVEHAVQENVYAGPAMLRRATYMYGTLLPRGLFDHVGCGLGQAASMGEVALIVPTVDIRETGETHTIDGVEIEFQMAPGTEAPAEMHFYFPQFRALCMAENATHNLHNLLTLRGALVRDPRAWSGYLTEAIDTFADRADVVFASHHWPTWGRDGIVEFLSLQRDLYAYLHDQTLRLLNQGHTGVEIAEMFRLPPALERAWHARGYYGSVSHNVKAIYQRYMGWFDGNPARLWPHPPEALGPRYVAAMGGIDRVVDLAQQAFDSGDYRWAATLLDHAMFTDGEHVGARELYADTLEQLAYGAENATWRNFFLSGATELRDGNFGTAGQVTSPTMLAQLTPEQIFDGLAIRVNGPRSWGLDITVDVTLADTAVNHRLALRNGVLVQRKVPADPTTATVTVRLANKIRLLALAAGDFASPGLELTGDRGALQSLVGALDAPDPDFNIVTP

SEQ ID NO: 12973 - DNA, 1881 bp, Mycobacterium smegmatis str. MC2 155
  CDS (1)..(1881): transl_table=11
atggagtcgaacccaccgagtgccgtcgtcgaagccgcgcaccgcgaacacctcaccaccctcccgttcggcgaccgccgagatttcgacgacgccgaccgtggcttcatcgccgcgctcgaaccgtgcgtgatcaccgccgacgacgggcggttggtgtgggacaacgattcataccggttcctcgacagcgagcaggccccggccagtgtgcaccccagcctgtggcggcagagccggctttgcgccaaacaggggctctacgaggtcgtcgatggcatctaccaggtgcgcggactcgacctgtccaacatcacgttcgtcgagggcgacagcggcgtcatcgtcatcgacccactgatctcgaccgagaccgcggccgccgcgctggcgttgtaccgcgcgcaccgcggtgaccgccgcgtcaccgcggtgatctacacccacagccacgtcgaccatttcggcggtgtgctcggtgtgacaacccaggccgacgtggacgcgggcagggtcgtggtgatcgcccccgagcacttcaccacgcacgcggtgcaggagaacgtgtatgcgggaacggcgatggcgcggcgcgcggcctacatgtacggcgccgcgctggcccgcgggcccctggggcaggtgggttgcggtctggggcaggtgccgtcgacgggggaggtggcgctgatcgtgccgaccctcgacatccgcgaaaccggggagatccactcgatcgacggtgtcgacatcgagttccagatggcgcccggcaccgaggcgcctgcggagatgcacttctatttcccgaaattccgggcgttgtgcatggcggagaacgcgacccacaatctgcacaatctcctgaccctgcgtggcgcgctggtgcgcgacccgcacggctgggcgggatatctcaccgaggccatcgacagtttcgccgaccgcaccgacgtggtgttcgcatcccaccactggcccacgtggggacgcgacaacatcgtcgaatacctttcgctgcaacgagatctgtacgcctacctgcacgaccagacgttgcgtctgatcaaccaggggcacaccgggatcgagatcgccgagcagttcgagctcccgcccgcgttacaggccgcgtggcacacgcacggctactacggatcggtcagccacaacgtcaaagcggtctaccagcgctacatgggctggttcgacggcaaccccggccggttgtggcagcatccgcccgaggcgctcggcccgcgctacgtcgacgcgatgggcggcatcgaccgtgtcgtagagctggcgcggcgcgccttcgacagtggtgactaccgctgggcggcaacgctgttggaccatgcggtgttcaccgatgagcaccatcgcggcgcacgcgcgctgtacgccgaggtgctcgaacagctcgcctacggcgccgagaacgcggtctggcgcaacttcttcctcggcggcgccaccgagttgcgtgacggcaagttcggcaccccgaccgcgccgtcctcgcccacactgctcgcccagctgacacccgagcagatcttcgacgcggtcgccatcaacgtgaacgggccgcgcgcatgggatctcgacctcgccatcgacgtcacgttcgccgacaccggcgatacctaccggctgacgctgcgcaacggggtactggtgcaccgcagaaccgagccggatccgtcgagtgcgcacgccagcgtgaccgtcgccgacaggatgcggctgctgaccttcttcatcggcgacaccgcgatgcccggacttcaggtcaccggtgcccctgacgtgctgcagtcgttcctgcgcgtgctcgaccggcccgacccgaacttcagcatcgtcacgccctag

SEQ ID NO: 12974 - protein, 626 aa, Mycobacterium smegmatis str. MC2 155
MESNPPSAVVEAAHREHLTTLPFGDRRDFDDADRGFIAALEPCVITADDGRLVWDNDSYRFLDSEQAPASVHPSLWRQSRLCAKQGLYEVVDGIYQVRGLDLSNITFVEGDSGVIVIDPLISTETAAAALALYRAHRGDRRVTAVIYTHSHVDHFGGVLGVTTQADVDAGRVVVIAPEHFTTHAVQENVYAGTAMARRAAYMYGAALARGPLGQVGCGLGQVPSTGEVALIVPTLDIRETGEIHSIDGVDIEFQMAPGTEAPAEMHFYFPKFRALCMAENATHNLHNLLTLRGALVRDPHGWAGYLTEAIDSFADRTDVVFASHHWPTWGRDNIVEYLSLQRDLYAYLHDQTLRLINQGHTGIEIAEQFELPPALQAAWHTHGYYGSVSHNVKAVYQRYMGWFDGNPGRLWQHPPEALGPRYVDAMGGIDRVVELARRAFDSGDYRWAATLLDHAVFTDEHHRGARALYAEVLEQLAYGAENAVWRNFFLGGATELRDGKFGTPTAPSSPTLLAQLTPEQIFDAVAINVNGPRAWDLDLAIDVTFADTGDTYRLTLRNGVLVHRRTEPDPSSAHASVTVADRMRLLTFFIGDTAMPGLQVTGAPDVLQSFLRVLDRPDPNFSIVTP

SEQ ID NO: 12975 - DNA, 1878 bp, Mycobacterium sp. KMS
  CDS (1)..(1878): transl_table=11
atggactcgaagccaccgagtgacgccatccaagcggcccaccggcatcacctgagcaccctgccgttcaccgacagagcggatttcgacgacgccgaccgcgggttcatcgccgcgctcgagccgtgcgtggtcgccgcggccgacgggcgggtggtgtgggacaacgacgtctacgcgttcctcgacggggaggcgccggcgtcggtgcaccccagcctgtggcggcagtcccaactcgccgccaaacaggggctgtacgaagtggtcgagggcatctaccaggtccgcggcctcgacctgtcgaacatcacattcgtcgagggggacaccggcgtcatcgtcatcgacccgctgatctcgaccgagaccgcggccgcggcgttggcgctctaccgccagcaccgcggcgaccgtgcggtgaccgctgtcatctacacccacagtcacgtcgaccacttcggcggcgtgctcggcgtcacctcacaggccgacgtcgatgccggcaaggtggccgtgctggcgccggagggtttcgtcgaacacgcggtgcaggagaacgtctatgccggcaccgcaatggcccgccgggccacgtacatgtacgggacgctgttggcgcgcggaccgcggggccaggtgggatgtggcttggggcaacagacttcgacgggtgaggtcgccttggtcgtgcccacgctcgacatccgcgagacgggcgaggcgcacacgatcgacggtgtcgagatcgagttccagatggcgccggggaccgaggcgcctgccgagatgcacttctacttcccgcgctaccgcgcgctgtgcatggccgagaacgcgacgcacaacctgcacaacctgctcacgctgcgcggggccctggtacgcgatccgcacgcgtggtcgggttacctcaccgaggcgatcgacaccttcgccgacaaggccgacgtcgtgttcgcctcccatcactggccgacctggggccgcgaccgcatcaccgaatacctgtcgctgcaacgcgatatgtacgcctacctgcacgaccagacgctgcgcatgctcaaccaggggcacacgggcatcgagatcgccgagcagttccagatgccgcccgcgctggagcgggcctggcacacccacggctactacggttcggtcagccacaacgtcaaggcggtctaccagcgctacatgggctggttcgacggcaaccccggccgactgtgggcgcacccgccggaggcgctggccgcccggtacgccgaggtcctcggcggcgtcgaccgggtggtcgagctggccaggaaagcctgcgacgagggtgacttccgctgggcggcaacgctgctcgatcacgccgtgttcgccgaccagaatcacaccgaggcccggcaactctacgccgacactctcgagcagctggcctacggcgcggagaacggggtgtggcgcaacttcttcctgtccggggccgccgaactgcgcgacggcaacttcggcaccgcggtccagtccacgtcaccgaccctgctgagcgaactgactccggcgcagatgttcgacagcctcgccatcagcatcaacggcccccgcgcctgggatctcgacgtggcggtggacgtgacgttcctcgacaccggcgacaactaccggctgacgctgcgcaacggagtcctggtgcaccgcaaggtctctgccgacgagtcgagtgtgcaggccacgatccggctggcgaacaaggtgcggttgctggcctacgccgcgggcgacaccacgtcgccgggcgtcgagatcaccggtgacgaggcggcgctggcgaacatcgtgggggtgctcgaccgcccggaccccgctttcgacatcgtcatgccgtag

SEQ ID NO: 12976 - protein, 625 aa, Mycobacterium sp. KMS
MDSKPPSDAIQAAHRHHLSTLPFTDRADFDDADRGFIAALEPCVVAAADGRVVWDNDVYAFLDGEAPASVHPSLWRQSQLAAKQGLYEVVEGIYQVRGLDLSNITFVEGDTGVIVIDPLISTETAAAALALYRQHRGDRAVTAVIYTHSHVDHFGGVLGVTSQADVDAGKVAVLAPEGFVEHAVQENVYAGTAMARRATYMYGTLLARGPRGQVGCGLGQQTSTGEVALVVPTLDIRETGEAHTIDGVEIEFQMAPGTEAPAEMHFYFPRYRALCMAENATHNLHNLLTLRGALVRDPHAWSGYLTEAIDTFADKADVVFASHHWPTWGRDRITEYLSLQRDMYAYLHDQTLRMLNQGHTGIEIAEQFQMPPALERAWHTHGYYGSVSHNVKAVYQRYMGWFDGNPGRLWAHPPEALAARYAEVLGGVDRVVELARKACDEGDFRWAATLLDHAVFADQNHTEARQLYADTLEQLAYGAENGVWRNFFLSGAAELRDGNFGTAVQSTSPTLLSELTPAQMFDSLAISINGPRAWDLDVAVDVTFLDTGDNYRLTLRNGVLVHRKVSADESSVQATIRLANKVRLLAYAAGDTTSPGVEITGDEAALANIVGVLDRPDPAFDIVMP

SEQ ID NO: 12977 - DNA, 1902 bp, Listeria monocytogenes str. 1/2a F6854
  CDS (1)..(1902): transl_table=11
atgacaaaaaaagtcttaccaaaagaagcgtccgaatttacaaagaaagtgaatgagaaagtaaaaaaatctttaccatttgagaacacgaaagattttgatgatgctaaaaaaggttttattggaacttgggatcatgtaaaagtagatactgaagatggccatgcagtttgggatttggaggattataagtttattgaaggagaagcacctgattctgttaacccaagtttgtggcgtatcgctcagcttaatatgacaaatggtttattcaaagtaacggaccgcgtttatcaagtacgtgggtttgatatgtcgaatactacgattatggaaggcgatacaggtcttgtaattacggatacattaatgtcggttgaaactgctcgtgcggcgcttgatctatactatgagcatcgtccaaaaaaacctattaaggcgattatttatacccattcccatgccgatcattacggcggtgtagcgggtcttattagcaaagaagatgtagcctctggaaaagtggcacttattgggccagaaggatttatggaagctgcggtcagtgaaaatatttttgctggaaacgcgatgattcgtcgtgcagaatatatgtatggtagccgcttgtcacgcggggaattaggtcaagtagatgctggtcttggtaagacagcttctaaaggtcatatgtccttgcttgctccaaatgatactattacgtttgatcacgaaaaacgtgttgttgatgggattgaagtggaattcttgatggctccaaatacagaagctccttcagaacatatgatgtatttcccacaatttaaactacttaatatcgcagaagatgccgttcataacttgcataacattttaacattacgtggtgcgcaaattcgtgacgcttatgagtggtggaaagatattgacaaagcaattcgtgcctttggcgataaatatgaagtttgtatcggtcaacatcactggccaacgtgggggaatgaagaaattaatgatatgcttattcaccaacgtgacgcttataaatatatgcatgaccaaacgcttcattttattaataaaggattaactgctattgaagtagctgaagctgtgaaattccctcctgcactagaagaaaaatggtatttacgaggctactacggtacgcttaaccatgatgttaaagcgatttatcaattttatcttgggtggtatgacggaaatcctgctgacctttatccgctacctccagaagatgttgcgaaaaaatacgttgagtttatgggtggcgttgatgaagtattgaaaaaagcgcgtgtatcctatgaagcgggtgaatatcgctgggttgcggaagttgtcaaacatgcggttttcgcagatggagaaaacggagaagcaagagctcttcttgcagatgcgttagaacaacttggctatcaatctgagtctggaccatggcgtaatgtatttttagctggtgcggatgaactgagaaattctgtcccagatgaagttatttctggtgttacactggatattgtggagggtatgccgtttaacttgattttagattacatgggtattcgtttaaatggggaaagatccattggtaaacgtatctccatgaactggaaattaacagatgttgatgagaattatcatttacttgtaaataattcagtacttatttatcgtgaaggtgaagtagacgataaagctgatttaactttaactactactcgtgatacatttaatcatatcttcggtggtgtgaaaagctttgaagcagcatttgctgaccaaacagctaaactagaaggagacgcgaagaaatttggggagtttgcttccttgttagatgaatttaatcctgtcttcaatattgttacaccttaa

SEQ ID NO: 12978 - protein, 633 aa, Listeria monocytogenes str. 1/2a F6854
MTKKVLPKEASEFTKKVNEKVKKSLPFENTKDFDDAKKGFIGTWDHVKVDTEDGHAVWDLEDYKFIEGEAPDSVNPSLWRIAQLNMTNGLFKVTDRVYQVRGFDMSNTTIMEGDTGLVITDTLMSVETARAALDLYYEHRPKKPIKAIIYTHSHADHYGGVAGLISKEDVASGKVALIGPEGFMEAAVSENIFAGNAMIRRAEYMYGSRLSRGELGQVDAGLGKTASKGHMSLLAPNDTITFDHEKRVVDGIEVEFLMAPNTEAPSEHMMYFPQFKLLNIAEDAVHNLHNILTLRGAQIRDAYEWWKDIDKAIRAFGDKYEVCIGQHHWPTWGNEEINDMLIHQRDAYKYMHDQTLHFINKGLTAIEVAEAVKFPPALEEKWYLRGYYGTLNHDVKAIYQFYLGWYDGNPADLYPLPPEDVAKKYVEFMGGVDEVLKKARVSYEAGEYRWVAEVVKHAVFADGENGEARALLADALEQLGYQSESGPWRNVFLAGADELRNSVPDEVISGVTLDIVEGMPFNLILDYMGIRLNGERSIGKRISMNWKLTDVDENYHLLVNNSVLIYREGEVDDKADLTLTTTRDTFNHIFGGVKSFEAAFADQTAKLEGDAKKFGEFASLLDEFNPVFNIVTP

SEQ ID NO: 12979 - DNA, 2034 bp, gamma proteobacterium HTCC2207
  CDS (1)..(2034): transl_table=11
atgatgttcaagactgctttttattggctctcagtgccattgttcagtgttacttttttgctcacactggtcgcctgtgatcaaacagccgaagtccaatttatcgacgccgcagccagtcagttcactctagatagcaatctcgagctcgcagaaacccttgatatagagaatcaggtcgattttgacaatgcaaagcgaggcctaatagcaaaagccccaatcaaccgattaaaaaacctccgcggcactgaaatctggaatgctgcatcctatgattttgtaaaaggtgatgccccagacaccgttaatccaagcctctggcgccaagcaaaactcaacagcattcgcggactctttgaagttgaaaagggcctttatcaactgcgtggttttgatctcgccaatatgaccctgatcaaaagtgacaacggttggattgttgtggatcccctgaccacattggaaaccagccgcgttgccatggactttgccgagcagcatctcggctcaatcaatatcaccggcgtgatttttacccatagtcatgttgatcacttcggtgggattttggcactgctcgatgcacagcagatcgctgacagcaatatcccggttatagcgccagtgggttttatccatgaagcggtaagcgaaaatattatcgccgggccggccatgctgcgccgtggcagctacatgtatggcgatcccctcagtaactccgccacaggtcatgtggatacaggtctagggaagcaggttatctttggtagcagctcaattgtgcagccgacagtgactattgatcagcctcagcagaagctaactgtggatggtatcgagattgagttttttaatatgcccggcagtgaagcaccgtcggaattgaccttttacctgccccaatggaacgctttttgtggtgccgaaatcatctctcatgttatgcacaatgtgctgaccctgcgcggtgccaaggttcgcgacgccctagtctggagtgatcacattggttatatcgccgactttattgacgggaaagcggaggccgacgtgctgtttaacagtcaccactggccaacttgggggcatgatgaaattgtcactcagctgcaccagcagcaggatatgtataagtttacccatgaccaaacggtgcgcttggccaatattggactgaccccaaaagagatcgccgagcgcctagttctgcctaaaagccttgccggcaattttcatctgcgcggctattacggcaccctaagtcacaacagcaaagcggtttatcagtattattttggttggtataacggcaatccagcgacgcttaatccattgccccccgtagagtctgcactgcgctatgtggagtttatgggtggcgccgaggcgctgttagaaaaagccgcggtgtatcaggctaaaggggattatcgctgggtggcagaggtgcttaatcacctggtatttgccgagccagccaatacggatgcccgcgccatgttagcggaagcctatcgccagatggcctaccaagccgaggctggtccctggcgtgatatctacctctccggtgcctatgagcttcagggtggacctaatatagtccgttatgatgccgctgcatcaaaagggtttttgcaacaggtgccgctggagcaatttatgaaagcgctgtcggtgcgcttggatggagaaaaggccgaaggcgaagtgctgtcgattaatatcgcctttaccaatcctcagggcgatgttgacagcaattttgtgctcagtataagaaactcggtaatgcattatcgcaatctaacgcagactacaacgcagactacagcgaagagtacaacggccgatgcgaccctcactgtaagcaaagcgctatttgttgatattctggtgggcgaagcgggtctgaccgatttgatcggttccgaccaattgtcagttgatggcagtgtgctcaaactagtaaagttcttctcattattgggtgagcccaacgatgcgtttaatattgttttaccctaa

SEQ ID NO: 12980 - protein, 677 aa, gamma proteobacterium HTCC2207
MMFKTAFYWLSVPLFSVTFLLTLVACDQTAEVQFIDAAASQFTLDSNLELAETLDIENQVDFDNAKRGLIAKAPINRLKNLRGTEIWNAASYDFVKGDAPDTVNPSLWRQAKLNSIRGLFEVEKGLYQLRGFDLANMTLIKSDNGWIVVDPLTTLETSRVAMDFAEQHLGSINITGVIFTHSHVDHFGGILALLDAQQIADSNIPVIAPVGFIHEAVSENIIAGPAMLRRGSYMYGDPLSNSATGHVDTGLGKQVIFGSSSIVQPTVTIDQPQQKLTVDGIEIEFFNMPGSEAPSELTFYLPQWNAFCGAEIISHVMHNVLTLRGAKVRDALVWSDHIGYIADFIDGKAEADVLFNSHHWPTWGHDEIVTQLHQQQDMYKFTHDQTVRLANIGLTPKEIAERLVLPKSLAGNFHLRGYYGTLSHNSKAVYQYYFGWYNGNPATLNPLPPVESALRYVEFMGGAEALLEKAAVYQAKGDYRWVAEVLNHLVFAEPANTDARAMLAEAYRQMAYQAEAGPWRDIYLSGAYELQGGPNIVRYDAAASKGFLQQVPLEQFMKALSVRLDGEKAEGEVLSINIAFTNPQGDVDSNFVLSIRNSVMHYRNLTQTTTQTTAKSTTADATLTVSKALFVDILVGEAGLTDLIGSDQLSVDGSVLKLVKFFSLLGEPNDAFNIVLP

SEQ ID NO: 12981 - DNA, 1965 bp, Rickettsiella grylli
  CDS (1)..(1965): transl_table=11
atgttttggaaaatgattcccttttttttattagtgttgggcttgaatgtctatgcagacgatttaacgccaaaagcagcatctcaatttaccaaatcagccaaccaatccttcctcaataaacttcccttccataataaaaaagcttttgacgatgcaaaagctcattttataggaaatgctcccgatttagagattaaaaataaacacggtcaggtgatttggtcgatgaaaaactatgcgtttatcccagcctctttccaagctccttcgaccgtgaatccaagtctttggcatcaagcaagactcaacatgaattatggtctttatcacgttaaggataatatttatcaagtacggggttatgatctttctaacatggatattattgagggaagagaaggccttattatcatcgatccattactcactgaagaaactgcaaatgcagcgcttgcgttatattatcagcaccggcctaaaaagccggttattgcggttatttatacacatagtcacgcggatcattatggcggtgtgaaggggatcgtaacccctgaatcggttgcaaacggaaaagtaaaaataatagccccagaaggctttttaagcgccgctgtaagtgaaaatgtttatgcaggaaatgcaatgagccggcgcgcaacctatatgtatggtgcattattgcccaaaagcgaaacaggccagattgatgctggtttaggaaaaacaatatcactgggcaatatcagcttaattccgcctactgatgttattcgtaaaacaggtgaaaaacgaatgattgacggcgtcgagatggtctttcaaatggcgccccatactgaagctccggctgaaatgcttatttatttcccaaaacagcgggcattatgcatggcagaagatgcgactcataccttacacaatctttataccttgcgaggagcacaagttagagatcccgcgagttggtggaaaacaatcaatgaagcgattgaacggtgggggaaccaatctgatgtagtatttgctcaacatcattggcctatgtggggttcagaaaacattgtgaattatttaaaaaaacaaagagatctttacaaatatatccacgatcaaacacttcatatgataaatcaagggtataccctaactgaagtgggtaatcggcttacattacccccatcgttagcgagtgaatggtataatcgaggctactatggttccgtgagtcataatgcgaaagcagtttatcaacgttatatcggttggtatgattccaatccggcccatctcaatcctttatcccccgcggaagccggaaaacgctatgttgaatttatgggaggagaagaagccgttatccacaaagcacgggaatactaccaaaaaggggagtatcgatgggtggctgaagtcctgaatcacgttgtttttgccaatcctaataacaaagccgcacgttatttagaagccgatgcgtttgaacagctgggttatcaatctgaaaatgcaacctggcgaaatgaatatttgatgggagcttacgaacttcgtcatggcgtccctcatgtggcaggaactgaaacggcgagtcccgatacactacgtgcgatgcccatagaaatgtatcttgattttatgggtattcgattgaatagccataaagcagaaggtaaaaaatttaaaattaatctcaatttaacggataaaaaccaatcctatgcacttgaaatagaccattcagtattgatctatacgcccaataaacattttaaagatgccgatgtcagcttaaatcttaaaagaagtacgtttgataagctcaccttaaagcaagaaaatatgatgcacgatatatcaactggtgatattcaattagaaggtaaccaacaaaagcttgatgcatttatgaatttatttgataattttccgcccatgtttaatattattacgccgaattaa

SEQ ID NO: 12982 - protein, 654 aa, Rickettsiella grylli
MFWKMIPFFLLVLGLNVYADDLTPKAASQFTKSANQSFLNKLPFHNKKAFDDAKAHFIGNAPDLEIKNKHGQVIWSMKNYAFIPASFQAPSTVNPSLWHQARLNMNYGLYHVKDNIYQVRGYDLSNMDIIEGREGLIIIDPLLTEETANAALALYYQHRPKKPVIAVIYTHSHADHYGGVKGIVTPESVANGKVKIIAPEGFLSAAVSENVYAGNAMSRRATYMYGALLPKSETGQIDAGLGKTISLGNISLIPPTDVIRKTGEKRMIDGVEMVFQMAPHTEAPAEMLIYFPKQRALCMAEDATHTLHNLYTLRGAQVRDPASWWKTINEAIERWGNQSDVVFAQHHWPMWGSENIVNYLKKQRDLYKYIHDQTLHMINQGYTLTEVGNRLTLPPSLASEWYNRGYYGSVSHNAKAVYQRYIGWYDSNPAHLNPLSPAEAGKRYVEFMGGEEAVIHKAREYYQKGEYRWVAEVLNHVVFANPNNKAARYLEADAFEQLGYQSENATWRNEYLMGAYELRHGVPHVAGTETASPDTLRAMPIEMYLDFMGIRLNSHKAEGKKFKINLNLTDKNQSYALEIDHSVLIYTPNKHFKDADVSLNLKRSTFDKLTLKQENMMHDISTGDIQLEGNQQKLDAFMNLFDNFPPMFNIITPN

SEQ ID NO: 12983 - DNA, 1914 bp, marine gamma proteobacterium HTCC2143
  CDS (1)..(1914): transl_table=11
atgcctgatagcaaaaaaattgacgacagcgcagaaatcaccgacgcgacttcggactttcatgcgtggattcgggactttcttcccttcgaagatcacacggacttcgaagatgctaatcgaggctttatcgcccgctggcctgaagatcagatcatgcgagcgaatggccaaccatcctgggatataaaagcccacgagtacatcaagggggaatgccctccttcggtcaatccatcgcattggcggcaggcacaactgaatagtatccatggtttgttcaaagttaccgacagattgtggcaggttcggggttacgatctggccaacatctctttcattgccggtgacactggctggattgtaatagataccgggatgaccgcagagtttgccgcagccgcgttaaaattagcaaatgatgaactcggagagcgaccaatcaccggagtaatctatacacactcccatgttgatcactatggtggatctcgtgcgataatcaccgaggaggacgccgaagctcgtggcgtgccgattattgcaccgctcgggtttgttgaagaagctgtaagcgaaaatattatagccggggctaccatgcgccgccgagctacctacatgtacggcttactgctgcctaacaaccccctcggccatgttgatgttgggcttgggcccgggcattctagcggtagcatcggccttgtcgcgccaaacgatattatatcgaagaccggagaagagcgaattgtcgacggcgttaaagtgcagtttcaatacacccctgatgctgaagcccccgcggaaatgatgttttactttcctgagttaaaagcattatgtacctctgaagtcgtcactcatattttgcacaacgtctatacgcctaggggcgcaaaagtccgtgacgcacttgcttgggctaagtatatctacgagttaatggagttatttcctggggctgatgtcgtttttgcttcacatcactggccgatctggggcactgaaaaagtacagcaatatctgggtttgcagcgtgacctgtataaatatcttcatgacgaaaccctccggctagcaaatcacgggctaacgcccatcgaaattgcggaagaaattaaactacctgaaagcctctcgaaagaatttgctaaccgagattattatgggactgtcaaccacaacgttaaagcaatctatcagctttattttggctggttcgacgctaaccctgccaaccttcatccactgccaccacagcaatctgctgagaaatatgtcgaatttatgggaggggcggactcaattgtagaaagggctgcagactgttaccagcgaggagaattccgctgggtagctcaggtcttgaatcatgttgttttcgcggatccaagccataaagcagcgcgagaactgctagcccgcgcttatactcaaatgggctatcaggcagaaggcggtccctggagagacttttatcttagcggcgcgcaagaacttcgcttcggcgctccaaaatcccgagctatcgcctcggccggaaccgttgatacgctaaaggctgttcccatcaatttgttttttgatctcttagccgtacgtctcaatgggccaaaggccgctaaaacatcattttcactcaattttgttttccccgattctggcgaaaaactttttgccagtgttggtaatggtgttttgaactacatcgatggtcggacgcaggatactgctgacagctcggttaccatgtctcgtcagaactggaacaagctttcggcaggtgacacaacactggacgaattaacagacagtggacatattttgattagcggcaacgaagacactctcgctaaacttttttcattgcttgacagttttgaagtttttttcaatattattgaaccatag

SEQ ID NO: 12984 - protein, 637 aa, marine gamma proteobacterium HTCC2143
MPDSKKIDDSAEITDATSDFHAWIRDFLPFEDHTDFEDANRGFIARWPEDQIMRANGQPSWDIKAHEYIKGECPPSVNPSHWRQAQLNSIHGLFKVTDRLWQVRGYDLANISFIAGDTGWIVIDTGMTAEFAAAALKLANDELGERPITGVIYTHSHVDHYGGSRAIITEEDAEARGVPIIAPLGFVEEAVSENIIAGATMRRRATYMYGLLLPNNPLGHVDVGLGPGHSSGSIGLVAPNDIISKTGEERIVDGVKVQFQYTPDAEAPAEMMFYFPELKALCTSEVVTHILHNVYTPRGAKVRDALAWAKYIYELMELFPGADVVFASHHWPIWGTEKVQQYLGLQRDLYKYLHDETLRLANHGLTPIEIAEEIKLPESLSKEFANRDYYGTVNHNVKAIYQLYFGWFDANPANLHPLPPQQSAEKYVEFMGGADSIVERAADCYQRGEFRWVAQVLNHVVFADPSHKAARELLARAYTQMGYQAEGGPWRDFYLSGAQELRFGAPKSRAIASAGTVDTLKAVPINLFFDLLAVRLNGPKAAKTSFSLNFVFPDSGEKLFASVGNGVLNYIDGRTQDTADSSVTMSRQNWNKLSAGDTTLDELTDSGHILISGNEDTLAKLFSLLDSFEVFFNIIEP

SEQ ID NO: 12985 - DNA, 1842 bp, marine gamma proteobacterium HTCC2080
  CDS (1)..(1842): transl_table=11
atgaatcagggtgtggcagcgtctcttgatcttaaagacccccaagatttcaacgacgcaaggcgtggcttaattgcccgagccgaggatctgcaggtaaacatggcggatggctccgcggtatggaacctcagcgactatgactttattcatggagatgcgcctgcaagcgtgaatcccagcctgtggcgacaagagcggttgaataatatccatgggctgtttgaggtcactcaaggtgtttaccagttacggggctttgatctctctaatatgagtattattgaaggcgaacgtggctggattctggtagacccattaacaactagggaaaccgcggccgccgcactggccttcgctcgtcagcagttgggttatcggccggtgacagcggttattatcacccattcacacatcgaccactttggcggcgtacttgcggttttggaagaaaatggcgagaccgaaataatagcgcctcaaggttttatgagcgaggccaccagcgaaaatgttattgctggaacgacaatgagccgtcgctcaatgtttatgtatggcagtcagctagagcgctctgctttagggcatgtaggctcggggctgggtaaggggcccgcttttgggagtcctgggctggcaaccccgacccggataatttctcaaacgggggaaaaggcgaagattgatggcattaactttatctttcagaacgctgctggctcggaagcacccgcagagctaaccttttatttgcctgaaaaaaaggcgttttgcggtgcggaagttgtgtcgcgcaatatgcataacctatatacgttgcggggagcccacgttcgggacgcgcgtaaatggagttactacattaatgaggctatagagatttttcctgagatggaggtctattttgctagccatcactggccgatgtggggcaatgacgacattgtagattttctcaaaaagcagcgagacggttaccggtacattcatgatcaaactttacgtctagcctctcagggacatactccgggtgagattgccgagaccatacggcttcctactgcactgcgaaacagttttgctaatcgtggttattacggaacgttgaagcataattctcgcgctgtataccaacgctatttcggctggtacgacggcaatcctgcaagtttagacccactgcctgaggttgagtcctcaaagcggtacgtcgcggcgatgggtggtagcgacggcgtgatggcaaccgcgaagtctgcgtttgatagtggtgagtaccgctgggttgctgagcttctcaatcacttggtgttcgctgagcccaatcatacagaggcaaagatgctgttggcgcaaagttatgaccagctggggtatcaggctgagtcaggtccttggcgtgatgtgtatttgacgggcgctctagagcttcgaagaggtccgccctcacagggcctaggcattgctaatgccgtcgatttgatacgacaaacgccaatcagtgaatttatgcagcttattgctgtcatgcttaacggtgaaaaagcggatggcgaatcttatgtgttcaattttaccttcaccgatttggctgagacctatattttaagtctcgaaaatgcggtgttgcaccagcgcaatggtgaacctgcgataaatgctaatgcgacattgcgcattacccacgaactgtttatcagcatgctggtgggacaggccggcattaaagagacattgttttctgatgatatttctattgaaggatcaaggctggatttgctgcagttttttgccatgctcgatccccccgatgatgtctttaacattgtgacgccctag

SEQ ID NO: 12986 - protein, 613 aa, marine gamma proteobacterium HTCC2080
MNQGVAASLDLKDPQDFNDARRGLIARAEDLQVNMADGSAVWNLSDYDFIHGDAPASVNPSLWRQERLNNIHGLFEVTQGVYQLRGFDLSNMSIIEGERGWILVDPLTTRETAAAALAFARQQLGYRPVTAVIITHSHIDHFGGVLAVLEENGETEIIAPQGFMSEATSENVIAGTTMSRRSMFMYGSQLERSALGHVGSGLGKGPAFGSPGLATPTRIISQTGEKAKIDGINFIFQNAAGSEAPAELTFYLPEKKAFCGAEVVSRNMHNLYTLRGAHVRDARKWSYYINEAIEIFPEMEVYFASHHWPMWGNDDIVDFLKKQRDGYRYIHDQTLRLASQGHTPGEIAETIRLPTALRNSFANRGYYGTLKHNSRAVYQRYFGWYDGNPASLDPLPEVESSKRYVAAMGGSDGVMATAKSAFDSGEYRWVAELLNHLVFAEPNHTEAKMLLAQSYDQLGYQAESGPWRDVYLTGALELRRGPPSQGLGIANAVDLIRQTPISEFMQLIAVMLNGEKADGESYVFNFTFTDLAETYILSLENAVLHQRNGEPAINANATLRITHELFISMLVGQAGIKETLFSDDISIEGSRLDLLQFFAMLDPPDDVFNIVTP

SEQ ID NO: 12987 - DNA, 1986 bp, Escherichia coli B
  CDS (1)..(1986): transl_table=11
atgaataactctcggttattccgtttgagcaggattgttattgcgttaactgccgccagcggcatgatggtaaataccgctaacgcgaaagaggaagcgaaagccgccactcaatatacccaacaggttaatcagaattacgccaaatcattaccgtttagcgatcgtcaggattttgacgatgcccagcgtggatttatcgccccgctgctggatgaaggtattctgcgtgatgcgaacggtaaagtttactaccgcgcggacgattacaaatttgatattaatgccgcagcgccggaaaccgtaaaccccagcctgtggcgtcagtcgcaaatcaacggtatttctggcctgttcaaagtcaccgataaaatgtatcaggtgcgcggccaggatatctctaacattacgttcgttgagggcgagaaaggcattattgttatcgacccgctggtgacgccgcctgccgcaaaagccgcacttgacctttacttccagcatcgtccgcaaaaaccgattgttgccgttatctacactcacagccacaccgaccactatggtggcgtgaaaggcattatctctgaagccgatgttaaatccggcaaagttcaggtgattgcccctgcaggctttatggacgaagccatcagcgaaaacgtgctggcgggtaacatcatgagccgccgtgcgctctactcttacggtctgttactgccgcacaacgcgcaaggcaacgtgggtaatggccttggcgtgacgctggcaacgggcgacccgagcattattgcaccgactaaaactatcgtccgaactggcgagaagatgattatcgacggcctggagtttgacttcctgatgaccccaggtagcgaagcgccagccgaaatgcacttctatattccggccctgaaagccctgtgtaccgccgagaacgccacgcataccctgcacaacttctacactctacgcggcgcgaaaacccgcgacaccagcaagtggaccgagtatctgaacgaaacgctggatatgtggggtaacgacgcggaagtcctgtttatgccgcacacctggccggtctggggcaataagcatatcaatgattatattggtaaatatcgcgatactatcaagtacattcacgaccagaccctgcacctggcgaaccagggctacaccatgaatgaaatcggcgacatgattaagctgccgcctgcacttgccaataactgggccagccgtggctattacggttctgtcagccacaacgcccgcgcggtgtataacttctatcttggctattacgacggtaacccggctaacctgcatccgtatggtcaggtggagatgggtaaacgttacgtgcaggcgctgggcggttctgcccgtgtcatcaacctggcgcaagaagcgaacaagcaaggtgattaccgctggtcggcagaactgctgaaacaggtgattgccgccaacccgggtgaccaggtcgcgaagaatctgcaagcgaataactttgaacagctgggctatcaggccgagtccgccacctggcgcggtttctacctgaccggcgcgaaagagctgcgcgaaggggtgcataagttcagccacggcaccaccggttccccggacaccattcgcgggatgtcggtcgaaatactgttcgactttatgtccgttcgcctcgatagcgcgaaagccgcgggtaaaaatatcagcctgaacttcaatatgggcaacggcgataacctcaacctgacgctgaacgatagtgtgcttaactaccggaaaacgctgcaaccgcaagccaacgcctctttctacatcagccgtgaagatctgcacgccgtgctgaccggacaggcaaaaatggcggatctggtaaaagcgaagaaagccaaaattattggcaatggcgcgaaactggaagaaattattgcctgtctggataatttcgatttgtgggtgaatatcgtaaccccaaattaa

SEQ ID NO: 12988 - protein, 661 aa, Escherichia coli B
MNNSRLFRLSRIVIALTAASGMMVNTANAKEEAKAATQYTQQVNQNYAKSLPFSDRQDFDDAQRGFIAPLLDEGILRDANGKVYYRADDYKFDINAAAPETVNPSLWRQSQINGISGLFKVTDKMYQVRGQDISNITFVEGEKGIIVIDPLVTPPAAKAALDLYFQHRPQKPIVAVIYTHSHTDHYGGVKGIISEADVKSGKVQVIAPAGFMDEAISENVLAGNIMSRRALYSYGLLLPHNAQGNVGNGLGVTLATGDPSIIAPTKTIVRTGEKMIIDGLEFDFLMTPGSEAPAEMHFYIPALKALCTAENATHTLHNFYTLRGAKTRDTSKWTEYLNETLDMWGNDAEVLFMPHTWPVWGNKHINDYIGKYRDTIKYIHDQTLHLANQGYTMNEIGDMIKLPPALANNWASRGYYGSVSHNARAVYNFYLGYYDGNPANLHPYGQVEMGKRYVQALGGSARVINLAQEANKQGDYRWSAELLKQVIAANPGDQVAKNLQANNFEQLGYQAESATWRGFYLTGAKELREGVHKFSHGTTGSPDTIRGMSVEILFDFMSVRLDSAKAAGKNISLNFNMGNGDNLNLTLNDSVLNYRKTLQPQANASFYISREDLHAVLTGQAKMADLVKAKKAKIIGNGAKLEEIIACLDNFDLWVNIVTPN

SEQ ID NO: 12989 - DNA, 1986 bp, Shewanella sp
  CDS (1)..(1986): transl_table=11
atgaaacagactctaatggctatctcaatcatgtcgcttttttcattcaatgcgctagcagcgcaacatgaacatgaccacatcactgttgattacgaagggaaagccgcaacagaacacaccatagctcacaaccaagctgtagctaaaacacttaactttgccgacacgcgtgcatttgagcaatcgtctaaaaatctagtcgccaagtttgataaagcaactgccgatatattacgtgccgaatttgcttttattagcgatgaaatccctgactcggttaacccgtctctctaccgtcaggctcagcttaatatggtgcctaatggtctgtataaagtgagcgatggcatttaccaggtccgcggtaccgacttatctaaccttacacttatccgcagtgataacggttggatagcatacgatgttttgttaaccaaagaagcagcaaaagcctcactacaatttgcgttaaagaatctacctaaagatggcgatttacccgttgttgcgatgatttactcccatagccatgcggaccactttggcggagctcgcggtgttcaagagatgttccctgatgtcaaagtctacggctcagataacatcactaaagaaattgtcgatgagaacgtacttgccggtaacgccatgagccgccgcgcagcttatcaatacggcgcaacactgggcaaacatgaccacggtattgttgatgctgcgctaggtaaaggtctatcaaaaggtgaaatcacttacgtcgccccagactacaccttaaacagtgaaggcaaatgggaaacgctgacgattgatggtctagagatggtgtttatggatgcctcgggcaccgaagctgagtcagaaatgatcacttatattccctctaaaaaagcgctctggacggcggagcttacctatcaaggtatgcacaacatttatacgctgcgcggcgctaaagtacgtgatgcgctcaagtggtcaaaagatatcaacgaaatgatcaatgcctttggtcaagatgtcgaagtgctgtttgcctcgcactctgcgccagtgtggggtaaccaagcgatcaacgatttcttacgcctacagcgtgataactacggcctagtgcacaatcaaaccttgagacttgccaacgatggtgtcggtatacaagatattggcgatgcgattcaagacacgattccagagtctatctacaagacgtggcataccaatggttaccacggcacttatagccataacgctaaagcggtttataacaagtatctaggctacttcgatatgaacccagccaaccttaatccgctgccaaccaagcaagaatctgccaagtttgtcgaatacatgggcggcgcagatgccgcaattaagcgcgctaaagatgattacgctcaaggtgaataccgctttgttgcaacggcattaaataaggtggtgatggccgagccagaaaatgactccgctcgtcaattgctagccgatacctatgagcaacttggttatcaagcagaaggggctggctggagaaacatttacttaactggcgcacaagagctacgagtaggtattcaagctggcgcgcctaaaaccgcatcggcagatgtcatcagtgaaatggacatgccgactctatttgacttcctcgcggtgaagattgatagtcaacaggcggctaagcacggcttagttaagatgaatgttatcacccctgatactaaagatattctctatattgagctaagcaacggtaacttaagcaacgcagtggtcgacaaagagcaagcagctgacgcaaaccttatggttaataaagctgacgttaaccgcatcttacttggccaagtaaccctaaaagcgttattagccagcggcgatgccaagctcactggtgataaaacggcatttagtaaaatagccgatagcatggtcgagtttacacctgacttcgaaatcgtaccaacgcctgttaaatga

SEQ ID NO: 12990 - protein, 661 aa, Shewanella sp
MKQTLMAISIMSLFSFNALAAQHEHDHITVDYEGKAATEHTIAHNQAVAKTLNFADTRAFEQSSKNLVAKFDKATADILRAEFAFISDEIPDSVNPSLYRQAQLNMVPNGLYKVSDGIYQVRGTDLSNLTLIRSDNGWIAYDVLLTKEAAKASLQFALKNLPKDGDLPVVAMIYSHSHADHFGGARGVQEMFPDVKVYGSDNITKEIVDENVLAGNAMSRRAAYQYGATLGKHDHGIVDAALGKGLSKGEITYVAPDYTLNSEGKWETLTIDGLEMVFMDASGTEAESEMITYIPSKKALWTAELTYQGMHNIYTLRGAKVRDALKWSKDINEMINAFGQDVEVLFASHSAPVWGNQAINDFLRLQRDNYGLVHNQTLRLANDGVGIQDIGDAIQDTIPESIYKTWHTNGYHGTYSHNAKAVYNKYLGYFDMNPANLNPLPTKQESAKFVEYMGGADAAIKRAKDDYAQGEYRFVATALNKVVMAEPENDSARQLLADTYEQLGYQAEGAGWRNIYLTGAQELRVGIQAGAPKTASADVISEMDMPTLFDFLAVKIDSQQAAKHGLVKMNVITPDTKDILYIELSNGNLSNAVVDKEQAADANLMVNKADVNRILLGQVTLKALLASGDAKLTGDKTAFSKIADSMVEFTPDFEIVPTPVK

SEQ ID NO: 12991 - DNA, 1881 bp, Aspergillus oryzae
  CDS (1)..(1881)
atgtcttccacatcctatccacctgaggaccctaccgacaagacgaatgcctcgcgaggactgatcaccagtctagagccctgcgtggtgtactcagacaccgacccggcacgagccatttgggacaatgattcttttgacttcttggcaaaagagtaccctccccatttcacaaacccatctctctggaggcagtcccaactttgccaaaagcagggtctatttggagttcgacctggaatctaccaggtccgggggctcgatctttcgaacatcactttcatcgagtgtccgaacacaaaaggcgtggccgttatcgacccgctcacttctgttgaaacagccaagaaggcccttgaactgtaccaaggccagttcccagatagggctatcaaagctttgatctacacccattcccatgtggaccatttcggcggagccaaggccatcgcagatgctgctggcgagggtctgaaggtgtacgcccctaatggattccttgaacatgccgtgagtgagaacgtctatgctggaaacgccatgggccgtcgagcggtctacatgtacggcgagtctctgccacgacagcgggacggccaaatcggctgcggactaggtctcaccgtttcaactggtgtatcgggattgattccgcccacgaccggtatcaagcgtacgggggagaaaatcattgtagatgatgatctggaaatcgaatgtcaattaactcctggaaccgaggcgccggcggagatgaacatgtatttccctcagtataacgctctctgcatggctgaaaatgctactcacactctccacaacatccaaacactgagaggggctttagtacgcgacgccagagtttgggccaaataccttgatgaggctatcgtgcgctatggaaaggatgcccatgttgtattctctagccatcattggccgacatgggataacgagaacgtcaatgagttcctgaccaagcagcgcgatctatatgcctatctgcataatgaaactctccgtcttctcaacacaggccaaacaggtatagaaatcgccgaaaactttcatcttccaccatccttgaacaacacctggagtgcccgcggctactatggttcgatcagccacaatgtcaaggcgatctacaatcgctacatgggctggctcgacgggaatcctgctcacctatgggaacacacacccgtggcatccgcaaagcgctacgtgaaatgcatgggtgggatagcgaaagtgatcgacttggctaaagagtacacagacgagggagatcttcgtttcgccgcaacactcctcaaccatgctgtctatgctgaccaaaacaatgaccaggctagaagcgagctcgcatcagtttatcgcaaactggggtacggcgcggaaaatggcgtctggcgtaatttttaccttactggagcgcgcgagctgcatccccagaataaacctgtcggttcccagctagccatgtcagctgagttattgatggctcttgatttggagcaattgttcgatactattgctatgcatgttgatggacccaaagcatggggtcggtcactcacgatcgactttatgatcacggacatgagtcggggatggcatttgaacttgagcaatggtgccttgactggccatggaattgagtaccgcgagccgtcgaatgagagagacgcgtctttggtgatctggttgacgcacaaggatctgactgctttgattgctggagacagaaaggatcttggcggcctcaccacggccggagatgtgaaatactgggaaacgttagtgtcattgctcactacgcctgaccctgcgtttgcgatcgtgactcccagagcgattcagggctcatcgacctaa

SEQ ID NO: 12992 - protein, 626 aa, Aspergillus oryzae
MSSTSYPPEDPTDKTNASRGLITSLEPCVVYSDTDPARAIWDNDSFDFLAKEYPPHFTNPSLWRQSQLCQKQGLFGVRPGIYQVRGLDLSNITFIECPNTKGVAVIDPLTSVETAKKALELYQGQFPDRAIKALIYTHSHVDHFGGAKAIADAAGEGLKVYAPNGFLEHAVSENVYAGNAMGRRAVYMYGESLPRQRDGQIGCGLGLTVSTGVSGLIPPTTGIKRTGEKIIVDDDLEIECQLTPGTEAPAEMNMYFPQYNALCMAENATHTLHNIQTLRGALVRDARVWAKYLDEAIVRYGKDAHVVFSSHHWPTWDNENVNEFLTKQRDLYAYLHNETLRLLNTGQTGIEIAENFHLPPSLNNTWSARGYYGSISHNVKAIYNRYMGWLDGNPAHLWEHTPVASAKRYVKCMGGIAKVIDLAKEYTDEGDLRFAATLLNHAVYADQNNDQARSELASVYRKLGYGAENGVWRNFYLTGARELHPQNKPVGSQLAMSAELLMALDLEQLFDTIAMHVDGPKAWGRSLTIDFMITDMSRGWHLNLSNGALTGHGIEYREPSNERDASLVIWLTHKDLTALIAGDRKDLGGLTTAGDVKYWETLVSLLTTPDPAFAIVTPRAIQGSST

SEQ ID NO: 12993 - DNA, 1827 bp, Aspergillus oryzae
  CDS (1)..(1827)
atgaccttctcgccctccttcaatgaccgaaccgattttgataacgctacccgagggtttatccatgcattaaaaccatgtatcatccgaaactcgagtggccgcgtagtgtggaacaacgacgagtacggttttctccaagacgcagaatgccctgccactgccgagccaaaactgtggcgacaaggccaattgaactccatccagggtcttttccaagtaactgacggaatttaccaaattcgaggcttcgatctctcgaacatgaccgtcgttgagggacacaaaggtgttattgtgattgacccgttgacgtcggtcgaatgtgcagcggcggcactagcgctttaccgtgaacaccgcggggaccggccagtaaccggtttgatctattcacactcacatgtagatcatttcggtggagctcagggcgtgctccaacaaggcacaaatacatcgatacctatcatcgccccggagggtttcatggccgaagcgactagcgagaacatctacgtcggcgatgccatgcgccggcgtgcagggtatatgtacggcatgcgattaccaaaagggccagatggtcacattggctgtggccttggaatgatgccgtctagtggaacaatgtcattgattcctccaaatgtctctatctgccacacaggcgagaaacggacggtggatggcattcgtattgagttccaaatggttcctgaaaccgaggcaccggcggagatgaacttctactttcccgagcacaaggcactttgcattgctgaatgcgcaactcattgccttcacaatataatcactcttcgcggggctttggttcgtgacgcgaaggcctgggcacgctatcttgacgaaacagcagtgctctatgggcagaaatccaatgtgctctttgctggccacaactggccgacctggggacaggatgaaatcgtcaagttcatatcggagcaacgagacctctacacctatctccatgaccaaactgtccggatgatgaatatcggcctgacaggcatcgagattgcagagagattcaccctcccaccagcactgcaaatggcgtggcatgcgcagggtttctacggctctgtcagtcataatgtcaagggaatctaccaacgctatctgggttggtttgatgggaatccagcacacttatgggagtacccagcggctgaagctggtcagagatacattgactgtatgggaggtgtagatgaggttgttcgaaaggcaagaaagtatgccagcgaaggtgattcacgctttgcggtgacactattgggccatgtcatagccgctcatcctgaacacaaggagtcaagacttgcgctggcatctgtgtacacgaaactggcatatggctgtgagaatgcgacatggcgcaacatctacctttccggtgcccaggatatgcactctcctcccccgccagatcgtccagaacccccgaagcgcgaatacagggctgcgctatcgatggaacaactgcttactcttctgtcagtccaattggatggacccaaagccgcaacagaatcgtttacgatagacctggatctgcaagaacaaaagcaaagttggcggctgattctgagcaacggagccttgacatatcgcatcaaaacagatcacgacaggtccattgacacgtctggtttgcgtctaacgctcaccaaaaaggaattggtggagatactgaatgggggtggagggatcccagaaaacagctcagagggcgatgtgagcctgctcttcaagttgatgagattggttggggcatccatgcccccagcaagccttttgtaa

SEQ ID NO: 12994 - protein, 608 aa, Aspergillus oryzae
MTFSPSFNDRTDFDNATRGFIHALKPCIIRNSSGRVVWNNDEYGFLQDAECPATAEPKLWRQGQLNSIQGLFQVTDGIYQIRGFDLSNMTVVEGHKGVIVIDPLTSVECAAAALALYREHRGDRPVTGLIYSHSHVDHFGGAQGVLQQGTNTSIPIIAPEGFMAEATSENIYVGDAMRRRAGYMYGMRLPKGPDGHIGCGLGMMPSSGTMSLIPPNVSICHTGEKRTVDGIRIEFQMVPETEAPAEMNFYFPEHKALCIAECATHCLHNIITLRGALVRDAKAWARYLDETAVLYGQKSNVLFAGHNWPTWGQDEIVKFISEQRDLYTYLHDQTVRMMNIGLTGIEIAERFTLPPALQMAWHAQGFYGSVSHNVKGIYQRYLGWFDGNPAHLWEYPAAEAGQRYIDCMGGVDEVVRKARKYASEGDSRFAVTLLGHVIAAHPEHKESRLALASVYTKLAYGCENATWRNIYLSGAQDMHSPPPPDRPEPPKREYRAALSMEQLLTLLSVQLDGPKAATESFTIDLDLQEQKQSWRLILSNGALTYRIKTDHDRSIDTSGLRLTLTKKELVEILNGGGGIPENSSEGDVSLLFKLMRLVGASMPPASLL

SEQ ID NO: 12995 - DNA, 1875 bp, Aspergillus oryzae
  CDS (1)..(1875)
atgagccagccaaccatcaatcctgaggattcgcatcctccaagcctccacatcatcgagcagtggaaggaggtcaaacaaagtctacccttcgatgaccagcaggactttgacgactctagacagggctggagaggtcacctccaccctaaccaggtcaccaatgatcaaggcgtggtgtgggacaacgatgtctacgatttcctgaaggaggacgctccattctcagccaacccaagtctgtggcgccagtcgcaacttactcgcaagaatggactttatcatgtcgccgggcccatctaccaagtgcgtggactcgacctctcgaacacgaccatcattgagggtgacgagggcatcattgtcatcgatcccctcacttcgctggagaccggtgctgctgcactcgccctctatcagaaacatcggggcagcaacagagacgtcaaggctatcatttatacgcactcccacgttgaccacttcggtggggtcaaaggcttcgtcagcgaaaaggatgtcgaggaaaaggacgtcaagatcattgcccccgagggcttcctggagcatgctgtctccgagaacgtctacactggcacttcaatgagccgccgcgccgcgtacatgtacggtgctgccctcgagcgcggaccgagaggtcagatcggtgctggtttgggacagactacatccaccggcacccacaggagaaaagtcaatcatcgatgggatccaaatggagttccgatggcaccggacaccgaggcgccttccgaaatgctcatctggttccccgatctcaacgcactctgtgctgccgaggacgccactcacaccttccacaacatcctgaccctgcgtggcgctgtcgtccgcgatccgcactcctgggccaagtacctcacagagaccattgaccgatacggcaacaaagtcgaggtcgttttcgcccagcctcactggccaacctggggcaatgacaacatcctgaagttcctcacctaccagcgtgacctgtacgcatatgtgcatgaccagaccctctgcctcctgaacaagggatacaacggccctgagatcgccgaaatgctgaccttgcccccggcccttgatcagtcttggtattgccgtggctactacggctctctgagccacaacgtcaaagccatctatcaacgctacgtcggctggttcgacggcaacccagctcatttgtgggagcacaccccagtcgcgaaggccaaaaggtacgtgaaactcattggtgaggatgagatcatcgaacagggtgtcaagggatacctaaaaggagactaccgctgggccgctgaacttctgagtcatgctgtcttcaacaaccctgacaacaaggatgcctgcaacaagctggcagatgtgtacgaacaactgggatacggcgccgaaaacggcacctggagaaacttttacatctccggagcgactgagctgcgcagtggcaactttggcacgcctacaaagacggcctcggcagatgtggcgggccagctcagcccagatatggtcctggacactctcgctatccagattaaaggacctgaggcgtgggataagaagttgcttatggatctcgtcgtttcggatcaagataataaaacttaccattcctggctctctaacggggcactcgtctacagcaccgctgaccagtcggacgctgctcaggtgactctgagtggtactgctaagcagttgactgcgcttgctgtgtatgggcctgatccagaggctttggttaataccggcgttgtcattgatggagatactactgcgctggatatgcttgcgtcgttgcttgatccgggtgatcctaacttcaatattgttactccatga

SEQ ID NO: 12996 - protein, 624 aa, Aspergillus oryzae
MSQPTINPEDSHPPSLHIIEQWKEVKQSLPFDDQQDFDDSRQGWRGHLHPNQVTNDQGVVWDNDVYDFLKEDAPFSANPSLWRQSQLTRKNGLYHVAGPIYQVRGLDLSNTTIIEGDEGIIVIDPLTSLETGAAALALYQKHRGSNRDVKAIIYTHSHVDHFGGVKGFVSEKDVEEKDVKIIAPEGFLEHAVSENVYTGTSMSRRAAYMYGAALERGPRGQIGAGLGQTTSTGTHRRKVNHRWDPNGVPMAPDTEAPSEMLIWFPDLNALCAAEDATHTFHNILTLRGAVVRDPHSWAKYLTETIDRYGNKVEVVFAQPHWPTWGNDNILKFLTYQRDLYAYVHDQTLCLLNKGYNGPEIAEMLTLPPALDQSWYCRGYYGSLSHNVKAIYQRYVGWFDGNPAHLWEHTPVAKAKRYVKLIGEDEIIEQGVKGYLKGDYRWAAELLSHAVFNNPDNKDACNKLADVYEQLGYGAENGTWRNFYISGATELRSGNFGTPTKTASADVAGQLSPDMVLDTLAIQIKGPEAWDKKLLMDLVVSDQDNKTYHSWLSNGALVYSTADQSDAAQVTLSGTAKQLTALAVYGPDPEALVNTGVVIDGDTTALDMLASLLDPGDPNFNIVTP

SEQ ID NO: 12997 - DNA, 1896 bp, Rhodococcus ruber
  CDS (1)..(1896): transl_table=11
atgactgttaagggaaagtcggcgacagcgacgaccaaggctgcgaaccgcgccgtgtctgctcgcctggacttcgacgacaagacggcgttcgacgatgcgcgccgtggcttcgtcgccacactcgatccgctggtgatcagaaacgctcaaggtcatgtcgtgtgggacggcgatacctacgccttcctcgccgacgaggcaccggacacggtgaacccgagcctgtggcgcatgtcgcaactacatacgattcacggcctgttcaaggtcgtcgacggcatctatcaggtgcgcggcttcgacatctccaacatgactctggtcgagggcgacaccggatacgtcgtcatcgatccgctgacctcggccgaatgcgcttcggcggccatggatctggtgcgcagggaactcggtgaccggccggtgacggcgatcgtctacacccacagccacgtcgatcatttcggtggtgtgaaagggctcgtgtcggaggcggacatctccgcgggttccgtgcggatcgtcgcgccgacggggttcctggcccacacggtcagcgagaacgtctacgccggcaacgcgatgaaccgccgtgcgcagtacatgcacggcggcaagctgccgcacgggccgagcggggtggtctcggccggtctcggcctcgggctctccaccggcaccgtcacgctgctcgagcccaccgattacgtcaccgagaccggtcaggaactcgtgctcgacggggtgcggttcgagtttcagtacacgcccgacgccgaggcaccggccgagatgaacttctacctgcccgatttccgggcgctgtgcatggcggagaacgtctctcaccacatgcacaacctgtacaccccccgcggcgcgcagattcgtgacgctgccgcgtggagcgactacatccatgccgcgatcgggctctatgcgcaccggtcggacgtgctgttcatctgtcaccactggccggtgtggggtcggcagaagctcaccgacttcttggagcagcagcgggacctgtaccgctacatccacgacgagaccctgcgtctggccgcccacggccacacgctggtcgagatcgccgaactgatcgagctgcccgagccgctgggctcgtcgtggtcgagccgcggctactacggcaccttgaaccacaacgccaaggcggtctatcagaagtacctcggctggttcgacggcaatccggccaccttgcaccagcatccaccggtcgaggcgggtaagcgctacgtcgaatacatgggcggagccgacgccgtgctgcgcaatgcgcgcaaatcgttcgacgacggggactaccggtgggtggcccaggtggtcaaccatgtggtgttcgccgagccggacaaccagcaggcacgggaactgcaggcggacgcgctcgaacagctcggctaccaggccgaatccgcttcgtggcgcaacttctatctcaccggtgcccaggaactgcgtcacggtgtggtggtggagtcgacctcgttcgacacctcggacgtgctggccgcgatgacgacggacatgatgctcaagtatctggccatccgtctgaacggaccgaaggccgccggccgtgccttgcgggtcgacctgcacgtgaccgacaccgacgagcgccggctgctgcaggtgaccaacggtgtcctcgtccacacggcgacgagcgcgccccaggatgcggacgtgtcggtcgcgctcacccgggccgcgctcggatcgctgacgctcggcggcacggccctcgaccggtgcattgccgacggcagcgtctcggtcggcggcaatgccgacgtgcttcgcgaactgttcgcgctgctcgacactttcgaccggttcttcgacatcgtcaccccctga

SEQ ID NO: 12998 - protein, 631 aa, Rhodococcus ruber
MTVKGKSATATTKAANRAVSARLDFDDKTAFDDARRGFVATLDPLVIRNAQGHVVWDGDTYAFLADEAPDTVNPSLWRMSQLHTIHGLFKVVDGIYQVRGFDISNMTLVEGDTGYVVIDPLTSAECASAAMDLVRRELGDRPVTAIVYTHSHVDHFGGVKGLVSEADISAGSVRIVAPTGFLAHTVSENVYAGNAMNRRAQYMHGGKLPHGPSGVVSAGLGLGLSTGTVTLLEPTDYVTETGQELVLDGVRFEFQYTPDAEAPAEMNFYLPDFRALCMAENVSHHMHNLYTPRGAQIRDAAAWSDYIHAAIGLYAHRSDVLFICHHWPVWGRQKLTDFLEQQRDLYRYIHDETLRLAAHGHTLVEIAELIELPEPLGSSWSSRGYYGTLNHNAKAVYQKYLGWFDGNPATLHQHPPVEAGKRYVEYMGGADAVLRNARKSFDDGDYRWVAQVVNHVVFAEPDNQQARELQADALEQLGYQAESASWRNFYLTGAQELRHGVVVESTSFDTSDVLAAMTTDMMLKYLAIRLNGPKAAGRALRVDLHVTDTDERRLLQVTNGVLVHTATSAPQDADVSVALTRAALGSLTLGGTALDRCIADGSVSVGGNADVLRELFALLDTFDRFFDIVTP

SEQ ID NO: 12999 - DNA, 1986 bp, Escherichia coli
  CDS (1)..(1986): transl_table=11
atgaataactctcggttattccgtttgagcaggattgttattgcgttaactgccgccagcggcatgatggtaaataccgctaacgcgaaagaggaagcgaaagccgccactcaatatacccaacaggttaatcagaattacgccaaatcattaccgtttagcgatcgtcaggattttgacgatgcccagcgtggatttatcgccccgctgctggatgaaggtattctgcgtgatgcgaacggtaaagtttactaccgcgcggacgattacaaatttgatattaatgccgcagcgccggaaaccgtaaaccccagcctgtggcgtcagtcgcaaatcaacggtatttctggcctgttcaaagtcaccgataaaatgtatcaggtgcgcggccaggatatctctaacattacgttcgttgagggcgagaaaggcattattgttatcgacccgctggtgacgccgcctgccgcaaaagccgcacttgacctttacttccagcatcgtccgcaaaaaccgattgttgccgttatctacactcacagccacaccgaccactatggtggcgtgaaaggcattatctctgaagccgatgttaaatccggcaaagttcaggtgattgcccctgcaggctttatggacgaagccatcagcgaaaacgtgctggcgggtaacatcatgagccgccgtgcgctctactcttacggtctgttactgccgcacaacgcgcaaggcaatgtgggtaatggccttggcgtgacgctggcaacgggcgacccgagcattattgcaccgacgaaaactatcgtcagaactggcgagaagatgattatcgacggcctggagtttgacttcctgatgaccccaggtagcgaagcgccagccgaaatgcacttctatattccggccctgaaagccctgtgtaccgccgagaacgccacgcataccctgcacaacttctacactctgcgcggcgcgaaaacccgcgacaccagcaagtggaccgagtatctgaacgaaacgctggatatgtggggtaacgacgcggaagtgctgtttatgccgcacacctggccggtctggggcaataagcatatcaatgattatattggtaaataccgcgataccatcaagtacattcacgaccagaccctgcacctggcgaaccagggctacaccatgaatgaaatcggcgacatgattaagctgccgcctgcacttgccaataactgggccagccgcggctattacggttctgtcagccacaacgcccgcgcggtgtataacttctatcttggctattacgacggtaacccggctaacctgcatccgtatggtcaggtggagatgggtaaacgttacgtgcaggcgctgggcggttctgcccgtgtcatcaacctggcgcaagaagcgaacaagcaaggtgattaccgctggtcggcagaactgctgaaacaggtgattgccgccaacccgggtgaccaggtcgcgaagaatctgcaagcgaataactttgaacagctgggctatcaggccgagtccgccacatggcgcggtttctacctgaccggcgcgaaagagctgcgcgaaggggtgcataagttcagccacggcaccaccggttccccggacaccattcgcgggatgtcggtcgaaatgctgttcgactttatggccgttcgcctcgatagcgcgaaagctgcgggtaaaaatatcagcctgaacttcaatatgagcaacggcgataacctcaacctgacgctgaacgatagcgtgcttaactaccggaaaacgctgcaaccgcaagccgacgcctctttctacatcagccgtgaagatctgcacgccgtgctgaccggacaagccaaaatggcggatctggtaaaagcgaagaaagccaaaattattggcaatggcgcgaaactggaagaaattatcgcctgtctggataatttcgatttgtgggtgaatatcgtaaccccaaattaa

SEQ ID NO: 13000 - protein, 661 aa, Escherichia coli
MNNSRLFRLSRIVIALTAASGMMVNTANAKEEAKAATQYTQQVNQNYAKSLPFSDRQDFDDAQRGFIAPLLDEGILRDANGKVYYRADDYKFDINAAAPETVNPSLWRQSQINGISGLFKVTDKMYQVRGQDISNITFVEGEKGIIVIDPLVTPPAAKAALDLYFQHRPQKPIVAVIYTHSHTDHYGGVKGIISEADVKSGKVQVIAPAGFMDEAISENVLAGNIMSRRALYSYGLLLPHNAQGNVGNGLGVTLATGDPSIIAPTKTIVRTGEKMIIDGLEFDFLMTPGSEAPAEMHFYIPALKALCTAENATHTLHNFYTLRGAKTRDTSKWTEYLNETLDMWGNDAEVLFMPHTWPVWGNKHINDYIGKYRDTIKYIHDQTLHLANQGYTMNEIGDMIKLPPALANNWASRGYYGSVSHNARAVYNFYLGYYDGNPANLHPYGQVEMGKRYVQALGGSARVINLAQEANKQGDYRWSAELLKQVIAANPGDQVAKNLQANNFEQLGYQAESATWRGFYLTGAKELREGVHKFSHGTTGSPDTIRGMSVEMLFDFMAVRLDSAKAAGKNISLNFNMSNGDNLNLTLNDSVLNYRKTLQPQADASFYISREDLHAVLTGQAKMADLVKAKKAKIIGNGAKLEEIIACLDNFDLWVNIVTPN

SEQ ID NO: 13001 - DNA, 24 bp, Artificial sequence
  primer
atgattggtgcctttaagaggaac

SEQ ID NO: 13002 - DNA, 22 bp, Artificial sequence
  primer
tcaagtgcttccccccataggc

SEQ ID NO: 13003 - protein, 654 aa, Artificial sequence
  consensus sequence
  Variant (2)..(4): Xaa in position 2 to 4 is any amino acid
  Variant (6)..(7): Xaa in position 6 to 7 is any amino acid
  Variant (10)..(11): Xaa in position 10 to 11 is any amino acid
  Variant (13)..(14): Xaa in position 13 to 14 is any amino acid
  Variant (16)..(31): Xaa in position 16 to 31 is any amino acid
  Variant (32)..(40): Xaa in position 32 to 40 is any or no amino acid
  Variant (42)..(42): Xaa in position 42 is any amino acid
  Variant (44)..(48): Xaa in position 44 to 48 is any amino acid
  Variant (49)..(52): Xaa in position 49 to 52 is any or no amino acid
  Variant (54)..(55): Xaa in position 54 to 55 is any amino acid
  Variant (57)..(57): Xaa in position 57 is any amino acid
  Variant (63)..(65): Xaa in position 63 to 65 is any amino acid
  Variant (67)..(70): Xaa in position 67 to 70 is any amino acid
  Variant (71)..(71): Xaa in position 71 is any or no amino acid
  Variant (74)..(75): Xaa in position 74 to 75 is any amino acid
  Variant (77)..(80): Xaa in position 77 to 80 is any amino acid
  Variant (81)..(81): Xaa in position 81 is any or no amino acid
  Variant (87)..(87): Xaa in position 87 is any amino acid
  Variant (89)..(90): Xaa in position 89 to 90 is any amino acid
  Variant (92)..(92): Xaa in position 92 is any amino acid
  Variant (94)..(96): Xaa in position 94 to 96 is any amino acid
  Variant (98)..(99): Xaa in position 98 to 99 is any amino acid
  Variant (100)..(101): Xaa in position 100 to 101 is any or no amino acid
  Variant (103)..(106): Xaa in position 103 to 106 is any amino acid
  Variant (108)..(108): Xaa in position 108 is any amino acid
  Variant (110)..(112): Xaa in position 110 to 112 is any amino acid
  Variant (114)..(114): Xaa in position 114 is any amino acid
  Variant (116)..(116): Xaa in position 116 is any amino acid
  Variant (119)..(129): Xaa in position 119 to 129 is any amino acid
  Variant (130)..(133): Xaa in position 130 to 133 is any or no amino acid
  Variant (135)..(138): Xaa in position 135 to 138 is any amino acid
  Variant (141)..(141): Xaa in position 141 is any amino acid
  Variant (145)..(145): Xaa in position 145 is any amino acid
  Variant (148)..(148): Xaa in position 148 is any amino acid
  Variant (151)..(152): Xaa in position 151 to 152 is any amino acid
  Variant (154)..(160): Xaa in position 154 to 160 is any amino acid
  Variant (161)..(165): Xaa in position 161 to 165 is any or no amino acid
  Variant (167)..(168): Xaa in position 167 to 168 is any amino acid
  Variant (169)..(169): Xaa in position 169 is any or no amino acid
  Variant (172)..(172): Xaa in position 172 is any amino acid
  Variant (175)..(177): Xaa in position 175 to 177 is any amino acid
  Variant (179)..(180): Xaa in position 179 to 180 is any amino acid
  Variant (183)..(184): Xaa in position 183 to 184 is any amino acid
  Variant (187)..(187): Xaa in position 187 is any amino acid
  Variant (190)..(190): Xaa in position 190 is any amino acid
  Variant (194)..(194): Xaa in position 194 is any amino acid
  Variant (196)..(196): Xaa in position 196 is any amino acid
  Variant (199)..(200): Xaa in position 199 to 200 is any amino acid
  Variant (202)..(206): Xaa in position 202 to 206 is any amino acid
  Variant (208)..(208): Xaa in position 208 is any amino acid
  Variant (210)..(211): Xaa in position 210 to 211 is any amino acid
  Variant (215)..(219): Xaa in position 215 to 219 is any amino acid
  Variant (220)..(220): Xaa in position 220 is any or no amino acid
  Variant (222)..(227): Xaa in position 222 to 227 is any amino acid
  Variant (230)..(231): Xaa in position 230 to 231 is any amino acid
  Variant (233)..(241): Xaa in position 233 to 241 is any amino acid
  Variant (242)..(243): Xaa in position 242 to 243 is any or no amino acid
  Variant (246)..(249): Xaa in position 246 to 249 is any amino acid
  Variant (250)..(250): Xaa in position 250 is any or no amino acid
  Variant (252)..(254): Xaa in position 252 to 254 is any amino acid
  Variant (256)..(257): Xaa in position 256 to 257 is any amino acid
  Variant (261)..(261): Xaa in position 261 is any amino acid
  Variant (263)..(267): Xaa in position 263 to 267 is any amino acid
  Variant (269)..(275): Xaa in position 269 to 275 is any amino acid
  Variant (278)..(283): Xaa in position 278 to 283 is any amino acid
  Variant (286)..(287): Xaa in position 286 to 287 is any amino acid
  Variant (289)..(289): Xaa in position 289 is any amino acid
  Variant (293)..(294): Xaa in position 293 to 294 is any amino acid
  Variant (297)..(299): Xaa in position 297 to 299 is any amino acid
  Variant (301)..(315): Xaa in position 301 to 315 is any amino acid
  Variant (316)..(318): Xaa in position 316 to 318 is any or no amino acid
  Variant (320)..(323): Xaa in position 320 to 323 is any amino acid
  Variant (325)..(325): Xaa in position 325 is any amino acid
  Variant (328)..(328): Xaa in position 328 is any amino acid
  Variant (331)..(333): Xaa in position 331 to 333 is any amino acid
  Variant (334)..(338): Xaa in position 334 to 338 is any or no amino acid
  Variant (340)..(345): Xaa in position 340 to 345 is any amino acid
  Variant (349)..(349): Xaa in position 349 is any amino acid
  Variant (351)..(353): Xaa in position 351 to 353 is any amino acid
  Variant (358)..(359): Xaa in position 358 to 359 is any amino acid
  Variant (361)..(361): Xaa in position 361 is any amino acid
  Variant (363)..(363): Xaa in position 363 is any amino acid
  Variant (365)..(365): Xaa in position 365 is any amino acid
  Variant (367)..(368): Xaa in position 367 to 368 is any amino acid
  Variant (371)..(376): Xaa in position 371 to 376 is any amino acid
  Variant (377)..(378): Xaa in position 377 to 378 is any or no amino acid
  Variant (380)..(381): Xaa in position 380 to 381 is any amino acid
  Variant (383)..(385): Xaa in position 383 to 385 is any amino acid
  Variant (387)..(389): Xaa in position 387 to 389 is any amino acid
  Variant (394)..(396): Xaa in position 394 to 396 is any amino acid
  Variant (399)..(400): Xaa in position 399 to 400 is any amino acid
  Variant (402)..(402): Xaa in position 402 is any amino acid
  Variant (404)..(405): Xaa in position 404 to 405 is any amino acid
  Variant (407)..(407): Xaa in position 407 is any amino acid
  Variant (409)..(410): Xaa in position 409 to 410 is any amino acid
  Variant (411)..(411): Xaa in position 411 is any or no amino acid
  Variant (413)..(413): Xaa in position 413 is any amino acid
  Variant (416)..(417): Xaa in position 416 to 417 is any amino acid
  Variant (419)..(422): Xaa in position 419 to 422 is any amino acid
  Variant (424)..(429): Xaa in position 424 to 429 is any amino acid
  Variant (432)..(434): Xaa in position 432 to 434 is any amino acid
  Variant (437)..(443): Xaa in position 437 to 443 is any amino acid
  Variant (445)..(450): Xaa in position 445 to 450 is any amino acid
  Variant (452)..(453): Xaa in position 452 to 453 is any amino acid
  Variant (455)..(463): Xaa in position 455 to 463 is any amino acid
  Variant (465)..(465): Xaa in position 465 is any amino acid
  Variant (467)..(472): Xaa in position 467 to 472 is any amino acid
  Variant (474)..(475): Xaa in position 474 to 475 is any amino acid
  Variant (477)..(477): Xaa in position 477 is any amino acid
  Variant (479)..(481): Xaa in position 479 to 481 is any amino acid
  Variant (487)..(488): Xaa in position 487 to 488 is any amino acid
  Variant (490)..(492): Xaa in position 490 to 492 is any amino acid
  Variant (495)..(497): Xaa in position 495 to 497 is any amino acid
  Variant (499)..(499): Xaa in position 499 is any amino acid
  Variant (502)..(502): Xaa in position 502 is any amino acid
  Variant (506)..(506): Xaa in position 506 is any amino acid
  Variant (508)..(529): Xaa in position 508 to 529 is any amino acid
  Variant (530)..(532): Xaa in position 530 to 532 is any or no amino acid
  Variant (534)..(543): Xaa in position 534 to 543 is any amino acid
  Variant (545)..(565): Xaa in position 545 to 565 is any amino acid
  Variant (566)..(571): Xaa in position 566 to 571 is any or no amino acid
  Variant (573)..(574): Xaa in position 573 to 574 is any amino acid
  Variant (576)..(613): Xaa in position 576 to 613 is any amino acid
  Variant (614)..(627): Xaa in position 614 to 627 is any or no amino acid
  Variant (629)..(646): Xaa in position 629 to 646 is any amino acid
  Variant (647)..(648): Xaa in position 647 to 648 is any or no amino acid
  Variant (650)..(650): Xaa in position 650 is any amino acid
  Variant (653)..(653): Xaa in position 653 is any amino acid
LXXXDXXDFXXAXXGXXXXXXXXXXXXXXXXXXXXXXXXXYXFXXXXXXXXXPXXVXPSLWRXXXLXXXXXGLXXVXXXXXYQVRGXDXXNXTXXXGXXXXGXXXXDXLXXXEXAXAAXXXXXXXXXXXXXXXPXXXXIYXHSHXDHXGGXXGXXXXXXXXXXXXVXXXAPXGFXXXAXXENXXAGXAMXRRAXYXYGXXLXXXXXGXVXXGLGXXXXXXGXXXXXXPTXXIXXXXXXXXXXXDGXXXXXFXXXPXXEAPXEXXXXXPXXXXXXXAEXXXXXXHNXXTXRGAXXRDXXXWXXXXXXXXXXXXXXXXXXVXXXXHXWPXWGXXXXXXXXIXXXXXXQRDXYXXXHDQTXXLXNXGXTXXEIXXXXXXXXPXXLXXXWXXXGYYGXXXHNXXAXYXXYXGXXXDXNPXXLXXXXPXXXXXXYVXXXGGXXXXXXXAXXXXXXGXXRXXXXXXXXXVXAXXXXXXAXXLXAXXXEQLGYXXEXXXWRXXXLXGAXELRXGXXXXXXXXXXXXXXXXXXXXXXXXXDXXXXXXXXXXAXXXXXXXXXXXXXXXXXXXXXXXXXXXNXXLXXXXXXXXXXXXXXXXXXXXXXXXXXXXXXXXXXXXXXXXXXXXXXXXXXXXGXXXXXXXXXXXXXXXXXXXXFXIVXP

SEQ ID NO: 13004 - protein, 51 aa, Artificial sequence
  protein pattern
  Variant (2)..(2): Xaa in position 2 is any amino acid
  Variant (3)..(3): Xaa in position 3 is Ala, Ser or Thr
  Variant (7)..(7): Xaa in position 7 is Ala, Ser or Thr
  Variant (9)..(13): Xaa in position 9 to 13 is any amino acid
  Variant (15)..(17): Xaa in position 15 to 17 is any amino acid
  Variant (18)..(21): Xaa in position 18 to 21 is any or no amino acid
  Variant (23)..(29): Xaa in position 23 to 29 is any amino acid
  Variant (30)..(30): Xaa in position 30 is any or no amino acid
  Variant (33)..(34): Xaa in position 33 to 34 is any amino acid
  Variant (35)..(35): Xaa in position 35 is Ala, Asn, Pro or Thr
  Variant (36)..(36): Xaa in position 36 is any amino acid
  Variant (39)..(39): Xaa in position 39 is Ala, Ser or Val
  Variant (40)..(41): Xaa in position 40 to 41 is any amino acid
  Variant (44)..(44): Xaa in position 44 is Ala, Gly, Pro, Ser or Thr
  Variant (45)..(46): Xaa in position 45 to 46 is any amino acid
  Variant (48)..(50): Xaa in position 48 to 50 is any amino acid
  Variant (51)..(51): Xaa in position 51 is Ile, Leu or Met
PXXEAPXEXXXXXPXXXXXXXAXXXXXXXXHNXXXXRGXXXRDXXXWXXXX

SEQ ID NO: 13005 - protein, 30 aa, Artificial sequence
  protein pattern
  Variant (2)..(3): Xaa in position 2 to 3 is any amino acid
  Variant (5)..(7): Xaa in position 5 to 7 is any amino acid
  Variant (8)..(8): Xaa in position 8 is Phe or Trp
  Variant (9)..(10): Xaa in position 9 to 10 is any amino acid
  Variant (11)..(11): Xaa in position 11 is His or Arg
  Variant (12)..(12): Xaa in position 12 is Asp, Gly or Pro
  Variant (16)..(18): Xaa in position 16 to 18 is any amino acid
  Variant (19)..(19): Xaa in position 19 is Phe or His
  Variant (20)..(20): Xaa in position 20 is Asp or Asn
  Variant (21)..(21): Xaa in position 21 is Ala, Ser or Val
  Variant (22)..(22): Xaa in position 22 is Lys or Arg
  Variant (24)..(24): Xaa in position 24 is any amino acid
  Variant (26)..(27): Xaa in position 26 to 27 is any amino acid
  Variant (29)..(29): Xaa in position 29 is Phe, Ile, Leu, Met or Val
PXXLXXXXXXXXYYGXXXXXXXAXYXXYXG

SEQ ID NO: 13006 - protein, 20 aa, Artificial sequence
  protein pattern
  Variant (2)..(2): Xaa in position 2 is Ile or Val
  Variant (3)..(3): Xaa in position 3 is any amino acid
  Variant (4)..(4): Xaa in position 4 is Ala, Gly or Thr
  Variant (5)..(5): Xaa in position 5 is Ile, Leu, Met or Val
  Variant (6)..(6): Xaa in position 6 is Ile or Val
  Variant (7)..(7): Xaa in position 7 is any amino acid
  Variant (8)..(8): Xaa in position 8 is Ser or Thr
  Variant (10)..(10): Xaa in position 10 is Ala, Pro, Ser or Thr
  Variant (12)..(12): Xaa in position 12 is any amino acid
  Variant (15)..(15): Xaa in position 15 is Phe, Trp or Tyr
  Variant (18)..(19): Xaa in position 18 to 19 is any amino acid
  Variant (20)..(20): Xaa in position 20 is Ala or Gly
PXXXXXXXHXHXDHXGGXXX

SEQ ID NO: 13007 - protein, 16 aa, Artificial sequence
  protein pattern
  Variant (3)..(3): Xaa in position 3 is Ile, Leu or Val
  Variant (6)..(6): Xaa in position 6 is any amino acid
  Variant (8)..(8): Xaa in position 8 is Ile, Leu or Met
  Variant (9)..(9): Xaa in position 9 is Ala or Ser
  Variant (11)..(11): Xaa in position 11 is any amino acid
  Variant (12)..(12): Xaa in position 12 is Ser or Thr
  Variant (13)..(13): Xaa in position 13 is Phe, Ile, Leu or Val
  Variant (14)..(14): Xaa in position 14 is any amino acid
  Variant (15)..(15): Xaa in position 15 is Asp, Glu, Lys or Arg
  Variant (16)..(16): Xaa in position 16 is Cys, Gly, Ser or Thr
YQXRGXDXXNXXXXXX

SEQ ID NO: 13008 - protein, 57 aa, Artificial sequence
  protein pattern
  Variant (2)..(25): Xaa in position 2 to 25 is any amino acid
  Variant (27)..(27): Xaa in position 27 is any amino acid
  Variant (29)..(29): Xaa in position 29 is any amino acid
  Variant (30)..(30): Xaa in position 30 is Ala, Asn, Ser, Thr or Val
  Variant (31)..(31): Xaa in position 31 is any amino acid
  Variant (32)..(32): Xaa in position 32 is Asp, Glu or Thr
  Variant (34)..(34): Xaa in position 34 is Ile, Leu or Met
  Variant (35)..(35): Xaa in position 35 is Ala or Gly
  Variant (37)..(37): Xaa in position 37 is Ala, Gly or Gln
  Variant (38)..(38): Xaa in position 38 is any amino acid
  Variant (40)..(40): Xaa in position 40 is Ala, Cys, Gly, Asn or Ser
  Variant (41)..(43): Xaa in position 41 to 43 is any amino acid
  Variant (45)..(45): Xaa in position 45 is Asp, Gly, Asn or Ser
  Variant (46)..(46): Xaa in position 46 is any amino acid
  Variant (47)..(47): Xaa in position 47 is Phe or Tyr
  Variant (49)..(49): Xaa in position 49 is any amino acid
  Variant (50)..(50): Xaa in position 50 is Ala or Gly
  Variant (52)..(52): Xaa in position 52 is any amino acid
  Variant (56)..(56): Xaa in position 56 is any amino acid
  Variant (57)..(57): Xaa in position 57 is Gly or Ser
GXXXXXXXXXXXXXXXXXXXXXXXXLXAXXXXQXXYXXEXXXXRXXXLXXAXELRXX

SEQ ID NO: 13009 - protein, 55 aa, Artificial sequence
  protein pattern
  Variant (2)..(8): Xaa in position 2 to 8 is any amino acid
  Variant (10)..(12): Xaa in position 10 to 12 is any amino acid
  Variant (13)..(13): Xaa in position 13 is Ala, Ser, Thr or Val
  Variant (14)..(14): Xaa in position 14 is Ala, Ile or Val
  Variant (15)..(15): Xaa in position 15 is any amino acid
  Variant (18)..(18): Xaa in position 18 is Ile, Leu or Val
  Variant (19)..(19): Xaa in position 19 is any amino acid
  Variant (20)..(20): Xaa in position 20 is Ala or Thr
  Variant (22)..(22): Xaa in position 22 is Ala, Gly, Asn, Pro, Ser or Thr
  Variant (23)..(23): Xaa in position 23 is any amino acid
  Variant (25)..(25): Xaa in position 25 is any amino acid
  Variant (28)..(29): Xaa in position 28 to 29 is any amino acid
  Variant (30)..(30): Xaa in position 30 is Phe or Tyr
  Variant (31)..(31): Xaa in position 31 is any amino acid
  Variant (32)..(32): Xaa in position 32 is Phe, His or Tyr
  Variant (34)..(34): Xaa in position 34 is any amino acid
  Variant (35)..(35): Xaa in position 35 is any or no amino acid
  Variant (37)..(38): Xaa in position 37 to 38 is any amino acid
  Variant (39)..(39): Xaa in position 39 is Ala, Asp, Gly, Asn or Ser
  Variant (40)..(41): Xaa in position 40 to 41 is any amino acid
  Variant (42)..(42): Xaa in position 42 is Asp or Gly
  Variant (43)..(43): Xaa in position 43 is any amino acid
  Variant (44)..(44): Xaa in position 44 is Gly, Ile, Leu or Val
  Variant (45)..(45): Xaa in position 45 is Asp, Gly, Asn, Ser or Thr
  Variant (46)..(46): Xaa in position 46 is any amino acid
  Variant (47)..(47): Xaa in position 47 is Ala, Gly or Ser
  Variant (48)..(48): Xaa in position 48 is Ile or Leu
  Variant (49)..(49): Xaa in position 49 is Asp or Gly
  Variant (50)..(52): Xaa in position 50 to 52 is any amino acid
  Variant (53)..(53): Xaa in position 53 is Ala, Pro or Ser
  Variant (54)..(54): Xaa in position 54 is any amino acid
  Variant (55)..(55): Xaa in position 55 is Gly or Asn
VXXXXXXXFXXXXXXENXXXGXXMXRRXXXXXGXXLXXXXXXXXXXXXXXXXXXX

SEQ ID NO: 13010 - protein, 20 aa, Artificial sequence
  protein pattern
  Variant (3)..(8): Xaa in position 3 to 8 is any amino acid
  Variant (9)..(9): Xaa in position 9 is Asp or Asn
  Variant (10)..(10): Xaa in position 10 is Glu, Gly or Gln
  Variant (11)..(11): Xaa in position 11 is Ser, Thr or Val
  Variant (12)..(12): Xaa in position 12 is Ile, Leu, Met or Val
  Variant (13)..(13): Xaa in position 13 is His or Arg
  Variant (14)..(14): Xaa in position 14 is Phe, Leu or Met
  Variant (15)..(15): Xaa in position 15 is any amino acid
  Variant (17)..(17): Xaa in position 17 is any amino acid
  Variant (19)..(19): Xaa in position 19 is any amino acid
RDXXXXXXXXXXXXXNXGXT

SEQ ID NO: 13011 - protein, 23 aa, Artificial sequence
  protein pattern
  Variant (3)..(3): Xaa in position 3 is Ala, Gly, Ser, Thr or Val
  Variant (4)..(4): Xaa in position 4 is any amino acid
  Variant (6)..(6): Xaa in position 6 is any amino acid
  Variant (7)..(7): Xaa in position 7 is Glu, Asn, Pro or Gln
  Variant (8)..(9): Xaa in position 8 to 9 is any amino acid
  Variant (10)..(10): Xaa in position 10 is Glu, Pro, Gln or Thr
  Variant (11)..(11): Xaa in position 11 is any amino acid
  Variant (12)..(12): Xaa in position 12 is Ala, Asp, Glu, Asn or Gln
  Variant (13)..(13): Xaa in position 13 is any amino acid
  Variant (14)..(14): Xaa in position 14 is Ala, Gly or Ser
  Variant (15)..(17): Xaa in position 15 to 17 is any amino acid
  Variant (19)..(20): Xaa in position 19 to 20 is any amino acid
  Variant (21)..(21): Xaa in position 21 is Leu or Met
NPXXLXXXXXXXXXXXXVXXXGG

SEQ ID NO: 13012 - protein, 20 aa, Artificial sequence
  protein pattern
  Variant (2)..(5): Xaa in position 2 to 5 is any amino acid
  Variant (7)..(7): Xaa in position 7 is any amino acid
  Variant (10)..(11): Xaa in position 10 to 11 is any amino acid
  Variant (13)..(15): Xaa in position 13 to 15 is any amino acid
  Variant (16)..(16): Xaa in position 16 is Ile, Leu or Val
  Variant (17)..(19): Xaa in position 17 to 19 is any amino acid
  Variant (20)..(20): Xaa in position 20 is Phe, Ile, Leu or Met
VXXXXHXWPXXGXXXXXXXX

SEQ ID NO: 13013 - protein, 20 aa, Artificial sequence
  protein pattern
  Variant (2)..(2): Xaa in position 2 is Asp, Asn or Pro
  Variant (3)..(4): Xaa in position 3 to 4 is any amino acid
  Variant (5)..(5): Xaa in position 5 is Asp or Asn
  Variant (6)..(7): Xaa in position 6 to 7 is any amino acid
  Variant (8)..(8): Xaa in position 8 is Ala or Asp
  Variant (10)..(11): Xaa in position 10 to 11 is any amino acid
  Variant (13)..(14): Xaa in position 13 to 14 is any amino acid
  Variant (15)..(17): Xaa in position 15 to 17 is any or no amino acid
  Variant (19)..(19): Xaa in position 19 is any amino acid
  Variant (20)..(20): Xaa in position 20 is Ala, Ile, Leu or Val
LXXXXXXXFXXAXXXXXGXX

SEQ ID NO: 13014 - DNA, 2244 bp, Saccharomyces cerevisiae
  CDS (1)..(2244)
atgtcgttattagagcaattagcaagaaaaagaatagaaaaatctaaaggccttttaagtgcggaccagtctcatagtacatcgaaaagtgcatccttactagaaagactacataagaatagagaaactaaagataacaatgctgagacaaaaaggaaggatctgaagacgctacttgcaaaagacaaggtaaaaagaagcgactttaccccgaaccagcatagtgtttcattgagtttaaagttgtctgccttaaagaagtcaaatagtgatttggagaaacaaggaaaatcagtgacattagacagcaaagaaaacgaactccctaccaaaaggaaatcgcctgatgataaactcaacttagaagagtcatggaaggctattaaagaaatgaaccattactgtttcttgaaaaacgatccatgcataaatcaaaccgacgattttgcgttcacaaactttatcataaaagataaaaaaaactcgttgagtacatcaataccgctatcgtcgcagaattcatcatttctgtccttaaaaaagcataacaatgagctccttggtatttttgtgccttgtaacctgccgaaaacaactcgtaaagtagccattgagaatttcaatagaccaagtcctgatgatataatacaatcggcccaacttaatgctttcaatgaaaaattagaaaacttaaatatcaaatctgtgcccaaggccgaaaaaaaggaaccaattaaccttcaaacaccacctactgagtcgattgatattcattcattcattgccacccatcctctgaatttgacatgtttgttcctcggtgatacaaacgcaggcaaatccactttgcttggtcatcttttatatgatctaaacgaaatttctatgtcatcaatgagggaactacaaaaaaaaagcagtaatttggatccttcatcttcaaatagttttaaggtcattctagacaataccaaaacagaaagagaaaatggattttccatgtttaagaaagttattcaggtagaaaatgatttactaccgccatcatcaaccttgacgcttatagacactcctggtagtatcaaatacttcaataaagaaactctgaactcaattttgacctttgatcctgaagtttatgtattggttattgattgcaattatgactcgtgggaaaaatcattagatggtccaaataatcagatttatgaaattttaaaagtgatctcttatttgaacaagaattccgcatgcaaaaagcacttgataattcttttgaataaggcagatctaattagttgggataagcaccgactagaaatgattcagtctgagctaaattatgtgttgaaggaaaactttcagtggacagacgcagaattccaatttatcccgtgttcgggtttattaggttcgaatttgaataaaactgaaaacatcacaaaatctaagtataagtcagaatttgactctataaattatgttcccgaatggtatgaaggtccgacatttttttcgcaactatatctattggtagagcataatatgaacaaaatagaaacaactttggaagagccatttgtaggcacaatactgcaatcttctgttcttcaaccgatagcggagataaattacgtgtcactcaaagtcttgatcaacagcggatatattcaatcaggccagacaattgaaattcatacacaatatgaagattttcattactatggtatagtttcaagaatgaagaattcaaaacaaatactggagactaacacaaaaaataatatatcagtcggtttgaaccctgacattttagaggttcttgttaagattcataataccgaagacttcacgaaaaagcaatttcacattcgtaagggtgatataataattcactctagaaagacgaatacactatcaccgaatttaccaaacacactaaagttgttagccttgcgtttaataaaattatcaatacaaacgcacgcgctaagtgatcccgttgacttgggttctgaattgcttctttaccataatttgacgcacaacgcggtaaaattggtgaagattctcgggactaacgacatctcaattaatccaaatcagtcacttattgtcgaagtcgaaattatagaaccagactttgctcttaatgtgattgattccaaatacattaccaacaatattgttttaacatcaatagatcataaggttatcgcagttggcagaattgcatgccagtaa

SEQ ID NO: 13015 - protein, 747 aa, Saccharomyces cerevisiae
MSLLEQLARKRIEKSKGLLSADQSHSTSKSASLLERLHKNRETKDNNAETKRKDLKTLLAKDKVKRSDFTPNQHSVSLSLKLSALKKSNSDLEKQGKSVTLDSKENELPTKRKSPDDKLNLEESWKAIKEMNHYCFLKNDPCINQTDDFAFTNFIIKDKKNSLSTSIPLSSQNSSFLSLKKHNNELLGIFVPCNLPKTTRKVAIENFNRPSPDDIIQSAQLNAFNEKLENLNIKSVPKAEKKEPINLQTPPTESIDIHSFIATHPLNLTCLFLGDTNAGKSTLLGHLLYDLNEISMSSMRELQKKSSNLDPSSSNSFKVILDNTKTERENGFSMFKKVIQVENDLLPPSSTLTLIDTPGSIKYFNKETLNSILTFDPEVYVLVIDCNYDSWEKSLDGPNNQIYEILKVISYLNKNSACKKHLIILLNKADLISWDKHRLEMIQSELNYVLKENFQWTDAEFQFIPCSGLLGSNLNKTENITKSKYKSEFDSINYVPEWYEGPTFFSQLYLLVEHNMNKIETTLEEPFVGTILQSSVLQPIAEINYVSLKVLINSGYIQSGQTIEIHTQYEDFHYYGIVSRMKNSKQILETNTKNNISVGLNPDILEVLVKIHNTEDFTKKQFHIRKGDIIIHSRKTNTLSPNLPNTLKLLALRLIKLSIQTHALSDPVDLGSELLLYHNLTHNAVKLVKILGTNDISINPNQSLIVEVEIIEPDFALNVIDSKYITNNIVLTSIDHKVIAVGRIACQ

SEQ ID NO: 13016 - DNA, 26 bp, Artificial sequence
  primer
atgtcgttattagagcaattagcaag

SEQ ID NO: 13017 - DNA, 24 bp, Artificial sequence
  primer
ttactggcatgcaattctgccaac

SEQ ID NO: 13018 - DNA, 888 bp, Saccharomyces cerevisiae
  CDS (1)..(888)
atgagtttgagaacgccgaagagaagcaggactagcgatgaacaagaacaagaacaagaacaagagcaggtacagaacccagatacacatgtaaacaacgagcatcagcagcgacctgggccaaccactctattgagcacgccagtacgtctcaaaaatggctttggaacaccatcgccgccgtcaccaccaggcataacgaaaagcatcactaaatcgagaagaaggccgtcgacaacgagtcttcagggtatattcatgtcgcccgtcaataagcgtcgtgtcggcataaccgcacatggacgtgtatatgaccataacgacgacggacacgaaagtgagagtgaggacgacgaaaatgaagaagaaaatgaaaatcaaaagaagtacgacggacacgttagtatgcctttgttgccaccgacaacgcccaagtcaagacggtcggaggtgtttctgtcgccgtcgccgcgtttgaggtcacctccgacggctgcgcgtcggtctacgggcgagcggcccatccgcgaaatatcacatactttgcgcaccaggctcaattacgcgttagtcaagctgcaaaatggatggacggacaagacacttcccgagctggagacggagcttgctccagcagtgcagacgccgccacgtcgctatcacaacagatttccagatagtgcagacgcgggtacttccgcgcatacagcgtttcttcaggcgctcggaggccacccaccacgggaggaggccacggctgtcgaaacactgatgctattgtcgtcgcctaccaagaagcaacaacaccgacccgtgccggcgacatctgctggagaacccacggacgaaacggagcccgagtcggataccgaagtggagacgtcttaa

SEQ ID NO: 13019 - protein, 295 aa, Saccharomyces cerevisiae
MSLRTPKRSRTSDEQEQEQEQEQVQNPDTHVNNEHQQRPGPTTLLSTPVRLKNGFGTPSPPSPPGITKSITKSRRRPSTTSLQGIFMSPVNKRRVGITAHGRVYDHNDDGHESESEDDENEEENENQKKYDGHVSMPLLPPTTPKSRRSEVFLSPSPRLRSPPTAARRSTGERPIREISHTLRTRLNYALVKLQNGWTDKTLPELETELAPAVQTPPRRYHNRFPDSADAGTSAHTAFLQALGGHPPREEATAVETLMLLSSPTKKQQHRPVPATSAGEPTDETEPESDTEVETS

SEQ ID NO: 13020 - DNA, 741 bp, Saccharomyces cerevisiae
  CDS (1)..(741)
atgtttcttaagacacctaattgggaaacggtaaatgagactcccaaatcgagagtcttaacgataaacgaattgatctctcccaacctggatactgaatctaacagccttctggcgacgccggcaaggaaatatttcaaaacttcaataagtgaagcgcaagattctcctacatctgccccttcgcccgatggcaatgaggatcccacatatcaatacaacgtacaatttcattttccaggaccaataacacctacaacacccaggtctaagaatgcagaaatgtttccatcccccacgcccccattggtttctcccacagcggttatcgaggaagagaatgacgattccgtacgggagttttcacgcacgctaaaatcaagactcaactgcgcaatggttaagctatcaaaggaacatgagcaagtagctttgattcctccacctccgacggaaaagatacgaaagggctcttatagtaataaatttgccgctaagcataggcgctgtcactcgttagatgaatccaaaaagtttctgagttctctggaagattcatccgctcatgcagcgttcttgaaggcaatttcgtccaaacatgccaaaagcaatagggtagacaacgttaacgtttcgccgttacgttggtcatctcatagaagaacgcaaagtacacaggagaattctttacaagaagttgttgctatcgatacattattgaagatgtcctcatcggactga

SEQ ID NO: 13021 - protein, 246 aa, Saccharomyces cerevisiae
MFLKTPNWETVNETPKSRVLTINELISPNLDTESNSLLATPARKYFKTSISEAQDSPTSAPSPDGNEDPTYQYNVQFHFPGPITPTTPRSKNAEMFPSPTPPLVSPTAVIEEENDDSVREFSRTLKSRLNCAMVKLSKEHEQVALIPPPPTEKIRKGSYSNKFAAKHRRCHSLDESKKFLSSLEDSSAHAAFLKAISSKHAKSNRVDNVNVSPLRWSSHRRTQSTQENSLQEVVAIDTLLKMSSSD

SEQ ID NO: 13022 - DNA, 24 bp, Artificial sequence
  primer
atgagtttgagaacgccgaagaga

SEQ ID NO: 13023 - DNA, 24 bp, Artificial sequence
  primer
ttaagacgtctccacttcggtatc

SEQ ID NO: 13024 - DNA, 528 bp, Saccharomyces cerevisiae
  CDS (1)..(528)
atggatttgaaaagggattggttacgatggaaaattacaataggtagtgggcctggcagtattgtgctggatttcccatcatttttggtagggtgcgtattcacaacaatgatggggccaatattacagaagcttataggtaaacttttggtaggtttaataacggtatgcaaattcttagttattattggaagcattgtcttcgttatcggagttgcatcaaagaaatacacatatgacgatttcaaagtaagtataaaaagatcaggagagccaggggaatcacatgatatgaggactgaaccaaaaagaactgcgaaaacggcaactgttccaatggagaaagacgagggcgtaggttcttataattattttgaaatacctataacgaaagaaacatctacaattccttatattaattgtgatggcacgagctcacttagaaagccacccaacggtccatcaagcgtaggcttatctaactccaacagatacgaaaattttataaacatggcacgacataaataa

SEQ ID NO: 13025 - protein, 175 aa, Saccharomyces cerevisiae
MDLKRDWLRWKITIGSGPGSIVLDFPSFLVGCVFTTMMGPILQKLIGKLLVGLITVCKFLVIIGSIVFVIGVASKKYTYDDFKVSIKRSGEPGESHDMRTEPKRTAKTATVPMEKDEGVGSYNYFEIPITKETSTIPYINCDGTSSLRKPPNGPSSVGLSNSNRYENFINMARHK

SEQ ID NO: 13026 - DNA, 450 bp, Candida glabrata CBS 138
  CDS (1)..(450)
atggagaaagcgatacctttcatccgatcaaatcaagagattgaattcagggtcggtgatagggatgtatatattcatctgccctcatttgttctaggtgcattggttataggactagttggcccaatattgaaaacagtaatagggggtatatgggtgggcctaattctattttcgaaatttgcggtggtgattggtatagcgttaactatcatatggatattgtctggtagccagaagcgtcaagtgaagaggagtaaaccaacctatacagaaacaattaataagatacgacctcaagaagacagcgaagctgatattggaagttacaagtactttaatatacccgttgagaaagagccctacatcaaacgaaaaccttcaatctctacgatatcaatagatgaaaaggatctatataccaattttgtacgcaaggcaagaagatag

SEQ ID NO: 13027 - protein, 149 aa, Candida glabrata CBS 138
MEKAIPFIRSNQEIEFRVGDRDVYIHLPSFVLGALVIGLVGPILKTVIGGIWVGLILFSKFAVVIGIALTIIWILSGSQKRQVKRSKPTYTETINKIRPQEDSEADIGSYKYFNIPVEKEPYIKRKPSISTISIDEKDLYTNFVRKARR

SEQ ID NO: 13028 - DNA, 25 bp, Artificial sequence
  primer
atggatttgaaaagggattggttac

SEQ ID NO: 13029 - DNA, 27 bp, Artificial sequence
  primer
ttatttatgtcgtgccatgtttataaa

SEQ ID NO: 13030 - DNA, 1716 bp, Saccharomyces cerevisiae
  CDS (1)..(1716)
atggattctagaacagttggtatattaggagggggacaattgggacgtatgattgttgaggcagcaaacaggctcaacattaagacggtaatactagatgctgaaaattctcctgccaaacaaataagcaactccaatgaccacgttaatggctccttttccaatcctcttgatatcgaaaaactagctgaaaaatgtgatgtgctaacgattgagattgagcatgttgatgttcctacactaaagaatcttcaagtaaaacatcccaaattaaaaatttacccttctccagaaacaatcagattgatacaagacaaatatattcaaaaagagcatttaatcaaaaatggtatagcagttacccaaagtgttcctgtggaacaagccagtgagacgtccctattgaatgttggaagagatttgggttttccattcgtcttgaagtcgaggactttggcatacgatggaagaggtaacttcgttgtaaagaataaggaaatgattccggaagctttggaagtactgaaggatcgtcctttgtacgccgaaaaatgggcaccatttactaaagaattagcagtcatgattgtgagatctgttaacggtttagtgttttcttacccaattgtagagactatccacaaggacaatatttgtgacttatgttatgcgcctgctagagttccggactccgttcaacttaaggcgaagttgttggcagaaaatgcaatcaaatcttttcccggttgtggtatatttggtgtggaaatgttctatttagaaacaggggaattgcttattaacgaaattgccccaaggcctcacaactctggacattataccattgatgcttgcgtcacttctcaatttgaagctcatttgagatcaatattggatttgccaatgccaaagaatttcacatctttctccaccattacaacgaacgccattatgctaaatgttcttggagacaaacatacaaaagataaagagctagaaacttgcgaaagagcattggcgactccaggttcctcagtgtacttatatggaaaagagtctagacctaacagaaaagtaggtcacataaatattattgcctccagtatggcggaatgtgaacaaaggctgaactacattacaggtagaactgatattccaatcaaaatctctgtcgctcaaaagttggacttggaagcaatggtcaaaccattggttggaatcatcatgggatcagactctgacttgccggtaatgtctgccgcatgtgcggttttaaaagattttggcgttccatttgaagtgacaatagtctctgctcatagaactccacataggatgtcagcatatgctatttccgcaagcaagcgtggaattaaaacaattatcgctggagctggtggggctgctcacttgccaggtatggtggctgcaatgacaccacttcctgtcatcggtgtgcccgtaaaaggttcttgtctagatggagtagattctttacattcaattgtgcaaatgcctagaggtgttccagtagctaccgtcgctattaataatagtacgaacgctgcgctgttggctgtcagactgcttggcgcttatgattcaagttatacaacgaaaatggaacagtttttattaaagcaagaagaagaagttcttgtcaaagcacaaaagttagaaactgtcggttacgaagcttatctagaaaacaagtaa

SEQ ID NO: 13031 - protein, 571 aa, Saccharomyces cerevisiae
MDSRTVGILGGGQLGRMIVEAANRLNIKTVILDAENSPAKQISNSNDHVNGSFSNPLDIEKLAEKCDVLTIEIEHVDVPTLKNLQVKHPKLKIYPSPETIRLIQDKYIQKEHLIKNGIAVTQSVPVEQASETSLLNVGRDLGFPFVLKSRTLAYDGRGNFVVKNKEMIPEALEVLKDRPLYAEKWAPFTKELAVMIVRSVNGLVFSYPIVETIHKDNICDLCYAPARVPDSVQLKAKLLAENAIKSFPGCGIFGVEMFYLETGELLINEIAPRPHNSGHYTIDACVTSQFEAHLRSILDLPMPKNFTSFSTITTNAIMLNVLGDKHTKDKELETCERALATPGSSVYLYGKESRPNRKVGHINIIASSMAECEQRLNYITGRTDIPIKISVAQKLDLEAMVKPLVGIIMGSDSDLPVMSAACAVLKDFGVPFEVTIVSAHRTPHRMSAYAISASKRGIKTIIAGAGGAAHLPGMVAAMTPLPVIGVPVKGSCLDGVDSLHSIVQMPRGVPVATVAINNSTNAALLAVRLLGAYDSSYTTKMEQFLLKQEEEVLVKAQKLETVGYEAYLENK

SEQ ID NO: 13032 - DNA, 1938 bp, Arabidopsis thaliana
  CDS (136)..(1938)
atgttgcttttgaaacaaagctcagctgctgttcttgtcgttggaaatacaactccagtccttcacacttctcgctccacctacagagttggaccttttccagtgaccagaacgcagtcgttccagagtttgactatggcaaatttgcagaagcttcccacttcttcgtctgggaaattgaatacggcttcagctgtgccctgtagctctcacgatgcttctcctatcagtgagaatcgcgagaataaacatgtccatggagtttctgagaaaattgtgggagttcttgggggtggacaattgggtcgtatgctttgccaagctgcttctcagttggctatcaaagtgatgattttagatccttctaaaaattgttcagcaagtgcattgtcctacggtcacatggttgatagctttgacgacagtgctacagtagaagaatttgcaaaaagatgtggagtcttaactgtagaaattgaacatgttgacgtggacacactagagaagcttgagaaacaaggagtggattgccaacccaaagcttctactattaggataatacaggataaatacatgcaaaaggttcatttctctcagcatggcatcccacttccagaatttatggagataagcgatattgaaggagcaagaaaagcaggtgaacttttcggttaccctcttatgatcaagagcaaacgattggcttatgatggacgtggaaatgcagttgccaacaaccaagatgagctttcttctgctgtaacggctcttggaggtttcagtcgtggtttgtatattgagaaatgggcaccttttgttaaggagttagctgttattgtggctagggggagagatggttctatggtttgttatcccgttgttgaaaccattcacagggataacatatgccatatagttaaagcacctgcagatgtgccttggaagattaacaaacttgccaccgatgttgcccaaaaggctgtcggttctttagaaggtgctggtgtttttgcagttgaactgttcttgacagaggatagtcagattctgctaaacgaagttgcacctagaccacacaacagtggccatcaaacgatcgagtgctgttatacttcacagtttgaacaacacttgcgagctgtggttggtcttccacttggtgatccgtcaatgagaactccggcgtccattatgtacaatattctgggagaagatgatgtaattgatggagaagcaggtttcaaattggctcatcggcttattgcaagggctctgtgtattccaggtgcatctgttcattggtatgacaagccagaaatgagaaagcagagaaagatgggtcacatcactcttgttgggcagtctatgggcattttggaacaaaggttacaatgcatattaagtgagcaaagccaccaagtacacgagacacctcgtgttgctatcatcatgggttcagacacggatcttcctgttatgaaggatgctgccaaaattctggacctgtttggtgtgacacatgaggtaaagatagtttctgctcatcgcaccccagagatgatgtatacatatgcaacctcagctcatagtcgaggcgttcaagtcattattgcaggtgctggtggtgctgctcacttaccaggtatggttgcttcactcactcctttgcctgtgattggtgtccctgtccgtgctacccgtttggatggagttgattcacttctttccatcgttcagatgcctagaggtgttcctgttgcgacagttgcaataaacaatgcgaccaacgcagccttgcttgcagttcggatgttgggaatctctgatacggatcttgtctcaaggatgaggcagtaccaggaagacatgagagatgagaacctgaataaaggagagaaactggagacagaaggttgggaatcatatttgaaccagtga

SEQ ID NO: 13033 - protein, 600 aa, Arabidopsis thaliana
MANLQKLPTSSSGKLNTASAVPCSSHDASPISENRENKHVHGVSEKIVGVLGGGQLGRMLCQAASQLAIKVMILDPSKNCSASALSYGHMVDSFDDSATVEEFAKRCGVLTVEIEHVDVDTLEKLEKQGVDCQPKASTIRIIQDKYMQKVHFSQHGIPLPEFMEISDIEGARKAGELFGYPLMIKSKRLAYDGRGNAVANNQDELSSAVTALGGFSRGLYIEKWAPFVKELAVIVARGRDGSMVCYPVVETIHRDNICHIVKAPADVPWKINKLATDVAQKAVGSLEGAGVFAVELFLTEDSQILLNEVAPRPHNSGHQTIECCYTSQFEQHLRAVVGLPLGDPSMRTPASIMYNILGEDDVIDGEAGFKLAHRLIARALCIPGASVHWYDKPEMRKQRKMGHITLVGQSMGILEQRLQCILSEQSHQVHETPRVAIIMGSDTDLPVMKDAAKILDLFGVTHEVKIVSAHRTPEMMYTYATSAHSRGVQVIIAGAGGAAHLPGMVASLTPLPVIGVPVRATRLDGVDSLLSIVQMPRGVPVATVAINNATNAALLAVRMLGISDTDLVSRMRQYQEDMRDENLNKGEKLETEGWESYLNQ

SEQ ID NO: 13034 - DNA, 1938 bp, Arabidopsis thaliana; identical to SEQ ID NO: 13032
  CDS (310)..(1938)

SEQ ID NO: 13035 - protein, 542 aa, Arabidopsis thaliana
MLCQAASQLAIKVMILDPSKNCSASALSYGHMVDSFDDSATVEEFAKRCGVLTVEIEHVDVDTLEKLEKQGVDCQPKASTIRIIQDKYMQKVHFSQHGIPLPEFMEISDIEGARKAGELFGYPLMIKSKRLAYDGRGNAVANNQDELSSAVTALGGFSRGLYIEKWAPFVKELAVIVARGRDGSMVCYPVVETIHRDNICHIVKAPADVPWKINKLATDVAQKAVGSLEGAGVFAVELFLTEDSQILLNEVAPRPHNSGHQTIECCYTSQFEQHLRAVVGLPLGDPSMRTPASIMYNILGEDDVIDGEAGFKLAHRLIARALCIPGASVHWYDKPEMRKQRKMGHITLVGQSMGILEQRLQCILSEQSHQVHETPRVAIIMGSDTDLPVMKDAAKILDLFGVTHEVKIVSAHRTPEMMYTYATSAHSRGVQVIIAGAGGAAHLPGMVASLTPLPVIGVPVRATRLDGVDSLLSIVQMPRGVPVATVAINNATNAALLAVRMLGISDTDLVSRMRQYQEDMRDENLNKGEKLETEGWESYLNQ

SEQ ID NO: 13036 - DNA, 2199 bp, Zea mays
  CDS (103)..(2007)
gcacgaggcacgagcggcacgagctagacacccatcgtctcccgttcccggctaaaccctgcttgagccctagacaccgcccgcctccgggaggtagagagcatgcacgccaggttcctcagcgcgccgtcccctgcctccgccgccccctccccgtacgttcgcttggccttcacgggcgcccgcccgcgccgcgcgtgttggaagccgcgaggccccgcgtccgcgtccgcgccgccgcctcggcctctccactcgctgtgcgcccgggcctccatgcagcccgcctctcccgcgcacgacgggcatggtggtccgccggtgcacggcgtctccaacaccgtcatcggggtcctggggggcggtcagctcgggaagatgctctgccatgcagcgagtcaaatggggattagaattgtcatcctcgaccctcttcccggctgccccgcgagctcggtttgcgatgagcacgtaatcgggagcttcaacgatagggacacggtccgggagttcgccaagaggtgtggggtcctaacagtggagattgagcatgttgatgccgccacactggagaagctggaaaaacagggcgttgactgcgagcctaaagcctccacaatcacgattattcaggacaagtacaggcagaaaaagcatttctcaagatgcgagatcccattgcctgactttatggaagtagatactttacgcagtatagaggaggctggggaaaagtttggctatcccctaatggtcaaaagcaagagattagcatatgatggtcgaggaaatgctgtagccaagaacagagaggagctaccttctgttgttgcttcactgggtgggtttgagcggggcttgtatgttgagagatggactcctttcgtaaaggagctttctgtaattgtggcaaggagcagagacaactctactgtctgctatcctgttgtggaaacagttcacaaggaaaatatatgccatgttgttgaagctcctgctgatttatctaacaaaataaagaagttagctactagcgtggctgaaaaagctatcaaatcattagaaggagctggtgtctttgctgtagagttgtttttaacagaagatgatcagattttattgaatgaggtagcccctaggcctcacaatagtgggcatcacacaatagagtcatgctacacctcacaatatgagcagcatatacgcgctattcttggccttcctcttggtgatccctcaatgaaagcacctgcagcaataatgtacaacatcctgggcgaggatgagggtgaagcagggttctttctggctcatcagcttatcagtagggcactaaccattccaggcacatcggtccattggtacgcaaagccagagatgcggaagcaaaggaagatgggtcatattacaattgtggggccttctaagataagtgtaaaatcacgcttggacaacttgctgcaaagaaactcgtctgatcccaaggaagttagccctcgtgttgctattataatggggtcccaatctgatcttcctgtgatgaaagatgctgagagggttttgaaagagttcgacataccttgtgaggtaactattgtttctgcacatcgtacaccagagcggatgtatgattatgcgaagtctgctaaagacaggggtttcgaggtcataattgcaggtgcaggcggagcagctcatttaccagggatggtggcttcattgactcctcttcctgtaatcggagttcccattaagacttcaacactatcaggatttgattccctcctatctattgtgcaaatgccaaaaggtattcctgttgcgactgttgctatcgggaatgcagaaaatgcaggtttgctggcagctaggattctggctgcaagagatcctgagctccaggacagggtaactaagtaccaggatgatctgagggacatggttttggagacggcagaaaggctggaggaccaaggcccggaggaatttctgaagggaatggattgaccccttttgaagccctggctctggggcctgggagaggaatacgagtgtatgggtcggcgataactcactgtccactcgattatggtttaagatggggagtcatcaagaagatactttaataggctcggctgcattcgattttccttacaattcttttttgataaaaaaaaaaaaaaaaaaaaaaaaaaaaaa

SEQ ID NO: 13037 - protein, 634 aa, Zea mays
MHARFLSAPSPASAAPSPYVRLAFTGARPRRACWKPRGPASASAPPPRPLHSLCARASMQPASPAHDGHGGPPVHGVSNTVIGVLGGGQLGKMLCHAASQMGIRIVILDPLPGCPASSVCDEHVIGSFNDRDTVREFAKRCGVLTVEIEHVDAATLEKLEKQGVDCEPKASTITIIQDKYRQKKHFSRCEIPLPDFMEVDTLRSIEEAGEKFGYPLMVKSKRLAYDGRGNAVAKNREELPSVVASLGGFERGLYVERWTPFVKELSVIVARSRDNSTVCYPVVETVHKENICHVVEAPADLSNKIKKLATSVAEKAIKSLEGAGVFAVELFLTEDDQILLNEVAPRPHNSGHHTIESCYTSQYEQHIRAILGLPLGDPSMKAPAAIMYNILGEDEGEAGFFLAHQLISRALTIPGTSVHWYAKPEMRKQRKMGHITIVGPSKISVKSRLDNLLQRNSSDPKEVSPRVAIIMGSQSDLPVMKDAERVLKEFDIPCEVTIVSAHRTPERMYDYAKSAKDRGFEVIIAGAGGAAHLPGMVASLTPLPVIGVPIKTSTLSGFDSLLSIVQMPKGIPVATVAIGNAENAGLLAARILAARDPELQDRVTKYQDDLRDMVLETAERLEDQGPEEFLKGMD

SEQ ID NO: 13038 - DNA, 2329 bp, Brassica sp
  CDS (112)..(2028)
gtgagttaatgggttttgtttccctcaaataaaaatcgaaccttcgaagcttaagttctcgcatcctctttctccttgtcaagccacagctcgaaaccagctatgttctagatgttgcttctgaaacagagctcagctgctgttcttgtctctgggaatccaagtcctgtcctttacactcctcgcttcacttccagagttggatctcttccagttagcaaaacgaactccttcaccatggcgaatcttcagaagggtcttacttattcttcttctgagaaattcaacccggtgttagcgtgtagctctcacgaggcttctcctatcagcgaggatacacatatcaagggagtctctgagatcattgtgggagtgttgggaggtggacagttaggtcgcatgctttgccaagctgcttctcaaatggccatcaaggttatgattctagatccttcaaagaactgttcagcaagctcattagcttatggccacatggttgatagctttgacgacagtgctacagttgaagagtttgcaaaaagatgtggagtcttgacagtagaaattgaacatgttgacgttgaaacactagagaagcttgagaaacaaggagtagatgtccaaccaaaagcctctactatcaggataatacaggataaatacatacaaaaagttcatttctctcggcatggcatcccacttccagagtttatggagataagcgatattgaaggagctgaaagagcaggtgaactttttggttaccctcttatgatcaagagcaagagattagcttatgatggacgaggaaatgcagttgctaatagccaagacgcgcttacttctgctgtaactgctcttggaggtttcagtcgtggtttgtacgttgagaaatgggcaccctttgtaaaggagttggctgttattgtggctaggggaagagatggttccatggtttgttatccagttgttgaaactgttcacagggataacatatgccatatagttaaagcaccagcagatgtgccttggaagattaacaaacttgccactgatgttgctcaaaaggctgttggttctttagaaggcgctggtgttttcgctgttgagctgttcttgacagaggatggtcagatcctgctgaatgaagttgcacctagaccacacaacagtggacatcagacgatcgagtcatgttacacttcacagtttgagcaacacttgcgagctgtggttggtcttccactcggtgatccgtctatgagaactcctgcctccattatgtacaatattctgggcgaagatgatggagaagctggtttcagattggcacatcggctcattgcaagagctctgagtgttccaggtgcatctgtgcattggtatgacaagccagaaatgagaaagcagcggaagatggggcacatcactcttgttggaaagtctattggtgttttggaacaaaggttgcattgtatattaagtgaacaaagccatcaactacatgacattgcagagatacctcgtgttggtatcatcatgggttcagactctgatcttcctgttatgaaagatgctgcaaaaattcttgacacgtttaatgtaacatatgaggtgaagatagtttcagcacatcggacaccagagatgatgttttcttatgcaacatcagctcatagtagaggaatccaagtgataattgcaggtgctggtggtgctgctcacttaccaggtatggttgcttcactcactcccttacctgtgattggtgtccctgtacgtgctacccgtttggatggagttgattcacttctctccattgttcagatgcctagaggtgttcctgtagccacagttgctataaacaactccaccaacgcagccttgcttgctatcaggatgctggggatctctgatactgatctcgtctcaaggataagtcagtaccaggaagacatgagagaagagaacatggttaaaggtgagaaacttgagcgtcaaggttgggaatcatacttgaaccagtgaatattacttgtcagaactcctcattggttaccgggaactccatagtgatcgattttgctgccagtaagatcttgttgagagttagtttcggatcttgagttgttgtcacggctaattccggtttagctttgtcaagttaagccacaattgtttgagactcaagctaagtcctggtgagggatctgatagttagcttcagttcttgagaaactattggatgagttatccacacgatgttttattttataatattatgtaactcccatagagacatgggatataacatgttcttacaaaaaaa

SEQ ID NO: 13039 - protein, 638 aa, Brassica sp
MLLLKQSSAAVLVSGNPSPVLYTPRFTSRVGSLPVSKTNSFTMANLQKGLTYSSSEKFNPVLACSSHEASPISEDTHIKGVSEIIVGVLGGGQLGRMLCQAASQMAIKVMILDPSKNCSASSLAYGHMVDSFDDSATVEEFAKRCGVLTVEIEHVDVETLEKLEKQGVDVQPKASTIRIIQDKYIQKVHFSRHGIPLPEFMEISDIEGAERAGELFGYPLMIKSKRLAYDGRGNAVANSQDALTSAVTALGGFSRGLYVEKWAPFVKELAVIVARGRDGSMVCYPVVETVHRDNICHIVKAPADVPWKINKLATDVAQKAVGSLEGAGVFAVELFLTEDGQILLNEVAPRPHNSGHQTIESCYTSQFEQHLRAVVGLPLGDPSMRTPASIMYNILGEDDGEAGFRLAHRLIARALSVPGASVHWYDKPEMRKQRKMGHITLVGKSIGVLEQRLHCILSEQSHQLHDIAEIPRVGIIMGSDSDLPVMKDAAKILDTFNVTYEVKIVSAHRTPEMMFSYATSAHSRGIQVIIAGAGGAAHLPGMVASLTPLPVIGVPVRATRLDGVDSLLSIVQMPRGVPVATVAINNSTNAALLAIRMLGISDTDLVSRISQYQEDMREENMVKGEKLERQGWESYLNQ

SEQ ID NO: 13040 - DNA, 1896 bp, Oryza sativa (japonica cultivar-group)
  CDS (1)..(1896)
atgcactccaggctcctcagcgccccctcccacgcctccgccgcctcctcctcccccctccccttcgccgccgcccacccttgccgcgcctcctggacgccgcggcccacctccccgctgccgcctctatcgctgctgcgcgccaccgcctccatgcatccttctcctcctcccgaggggcatagcgaccagcctgtgcatggcgtcaccaacacggtcgtcggcgtgctggggggaggccagctggggaagatgctgtgccaggcggccagccagatgggggtcaggatggccatacttgatcccctcgaggactgcccggcgagctcggtttgccacgagcatgtcgtcgggagcttcaatgatggcgccacggttagcgagttcgcaaagaggtgcggggttttgacggtggaaattgagcatgtcgacgctgtaacactcgagaagcttgagaaacagggcatcgattgtgagcccaaagcctccaccatcatgattattcaagacaagtacaggcagaaaactcatttctcaaaatttggaattccgttacctgactttgtggaagtagatactttaagtagcatagagaaagctggggaaatgtttggttatcctctaatggtcaaaagcaagagattagcatatgatggccgtggaaatgctgttgctcacgacaaaaaagagctatcttctgttgttgcttctcttggtgggtttgagcatggcttgtatgttgagaggtggacatcttttgtaaaggagctttctgtcattgtggcaaggagcagagacggttctacggtgtgctatcctgttgttgaaaccatccacaaggataacatctgccatgttgttgaggctcctgccgaggtgcctgataaaataaagaagttggctactaatgtagctgaaaaggctatcaaatcattggaaggtgctggtgttttcgctgtagaattatttttaacacaagataatcaggttttattgaatgaagtagctccaaggcctcacaacagtgggcatcacacaattgagtcatgttatacctcgcaatatgagcaacatttacgtgctattcttggccttcctcttggtgatccttcaatgaaagcgcctgcatcaataatgtacaacatcctgggtgaggatgagggtgaggcaggatttactcaagctcatcagttgattgagagagctttggacatttcaggtgcatctgtccattggtatgcaaaaccagaaatacggaagcagagaaagatgggccatattacaattgtggggccttcaaagtacagtgtaaaagcacgcttagataagttgctgcaaagagacgcatatgaccccaagaaagttgcagttaaacctcgtgctgcaataataatgggttctgattctgatcttcctgtcatgaaagatgctgcagtagtattgaagaaattcaacataccttttgagcttacaattgtttcggctcatcgtacaccagagaggatgtaccattatgcattatctactaaagaaagaggcttagaggtcataattgcaggtgcaggtggagcggctcacttaccagggatggtggcttcattgacttctgtcccagtaataggagtacccatcatgacttcatctttacatggaactgattccctcctatctattgtccagatgccgaaaggtattcctgttgctactgttgcaattggaaatgcggaaaatgcaggtttattggcagttaggatgctggcctcaagagatcctgagttgggggacaaggcaactgaataccagcatgatctgagggatatggtgttggagaaagcaaaaaggctcgaggaactaggttgggaggaatataccgagctatacttgaagaagcattga

SEQ ID NO: 13041 - protein, 631 aa, Oryza sativa (japonica cultivar-group)
MHSRLLSAPSHASAASSSPLPFAAAHPCRASWTPRPTSPLPPLSLLRATASMHPSPPPEGHSDQPVHGVTNTVVGVLGGGQLGKMLCQAASQMGVRMAILDPLEDCPASSVCHEHVVGSFNDGATVSEFAKRCGVLTVEIEHVDAVTLEKLEKQGIDCEPKASTIMIIQDKYRQKTHFSKFGIPLPDFVEVDTLSSIEKAGEMFGYPLMVKSKRLAYDGRGNAVAHDKKELSSVVASLGGFEHGLYVERWTSFVKELSVIVARSRDGSTVCYPVVETIHKDNICHVVEAPAEVPDKIKKLATNVAEKAIKSLEGAGVFAVELFLTQDNQVLLNEVAPRPHNSGHHTIESCYTSQYEQHLRAILGLPLGDPSMKAPASIMYNILGEDEGEAGFTQAHQLIERALDISGASVHWYAKPEIRKQRKMGHITIVGPSKYSVKARLDKLLQRDAYDPKKVAVKPRAAIIMGSDSDLPVMKDAAVVLKKFNIPFELTIVSAHRTPERMYHYALSTKERGLEVIIAGAGGAAHLPGMVASLTSVPVIGVPIMTSSLHGTDSLLSIVQMPKGIPVATVAIGNAENAGLLAVRMLASRDPELGDKATEYQHDLRDMVLEKAKRLEELGWEEYTELYLKKH

SEQ ID NO: 13042 - DNA, 1929 bp, Arabidopsis thaliana
  CDS (1)..(1929)
atgttgcttttgaaacaaagctcagctgctgttcttgtcgttggaaatacaactccagtccttcacacttctcgctccacctacagagttggaccttttccagtgaccagaacgcagtcgttccagagtttgactatggcaaatttgcagaagcttcccacttcttcgtctgggaaattgaatacggcttcagctgtgccctgtagctctcacgatgcttctcctatcagtgagaatcgcgagaataaacatgtccatggagtttctgagaaaattgtgggagttcttgggggtggacaattgggtcgtatgctttgccaagctgcttctcagttggctatcaaagtgatgattttagatccttctaaaaattgttcagcaagtgcattgtcctacggtcacatggttgatagctttgacgacagtgctacagtagaagaatttgcaaaaagatgtggagtcttaactgtagaaattgaacatgttgacgtggacacactagagaagcttgagaaacaaggagtggattgccaacccaaagcttctactattaggataatacaggataaatacatgcaaaaggttcatttctctcagcatggcatcccacttccagaatttatggagataagcgatattgaaggagcaagaaaagcaggtgaacttttcggttaccctcttatgatcaagagcaaacgattggcttatgatggacgtggaaatgcagttgccaacaaccaagatgagctttcttctgctgtaacggctcttggaggtttcagtcgtggtttgtatattgagaaatgggcaccttttgttaaggagttagctgttattgtggctagggggagagatggttctatggtttgttatcccgttgttgaaaccattcacagggataacatatgccatatagttaaagcacctgcagatgtgccttggaagattaacaaacttgccaccgatgttgcccaaaaggctgtcggttctttagaaggtgctggtgtttttgcagttgaactgttcttgacagaggatagtcagattctgctaaacgaagttgcacctagaccacacaacagtggccatcaaacgatcgagtgctgttatacttcacagtttgaacaacacttgcgagctgtggttggtcttccacttggtgatccgtcaatgagaactccggcgtccattatgtacaatattctgggagaagatgatggagaagcaggtttcaaattggctcatcggcttattgcaagggctctgtgtattccaggtgcatctgttcattggtatgacaagccagaaatgagaaagcagagaaagatgggtcacatcactcttgttgggcagtctatgggcattttggaacaaaggttacaatgcatattaagtgagcaaagccaccaagtacacgagacacctcgtgttgctatcatcatgggttcagacacggatcttcctgttatgaaggatgctgccaaaattctggacctgtttggtgtgacacatgaggtaaagatagtttctgctcatcgcaccccagagatgatgtatacatatgcaacctcagctcatagtcgaggcgttcaagtcattattgcaggtgctggtggtgctgctcacttaccaggtatggttgcttcactcactcctttgcctgtgattggtgtccctgtccgtgctacccgtttggatggagttgattcacttctttccatcgttcagatgcctagaggtgttcctgttgcgacagttgcaataaacaatgcgaccaacgcagccttgcttgcagttcggatgttgggaatctctgatacggatcttgtctcaaggatgaggcagtaccaggaagacatgagagatgagaacctgaataaaggagagaaactggagacagaaggttgggaatcatatttgaaccagtga

SEQ ID NO: 13043 - protein, 642 aa, Arabidopsis thaliana
MLLLKQSSAAVLVVGNTTPVLHTSRSTYRVGPFPVTRTQSFQSLTMANLQKLPTSSSGKLNTASAVPCSSHDASPISENRENKHVHGVSEKIVGVLGGGQLGRMLCQAASQLAIKVMILDPSKNCSASALSYGHMVDSFDDSATVEEFAKRCGVLTVEIEHVDVDTLEKLEKQGVDCQPKASTIRIIQDKYMQKVHFSQHGIPLPEFMEISDIEGARKAGELFGYPLMIKSKRLAYDGRGNAVANNQDELSSAVTALGGFSRGLYIEKWAPFVKELAVIVARGRDGSMVCYPVVETIHRDNICHIVKAPADVPWKINKLATDVAQKAVGSLEGAGVFAVELFLTEDSQILLNEVAPRPHNSGHQTIECCYTSQFEQHLRAVVGLPLGDPSMRTPASIMYNILGEDDGEAGFKLAHRLIARALCIPGASVHWYDKPEMRKQRKMGHITLVGQSMGILEQRLQCILSEQSHQVHETPRVAIIMGSDTDLPVMKDAAKILDLFGVTHEVKIVSAHRTPEMMYTYATSAHSRGVQVIIAGAGGAAHLPGMVASLTPLPVIGVPVRATRLDGVDSLLSIVQMPRGVPVATVAINNATNAALLAVRMLGISDTDLVSRMRQYQEDMRDENLNKGEKLETEGWESYLNQ

SEQ ID NO: 13044 - DNA, 1818 bp, Magnaporthe grisea 70-15
  CDS (1)..(1818)
atgtctcaagaaacagttgtaggcctcctcggaggaggccagctgggtcgcatgctttgcgaggcagcaggaccacttggctttcccatcgccatacttgacgagggaaacagtcctgccaagcaggccctccacggcccgcatgttgacggctccttcaaggatcctcaaaaaatccgcgagctcgccaggaagtgcgacgtgctcaccgtggagatcgagcacgttgacaccgaggtcctggaggagattgctactaaaggcgtcgaggtgcaagggtctatgaagaagatcccggtgcacccctcatgggagaccatccgccttatccaggataagttcctccagaaggagcactacaagaaacacaagctgccgatcgcggagcaggtggctattgagtcgggagacgccatgctgtcatcactcaaggatgcaggacgtaaatttggctaccccctgatgctcaaggcacgtaagggctcctacgatggtcgggggaactttaaaatctcaagcgaggcagatttggagcatgcggtaaaggaacttggctccctgtcgctgtatgctgagaagtggtgcaaattcgttcaggagctcgccgtcatggtcatcaggacagaggacgaccaaggaaacctgaagtccctggcagcataccctgccgttgagaccatccacgaggacagcatctgcaccaagactttcatgccgcccaggaatgtgtcggatgaaatctgcgagaaggctagagaaacagcacgtcaagtcatctcaaccatctccgggagaggtgtctttgccgtcgagatgtttttgctggaagacggctccatcttggtcaacgaggtcgcgccgaggcctcataactcgggccattacaccatcgaggctgtgccttatttttcgcaatacaaagcccagctatacgcccttctggatctgcctataccaaaacagctgaagcctcgggtggcttccgccatcatgataaatattcttggtggcgccgggcccgagtcccacaacgacctggtagagaccgcagcgcgctcgttcgaagacgacatcgacgtacatgttcacctttacggcaaggccagcaagcccggaaggaagattggccacatcaccatcacatcagagctgaggatcgcggagctacagaagaagtctgagcatttgttcgtcctggctgatgcgatgcgggcagagcgtctcaaggctgcgtcggcgcagttgaggccacaagaatcggttgtcaagtccagctccagtgcaccatccaagacagatgcactggtcctcgtgaccatggggtcagactcggatttgccagtgatgaaggcaggccttgacatcctgaagcagttcggagtgccctacgaagtcaggatcacgtctgcccacaggacgccgaacctgatgggagacgtggctgccgaggctgcaggtcgcggaatcaaggtagccattgctgcggccggcggcgctgcccatctgcctggcatgtttgcatcccactgccccatcccagtcattggtgtgcctgtcaaggcgactcacctggacggagaggacagtcttctcagcatcgtgcagatgcccaggggcgtccccgtggccacggttggcatcaacaactcgaccaacgctgcactccttgcaatccgcatgctcgggtccttcattcctaaataccaggaccaaatgaagagttaccagcaagaaatggaggatgccgttctggccaaggatgaggagctacgtggtatcgggtacgagtcttacctggccaaaatgggtaagaagtag

SEQ ID NO: 13045 - protein, 605 aa, Magnaporthe grisea 70-15
MSQETVVGLLGGGQLGRMLCEAAGPLGFPIAILDEGNSPAKQALHGPHVDGSFKDPQKIRELARKCDVLTVEIEHVDTEVLEEIATKGVEVQGSMKKIPVHPSWETIRLIQDKFLQKEHYKKHKLPIAEQVAIESGDAMLSSLKDAGRKFGYPLMLKARKGSYDGRGNFKISSEADLEHAVKELGSLSLYAEKWCKFVQELAVMVIRTEDDQGNLKSLAAYPAVETIHEDSICTKTFMPPRNVSDEICEKARETARQVISTISGRGVFAVEMFLLEDGSILVNEVAPRPHNSGHYTIEAVPYFSQYKAQLYALLDLPIPKQLKPRVASAIMINILGGAGPESHNDLVETAARSFEDDIDVHVHLYGKASKPGRKIGHITITSELRIAELQKKSEHLFVLADAMRAERLKAASAQLRPQESVVKSSSSAPSKTDALVLVTMGSDSDLPVMKAGLDILKQFGVPYEVRITSAHRTPNLMGDVAAEAAGRGIKVAIAAAGGAAHLPGMFASHCPIPVIGVPVKATHLDGEDSLLSIVQMPRGVPVATVGINNSTNAALLAIRMLGSFIPKYQDQMKSYQQEMEDAVLAKDEELRGIGYESYLAKMGKK

SEQ ID NO: 13046 - DNA, 1788 bp, Gibberella zeae PH-1
  CDS (1)..(1788)
atgagtggaaagccagagctcggactcctcggtggtggccaactcggccgaatgctatgcgaggccgcatcacccctcgaagttgaaatcgccatcctcgatgctcaagacgccccagccaaacaagtctcccgcagcaagtaccacgtcgacggatctttcaaggaccccgccaagatcagggaacttgcctcgcactgcaaggtcctcagtgtagagacggaacacatcgagactgccgttctcgaggagctgagcaaggagggcaaggttgtcgtctacccttcatggaagacattgcgtcttatccaggacaagtatgagcagaaggattatcttggcaagcagggcattcccatcgctgagcaggtcgctgtccaagcttcgggtagtgatgacatgcgcgctgctctcaaggacatttccaacaagtacggtctgcctttcatgctcaaatcgcgaaaggattcttacgatggacgtggaaacatcaagatcgccaatgataacgacatcgagacagccgtgaccgagtttggaaacctacaatgctatgccgaaaagtacgtccccttccagcgtgagctgtccgtcatcgtcatccgcacagaggacgccgatggtaagacaaagcgtctggtgccataccccgccgtggagactgtccatgaggacaatgtctgttcgcgcgtgtacatgcctccacgcgacacccccgatgctgtatccaagcgtgcccaggaggttgctgtcagtgtggttgagaagctctggggacgaggcgtttttgctgttgagatgtttgtcactgagaacaatgacattctcgtcaatgagattgctccccgacctcacaattctggacatctcacaatcgaagcagtgccctacatgtctcagtacaaggcccaacttacatccatcctcgacgaacccctccccgaaacgctcgagccccacgtctcgtccagcatcatgatcaacatcctcggcggtgcttcaccagaatctcatatccctctggtcaacaaggccaagtccatgtttgcccctaagattggtgtctatcctcatctttacggcaaacaatccaagcccgggcgcaagattggtcacatcactcttactggcctcgaggggaccatcaaggatctcgaaaagtttgcgcagccactcgtccagttggcggctgatatgcgccaagagagaattgaggcgaagagcaaggctatgagacctgagcaagctgttgtcaagactgcaaaggacccattggttcttgttaccatgggttctgactcagatctccctgttctcaaggctggtcttgatattctcacacagtttggtgtcccttgggaggttgatattacttctgcacaccgaacgcccgtcaagatgggggatgtcgctgttgctgctgctgatcgtggcatcaaagtgattattgctgctgctggaggagctgctcacttgccaggcatgatctcggcttacacgcctctgcccgtcatcggagttcccgtcaaggctactcatctcgacggaatggattcccttctcagcatcgtccaaatgcctcgaggtgttccaactgccaccgtgggtatcaacaactccactaacgctgcccttcttgccatccgcatcctcggtgctttcatccctgaatacctggagaagatgaagggatatcaaacagacatcggagagcaggtcaacggtaaggccactcgtctgagagaatcagatgtggaatcctatctcgcccaaatgaagaagggttag

SEQ ID NO: 13047 - protein, 595 aa, Gibberella zeae PH-1
MSGKPELGLLGGGQLGRMLCEAASPLEVEIAILDAQDAPAKQVSRSKYHVDGSFKDPAKIRELASHCKVLSVETEHIETAVLEELSKEGKVVVYPSWKTLRLIQDKYEQKDYLGKQGIPIAEQVAVQASGSDDMRAALKDISNKYGLPFMLKSRKDSYDGRGNIKIANDNDIETAVTEFGNLQCYAEKYVPFQRELSVIVIRTEDADGKTKRLVPYPAVETVHEDNVCSRVYMPPRDTPDAVSKRAQEVAVSVVEKLWGRGVFAVEMFVTENNDILVNEIAPRPHNSGHLTIEAVPYMSQYKAQLTSILDEPLPETLEPHVSSSIMINILGGASPESHIPLVNKAKSMFAPKIGVYPHLYGKQSKPGRKIGHITLTGLEGTIKDLEKFAQPLVQLAADMRQERIEAKSKAMRPEQAVVKTAKDPLVLVTMGSDSDLPVLKAGLDILTQFGVPWEVDITSAHRTPVKMGDVAVAAADRGIKVIIAAAGGAAHLPGMISAYTPLPVIGVPVKATHLDGMDSLLSIVQMPRGVPTATVGINNSTNAALLAIRILGAFIPEYLEKMKGYQTDIGEQVNGKATRLRESDVESYLAQMKKG

SEQ ID NO: 13048 - DNA, 1710 bp, Kluyveromyces lactis NRRL Y-1140
  CDS (1)..(1710)
atggatcaaagaactgtcggtattttaggcggtggccaattgggccgtatgattgttgaagctgctcatagactgaatgtgaaaactatcattttggatgcagaaaactctccggcaaagcagattaatgctttgagcgaacatgtcaatggttcctttgccaaaccggaagatatcaagaaaattgcatctctttgtgatgtcttaactgttgaaatcgaacacgtcgatgttccaactttgaaaagggttcaacaggatcaccctaacttgaagatctatcccgacccagagacgatcgctttgattcaagataaatttgttcaaaagcaatatttgattcagaataagatcagtgtggcaaagtccgttgctgttaacagcgatgaagaatcgttggctaaagttggttttgaatttggttacccattcatgcttaaatcaagaactttagcctacgatggcagagggaactttgtcgtgaaatccaaggagtctctttccgaagcacttgaggtattgaaagatcgtcccttgtatgccgagaaatgggctccattcgtcaaagagttggctgtaatggtcgtgagatctccagaaggtaaagtgttttcttacactactgttgaaactattcatcaggataatatttgccatttgtgctatgctccagctagagtcccagattccgtccaattgaaagctaagctcttggcagaacatgctattgcagcattcccaggcgctggtatctttggtgtggagatgttctatttagaagacggggaattactcataaatgaaattgctccaagacctcacaactctggccattatacaattgacgcatgtgttacctctcaattcgaagctcacataaggtcaatcttaaacctaccgttacctgaagggttcagtgccttgtctaccacaaacaccaacgctatcatgttaaacgtcttgggtgatcatgctgaaaagaataaagaactacaaatctgtgaaagagcactatctacacctggtgcctctgtatatctttacggtaaagaatcaagaccgcagagaaagatgggtcacattaatatcattggatcttcaatgagcgaatgcgaacgtaaactaaaatatatcatgtatgccgatgctgcttacgaacatatcgccaccagggaattcactctacccggcgcgtctatgagaccattgatcagtattattatgggatcagactctgatctaccggttatgtccaaggcctgcgatatcttgaatgattttaatattcaatatgaagtgaccatcgtctctgctcatagaactccacacagaatgtctaagtttgctatcgaagctgctaaccgtggtatcaaagccatcattgccggtgctggtggtgcagcccacttaccaggcatggtggctgctatgactccgttgccagtcatcggtgttccagtaaagggctccaccctagacggtgtcgattctctacattccattgtacaaatgccaagaggtgtacccgtggccacagttgcaattaacaatagtacaaatgctgctttgttagcaatcagaattttgggtgcgtatgatccagtatacttctctaagatgcaacaattcttacaaaaacaagaagaagaggtgttaacgaaagctgccaaattagaaactatcggatatcaagaatacttgaaaaaatag

SEQ ID NO: 13049 - protein, 569 aa, Kluyveromyces lactis NRRL Y-1140
MDQRTVGILGGGQLGRMIVEAAHRLNVKTIILDAENSPAKQINALSEHVNGSFAKPEDIKKIASLCDVLTVEIEHVDVPTLKRVQQDHPNLKIYPDPETIALIQDKFVQKQYLIQNKISVAKSVAVNSDEESLAKVGFEFGYPFMLKSRTLAYDGRGNFVVKSKESLSEALEVLKDRPLYAEKWAPFVKELAVMVVRSPEGKVFSYTTVETIHQDNICHLCYAPARVPDSVQLKAKLLAEHAIAAFPGAGIFGVEMFYLEDGELLINEIAPRPHNSGHYTIDACVTSQFEAHIRSILNLPLPEGFSALSTTNTNAIMLNVLGDHAEKNKELQICERALSTPGASVYLYGKESRPQRKMGHINIIGSSMSECERKLKYIMYADAAYEHIATREFTLPGASMRPLISIIMGSDSDLPVMSKACDILNDFNIQYEVTIVSAHRTPHRMSKFAIEAANRGIKAIIAGAGGAAHLPGMVAAMTPLPVIGVPVKGSTLDGVDSLHSIVQMPRGVPVATVAINNSTNAALLAIRILGAYDPVYFSKMQQFLQKQEEEVLTKAAKLETIGYQEYLKK

SEQ ID NO: 13050 - DNA, 1686 bp, Debaryomyces hansenii CBS767
  CDS (1)..(1686)
atggacggaaaaactataggtatattaggtggtggccaattaggtcgtatgattgttgaagcagcacatagattgaatattaaaaccattatcttagatgcgcctaactcaccagctaagcagattaatgcattggatgaacatgttaacggttcattttcagacgcaaagtctatcatggaattagccagaaaatgtgatattttaacagtagaaatagaacatgttgatgcccacgcattacaagaagctaaaaataaatatggtgtcgagatctacccattgccagagaccatcaagatgatccaagataaatattcgcagaaagaacacttgattgaacacggaattgatgttactgaatctattgatgttaaggaaaataacatcgaaacgttatcggaagttggtaacaagttccaatatccattcatgttgaagtcaagaactttagcatacgacggtaggggaaattacgtagtcaagagtaaggaccacttgtcagaagcattagaatatttaaaggatagaccattgtatgcggaaaaatggtgcaagttttccaaggaattagctgtcatggtcgtaagatctattgaaggggaggttttcgcgtaccccactgtggaaacagtccataagaataacatttgcgatgttgtctacgcgccagctagaatcactgatactttatctgtcaaggcatcgattttggctaagaatgccgtcaaatcattccctgggtgtggtattttcggggtcgagatgttcttattgtcaaatggtgaattattgattaatgaaatcgcaccaagacctcataactctggtcattatactatcgatgcttgtgtcacatcacaatttgaagctcatgttagagctgtcgttggattgccaatgcctaaggactttaccaagttttccaccactaacaccaacgccattatgttgaatgtgttaggtgacgatactgctaataaggaattagagatctgtcgtagagcattagaaactccaaatgcctcagtctatctctatggtaagagtactagaccccaaagaaaaatgggtcatattaacattgtttcatcatccatgaaagactgtgaaaacagattagcacacatcttaggtggcgaagaaggagtagccaaggaccttgatgtttctgcagaaaagccattagttggaataataatgggttctgattccgatttaccagtcatgtcagtgggtgcaaatatcttgaagactttcggggtaccatttgaagtgaccattgtaagtgcgcaccgtacgccccacagaatgactcaatatgctatcgaggccgccaagcgtggtatcaagtgtattattgccggtgccggtggtgctgctcacttgccaggaatggttgcagccatgaccccattgccagttattggtgttccagtcaagggatctaccttggacggagtcgattcgttacactcgattgtgcaaatgccaaggggtattccagtcgctaccgtggctattaacaacagtaccaacgccgcattattggcggtcagaatcttgggtgccatcgacaacaagtggttaaacaagatgtcacagtacatggactccatggagagtgaagttttggccaaggctgacaagttggagtcggtgggctacgaaaactacaaggcgtaa

SEQ ID NO: 13051 - protein, 561 aa, Debaryomyces hansenii CBS767
MDGKTIGILGGGQLGRMIVEAAHRLNIKTIILDAPNSPAKQINALDEHVNGSFSDAKSIMELARKCDILTVEIEHVDAHALQEAKNKYGVEIYPLPETIKMIQDKYSQKEHLIEHGIDVTESIDVKENNIETLSEVGNKFQYPFMLKSRTLAYDGRGNYVVKSKDHLSEALEYLKDRPLYAEKWCKFSKELAVMVVRSIEGEVFAYPTVETVHKNNICDVVYAPARITDTLSVKASILAKNAVKSFPGCGIFGVEMFLLSNGELLINEIAPRPHNSGHYTIDACVTSQFEAHVRAVVGLPMPKDFTKFSTTNTNAIMLNVLGDDTANKELEICRRALETPNASVYLYGKSTRPQRKMGHINIVSSSMKDCENRLAHILGGEEGVAKDLDVSAEKPLVGIIMGSDSDLPVMSVGANILKTFGVPFEVTIVSAHRTPHRMTQYAIEAAKRGIKCIIAGAGGAAHLPGMVAAMTPLPVIGVPVKGSTLDGVDSLHSIVQMPRGIPVATVAINNSTNAALLAVRILGAIDNKWLNKMSQYMDSMESEVLAKADKLESVGYENYKA

SEQ ID NO: 13052 - DNA, 1698 bp, Yarrowia lipolytica CLIB122
  CDS (1)..(1698)
atggactcgaaaacaattggtattcttggaggaggtcagctgggccgaatggtcgtggaggctgcccatcgactcaacgtcaagactgtcattctagacgcccccaactctcccgccaaacagattcatgctggagagcatgtcgatggctccttcaaggaccctgccgacattgctaagcttgcctccaagtgcgacgtcataaccgttgaaattgagcatgtgaacgccgacactctggccgatctccagaagactggtgtcgaggttcacccttctcctgagaccatccgaattatccaggacaagtaccgacagaaggagcacctgatctcccacggcattcccgttgccgaatcctacgaggtcaccgagtctactgaggctgcccttgtcgttgctgctgaaaaggtcggctatccttgtgttgtcaaggccaagactcttgcttacgatggtagaggcaacttcgttcttaagggtccagagaatgtcaaggaagctcttgagttcctctccgaccgacctttgtacgtagagaaatggtgtcccttcgtcaaggagctcgctgttatggttgtccgatctaccgacggaaccactgttgcttaccccaccgtcgagactgttcagaaaaacaacatctgccatactgtctacgcccccgctcgagacgtttctccttccaccctgtacgaggctcagctcgttgccgagaacgccattaagtccttcactggcgctggtatctttggtgtcgagatgttcctgctcgaaaacggcacgattgttctcaatgagattgctcctcgaccccacaactccggtcattacacaacagatgcctgctccacctcgcagtttgaggcccatgtccgagccattcttggtctgcctcttttccccgagatggcccagatgcgaacagcagacactcatgccattatgctgaacattctaggaggtgacaagcccgacagcgagcttgagtactgcaagcggtcactttccgtacctgggtccaccatccatctctacggcaagaccacgagacccgagcgaaagatgggacacatcaacattgttgctagcagcatggacgaatgcgagcgacggctggccaaaatatctggagaggacatcgaggaggcaccaaagactgtcgagggtgtagcaggaacctctaagacccccctcgtgtctatcattatgggctcggactccgatcttaaggtcatgtctgccggagccgacatcctgcggaaatttgacattcccttcgaactgaccattgtgtctgcccaccgaaccgcccaccgaatggctaaatttgccgctgaggttgccagccgaggtgtcaaggctgtcattgccggagctggaggagccgctcaccttcccggaatggttgcctcggaaaccactctgccagtcatcggtgtccccgttaagggctcctctctggacggagttgactctctctactccattgtgcagatgcctcgaggcatccccgtggccaccatgggtgtcaacaactccaccaatgctgctctgctggccatccgaattctggctgcttacgacgccaccctacacattcgactggccgagtacatcaagaacatggagaaggaggttcttgccaaggccgacaagctcgagaccattggatacgagcagtacctcaaccaatag

SEQ ID NO: 13053 - protein, 565 aa, Yarrowia lipolytica CLIB122
MDSKTIGILGGGQLGRMVVEAAHRLNVKTVILDAPNSPAKQIHAGEHVDGSFKDPADIAKLASKCDVITVEIEHVNADTLADLQKTGVEVHPSPETIRIIQDKYRQKEHLISHGIPVAESYEVTESTEAALVVAAEKVGYPCVVKAKTLAYDGRGNFVLKGPENVKEALEFLSDRPLYVEKWCPFVKELAVMVVRSTDGTTVAYPTVETVQKNNICHTVYAPARDVSPSTLYEAQLVAENAIKSFTGAGIFGVEMFLLENGTIVLNEIAPRPHNSGHYTTDACSTSQFEAHVRAILGLPLFPEMAQMRTADTHAIMLNILGGDKPDSELEYCKRSLSVPGSTIHLYGKTTRPERKMGHINIVASSMDECERRLAKISGEDIEEAPKTVEGVAGTSKTPLVSIIMGSDSDLKVMSAGADILRKFDIPFELTIVSAHRTAHRMAKFAAEVASRGVKAVIAGAGGAAHLPGMVASETTLPVIGVPVKGSSLDGVDSLYSIVQMPRGIPVATMGVNNSTNAALLAIRILAAYDATLHIRLAEYIKNMEKEVLAKADKLETIGYEQYLNQ

SEQ ID NO: 13054 - DNA, 1719 bp, Aspergillus nidulans FGSC A4
  CDS (1)..(1719)
atgaatgtacctccgctattgaggatgtggaactcacgcaaagtcggcgtccttggcggcggccagctcggccgcatgttcgtcgaatctgccaacagactcaacattcaatgcaacatcctcgatgcggagaactccccagccaagcagatcagtgcccacgacgaccatgtcaccggctcattcaaggaacgcgaggccgttcgggaattggctaaaaagtgcgacgtcatcacggcggaaatcgagcacgttgacacctatgccctcgaggagattgcgtcgcaggtccaaattgagccgagttggcaggctattcgcacgattcaaaacaagttcaaccagaaggagcaccttgcaaaacatggaattcccatggcggagcatcgtgagcttgtggaaaacaccccggagcaattggctaaggctggtgaagagttgggatacccgttgatgttgaagtcaaagaccatggcttacgatggacgcggtaattaccgtgtcaactcgaaagacgatatccccgatgcgctggagttcctcaaaggccgcccattatcgcaggaactcgctgtaatggttatcaaaaccaaagacgccgttctctcctaccccaccgtcgaaactgtccaagaagactctatctgcaagctcgtctatgcgcccgcacgtaacgttccggaacacatcaaccaagccgcgcagaagctcgcgcgcaaggccgtcgcaaccttcgaaggcaagggcgcctttggcgtcgaaatgttcctcatgaacgataacagcctgctcctctgcgaactcgcttcccgcgtacacaactcaggtcactacaccatcgagggcaccgccctttcccaatttgatgcccatctccgcgcgatcctcgacctgcccatccccccagagagcctgcaactccgccaaccctcgatcatgctcaacataatcggtggctccgcgccggatacgcacctcaaagctgccgaggccgccctctctatacccaacgcttcaattcacctctacagcaagggcgatgccaaaccgggccgcaagatgggccacgtcaccgtcaccgcatcgacaatgcacaaggccgaggaatatattcaaccgctcattgacgtcgtcgacgaaatccgctcccagcgccaagacatcaaaacgaatcccgctccctcgggcgttactaagcctcccccgcaggtcgcagtgatgatgggctcggacagtgacctcaaaacccttgtgcctggtctgaagttgctccgggataaattcggcattgaacctgccgttgatatcacatccgcccaccgcacgcctaccttcatggcagaatactctgcctccgctgcggcccggggtatcaaagtcatcattgctgccgctggcggcgccgcgcatctacctggtatggctgcagcgcatacggcactccctgtcatcggtgtcccagttaagggctcatcgttggatggagtggatagcttgtacagtattgtgcagatgcctagaggtgtccccgttgcaacggtcggtatcaacaatagcatcaacgctgcgctcctggcagcgcggatcattggcgcgtttgacccggatgtccagcggaaggttgaggagtacgccgaggatgctcggaaggagaacatggatatgaaaaatgtaaagatgcaggatttggggtgggagaagtacttcaatcagatgtaa

SEQ ID NO: 13055 - protein, 572 aa, Aspergillus nidulans FGSC A4
MNVPPLLRMWNSRKVGVLGGGQLGRMFVESANRLNIQCNILDAENSPAKQISAHDDHVTGSFKEREAVRELAKKCDVITAEIEHVDTYALEEIASQVQIEPSWQAIRTIQNKFNQKEHLAKHGIPMAEHRELVENTPEQLAKAGEELGYPLMLKSKTMAYDGRGNYRVNSKDDIPDALEFLKGRPLSQELAVMVIKTKDAVLSYPTVETVQEDSICKLVYAPARNVPEHINQAAQKLARKAVATFEGKGAFGVEMFLMNDNSLLLCELASRVHNSGHYTIEGTALSQFDAHLRAILDLPIPPESLQLRQPSIMLNIIGGSAPDTHLKAAEAALSIPNASIHLYSKGDAKPGRKMGHVTVTASTMHKAEEYIQPLIDVVDEIRSQRQDIKTNPAPSGVTKPPPQVAVMMGSDSDLKTLVPGLKLLRDKFGIEPAVDITSAHRTPTFMAEYSASAAARGIKVIIAAAGGAAHLPGMAAAHTALPVIGVPVKGSSLDGVDSLYSIVQMPRGVPVATVGINNSINAALLAARIIGAFDPDVQRKVEEYAEDARKENMDMKNVKMQDLGWEKYFNQM

SEQ ID NO: 13056 - DNA, 1707 bp, Candida albicans SC5314
  CDS (1)..(1707): transl_table=12
atggatagcaaaactgttggtattttaggaggtggccaattaggtcgtatgattgttgaagcagcacatagattgaatatcaagaccgtaattttggacgcagccaaatcaccagctaaacagatcaatgctctagacgatcacgttgatggatcgttcacaaactatgattcgattgtgaaattagctgaaaaggcagacgtattaactgttgaaatcgaacatgttgatgttgatgctttaatcaaagttcaagagaaattccctaaagttgaaatatatccattacctgaaaccataagattgattcaagataaatatttacagaaaaatcatttaatcaaacacgatgttgcagttacagaatctgttgcagttgaaaccaacacagtcgatgacttgttacacattggggaaaagtttggatacccttatatgttaaaatcgagaactttggcgtatgatggtagaggtaactttgttgtcaaagacaagtcatactgtgagaaagctttagaatttttaaaagaccgtccattatatgctgaaaaatggtgtcctttcaccaaagaattggctgtgatggttgtcagatcattagaaggggaagtctttgcttacccaactgttgaaactattcatgaaaacaatatttgtcatttagtgtatgctcctgccaggatcccagatactttggccaaaaaggcatctatattagccaaaaatgcagttaagtcattcctcgggtgtggtattttcggtgttgaaatgttcttgttggaaaacaacgaattattgatcaatgaaattgcaccaagacctcacaactctggtcattataccattgatgcatgtgtcacttcacaatttgaagctcatgttcgtgctgtcacaggattacctatgccaaaggggttcactgaattctccacttccatcaccaatgctattatgttgaatgttttgggtgataaggcaactccaaataaagaattggagatttgtcgccgtgctttggaaactccacatgcgtcagtgtatctttatggtaaaactactagaccagagcgaaagatgggtcatatcaatgttgtcacatcttccatgcaagatgccgagagtagattaagttatatattgggtgataccactgaaattcctaaatctttagctaccgacaaggaatctccattggtgggaataataatgggttccgattcggatctaccagttatggcagttggtgctcgtattttgaaacaatttggtgtgccatttgaactcacaatcgtaagtgcacacagaactcctcatagaatgtctgagtatgctattgaagcaccaaagcgtggcttgaaatgtatcattgctggtgcaggtggtgctgctcatttgccaggtatggtggcggccatgaccccattgcctgtcattggtgttccagttaagggatctacattagatggggttgattcgttacactctatagtacagatgccaagaggtattcctgttgcaactgttgctattaacaatagtactaatgctgcattgttggcaatcagaatattaggcgcctatgactcaaaatggttgactgagatgaaccaatatatgttgaacatggaaactgaagtattaggtaaagcagaaactttagaagaaattggatatgaagactatttaactgataaattgaaaaaatag

SEQ ID NO: 13057 - protein, 568 aa, Candida albicans SC5314
MDSKTVGILGGGQLGRMIVEAAHRLNIKTVILDAAKSPAKQINALDDHVDGSFTNYDSIVKLAEKADVLTVEIEHVDVDALIKVQEKFPKVEIYPLPETIRLIQDKYLQKNHLIKHDVAVTESVAVETNTVDDLLHIGEKFGYPYMLKSRTLAYDGRGNFVVKDKSYCEKALEFLKDRPLYAEKWCPFTKELAVMVVRSLEGEVFAYPTVETIHENNICHLVYAPARIPDTLAKKASILAKNAVKSFLGCGIFGVEMFLLENNELLINEIAPRPHNSGHYTIDACVTSQFEAHVRAVTGLPMPKGFTEFSTSITNAIMLNVLGDKATPNKELEICRRALETPHASVYLYGKTTRPERKMGHINVVTSSMQDAESRLSYILGDTTEIPKSLATDKESPLVGIIMGSDSDLPVMAVGARILKQFGVPFELTIVSAHRTPHRMSEYAIEAPKRGLKCIIAGAGGAAHLPGMVAAMTPLPVIGVPVKGSTLDGVDSLHSIVQMPRGIPVATVAINNSTNAALLAIRILGAYDSKWLTEMNQYMLNMETEVLGKAETLEEIGYEDYLTDKLKK

SEQ ID NO: 13058 - DNA, 2247 bp, Ustilago maydis 521
  CDS (1)..(2247)
atggctcaacatctttggcgatgggaatctgatgtatgttaccttgcttcctcccgacaaccgcaagcgagccaaaatgaggaaacatacattcaaactgtggttcatgctccaccacctcctcacttgagcggggcccgttgcactttgaacgttgccaagttatccgagctcttactactgctcgagtcctcttctagctcccatctgaacgcgtgtacaatagcctactcgatccaccttgtcaacgtcggtcgtcctttccgccacttgcactcacagaggccacccttctacgttgacaaacacagacgacatcctttaaagccgatcggtatcaagatggaacagcgtgttgtgggtgtgctcggcgctggtcagcttggccgcatgtttgttgaagcagcggctcgactcaacgtgcaagtcaagctgctcgatgtcggcgacacggctccagccaagcagatcaactacctccctggccccgatggaaagtcgcaacacattgatggcagctttgccgatcccgaaaagatccgccagcttgcttcgcaggtagatgtgctcaccatcgagatcgagcacgtcgatgctaaccagcttcagaaggtgctcgacgacaagctcgtagatgccgtccatccgctcccctcgaccatcgctctgatccaggacaagtatcttcaaaaggttcatctagccaacaaaggactgccgctcgctgaatacgtcgctgtgggtccagaagacatggccaaggttgccgatgtagcacaggcgcgctcggctcagatccaagctgtggagaaaattggcaaggtgtttggattcccattcatgctcaagtcaaggacgcaggcatacgacggcaagggcaactatgtcgtccgatctgccgaccaggctgctgctgctgccgctgttgctgcgctaggcgatggcaagcgtggtttgtacgctgaaaagtgggcgccgttcgagcgtgaagtggcggtgatggtggtgcgtagcgtcacgggcgaagtacgagcgtatccggcggtggaaacggtgcacaagaacagcatctgccacacggtatttgctccgttgcgaaccgctgatccgggcgtcgaggcgcgcgcacgaaagattgccgagcaagctgtggccacgtttggtggagctggtgtttttggcgtcgagatgttcctcatgcccaacggcgagctgctcatcaacgagattgcaccgcgaccccacaactcggggcactataccatcgaagccgccgacacgagtcagtacgagaaccacgtgcgcgccatcctcggcttgccgttgggtagcacggcgctcaaggtcccctcggcggccatgatcaacattcttggtttggctgattcagacaaggatgcggaagcggtggccaagacgctggttcctgctgttgtcagtctcaacgttgctggcacgacgtgccacctgtacggcaaagcgggctgccgtcagggtaggaagatgggccacattaccattgtggggcagagcgatgctcaggtgcgagcacgtttgcgtgtggtagacgaggcgttggacaaggctacggagctcgccgagaagggcggcaagcttccttctgagctgacgcttgctggcgttgtggcactcaacgcttcggcatcgactggctcgtcaagctcacaagcgcttttggtagcgtcacccaagtcggcggctgacttttcgcatcctcagccattggtgggcattattatgggctcggatagcgatttgcccgtgatgatggcagcagccgagattctcaaaaagtttgacgtgccgtttgagctgaccattgtcagcgcgcaccgcacgccagatcgcatgcgcacgtatgcgcgcagtgcgcctgctcgcgggctgcgcgccatcattgcaggtgccggtggcgcggctcacctgccaggcatggtagctgcgcagacggcacttcccgtcatcggcgtgccggtcaagggcagcacactcgacggtgtcgattcgctgcacagcattgtgcagatgcctcgaggaatccctgttgccaccgtggctatcaacaacagcaccaatgcggcccttttggcgattcgcatcttgggcgctgctgacccgacgtatctggataagatgcaaaagtacatggaagagatggaaaacgaggtgaatggcaagatcgagcgtctggcccatgatgcatgggattacacgttgaacaagtag

SEQ ID NO: 13059 - protein, 748 aa, Ustilago maydis 521
MAQHLWRWESDVCYLASSRQPQASQNEETYIQTVVHAPPPPHLSGARCTLNVAKLSELLLLLESSSSSHLNACTIAYSIHLVNVGRPFRHLHSQRPPFYVDKHRRHPLKPIGIKMEQRVVGVLGAGQLGRMFVEAAARLNVQVKLLDVGDTAPAKQINYLPGPDGKSQHIDGSFADPEKIRQLASQVDVLTIEIEHVDANQLQKVLDDKLVDAVHPLPSTIALIQDKYLQKVHLANKGLPLAEYVAVGPEDMAKVADVAQARSAQIQAVEKIGKVFGFPFMLKSRTQAYDGKGNYVVRSADQAAAAAAVAALGDGKRGLYAEKWAPFEREVAVMVVRSVTGEVRAYPAVETVHKNSICHTVFAPLRTADPGVEARARKIAEQAVATFGGAGVFGVEMFLMPNGELLINEIAPRPHNSGHYTIEAADTSQYENHVRAILGLPLGSTALKVPSAAMINILGLADSDKDAEAVAKTLVPAVVSLNVAGTTCHLYGKAGCRQGRKMGHITIVGQSDAQVRARLRVVDEALDKATELAEKGGKLPSELTLAGVVALNASASTGSSSSQALLVASPKSAADFSHPQPLVGIIMGSDSDLPVMMAAAEILKKFDVPFELTIVSAHRTPDRMRTYARSAPARGLRAIIAGAGGAAHLPGMVAAQTALPVIGVPVKGSTLDGVDSLHSIVQMPRGIPVATVAINNSTNAALLAIRILGAADPTYLDKMQKYMEEMENEVNGKIERLAHDAWDYTLNK

SEQ ID NO: 13060 - DNA, 1749 bp, Cryptococcus neoformans var. neoformans B-3501A
  CDS (1)..(1749)
atggcccccagaaagactgtcggtatcctcggcggtggccagctcggccggatgcttacccaccctgcggcccttctcggcattcctctccttatcctcgactctggctcctacacgcccgccaaacagactcttcttcctcctcctcctcattctcaccctgatggtcctttcacttcggaaactcatattcgcaaacttgcctctgcgtgcgacatcctgacagtggagatcgagcacgttaacgccgatgtccttgaggctgtagaaaaggaaggtctttgtgaagtccagcccagtcccaaaactatcagattgatccagaacaagtacgaccaaaagaagtaccttgctgaaagaggtgtggctgttgcaccttttgaggagcttcccgcaaacccgacggaagaggattttaaggctatcgcaggtcgattgggtttgcctttgatgctcaaagctaagacccttgcctacgatggacgtgggaactctcctcttaaatccgcatcttcagaggacattcaggcttccttgaaattccttggtgacaggcctctttatgctgaaggatgggcgccctttgtcaaggaagttgcggttatggtcgttaggaataaggagggcgaagtccaaagttacgacgccgtcgagactattcacagggagagcattttgcgagtctgtttgactcccctcagaggtgaaaagggtgtgaatcagagggctagggaattagctgagaaggcggtcggacaccttgagggtgctggtatctttggggttgagatgttcctcatgcctgatggtgaacttcttctaaacgagattgctcctcgtcctcacaactctggtcatcacactattgaggcctgtcttacttcccaatttgagaaccaccttcgagccattctctccttgcctcttggctctactgctcttcgtgttccatccgctgccatggtcaacattctcggtgcctcgtcgactatggacgccatcgacaaaatggcagacaatgctctcactgttcctggtgctgccgtgcatctctacggcaaagctgagagccgaaaggcccgtaagatgggccacatcacggtgactgccgaaagcgatgctgagctcaatgagcgccttagagctctcttattcgcccagcctgatgctcatgccgactggatcgacctcatcgcccctccttcccctgctcccgctcattcccacgccaaaccccttgttggtatcatcatgggtagcgactctgacttgcccgttatgcaccctgctaccaagatcctcgaaaaattcggtgtcccctacgagctcaccataacttctgcccatcgcactcctgagcgaatggtgaagtatgcgaagactgctgcagaccgaggattgcgagccatcattgctggggctggcggtgctgcccatttaccaggtatggtcgccagcgagaccagtttgccagtcatcggtgtgcccgtcaaggccagtgtactggatggcgtggattcattgtatagtattgtgcaaatgccccgaggtattccatgcgccactgtgggtatcaacaactctacaaatgccgcgctacttgcagtccgtatccttggaacgtctgtacccgcccttaacaaggctactgaggaatattccaaggcgctagaggaagaagttttggctaaagtcgacattttggaggaggaaggctgggacaagtacatcgagaggctgaagaaataa

SEQ ID NO: 13061 - protein, 582 aa, Cryptococcus neoformans var. neoformans B-3501A
MAPRKTVGILGGGQLGRMLTHPAALLGIPLLILDSGSYTPAKQTLLPPPPHSHPDGPFTSETHIRKLASACDILTVEIEHVNADVLEAVEKEGLCEVQPSPKTIRLIQNKYDQKKYLAERGVAVAPFEELPANPTEEDFKAIAGRLGLPLMLKAKTLAYDGRGNSPLKSASSEDIQASLKFLGDRPLYAEGWAPFVKEVAVMVVRNKEGEVQSYDAVETIHRESILRVCLTPLRGEKGVNQRARELAEKAVGHLEGAGIFGVEMFLMPDGELLLNEIAPRPHNSGHHTIEACLTSQFENHLRAILSLPLGSTALRVPSAAMVNILGASSTMDAIDKMADNALTVPGAAVHLYGKAESRKARKMGHITVTAESDAELNERLRALLFAQPDAHADWIDLIAPPSPAPAHSHAKPLVGIIMGSDSDLPVMHPATKILEKFGVPYELTITSAHRTPERMVKYAKTAADRGLRAIIAGAGGAAHLPGMVASETSLPVIGVPVKASVLDGVDSLYSIVQMPRGIPCATVGINNSTNAALLAVRILGTSVPALNKATEEYSKALEEEVLAKVDILEEEGWDKYIERLKK

SEQ ID NO: 13062 - DNA, 2115 bp, Physcomitrella patens
  CDS (1)..(2115)
atgggtgtgttgtgtgcctcatcgcaaggagctgctctgaaaagtcttgtcgacgctcctgccaaggtcaccgcctcggcggcttcgtctgcactcccacttcccggttttgcatcggggaggactgcgaaggctttgaggtcaagtagggagtgcctgaccattgctttgaaaggagggcttagccagggtttagggaactcttgcgccggaattagcagaaagagagaattgcgcctcacacaaactgctatttcggccacaactgagtcctctgaaactgtggaggatcaccaggagcagggagacgtcgcggtcatgaactctagtgggtgcgaaacgttgtgcacaacgacatggggtctgtgtgatacggtaatcggggttctcggcggcgggcagctcggacggatgctctgccaagctgcctctcccatgggcattaaagtatctgttttggacccgcttgaggattgtccagctgggaacattgcgtaccattatcaagttgggagtttcaaagatatgcaggctgttcgggaattcgctaaaggatgtggcgctttgactgtggagattgagcatgtgaatgttgagacgctcgaggctcttgcacgcgagaatgtcgacattgagcccaaacctttcacaattcgcattattcaggacaagtatatgcagaagatgcacttcaagaaacacgacgtagcccttcccgagtttatgaagattgactctgcggaggaggcggaggaggctgggaagttgtttggctacccgctgatgttgaagagccggcgggacgcatatgatggacgcggtaacgcggtggttgaatccagggaagctctacccctagcgatttcgtccttagggggcattgaacggtgtctttacgctgagaagtgggcgccatttgtaaaggagttggccatcatggtggctagagggagggatggttccattcgctcctttccagtcgtcgaaaccacacatgttagcaacatttgtcatacagttgaagctccggcccgtatccctaaagaggtcgctgaattagccatgcaggttgcagagcgagcagtgggatctctatctggagctggcatgttcggtgttgagcttttccttctcaaggatggaaacgtattgctgaacgaagtcgcaccgagaccccataactgtggacattacacaatcgaatcatgcttcgtctcccagtatgagcagcacctgcggtgtgtcctcgggcttcctctcggcgacccctccatgaaggtccctgccgctttgatgtacaacattttaggtgaagcagatggagaggaggggttcaccatcgcgcacaacattatgcgtagagccatgtctgtgccaggggcgagtgtacactggtacgagaaaccagaaatccggaagcagaggaaaatggggcacatcacggttgtaggcccaacggctgaggttgtgcgagctcgtatgaattggatcatcaacacgaaaggcatacaagattaccccaagaaaaagccatccttcgtctctggtgttcttccttcgaatgtagccactgcgctggcaagctcttctgaagatgcaaaaccatcgggcccgcctgttggaattatcatgggatcggactcagacttgccagtaatgtctgctgctgcagagattttggactcattcggtattccatatgagttgacggtggtgtctgctcacaggactccagagaggatggtctcatacgcccagactgcacacaaacgtggtgtaaaggtgattatcgctggggcaggaggagctgctcacctccccgggatggttgcttctttgactccgcttcctgtgattggagtgcctgtgaaaggaagccatacagatgggctggactcgttgctgtctatcgtccagatgccacgaggaattcccgttgctacagtagcgattcagaatgcaacaaatgcaggtctcctggctgtgcggatgcttggtgtagagagtgatcagattgttgataagatggctgcctaccagaacagcttgaaggatatggtgctcgagaaagcagagaggctcgagactatcggctggaaagagtatttgaagtga

SEQ ID NO: 13063 - protein, 704 aa, Physcomitrella patens
MGVLCASSQGAALKSLVDAPAKVTASAASSALPLPGFASGRTAKALRSSRECLTIALKGGLSQGLGNSCAGISRKRELRLTQTAISATTESSETVEDHQEQGDVAVMNSSGCETLCTTTWGLCDTVIGVLGGGQLGRMLCQAASPMGIKVSVLDPLEDCPAGNIAYHYQVGSFKDMQAVREFAKGCGALTVEIEHVNVETLEALARENVDIEPKPFTIRIIQDKYMQKMHFKKHDVALPEFMKIDSAEEAEEAGKLFGYPLMLKSRRDAYDGRGNAVVESREALPLAISSLGGIERCLYAEKWAPFVKELAIMVARGRDGSIRSFPVVETTHVSNICHTVEAPARIPKEVAELAMQVAERAVGSLSGAGMFGVELFLLKDGNVLLNEVAPRPHNCGHYTIESCFVSQYEQHLRCVLGLPLGDPSMKVPAALMYNILGEADGEEGFTIAHNIMRRAMSVPGASVHWYEKPEIRKQRKMGHITVVGPTAEVVRARMNWIINTKGIQDYPKKKPSFVSGVLPSNVATALASSSEDAKPSGPPVGIIMGSDSDLPVMSAAAEILDSFGIPYELTVVSAHRTPERMVSYAQTAHKRGVKVIIAGAGGAAHLPGMVASLTPLPVIGVPVKGSHTDGLDSLLSIVQMPRGIPVATVAIQNATNAGLLAVRMLGVESDQIVDKMAAYQNSLKDMVLEKAERLETIGWKEYLK

SEQ ID NO: 13064 - DNA, 1815 bp, Vitis vinifera
  CDS (1)..(1815)
atggggaagattgcccgcatcccctatgattggccttttctcaaaaataattgtttttcttcatggtctcctcctcagttaaaacagagagttccaatatgtttaattgaattgaggtttttgtttcctcaggtcccagatgatttaccagtacatggactatcggaaacagtagttggtgttcttggtggagggcaattgggccgtatgttgtgtcaagcagcgtcacaaatggctatcaaagtcattgttttggacccacttgagaactgcccatcaagctcaatctccaattatcatatggttggaagctttgatgatagtgctactgtccaggaatttgcaaagagatgtggaatattgaccgtggaaattgaacatgttgatgtggcaactctcgagaagcttgagcaacaaggagtagattgccaacctaaggcatctactattcgaataatccaggataaatatctccaaaaagttcacttttctcggcatgcaattccacttcctgagtttatgcagatagatgatcttgaaagtgccaagagagctggagatctgtttggctatcctcttatgatcaagagcaaaaggcttgcttatgatgggcgtggaaatgcagttgctaagagtgaagtggagctttcttctgctgtgactgcgcttggaggatatgaacatggtttatatattgagaaatgggcaccttttgtaaaggagctggccgtcattgtggcaagaggaagagacaattctattttgtgctatcctgttgttgaaactattcacaaggagaacatctgtcacatagttaaggcacctgctgatgtgccttggaagatcagaagacttgccacggatgttgcatataaagctgttagttcattagaaggtgctggtgtgtttgcagtagagatgtttttgactatagatggtcagattttactaaatgaagtagcacctagacctcacaatagtggtcatcacactattgaatcttgctacacttcacaattcgaacaacatcttcgggcggttgtcggccttcctcttggtgatccatcaatgaaaaccccagctgctattatgtacaatttactgggtgaagatgagggagaggctggtttcagttttgccaataaactgattggaaaggcattaaggattccaggggcctccgttcattggtacgataaaccagaaatgcgaaagcaaagaaaaatgggtcatatcactattgtaggcccttctatgggaattgtggaagctcggctgcactcaatgttgggggaagaaagtgtggatgatcagtcttcagtaacacctcgtgttggaatcataatgggctctgattcagatcttcctgttatgaaggatgctgcagggattttgaatcactttggtgtgcctcatgaggtgagaatagtttcagcacacagaactcctgaaatgatgttttcttatgcaatgtctgctcgggagcgaggcgttcagatcatcattgctggtgctggtggtatggtagctgcattgactcccctaccagttattggtgtgcctgtgcgtgcctcttcattagatggacttgactccctcctatcaattgtgcagatgccaaggggtgttcctgttgctacagtggctataaataatgccacaaatgctggtttgctggcagtaagaatgttgggggttagtgatcctgacctacaggcgagaatgagccagtaccaagaagacacaaaggatgatgtcttggtaaaagccgagaagctagagaaagatggctgggagtcctatttgaatccttag

SEQ ID NO: 13065 - protein, 604 aa, Vitis vinifera
MGKIARIPYDWPFLKNNCFSSWSPPQLKQRVPICLIELRFLFPQVPDDLPVHGLSETVVGVLGGGQLGRMLCQAASQMAIKVIVLDPLENCPSSSISNYHMVGSFDDSATVQEFAKRCGILTVEIEHVDVATLEKLEQQGVDCQPKASTIRIIQDKYLQKVHFSRHAIPLPEFMQIDDLESAKRAGDLFGYPLMIKSKRLAYDGRGNAVAKSEVELSSAVTALGGYEHGLYIEKWAPFVKELAVIVARGRDNSILCYPVVETIHKENICHIVKAPADVPWKIRRLATDVAYKAVSSLEGAGVFAVEMFLTIDGQILLNEVAPRPHNSGHHTIESCYTSQFEQHLRAVVGLPLGDPSMKTPAAIMYNLLGEDEGEAGFSFANKLIGKALRIPGASVHWYDKPEMRKQRKMGHITIVGPSMGIVEARLHSMLGEESVDDQSSVTPRVGIIMGSDSDLPVMKDAAGILNHFGVPHEVRIVSAHRTPEMMFSYAMSARERGVQIIIAGAGGMVAALTPLPVIGVPVRASSLDGLDSLLSIVQMPRGVPVATVAINNATNAGLLAVRMLGVSDPDLQARMSQYQEDTKDDVLVKAEKLEKDGWESYLNP

SEQ ID NO: 13066 - DNA, 1938 bp, Arabidopsis thaliana; identical to SEQ ID NO: 13032
  CDS (1)..(1938)

SEQ ID NO: 13067 - protein, 645 aa, Arabidopsis thaliana
MLLLKQSSAAVLVVGNTTPVLHTSRSTYRVGPFPVTRTQSFQSLTMANLQKLPTSSSGKLNTASAVPCSSHDASPISENRENKHVHGVSEKIVGVLGGGQLGRMLCQAASQLAIKVMILDPSKNCSASALSYGHMVDSFDDSATVEEFAKRCGVLTVEIEHVDVDTLEKLEKQGVDCQPKASTIRIIQDKYMQKVHFSQHGIPLPEFMEISDIEGARKAGELFGYPLMIKSKRLAYDGRGNAVANNQDELSSAVTALGGFSRGLYIEKWAPFVKELAVIVARGRDGSMVCYPVVETIHRDNICHIVKAPADVPWKINKLATDVAQKAVGSLEGAGVFAVELFLTEDSQILLNEVAPRPHNSGHQTIECCYTSQFEQHLRAVVGLPLGDPSMRTPASIMYNILGEDDVIDGEAGFKLAHRLIARALCIPGASVHWYDKPEMRKQRKMGHITLVGQSMGILEQRLQCILSEQSHQVHETPRVAIIMGSDTDLPVMKDAAKILDLFGVTHEVKIVSAHRTPEMMYTYATSAHSRGVQVIIAGAGGAAHLPGMVASLTPLPVIGVPVRATRLDGVDSLLSIVQMPRGVPVATVAINNATNAALLAVRMLGISDTDLVSRMRQYQEDMRDENLNKGEKLETEGWESYLNQ

SEQ ID NO: 13068 - DNA, 1749 bp, Ostreococcus tauri
  CDS (1)..(1749)
atgacgacgtcgcgcgcgccgcggcgtcgcgcgcgcgcgcgcgggcgggcgcgcgcggtgaaggaggagaaatttcgcgtgcgggatgaggagacggcgctcggacgagacgcgcgggtggggatcctgggcggcggacagctcggacgcatgttggggatcgcggcgtcgccgatgggggtgcgattgaaggctttggacccgaccgagaactgcccggcgagcgtgtcgtcgacgcaggtcgtcgggagctttcgggataaagaggctgtgaaggctttcgcgcgggagtgcgacgtgctcacggttgaaatcgagcacatcgacgtggaggcgctgagggagctcgcggcggagggtgtggacgtgcagccgacgccggagacgctggcgacgattcaggataagtacgcgcaaaaagtgcacttctcgcaggcgggcgtgcctctgggaccgttcgcggactgcccggatgaggcggcgctgcaaaaggcggcgagtgaatttgggtttccgctcatgctcaagtcgaagcgtttggcgtacgatggtcgagggaacgcggtggcgaagactgccgccgatctgaacgacgccgtggtcaagctcggcgggtttgagcaaggtttatattgcgagaagtgggtgccgtttgcgaaggagctggcggtgatggtcgtgcgcgcgcgagacggcgagacgcgcgcataccccgtcgtggagacggttcacgaggataatatttgcgacatcaccacgactcccgcaccggttccgaacaaggtcgccgaggcggttcaagaggcggccaagaaggcgatcggttcgtttacgggtgcgggcattttcggcgtcgagttgttcctcttgcacgacggctccattctgctcaacgagtgcgcgccgaggccgcataacagcggacactacaccatcgagggctgcgcgtgctcgcaatacgagaaccatctgcgcgcgatcttgggctggcctctgggagacacctcgctgaaggttggcggagccgtgatgaagaacattttgggtgacgccgagggcgacgaggcaatgtctcgcgcacaccgcctcatgggcgcggcgttagaggtcccgggcgcgagcattcattggtacgaaaagccggatatgaaggctgcgcgtaagatgggtcacatcaccgtcgtcggaccgagtgcggcggtggccacggagcgcttggacacaatcctgcgcgccgccaagggcgaccatacgcccgccaagccggcgcctcaggtgggcatcatcatgggttcggatagcgacttgcctacgatgagcgccgccgcggaggtcttggaatcattcggcatcggttgcgaggtcacggtgatctctgctcatcgaacgcccgatcgcatgaacgattacgccaagagcgcgcacacgcgcggtattcgagccattatcgctggcgccggcggcgccgcgcatcttcccggaatggtggccgccatgactccgctccccgtcatcggtgttcctgtgccgctgaagtacctcgacggcatggactccctcctctccatcgttcaaatgcccaagggcgttcccgtggccaccgtcgccatcgggaacagcgccaacgccggactcatcgccgcccgcatcgtctccgcgtacgagcccaccgttctgtctaagatgttagcctatcaggaagacatggagaacaacctcggctaccgagcctacctcgaccaaatgtaa

SEQ ID NO: 13069 - protein, 582 aa, Ostreococcus tauri
MTTSRAPRRRARARGRARAVKEEKFRVRDEETALGRDARVGILGGGQLGRMLGIAASPMGVRLKALDPTENCPASVSSTQVVGSFRDKEAVKAFARECDVLTVEIEHIDVEALRELAAEGVDVQPTPETLATIQDKYAQKVHFSQAGVPLGPFADCPDEAALQKAASEFGFPLMLKSKRLAYDGRGNAVAKTAADLNDAVVKLGGFEQGLYCEKWVPFAKELAVMVVRARDGETRAYPVVETVHEDNICDITTTPAPVPNKVAEAVQEAAKKAIGSFTGAGIFGVELFLLHDGSILLNECAPRPHNSGHYTIEGCACSQYENHLRAILGWPLGDTSLKVGGAVMKNILGDAEGDEAMSRAHRLMGAALEVPGASIHWYEKPDMKAARKMGHITVVGPSAAVATERLDTILRAAKGDHTPAKPAPQVGIIMGSDSDLPTMSAAAEVLESFGIGCEVTVISAHRTPDRMNDYAKSAHTRGIRAIIAGAGGAAHLPGMVAAMTPLPVIGVPVPLKYLDGMDSLLSIVQMPKGVPVATVAIGNSANAGLIAARIVSAYEPTVLSKMLAYQEDMENNLGYRAYLDQM

SEQ ID NO: 13070 - DNA, 1710 bp, Phaeosphaeria nodorum
  CDS (1)..(1710)
atggtcgacaaccgcaaggtaggtgtgttgggtggcggccagctaggtcgcatgctcattgaggctgcaaatcgcctcaatgttcaggtcaacgtcctggacgcagcagcatcgcccgcgaagcaaatatccgcacacgacggtcacattgaaggatctttcaaggatgcggcggctgtcaagcaactcgcgcaatcttgcgatgttgttaccgtcgaaatcgagcacgtggacacgcacatgctagaggaggtggccagcgaagttgttgtagagccaagctggaagacattacggaccatcaaggacaaatacgcgcagaaactgtaccttaaaaagcatggagttgaagttgcagagagcaccgacctagaaggcaaaggtgccgagggcttgaaagaagttggcgcttcatacggttatccattcatgttgaaaagcaagacggaggcctacgatggccgaggcaattttgtggtaaagagcgaggcggacatcggcgcggccatccaggcattgggcaaccgaccactgtatgcagagcgatgggctgacttcaggctcgagcttgcggtgatggtcgtcaagacgaaggacggcgtactcacattccctaccgtggaaactgtacatgaggacagcatctgcaagcttacttacgcaccaccaaggaatgtgtctgagtctacagcacagagagcgcaagacctggctaagaaggcgattggtgctttcgagggcaagggtgtctttggtgtcgagatgttccttcttaaggacgatagcttgctcgtcaatgagattgcaccacgaccgcataactcaggacactacaccatcgaagcctgtccactatcgcaatatgatgcgcatcttcgcgcgatccttgatctacccatcccacaatcggctctccgtctgcgcgagccatcaatcatgctcaacatcctcggcggaaagacaccggactcacatgtcaaggtagccaagaaggctctggagtcaccaaacgcttcaatacatctctacggcaagggtgatgcgcgcccgggtcgcaagatgggccatattactatcacggcacctacgcttgcggaagcagaacgtgagattcagcctcttatcgactttgttgatgagcagaagggaaaggctctaggacccctcgcagacccttcgagctcgaaaggagagcctctagtcgccgtcattatgggttcagactccgacctaccagtacttcgggctggtctcgagatcctggaaaagctcgaaatcccattcacaacgcgcatcacgtccgctcatcgcacacccgactggcttcgcgaattctccaagaatgcctcaagcacctcgctcaaggtcattattggcgcagcaggtggtgcggctcatttgcctggtatgtgcgcatcatggactacacttcccgtgatcggtcttccagtcaaggcgacgcacatggatggctgggacagtctagttagcatgacacaaatgccccgtggtgaaccagttgctactgttggcatcaacaatagcaccaatgcggcgctgttggctgtgaggatacttggtgcggatgacaagtcggtcagagagcgcttgagggtctggatggaaggcaacgagaaggaagtcatgaggaaggacaaggcgctactggaagatggctgggaggcctatttgaagagcatgggcaaatag

SEQ ID NO: 13071 - protein, 569 aa, Phaeosphaeria nodorum
MVDNRKVGVLGGGQLGRMLIEAANRLNVQVNVLDAAASPAKQISAHDGHIEGSFKDAAAVKQLAQSCDVVTVEIEHVDTHMLEEVASEVVVEPSWKTLRTIKDKYAQKLYLKKHGVEVAESTDLEGKGAEGLKEVGASYGYPFMLKSKTEAYDGRGNFVVKSEADIGAAIQALGNRPLYAERWADFRLELAVMVVKTKDGVLTFPTVETVHEDSICKLTYAPPRNVSESTAQRAQDLAKKAIGAFEGKGVFGVEMFLLKDDSLLVNEIAPRPHNSGHYTIEACPLSQYDAHLRAILDLPIPQSALRLREPSIMLNILGGKTPDSHVKVAKKALESPNASIHLYGKGDARPGRKMGHITITAPTLAEAEREIQPLIDFVDEQKGKALGPLADPSSSKGEPLVAVIMGSDSDLPVLRAGLEILEKLEIPFTTRITSAHRTPDWLREFSKNASSTSLKVIIGAAGGAAHLPGMCASWTTLPVIGLPVKATHMDGWDSLVSMTQMPRGEPVATVGINNSTNAALLAVRILGADDKSVRERLRVWMEGNEKEVMRKDKALLEDGWEAYLKSMGK

SEQ ID NO: 13072 - DNA, 1758 bp, Hebeloma cylindrosporum
  CDS (1)..(1758)
atgtcagaacaggttgttggaatacttggaggaggccagcttggtcgcatgcttgcagcatcggcttccttgttaaaccagaaagttattattcttgatacgggagaacatggaccagccaagcagattatcgcaccgacggaacctcacttggcccatctcgatggatcgttcgcagatcctgtgaagattcgcgaactcgctagcaaagtagatgtgcttaccgtcgagatcgagcacgtcgatgcagccgccctcgaagaagtacgattggcgacgaaaggaaaagttctcgctatccatccgagtccatccaccatccagattatccaggacaaatttcggcagaagcaacacttgtcgtcccacggtctgccagtatcggaatttgtcgaggtcgagtcctctgtggattcgatatccgaagcggcccagaaacttggcctgcctctcatgttgaagagtcgtaccttagcctacgacggccgtggcaattttgtggtccgaaacttgcgacaggtcgaagaagcaattgctgccctgggagggcggcccctttacgctgaaaagtgggttcccttctccaacgaaattgccattatggtcgttaggactgtcgacggtgaggtccaatcttaccctgtggtagaaaccgttcacaaggacaatgtttgccaccttgtattggcacctttacggagtcgagacccttctcttccatcgaaagcgacatctatcgccgaaaatgccataaaatcgttcaccggcgcaggtgtcttcggcgttgaattgtttctgatggatgatgggaaaatatttatcaatgaaattgctccccgtccccataactctggccattacacgatcgaagcctgtgaaacttctcagtatgaaaatcatttacgcgccatcctctcgctcccccttgggtcaaccgcactaaaggtgccttccgctgccatgcttaacttgatcggccagtcgtcttccatgggtgagatcacgaaaaccaaggatgtcgccctcaccattcccggggcttcggtccacttgtatgggaagtcagaatgcaggaaaggtcgaaagatgggtcatatcaccattgtggccgattcggacgcccaactccgatcccgtctgcgcacccttctccaatccctccccgaaaactactgtccgcctggtgagatagacctgtacgcccccgctgccatggtccctggctctggtttctccgatcccaacccactagtgggggttatcatgggctcagactcggatctgcatgtcatgcttccagcagcccgaattcttgatcatttcaagatcccatacgagttgacgatcgtatcagcgcaccgaactcccgaccgcctcgtcgaatacgcccggtccgcatcgacgaggggcctgcgaaccatcattgcaggcgcaggtggtgcggcccatcttccaggaatggtggctgcgatgacggccctccctgtgatcggcgttcccgtgaaaggcagtaccctcgatggcgtagattctttgcacagtatcgttcagatgccgcgtggtatacctgtggcgaccgttgccattaataacggcacgaacgctggtctattagcggtgcggatattgtcagcgggtatcccacatctcattcactccatggagcattatatgagctccatggaaaatgaagttctgggtaaagtcgaaaaattgaaggaagtggggtgggagaactatcaggtgaaacgaagttga

SEQ ID NO: 13073 - protein, 585 aa, Hebeloma cylindrosporum
MSEQVVGILGGGQLGRMLAASASLLNQKVIILDTGEHGPAKQIIAPTEPHLAHLDGSFADPVKIRELASKVDVLTVEIEHVDAAALEEVRLATKGKVLAIHPSPSTIQIIQDKFRQKQHLSSHGLPVSEFVEVESSVDSISEAAQKLGLPLMLKSRTLAYDGRGNFVVRNLRQVEEAIAALGGRPLYAEKWVPFSNEIAIMVVRTVDGEVQSYPVVETVHKDNVCHLVLAPLRSRDPSLPSKATSIAENAIKSFTGAGVFGVELFLMDDGKIFINEIAPRPHNSGHYTIEACETSQYENHLRAILSLPLGSTALKVPSAAMLNLIGQSSSMGEITKTKDVALTIPGASVHLYGKSECRKGRKMGHITIVADSDAQLRSRLRTLLQSLPENYCPPGEIDLYAPAAMVPGSGFSDPNPLVGVIMGSDSDLHVMLPAARILDHFKIPYELTIVSAHRTPDRLVEYARSASTRGLRTIIAGAGGAAHLPGMVAAMTALPVIGVPVKGSTLDGVDSLHSIVQMPRGIPVATVAINNGTNAGLLAVRILSAGIPHLIHSMEHYMSSMENEVLGKVEKLKEVGWENYQVKRS

SEQ ID NO: 13074 - DNA, 1668 bp, Mucor circinelloides
  CDS (1)..(1668)
  misc_feature (917)..(917): y is t or c
atgaatagtcaaaaagtcggtattcttggaggcggtcagttgggtcgtatgatggtagaagctgcatccagactcaacctctctgtcaccattcttgatgctcccgtggacgcacccgccaagcaaattgaatccactcaaaaccacattcaaggcgctttcaacgatgccgccaagatcactgaattagcctctcaagtggatgtgttgactgtagagatcgagcatgtcaatgcggatgtgcttgcccagatcgagcaagaaggtcgtgtgcgtgtctgcccctctgccttcactgtcaagaccatccaagacaagtacaaccaaaagaagtacctagagtcacatggcattcccgttgccgagtaccgcgaaatcaaggatgccgatgctgtcaagcaagtcgccaaggagtttggctatccattgatgctcaagtccaagaccatggcctatgacggcaagggcaactacgtcgtcaagtcagaagctgatgtcgagaaggcagtagctgctctgtccaagacacccttgtacgcagaaaagtgggccccctttgtcaaggaactcgctgtcatggtcgtccgtcgtgccaacggcgaaattagatcatatcctgtagtggaaaccattcacaagaacagcatttgccacctcgtcattgctcctgctcaaatcgacggcagcgtcgctgtcaaggctcaaaagattgccgaaaacgccatcaaatccttccctggtgctggtatctttggcgtcgagatgtttgtcatggccgacggtgagattctgctcaacgaaattgctcctcgtccccacaactcgggccattacaccatcgaggcctgtgagacctctcaatacgaaaaccacatgcgcgccatcttggatttgcccttgggctccactgccagtgyaaggtgcctgcgttccatcatggtcaatatcttgggcgaaaacagcgacatggaagcttgttacaagccttgccaagctgctttattggcagagggcgctaccatccacttgtacggtaagaaggaatccagagctggccgtaagatgggccacattacgttggtgggtgaatccatgatgcaagtgcaaaagaacttgaagcccatcttggacgaaatcgagcctggtgtagagagacccttgacattgcgacctttggtgggtatgattatgggttctgacagcgatttgcctgtcatgaaggtgggtgctcagatcctcaaggactttggtattccctttgaattgtccattgtgtctgctcatcgcactcccttgcgtatggtggaatatgcaaagtctgctgctcagcgcggtctgatggccatcattgctggtgctggtggtgctgctcatttgcctggtatggtggctgccatgacacctttgcctgtcattggtgtgcctgtcaagggcagctctcttgacggcgtggactctctctacagtattgtgcaaatgcctcgcggtatccctgtggccaccgtcgctgtcaacaacagcaccaatgctgctctgcttgctattcgtatcttgggtgcttccattcccggcattcaaaagcaaatggctgcttacatggagaagatggagggagaagtcttgaccaaggtcgagaagcttgacaatgttggatgggaaaactactag

SEQ ID NO: 13075 - protein, 555 aa, Mucor circinelloides
  misc_feature (306)..(306): The Xaa at location 306 stands for Ala, or Val.
MNSQKVGILGGGQLGRMMVEAASRLNLSVTILDAPVDAPAKQIESTQNHIQGAFNDAAKITELASQVDVLTVEIEHVNADVLAQIEQEGRVRVCPSAFTVKTIQDKYNQKKYLESHGIPVAEYREIKDADAVKQVAKEFGYPLMLKSKTMAYDGKGNYVVKSEADVEKAVAALSKTPLYAEKWAPFVKELAVMVVRRANGEIRSYPVVETIHKNSICHLVIAPAQIDGSVAVKAQKIAENAIKSFPGAGIFGVEMFVMADGEILLNEIAPRPHNSGHYTIEACETSQYENHMRAILDLPLGSTASXRCLRSIMVNILGENSDMEACYKPCQAALLAEGATIHLYGKKESRAGRKMGHITLVGESMMQVQKNLKPILDEIEPGVERPLTLRPLVGMIMGSDSDLPVMKVGAQILKDFGIPFELSIVSAHRTPLRMVEYAKSAAQRGLMAIIAGAGGAAHLPGMVAAMTPLPVIGVPVKGSSLDGVDSLYSIVQMPRGIPVATVAVNNSTNAALLAIRILGASIPGIQKQMAAYMEKMEGEVLTKVEKLDNVGWENY

SEQ ID NO: 13076 - DNA, 1719 bp, Aspergillus oryzae
  CDS (1)..(1719)
atgtggaactctcctaaggtgggaatcctcggcggaggccaattgggccgcatgctggtcgagtccgccaaccgattgaacattcaatgcaacgtgctcgatgcggagaactccccggccaagcagatcagtagccacgatggccacgttaccggttcttttaaggagcgcgaggccgttcgggaactggccaagacctgcgacgttgtgacggcagagattgaacatgtcgatacctacgccctggaggagattgcctctcaggtcaagattgaacccagctggcaagcgattcggacgatccagaacaagttcaaccagaaggagcacctgcggaaatatggtattcccatggcggagcatcgcgagctggccgagaacactcccgaagaattggccaaggtcggcgaacagcttggatatcctatgatgttgaagtcgaagactatggcttacgacggacgtggaaactatcgtgttaactctaaggaggatatccccgaggcccttgaagcgcttaaggaccgcccattgtatgcagagaagtgggcttacttcaagatggaattggccgtcatggtcgtaaagaccaaggatgatgtcctgtcataccctaccgtcgagaccgtccaagaagactcgatatgcaaactcgtctatgcccccgcgcgcaacgtgtccgacgccatcaaccagaaagcccaggagttagcacgtaaggccgtcgcagccttcgacggaaagggtgtttttggtgtcgaaatgttcctcctcgaagacgacagtctgatcctgtgcgaaattgctagccgcattcacaactccggtcactacaccattgaaggttgccccctgtctcaattcgatacccatatccgcgccatcctcgatctccccatccctcctaagagcctcgagctccgtcaaccctccatcatgctcaacatcatcggcggtgccgcccccgacacacacctcaaggccgcagagcatgctctctccatccccaacgccagcatccatctctacagcaagggcgccgccaaaccaggccgcaagatgggccatatcactgtcaccgcgccgaccatgcacgaagccgagacacacatccagcccctgatcgacgtggtcgacgagatccgctcccagcgcagcgacatcaagacccagccccagaagtcgggcccctcgaagcctgcaccctccgtggccgtcatcatgggctcggacagcgatctcaagaccctcgttccaggactcaagctccttaaagagtacttcggcatcgaacccgcagtcgacatcacctccgctcaccgcaccccggagtacatggccgaatactccgccagtgccgctgcccgcggtatcaaggttatcatcgccgctgctggcggcgccgcccatctccccggtatggccgccgctcacaccgctcttcctgtgatcggtgtcccggtcaagggcagctccttggatggtgtcgacagtctgtacagcatcgtgcagatgcccagaggtgtccctgtcgccaccgtcggaatcaacaacagcattaacgccgctctcctggccgccagaatcctgggctcctttgatccagccattcagcgcaaggtggaggcgtatgctgagcaggctaagaccgagaatctcgacttcaagggcactaagatgcgcgaactcggttgggaaaagtactttgagcaaatgtga

SEQ ID NO: 13077 - protein, 572 aa, Aspergillus oryzae
MWNSPKVGILGGGQLGRMLVESANRLNIQCNVLDAENSPAKQISSHDGHVTGSFKEREAVRELAKTCDVVTAEIEHVDTYALEEIASQVKIEPSWQAIRTIQNKFNQKEHLRKYGIPMAEHRELAENTPEELAKVGEQLGYPMMLKSKTMAYDGRGNYRVNSKEDIPEALEALKDRPLYAEKWAYFKMELAVMVVKTKDDVLSYPTVETVQEDSICKLVYAPARNVSDAINQKAQELARKAVAAFDGKGVFGVEMFLLEDDSLILCEIASRIHNSGHYTIEGCPLSQFDTHIRAILDLPIPPKSLELRQPSIMLNIIGGAAPDTHLKAAEHALSIPNASIHLYSKGAAKPGRKMGHITVTAPTMHEAETHIQPLIDVVDEIRSQRSDIKTQPQKSGPSKPAPSVAVIMGSDSDLKTLVPGLKLLKEYFGIEPAVDITSAHRTPEYMAEYSASAAARGIKVIIAAAGGAAHLPGMAAAHTALPVIGVPVKGSSLDGVDSLYSIVQMPRGVPVATVGINNSINAALLAARILGSFDPAIQRKVEAYAEQAKTENLDFKGTKMRELGWEKYFEQM

SEQ ID NO: 13078 - DNA, 1905 bp, Vigna unguiculata
  CDS (1)..(1905)
atgcttcacagtgcacgcgtagtattgtcaggccactccaccatcccagcttttgccttcagaccctctaatccctgtattaagacaacctcttcacttggtttctacatggagcaatctccttctttaaagctaaaacagtgtcaccagccccatcttgcctgtcaagcgacatcacgggatgatgatgatgcttctctaaggaatgatgaaccacctgttcatggaatatctgaagtggttgttggggttctgggaggtgggcaacttggtcgtatgatgtgtcaagccgcttctcagatggccattaaagtcatggttttggatccgcaagaaaattgccctgctagttctctctcttatcatcatatggtcggaagctttgacgaaagcactaaagtggaggaatttgccaagagatgtggagtattgaccgttgaaattgaacatgttgatgttgatacattggaaaaacttgagaaacagggagttgactgccagcccaaagcctctacagtcagaattattcaggataagtatcaacaaaaggttcacttctccaagcatggcattccacttcctgaatttatgaagatagatgatcttgaaagtgctaagaaagttggggaactctttgggtatcctcttatgattaagagtaggagactagcttatgatgggcgaggaaattttgttgctaaaagtgaagaggaactttcatctgctgtggatgctctaggaggatttgatcgaggtttatatgctgaaaaatgggcaccttttgtcaaggaactagctgttattgtggcaagaggaagagacaattcaatttcatgttatcctgttgttgaaactattcacagggacaatatatgccacatagttaaggctccggctaatgtgaaatggaagacgagggagcttgccactgaagttgctgttaatgctgttaagtccctggaaggtgccggtgtgtttgcagttgaattgtttttgactaatgatggagagattttattaaatgaagtagcacctagacctcacaacagtgggcatcatacaatagaatcttgccatacctcgcaatttgagcaacatttgcgggctgttgttggtcttccccttggtgatccatcattgaaaactccagctgctatcatgtacaacatattaggtgaagaagagggggaacttggttttcaattagcacatgaattgatgaaaagggcactggccatccctggtgcttctgttcattggtatgataagccagaaatgagaaagcaacggaagatgggccatataactatcgttgggccctcccttaacaatattgaaagcaatcttgcaattctgctggaagggaaaagattacatgataagactgctgttgctccacgtgtggggattataatgggttctgattcagatctgcctgttatgaaaagtgctgctgaaatcttggagatgtttggtgtgcctcatgaggtaagaatagtttcagcccacaggactccagaattgatgttttcttatgcctcatctgctcatgaacgaggcatacaagtcattattgctggtgctggtggtgcagctcacttgcctggtatggttgctgccctcactcccttgcctgttgttggcgttcctgtgcgtgcttctaccttggatggacttgattcactcttgtcaattgtccagatgccgagaggtgttccagttgccactgttgcagttaataatgcaactaatgctggattgctggcagtgaggatattgggtgttgccaacgataatcttctgtcaaggatgagtcaatatcaagaggaccaaaaagaaatcgtcttgaacaaaggagataaattagaaaaacatggctgggaatcctacttaaaaaatagttag

SEQ ID NO: 13079 - protein, 634 aa, Vigna unguiculata
MLHSARVVLSGHSTIPAFAFRPSNPCIKTTSSLGFYMEQSPSLKLKQCHQPHLACQATSRDDDDASLRNDEPPVHGISEVVVGVLGGGQLGRMMCQAASQMAIKVMVLDPQENCPASSLSYHHMVGSFDESTKVEEFAKRCGVLTVEIEHVDVDTLEKLEKQGVDCQPKASTVRIIQDKYQQKVHFSKHGIPLPEFMKIDDLESAKKVGELFGYPLMIKSRRLAYDGRGNFVAKSEEELSSAVDALGGFDRGLYAEKWAPFVKELAVIVARGRDNSISCYPVVETIHRDNICHIVKAPANVKWKTRELATEVAVNAVKSLEGAGVFAVELFLTNDGEILLNEVAPRPHNSGHHTIESCHTSQFEQHLRAVVGLPLGDPSLKTPAAIMYNILGEEEGELGFQLAHELMKRALAIPGASVHWYDKPEMRKQRKMGHITIVGPSLNNIESNLAILLEGKRLHDKTAVAPRVGIIMGSDSDLPVMKSAAEILEMFGVPHEVRIVSAHRTPELMFSYASSAHERGIQVIIAGAGGAAHLPGMVAALTPLPVVGVPVRASTLDGLDSLLSIVQMPRGVPVATVAVNNATNAGLLAVRILGVANDNLLSRMSQYQEDQKEIVLNKGDKLEKHGWESYLKNS

SEQ ID NO: 13080 - DNA, 1752 bp, Dipodascus magnusii
  CDS (1)..(1752)
atggactctagaactgttggaattctcggtggtggccagctgggtcgtatgcttgttgaagcagccaacagattgaacatcacgaccgccattctggacgctgaaaactcaccagctactcagatcaactcggttggacctcacgtcagcggctctttcaaagatgctgtcagcattgccaagtttgctgaaaagtgcgacgtcttgactgtagagatcgagcacgtcaatgcagacattttacaagatcttttggaccagaagaaagtgaaggaaatccatccatctcctgccactatcaagttgattcaagacaagtatacccagaagcttcattatcttaaacacaaattaccgactcctgctgttttggacgttcctaatgccactcaggaatccgttgctgctgtcggtcaaaagtttggttatccatttgttctcaaggctagaactaatgcttatgatggtcgcggaaactatgttgtcaagaccgctgaggatattcctgaagccttaaaagcccttaaagatactcctttatatgccgaaaagtttgccagatttgaccgtgaattggctgttatggttatccgtactaaggatggtcaaactatttcataccctgctgttgaaaccgttcaagaaaacaatgtttgtcatactgtttatgctcctgccagactttctgattctattcaacaacaagccagaaacgttgccgaaaacgctgtcaagactttagatggtgctggtatttatggtgttgaaatgttccttatgaatggtgacaatgaagaaaccaattctgatttgattcttctcaacgaaattgctcctcgtcctcacaactctggtcattatactcaagacggttgtgccgtttctcaatttgatgctcatattcgtgcagttcttggcttacctattcctcctcttaccatgtctacacctagcacctacacaatcatgctcaacattttgggcgccaaagaagccaatggcgaacttgaagtgtgtaaaagagctcttgaagttccaggctgcactatccatttgtatggaaaaactactagacctggcagaaagatgggtcatatcaacatcactgctggaagcatgcgtgaagctgaagcaaaattagctgccatttcaggtgctacctctaaaaataccatcgaacaaactattcctaaagaagtcgctattgctggaacatcttctactcccaccgttggcatcattatgggttcagattccgatcttcccgtcatgagtgcagcttgcaaggttcttactgaattcaatgttccctacgaagtcaagatcgttagtgctcatcgtacacccagtcgtatgtacagctacgccatcaacggcgtgaaccgtggtttacgcgtcattattgcaggcgccggcggtgctgctcatcttcctggtatggtcgctgctcttactcctttacctgtaattggtgttcctgttaagggttctacactcgatggtgttgattctcttcatagtattgttcaaatgccccgtggcgttcctgtcgctactgttgctattaataatgccatgaacgccggtcttttggctgtcagaatcttggccactggtagcgaaaccaaagatgctgtcttgcttgctaagcttgaaaagtatattcaaaatatggaaaacgaagtgttggcaaagacggaaaagttggaaaccattggctatgaaaagtatttagaagaaaagaagaattaa

SEQ ID NO: 13081 - protein, 583 aa, Dipodascus magnusii
MDSRTVGILGGGQLGRMLVEAANRLNITTAILDAENSPATQINSVGPHVSGSFKDAVSIAKFAEKCDVLTVEIEHVNADILQDLLDQKKVKEIHPSPATIKLIQDKYTQKLHYLKHKLPTPAVLDVPNATQESVAAVGQKFGYPFVLKARTNAYDGRGNYVVKTAEDIPEALKALKDTPLYAEKFARFDRELAVMVIRTKDGQTISYPAVETVQENNVCHTVYAPARLSDSIQQQARNVAENAVKTLDGAGIYGVEMFLMNGDNEETNSDLILLNEIAPRPHNSGHYTQDGCAVSQFDAHIRAVLGLPIPPLTMSTPSTYTIMLNILGAKEANGELEVCKRALEVPGCTIHLYGKTTRPGRKMGHINITAGSMREAEAKLAAISGATSKNTIEQTIPKEVAIAGTSSTPTVGIIMGSDSDLPVMSAACKVLTEFNVPYEVKIVSAHRTPSRMYSYAINGVNRGLRVIIAGAGGAAHLPGMVAALTPLPVIGVPVKGSTLDGVDSLHSIVQMPRGVPVATVAINNAMNAGLLAVRILATGSETKDAVLLAKLEKYIQNMENEVLAKTEKLETIGYEKYLEEKKN

SEQ ID NO: 13082 - DNA, 1719 bp, Candida boidinii
  CDS (1)..(1719)
atggattcaaagacaattggtatcttaggtggtggtcaacttggccgtatgttagttgaggctgctagtagattaaacatcaaaacagttattcttgaaaatggtgatcaatcaccagctaaacaaattaatgcttcttctactcacatagatggatctttcaatgatccagaagctattgctaaattagctgctgcttgtgatatcatgacagtagaaattgaacatgttaatacagaagccttacaaaaaatttcagattcaacaggtttaccaatttatccaactcctgctacattgtctgtcatcaaagataaatatttacaaaaagaacatttaataaaacatggtattgcagttgctgaatctgttgctgttgaatcaaatgaggaatcattattaaaagttggtgaacaatttggttaccctttcatgcttaaggctagaactttagcttatgacggaagaggtaattttgtcgttaaatctcaagataaaataaaagaagctatcgaattcttaggtgatagacctttatacgctgaaaaatgggctccatttactaaagaattagctgtcatggttgttagatccgttgatggtaacgtttactcttacccaacagttgaaacaatccatcgtgataatatctgtcatacagtctttgctccagctagagttcaagattctatcttaaagaaagctcaaatcttagctgataacgcagttaagtcatttgatggtgctggtatctttggtgttgaaatgttcttattaccttcaggtgatttattagttaatgaaattgccccaagaccacataactcaggtcattacacaattgacgcttgcgttacttcacaatttgaagctcttattagagctttagccggtttaccaatgccagataatttcactaaattctcaactccacaaacaaatgccattatgttaaacgttttaggtactgatatcccaaattctgaatttgaattatgtagacgtgctttagaaactccaaattcttctgtttatttatacggtaaaacaacaagacctaagagaaaaatgggtcacattaatattgtttcaggttctatgcaagattgtgaacgtcgtttaagatatatcgaaggtgaaacagatgaaaaacctgctgctgccaactcaaagaccaacgctgtcgctggtacttctgaaaaacctttggtcggtgttatcatgggttcagattctgatttacctgttatgtcattaggctgtaatatactgaaacaatttggtgtcccatttgaagtcactattgtatcagctcacagaaccccagaacgtatggctaaatacgcagctgacgctccagcaagaggtattaaagctataatagcaggtgctggtggtgctgctcacttaccaggtatggtcgctgccatgaccccattaccagtcattggtgtcccagttaaaggatcaactttagatggtgttgattctttacactcaattgttcaaatgccaagaggtatcccagttgctacagttgctattaataatgctacaaatgcggctttattagctattagaatattaggtgcttctgatagtaaatggtttacagaaatggatgcttatatgaaaggtatggaaaaagaagttttacaaaaagctgaaaaacttgaaaaaggcggttatgaagattacttatcaacctacaaaaaataa

SEQ ID NO: 13083 - protein, 572 aa, Candida boidinii
MDSKTIGILGGGQLGRMLVEAASRLNIKTVILENGDQSPAKQINASSTHIDGSFNDPEAIAKLAAACDIMTVEIEHVNTEALQKISDSTGLPIYPTPATLSVIKDKYLQKEHLIKHGIAVAESVAVESNEESLLKVGEQFGYPFMLKARTLAYDGRGNFVVKSQDKIKEAIEFLGDRPLYAEKWAPFTKELAVMVVRSVDGNVYSYPTVETIHRDNICHTVFAPARVQDSILKKAQILADNAVKSFDGAGIFGVEMFLLPSGDLLVNEIAPRPHNSGHYTIDACVTSQFEALIRALAGLPMPDNFTKFSTPQTNAIMLNVLGTDIPNSEFELCRRALETPNSSVYLYGKTTRPKRKMGHINIVSGSMQDCERRLRYIEGETDEKPAAANSKTNAVAGTSEKPLVGVIMGSDSDLPVMSLGCNILKQFGVPFEVTIVSAHRTPERMAKYAADAPARGIKAIIAGAGGAAHLPGMVAAMTPLPVIGVPVKGSTLDGVDSLHSIVQMPRGIPVATVAINNATNAALLAIRILGASDSKWFTEMDAYMKGMEKEVLQKAEKLEKGGYEDYLSTYKK

SEQ ID NO: 13084 - DNA, 1713 bp, Zygosaccharomyces rouxii
  CDS (1)..(1713)
atgaattcgcaaactgttggtatacttggtggtggccaattgggtcgtatggttgttgaagctgctaatagattaaacatcaagactattatattagatgcaccaaattccccagctaagcaaattaatgcgttaaatgaacatgtagatggttcattctcaaatccagctgatattgaaaaattagctgaaaaatgtgatgtcttgacagttgaaattgaacatgtcgatgtgcccactttgaagaaactacaatcaaaacatcctaacctaaaaatttatccatctccagaaaccattggtttaattcaagataagtatgtccaaaaaaaccatttagtggccaataatattgcagtagcagaatctatacccattgaatccacaactagtgaaggtttagctctagctggtagacaattgggatacccctacatgttaaaatcaagaacaatggcttacgatggtagaggaaattttgtagttaagagcgaggaatcaattccaaaagcccttgagtttttgaaagatagaccattatatgccgaaaaatgggctccatttactaaagaattggctgttatgattgtgcgttccattgatggtcgtgtgttttcatacccaaccgtagagacaattcataaggataacatctgtttcctatgttatgcaccagcaagagttcccgattccgttcaattaaaggccaaactattagcagaaaatgcagttagagcttttcccggttgtggtatctttggtgttgaaatgttctatttagaaacaggggaattgctcatcaacgaaattgcaccaagacctcataattctggtcactatacgattgatgcctgtattacttcacaatttgaagcacacctaagagctatcctagacttaccaatgcccaaggatttctcctctctttctacatcttgcaccaacgccattatgctcaacgtgcttggagaagatgtaaagaatcaagaattacagacttgcgaaagagcgttagagaccccaggtgcctctgtgtacctgtacggtaaggaatcaagacctaagcgcaaattaggtcacattaatgtggttacttcatccatggaggagtgtgaaagacgtctttcattcattactggcgagacttctgagccagttaagatcactgtagctcaaaagatagattcggaatccaatgggaaacctgttgtcggcattattatgggttccgattcagacctaccagtaatgtccaaggcatgtgctattcttgaagaatttgaggtcccattcgaagtgacaatcgtttctgctcacagaacccctcaaagaatgaacaaatatgcatcagaagcctcttctcgtggtctaaaggccatcattgcaggtgcaggtggtgctgcccatctacctggtatggttgccgctatgactcctctaccagttatcggtgtaccagtgaaaggctcctccctagatggtgtcgattccctacattccattgtacaaatgcctagaggggtgcctgtagctacagtggcaatcaacaatagcaccaacgcagccctgctggcagtcaggttcatcggtgctttcgaaccaaagtaccataagaaaatgcaacagtacctgttaaaacaagaggtagaagtgctagaaaaggctaaaaaattggaaaattctggttacaagaattacatgggccttgagtaa

SEQ ID NO: 13085 - protein, 570 aa, Zygosaccharomyces rouxii
MNSQTVGILGGGQLGRMVVEAANRLNIKTIILDAPNSPAKQINALNEHVDGSFSNPADIEKLAEKCDVLTVEIEHVDVPTLKKLQSKHPNLKIYPSPETIGLIQDKYVQKNHLVANNIAVAESIPIESTTSEGLALAGRQLGYPYMLKSRTMAYDGRGNFVVKSEESIPKALEFLKDRPLYAEKWAPFTKELAVMIVRSIDGRVFSYPTVETIHKDNICFLCYAPARVPDSVQLKAKLLAENAVRAFPGCGIFGVEMFYLETGELLINEIAPRPHNSGHYTIDACITSQFEAHLRAILDLPMPKDFSSLSTSCTNAIMLNVLGEDVKNQELQTCERALETPGASVYLYGKESRPKRKLGHINVVTSSMEECERRLSFITGETSEPVKITVAQKIDSESNGKPVVGIIMGSDSDLPVMSKACAILEEFEVPFEVTIVSAHRTPQRMNKYASEASSRGLKAIIAGAGGAAHLPGMVAAMTPLPVIGVPVKGSSLDGVDSLHSIVQMPRGVPVATVAINNSTNAALLAVRFIGAFEPKYHKKMQQYLLKQEVEVLEKAKKLENSGYKNYMGLE

SEQ ID NO: 13086 - DNA, 1707 bp, Candida albicans
  CDS (1)..(1707): transl_table=12
atggatagcaaaactgttggtattttaggaggtggccaattaggtcgtatgattgttgaagcagcacatagattgaatatcaagaccgtaattttggacgcagccaaatcaccagctaaacagatcaatgctctagacgatcacgttgatggatcgttcacaaactatgattcgattgtgaaattagctgaaaaggcagacgtattaactgttgaaatcgaacatgttgatgttgatgctttaatcaaagttcaagagaaattccctaaagttgaaatatatccattacctgaaaccataagattgattcaagataaatatttacagaaaaatcatttaatcaaacacgatgttgcagttacagaatctgttgcagttgaaaccaacacagtcgatgacttgttacacattggggaaaagtttggatacccttatatgttaaaatcgagaactttggcgtatgatggtagaggtaactttgttgtcaaagacaagtcatactgtgagaaagctttagaatttttaaaagaccgtccattatatgctgaaaaatggtgtcctttcaccaaagaattggctgtgatggttgtcagatcattagaaggggaagtctttgcttacccaactgttgaaactattcatgaaaacaatatttggcatttagtgtatgctcctgccaggatcccagatactttgggccaaaaggcatctatattagccaaaaatgcagttaagtcattccccgggtgtggtattttcggtgttgaaatgttcttgttggaaaacaacgaattattgatcaatgaaattgcaccaagacctcacaactctggtcattataccattgatgcatgtgtcacttcacaatttgaagctcatgttcgtgctgtcacaggattacctatgccaaaggggttcactgaattctccacttccatcaccaatgctattatgttgaatgtcttgggtgataaggcaaccccaaataaagaactggagatttgtcgccgtgctttggaaactccacatgcgtcagtgtatctttatggtaaagctactagaccagagcgaaagatgggtcatatcaatgttgtcacatcttccatgcaagatgccgagagtagattaagttatatattgggtgataccactgaaattcctaaatctttagctaccgacaaggaatctccattggtgggaataataatgggttccgattcggatctaccagttatggcagttggtgctcgtattttgaaacaattcggtgtgccatttgaactcacaatcgtaagtgcacacagaactcctcatagaatgtctgagtatgctattgaagcaccaaagcgtggcttgaaatgtatcattgctggtgcaggtggtgctgctcatttgccaggtatggtggcggccatgaccccattgcctgtcattggtgttccagttaagggatctacattagatggggttgattcgttacactctatagtacagatgccaagaggtattcctgttgcaactgttgctattaacaatagtactaatgctgcattgttggcaatcagaatattaggcgcctatgactcaaaatggttgactgagatgaaccaatatatgttgaacatggaaactgaagtattaggtaaagcagaaactttagaagaaattggatatgaagactatttaactgataaattgaaaaaatag

SEQ ID NO: 13087 - protein, 568 aa, Candida albicans
MDSKTVGILGGGQLGRMIVEAAHRLNIKTVILDAAKSPAKQINALDDHVDGSFTNYDSIVKLAEKADVLTVEIEHVDVDALIKVQEKFPKVEIYPLPETIRLIQDKYLQKNHLIKHDVAVTESVAVETNTVDDLLHIGEKFGYPYMLKSRTLAYDGRGNFVVKDKSYCEKALEFLKDRPLYAEKWCPFTKELAVMVVRSLEGEVFAYPTVETIHENNIWHLVYAPARIPDTLGQKASILAKNAVKSFPGCGIFGVEMFLLENNELLINEIAPRPHNSGHYTIDACVTSQFEAHVRAVTGLPMPKGFTEFSTSITNAIMLNVLGDKATPNKESEICRRALETPHASVYLYGKATRPERKMGHINVVTSSMQDAESRLSYILGDTTEIPKSLATDKESPLVGIIMGSDSDLPVMAVGARILKQFGVPFELTIVSAHRTPHRMSEYAIEAPKRGLKCIIAGAGGAAHLPGMVAAMTPLPVIGVPVKGSTLDGVDSLHSIVQMPRGIPVATVAINNSTNAALLAIRILGAYDSKWLTEMNQYMLNMETEVLGKAETLEEIGYEDYLTDKLKK

SEQ ID NO: 13088 - DNA, 1713 bp, Candida glabrata
  CDS (1)..(1713)
atggactctagaactgtcggtattttgggtggaggccagttgggccgtatgattgtcgaggctgcaaaccgcttgaatatcaagactttgatacttgacgcaccaaattcacctgcgaagcaaattacgaatgcatctgatcatgtcgatggatcatttgcaaataaggaggatatcgaggccttggctgccaagtgtgatgttatgacagttgaaatcgagcatgtggatgttaatgcattgaaggaagtccaaaaacaattccccaaattggaaatctaccctacgcctgaaaccattggtttgatccaggataagtatgtgcaaaaacaacatttagttaagaatagaattcccgtagtaccgagcatcactgttgaaaattcgaaggaatccttaattaaaacaggatcctcattgggttacccatttgtcttgaaatcaagaacattagcctacgatggaagaggcaactttgttgttaaatctgaagaagacattgagaaaggacttgaatttttggcgaacagaccactatacgctgaaaaatgggcttcctttaagaaggaattatctgtaatgattatcagatcattggatggaagagtatattcataccctattgttgaaacaattcacaaaaacaatgtgtgccacttgtgctatgttccggctcgtgtaccagactcagtacaacacaaggccaaattaatggcggaaaatgcaatcaagtcattcccaggttgtggtatatttggtgtagaaatgtttttgttggatgatgactctatcgtcttgaatgaaattgcacccagacctcataactcaggtcattacaccattaatgcttgtgttgtatctcaatttgaagcacacttgagagccatattagatttacccatgcccaagaactttacttccttaagtactaactctacaaatgctataatgctaaacctattaggagatcctgaaactaaagacaaggaacttcaaatatgtgagagggccttgaatacgcctggcgcatctgtatacctatacggcaaagagtccaagcctaacagaaaggtcggtcatatcaatattgtatgttcgagtatgaaggaatgtgacaagagattacagtttattatgggtctaaaaaccgacccaattaagcattcagttatggaaattttaaatgcggaggaagtaagaaaacctttagttggtgttataatgggatccgattctgatttacccgtaatgtcagcagcttgtaaaatgttggagcaattcgaggtcccatttgaggtcactatagtctcagcacacagaactccttacagaatgaataaatatgcttcagaagcagtatcccgtggtattaaagttatcattgcaggtgcgggtggagcagcacatcttccaggtatggtagcagctatgacacctgtaccagttattggagtacctgtcaagggctctactttagatggtgtagactcactacattctattgttcaaatgccaagaggtgtaccagtagccacagtagccataaataacagcactaacgcaggtattctggctgttaggatgttaggaatacataattatgactatgttaagaaaatggaggaatttttgaacaaacaggaagaggaagtacttcagaaagcagccaaactcgaaagcattggatatgaaaagtacctagagtccaaatag

SEQ ID NO: 13089 - protein, 570 aa, Candida glabrata
MDSRTVGILGGGQLGRMIVEAANRLNIKTLILDAPNSPAKQITNASDHVDGSFANKEDIEALAAKCDVMTVEIEHVDVNALKEVQKQFPKLEIYPTPETIGLIQDKYVQKQHLVKNRIPVVPSITVENSKESLIKTGSSLGYPFVLKSRTLAYDGRGNFVVKSEEDIEKGLEFLANRPLYAEKWASFKKELSVMIIRSLDGRVYSYPIVETIHKNNVCHLCYVPARVPDSVQHKAKLMAENAIKSFPGCGIFGVEMFLLDDDSIVLNEIAPRPHNSGHYTINACVVSQFEAHLRAILDLPMPKNFTSLSTNSTNAIMLNLLGDPETKDKELQICERALNTPGASVYLYGKESKPNRKVGHINIVCSSMKECDKRLQFIMGLKTDPIKHSVMEILNAEEVRKPLVGVIMGSDSDLPVMSAACKMLEQFEVPFEVTIVSAHRTPYRMNKYASEAVSRGIKVIIAGAGGAAHLPGMVAAMTPVPVIGVPVKGSTLDGVDSLHSIVQMPRGVPVATVAINNSTNAGILAVRMLGIHNYDYVKKMEEFLNKQEEEVLQKAAKLESIGYEKYLESK

SEQ ID NO: 13090 - DNA, 1749 bp, Cryptococcus neoformans
  CDS (1)..(1749)
atggcccccagaaagactgtcggtatcctcggcggtggccagctcggccggatgcttacccaccctgcggcccttctcggcattcctctccttatcctcgactctggctcctacacgcccgccaaacagactcttcttcctcctcctcctcattctcaccctgatggtcccttcacttcggaaactcatattcgcaaacttgcctctgcgtgcgacatcctgacagtggagatcgagcacgttaacgccgatgtccttgaggctgtagaaaaggaaggtctttgtgaagtccagcccagtccccaaactatcagattgatccagaacaagtacgaccaaaagaagtaccttgctgaaagaggtgtggctgttgcaccttttgaggagcttcccgcaaacccgacggaagaggattttaaggctatcgcaggtcgattgggtttgcctttgatgctcaaagctaagacccttgcctacgatggacgtgggaactcacctcttaaatccgcatcttcaggggacattcaggcttccttgaaattccttggtgacaggcctctttatgctgaaggatgggcgccctttgtcaaggaagttgcggttatggtcgttaggaataaggagggcgaagtccgaagttacgacgccgtcgagactattcacagggagagcattttacgagtctgtttggcccccctcagaggtgaaaagggtgtgaatcagagggctagggaattagctgagaaggcggttggacaccttgagggtgctggtatctttggggttgagatgttcctcatgcctgatggtgaacttcttctgaacgagattgctcctcgtcctcataactctggtcatcacactattgaggcctgtcttacttcccaatttgagaaccaccttcgagccattctctccttgcctcttggttctactgctcttcgtgttccctccgctgccatggtcaacattctcggtgcctcgtcgactatggacgccatcgacaaaatggcagacaatgctctcactgttcctggtgctgccgtgcatctctacggcaaagctgagagccgaaaggcccgtaagatgggccacatcacggtgactgccgaaagcgatgctgagctcaatgagcgccttagagccctcttattcgcccagcctgatgcccatgccgactggatcgacctcatcgcccctccttcccctgctcccgctcattcccacgccaaaccccttgttggtatcatcatgggtagcgactctgacttgcccgttatgcaccctgctaccaagatcctcgaaaaattcggtgtcccctacgagctcaccataacttctgcccatcgcactcctgagcgaatggtgaagtatgcgaagactgctgcagaccgaggattgcgagccatcattgctggggctggcggtgctgcccatttaccaggtatggtcgccagcgagaccagtttgccagtcatcggtgtgcccgtcaaggccagtgtactggatggcgtggattcattgtatagtattgtgcaaatgccccgaggtattccatgcgccactgtgggtatcaacaactctacaaatgccgcgctacttgcagtccgtatccttggaacatctgtacccgcccttaacaaggctactgaggaatattccaaggcgctagaggaagaagttttggctaaagccgacattttggaggaggaaggctgggacaagtacatcgagaggctgaagaaataa

SEQ ID NO: 13091 - protein, 582 aa, Cryptococcus neoformans
MAPRKTVGILGGGQLGRMLTHPAALLGIPLLILDSGSYTPAKQTLLPPPPHSHPDGPFTSETHIRKLASACDILTVEIEHVNADVLEAVEKEGLCEVQPSPQTIRLIQNKYDQKKYLAERGVAVAPFEELPANPTEEDFKAIAGRLGLPLMLKAKTLAYDGRGNSPLKSASSGDIQASLKFLGDRPLYAEGWAPFVKEVAVMVVRNKEGEVRSYDAVETIHRESILRVCLAPLRGEKGVNQRARELAEKAVGHLEGAGIFGVEMFLMPDGELLLNEIAPRPHNSGHHTIEACLTSQFENHLRAILSLPLGSTALRVPSAAMVNILGASSTMDAIDKMADNALTVPGAAVHLYGKAESRKARKMGHITVTAESDAELNERLRALLFAQPDAHADWIDLIAPPSPAPAHSHAKPLVGIIMGSDSDLPVMHPATKILEKFGVPYELTITSAHRTPERMVKYAKTAADRGLRAIIAGAGGAAHLPGMVASETSLPVIGVPVKASVLDGVDSLYSIVQMPRGIPCATVGINNSTNAALLAVRILGTSVPALNKATEEYSKALEEEVLAKADILEEEGWDKYIERLKK

SEQ ID NO: 13092 - DNA, 1674 bp, Debaryomyces occidentalis
  CDS (1)..(1674)
atggataacaagatagttgggattttaggcggtggccaattaggtcgtatgatagttgaagcagctaacaggctaaacatcaaaaccgtcgtattagatgtaccaaactcacctgcaaagcaaattaattcaaatgaacatgttgatggatcattcacagatttaaaatctattattcaattagctgaaaaatgtgacattttaaccgttgaaattgaacatgttgatgttgaagctttaaaatatgttaaggaaaaatttggcgttgaaatttatccattgccagacacaattaaattaattcaagataaatatttacagaaggagcatttgattcaacatggaatttctgtaactgaatcggtagcagtgccatccaatgatgaacaatccttaattgagatcggtaataaatttaattatcccttcatgttgaaatcgagaactttagcctatgatggaagaggtaactacgttgttaaaacaaaagaatcaattcctgaagctcttgagtttttaaaagacagacctttgtatgctgaaaaatggtgtccgtttaacaaagaattagcagtaatggttgttagatcaattgaaggtgaagtatttgcatatcctactgttgaaactatccataaaaataatatctgtcatgtagtgtatgctcctgcaagggtttcagactccatagcagtgaaagcttcagtattagctaaaaacgctgttaaatctttcccaggttgtggtatttttggtgttgaaatgttcttattaccaaacaatgaaatattaattaatgagattgctccaagacctcataactctggacattacactatcgatgcttgtgtcacatcacaatttgaagctcatgtcagagcagttgttggattaccaatgccaaagaactttaccagtctctctacaactacaacaaatgcaattatgttaaatgtgttaggtgacgaagaatcaaataaagaattagaaatttgtcgtagagctttggaaactccaaatgcttctgtttatctctacgggaagtcaactagaccaaacagaaaaatgggtcatattaacattgtctcatcttcaatggaagattgtgagagtagattggactatattataggcaaatcatcaaaaatcccagaaaatttaattccaaaagaaaaacccttagtcagtataataatgggttcagattcagacttgccagttatgtctgttggtgcaaacattttaaagaggtttggagttccatttgaattaactatcgttagtgcgcatagaacacctcatagaatgacacaatatgctattgaagcaccaaagagaggcttaaaagtcataattgctggtgcaggtggtgctgctcatttaccaggtatggttgctgccatgacaccattaccagttattggcgttcctgtgaaaggctcgactttagatggtgttgattcattgcattcaatcgttcaaatgccaaggggtattcctgttgcaactgtcgcaattaataacagtactaatgctgccttgttggcagtccgtattttgggagcctacgactacaagtggttaaatgagatgaaccagtatatgaataacatggaaaacgaagtgttagctaaagctgaaagattggaagaagttggttatgaaaaatattaa

SEQ ID NO: 13093 - protein, 557 aa, Debaryomyces occidentalis
MDNKIVGILGGGQLGRMIVEAANRLNIKTVVLDVPNSPAKQINSNEHVDGSFTDLKSIIQLAEKCDILTVEIEHVDVEALKYVKEKFGVEIYPLPDTIKLIQDKYLQKEHLIQHGISVTESVAVPSNDEQSLIEIGNKFNYPFMLKSRTLAYDGRGNYVVKTKESIPEALEFLKDRPLYAEKWCPFNKELAVMVVRSIEGEVFAYPTVETIHKNNICHVVYAPARVSDSIAVKASVLAKNAVKSFPGCGIFGVEMFLLPNNEILINEIAPRPHNSGHYTIDACVTSQFEAHVRAVVGLPMPKNFTSLSTTTTNAIMLNVLGDEESNKELEICRRALETPNASVYLYGKSTRPNRKMGHINIVSSSMEDCESRLDYIIGKSSKIPENLIPKEKPLVSIIMGSDSDLPVMSVGANILKRFGVPFELTIVSAHRTPHRMTQYAIEAPKRGLKVIIAGAGGAAHLPGMVAAMTPLPVIGVPVKGSTLDGVDSLHSIVQMPRGIPVATVAINNSTNAALLAVRILGAYDYKWLNEMNQYMNNMENEVLAKAERLEEVGYEKY

SEQ ID NO: 13094 - DNA, 1632 bp, Pichia methanolica
  CDS (1)..(1632)
atggactcgcaaactgtcgggattttaggtggtggccaacttggtcgtatgatcgttgaagctgcacacagattgaatatcaaaactgtgattctcgaaaatggagaccaggctccagcaaagcaaatcaacgctttagatgaccatattgacggctcattcaatgatccaaaagcaattgccgaattggctgccaagtgtgatgttttaaccgttgagattgaacatgttgacactgatgcgttggttgaagttcaaaaggcaactggcatcaaaatcttcccatcaccagaaactatttcattgatcaaagataaatacttgcaaaaagagcatttgattaagaatggcattgctgttgccgaatcttgtagtgttgaaagtagcgcagcatctttagaagaagttggtgccaaatacggcttcccatacatgctaaaatctagaacaatggcctatgacggaagaggtaattttgttgtcaaagacaagtcatatatacctgaagctttgaaagttttagatgacaggccgttatacgccgagaaatgggctccattttcaaaggagttagctgttatggttgtgagatcaatcgatggccaagtttattcctacccaactgttgaaaccatccaccaaaacaacatctgtcacactgtctttgctccagctagagttaacgatactgtccaaaagaaggcccaaattttggctgacaacgctgtcaaatctttcccaggtgctggtatctttggtgttgaaatgtttttattacaaaatggtgacttattagtcaacgaaattgccccaagacctcacaattctggtcactataccatcgacgcttgtgtcacctcgcaatttgaagctcatgttagggccattactggtctacccatgccgaagaacttcacttgtttgtcgactccatctacccaagctattatgttgaacgttttaggtggcgatgagcaaaacggtgagttcaagatgtgtaaaagagcactagaaactcctcatgcttctgtttacttatacggtaagactacaagaccaggcagaaaaatgggtcacattaatatagtttctcaatcaatgactgactgtgagcgtagattacattacatagaaggtacgactaacagcatccctctcgaagaacagtacactacagattccattccgggcacttcaagcaagccattagtcggtgtcatcatgggttccgattcggacctaccagtcatgtctctaggttgtaatatattgaagcaatttaacgttccatttgaagtcactatcgtttccgctcatagaaccccacaaagaatggccaagtatgccattgatgctccaaagagagggttgaagtgcatcattgctggtgctggtggtgccgctcatttaccgggaatggttgcggcgatgacgccgctgcctgttattggtgtccctgttaaaggctctactttggatggtgttgattcactacactccatcgttcaaatgccaagaggtattcctgttgctactgtggctattaacaatgctactaacgctgccttgctagctatcacaatcttaggtgccggcgatccaaatacttgtctgcaatggaagtttatatga

SEQ ID NO: 13095 - protein, 543 aa, Pichia methanolica
MDSQTVGILGGGQLGRMIVEAAHRLNIKTVILENGDQAPAKQINALDDHIDGSFNDPKAIAELAAKCDVLTVEIEHVDTDALVEVQKATGIKIFPSPETISLIKDKYLQKEHLIKNGIAVAESCSVESSAASLEEVGAKYGFPYMLKSRTMAYDGRGNFVVKDKSYIPEALKVLDDRPLYAEKWAPFSKELAVMVVRSIDGQVYSYPTVETIHQNNICHTVFAPARVNDTVQKKAQILADNAVKSFPGAGIFGVEMFLLQNGDLLVNEIAPRPHNSGHYTIDACVTSQFEAHVRAITGLPMPKNFTCLSTPSTQAIMLNVLGGDEQNGEFKMCKRALETPHASVYLYGKTTRPGRKMGHINIVSQSMTDCERRLHYIEGTTNSIPLEEQYTTDSIPGTSSKPLVGVIMGSDSDLPVMSLGCNILKQFNVPFEVTIVSAHRTPQRMAKYAIDAPKRGLKCIIAGAGGAAHLPGMVAAMTPLPVIGVPVKGSTLDGVDSLHSIVQMPRGIPVATVAINNATNAALLAITILGAGDPNTCLQWKFI

SEQ ID NO: 13096 - DNA, 1659 bp, Schizosaccharomyces pombe
  CDS (1)..(1659)
atgagcgaaaaacaggttgtagggatccttggaggtggtcaattgggccgaatgatggtagaggcagcccatcgcttaaacatcaaatgcatcatcttggatgcagcaaattctcctgccaaacaaattgatggaggacgtgagcacattgatgcatcatttactgaccccgatgcaattgttgaactgtctaagaagtgcacgttattaacaactgaaattgagcatattaacactgatgccttggcagccgttacgaaatctgttgctgttgaaccctctcctgcaactctgcgatgcattcaagacaaatatcttcaaaaacagcatttacaggtttttaagattgcacttcctgaattttgcgatgcacctgaccaggaaagtgttgaaaaagcaggccaagagtttggttatccttttgtactgaaaagtaaaacattggcttacgacggtcgtggaaattacgttgttcatcaaccatctgagattcctactgccatcaaagcacttggtgatcgtccgctttatgttgaaaagttcgttcctttctccatggaaattgcagtgatggtagtacggagtttagacggaaaagtttatgcttatcctacaactgagaccattcaaaaggataatgtttgtcatttagtatatgcccctgctcgtcttcccttctcaattcaacagcgtgctcaaacccttgccatggatgcggtgcgcacttttgaaggcgctggtatatatggtgtagagatgtttgttttgcaagatggtgagaccattttactcaacgaaattgctcctcggcctcacaattcaggtcactacaccattgaagcttgcccaacttctcagtttgaagctcacttacgggccatatgtggtcttcctttcagcgaaatcaacacccaactctcgacttccacaactcatgcgttgatggtaaatattttaggtactgatgatcctgattatgtttcaaagatcgctaaacgttctctgtccattcccggtgcaactttgcatctttatggtaaagctgaatctagaaagggtcgcaagatgggacacgttaccatcatttctgattcacctcaagaatgtgaacgtaggtatcagatgcttcttgacgtcaaagatcctgtcgaatcacctgttgttggtattatcatgggttcggattctgatttaagcaagatgaaagatgctgccgtcattttagatgaattcaaggtgccttacgaacttactattgtttcagctcaccgcacaccagatcgcatggttacttatgctcgtaccgcagcttcaagagggttgcgtgtgattattgctggtgctggtggtgccgctcatttgcctggtatggttgctgcaatgacacctcttccagtaatcggcgttcctgtaaaaggaagcactcttgacggagttgactctcttcactctattgttcagatgcctcgaggtgtccctgtcgccactgttgctatcaataatagccaaaatgccggtattttagcctgtcgtatacttgctacatttcaaccctcccttttggctgctatggagagctttatggacaatatgaaagagattgttttagaaaaggctgataaattagaaaaagttggttggaaaaattattctgcatag

SEQ ID NO: 13097 - protein, 552 aa, Schizosaccharomyces pombe
MSEKQVVGILGGGQLGRMMVEAAHRLNIKCIILDAANSPAKQIDGGREHIDASFTDPDAIVELSKKCTLLTTEIEHINTDALAAVTKSVAVEPSPATLRCIQDKYLQKQHLQVFKIALPEFCDAPDQESVEKAGQEFGYPFVLKSKTLAYDGRGNYVVHQPSEIPTAIKALGDRPLYVEKFVPFSMEIAVMVVRSLDGKVYAYPTTETIQKDNVCHLVYAPARLPFSIQQRAQTLAMDAVRTFEGAGIYGVEMFVLQDGETILLNEIAPRPHNSGHYTIEACPTSQFEAHLRAICGLPFSEINTQLSTSTTHALMVNILGTDDPDYVSKIAKRSLSIPGATLHLYGKAESRKGRKMGHVTIISDSPQECERRYQMLLDVKDPVESPVVGIIMGSDSDLSKMKDAAVILDEFKVPYELTIVSAHRTPDRMVTYARTAASRGLRVIIAGAGGAAHLPGMVAAMTPLPVIGVPVKGSTLDGVDSLHSIVQMPRGVPVATVAINNSQNAGILACRILATFQPSLLAAMESFMDNMKEIVLEKADKLEKVGWKNYSA

SEQ ID NO: 13098 - DNA, 1905 bp, Zea mays
  CDS (1)..(1905)
atgcacgccaggttcctcagcgcgccgtcccctgcctccgccgccccctccccgtacgttcgcttggccttcacgggcgcccgcccgcgccgcgcgtgttggaagccgcgaggccccgcgtccgcgtccgcgccgccgcctcggcctctccactcgctgtgcgcccgggcctccatgcagcccgcctctcccgcgcacgacgggcatggtggtccgccggtgcacggcgtctccaacaccgtcatcggggtcctggggggcggtcagctcgggaagatgctctgccatgcagcgagtcagatggggattagaattgtcatcctcgaccctcttcccggctgccccgcgagctcggtttgcgatgagcacgtcatcgggagcttcaacgatggggacacggtccgggagttcgccaagaggtgtggggtcctaacagtggagattgagcatgttgatgccgccacactggagaagctggaaaaacagggcgttgactgcgagcctaaagcctccacaatcacgattattcaggacaagtacaggcagaaaaagcatttctcaagatgcgagatcccattgcctgacttcatggaagtagatactttacgcagtatagaggaggctggagaaaagtttggctatcccctaatggtcaaaagcaagagattagcatatgatggtcgaggaaatgctgtagccaagaacaaagaggagctaccttctgttgttgcttcactgggtgggtttgagcggggcttgtatgttgagagatggactcctttcgtaaaggagctttctgtaattgtggcaaggagcagagacaactctactgtctgctatcctgttgtggaaacagttcacaaggaaaatatatgccatgttgttgaagctcctgctgatgtatctaacaaaataaagaagttagctactagcgtggctgaaaaagctatcaaatcattagaaggagctggtgtctttgctgtagagttgtttttaacagaagatgatcagattttattgaatgaggtagcccctaggcctcacaatagtgggcatcacacaatagagtcatgctacacctcacaatatgagcagcatatacgcgctattcttggccttcctcttggtgatccctcaatgaaagcacctgcagcaataatgtacaacatcctgggcgaggatgagggtgaagcagggttctttctggctcatcagcttatcagtagggcactaaccattccaggcacatcggtccattggtacgcaaagccagagatgcggaagcaaaggaagatgggtcatattacaattgtggggccttctaagataagtgtaaaatcacgcttggacaacttgctgcaaagaaactcgtctgatcccaaggaagttagccctcgtgttgctattataatggggtcccaatctgatcttcctgtgatgaaagatgctgagagggttttgaaagagttcgacataccttgtgagttaactattgtttctgcacatcgtacaccagagcggatgtatgattatgcgaagtctgctaaagacaggggtttcgaggtcataattgcaggtgcaggcggagcagctcatttaccagggatggtggcttcattgactcctcttcctgtaatcggagttcccattaagacttcaacactatcaggatttgattccctcctatctattgtgcaaatgccaaaaggtattcctgttgcgactgttgctatcgggaatgcagaaaatgcaggtttgctggcagctaggattctggctgcaagagatcctgagctccaggacagggtaactaagtaccaggatgatctgagggacatggttttggagacggcagaaaggctggaggaccaaggcccggaggaatttctgaagggaatggattga

SEQ ID NO: 13099 - protein, 634 aa, Zea mays
MHARFLSAPSPASAAPSPYVRLAFTGARPRRACWKPRGPASASAPPPRPLHSLCARASMQPASPAHDGHGGPPVHGVSNTVIGVLGGGQLGKMLCHAASQMGIRIVILDPLPGCPASSVCDEHVIGSFNDGDTVREFAKRCGVLTVEIEHVDAATLEKLEKQGVDCEPKASTITIIQDKYRQKKHFSRCEIPLPDFMEVDTLRSIEEAGEKFGYPLMVKSKRLAYDGRGNAVAKNKEELPSVVASLGGFERGLYVERWTPFVKELSVIVARSRDNSTVCYPVVETVHKENICHVVEAPADVSNKIKKLATSVAEKAIKSLEGAGVFAVELFLTEDDQILLNEVAPRPHNSGHHTIESCYTSQYEQHIRAILGLPLGDPSMKAPAAIMYNILGEDEGEAGFFLAHQLISRALTIPGTSVHWYAKPEMRKQRKMGHITIVGPSKISVKSRLDNLLQRNSSDPKEVSPRVAIIMGSQSDLPVMKDAERVLKEFDIPCELTIVSAHRTPERMYDYAKSAKDRGFEVIIAGAGGAAHLPGMVASLTPLPVIGVPIKTSTLSGFDSLLSIVQMPKGIPVATVAIGNAENAGLLAARILAARDPELQDRVTKYQDDLRDMVLETAERLEDQGPEEFLKGMD

SEQ ID NO: 13100 - DNA, 26 bp, Artificial sequence
  primer
atggattctagaacagttggtatatt

SEQ ID NO: 13101 - DNA, 26 bp, Artificial sequence
  primer
ttacttgttttctagataagcttcgt

SEQ ID NO: 13102 - protein, 665 aa, Artificial sequence
  consensus sequence
  Variant (2)..(2): Xaa in position 2 is any amino acid
  Variant (12)..(14): Xaa in position 12 to 14 is any amino acid
  Variant (17)..(25): Xaa in position 17 to 25 is any amino acid
  Variant (28)..(31): Xaa in position 28 to 31 is any amino acid
  Variant (32)..(32): Xaa in position 32 is any or no amino acid
  Variant (35)..(39): Xaa in position 35 to 39 is any amino acid
  Variant (40)..(48): Xaa in position 40 to 48 is any or no amino acid
  Variant (50)..(51): Xaa in position 50 to 51 is any amino acid
  Variant (55)..(63): Xaa in position 55 to 63 is any amino acid
  Variant (65)..(66): Xaa in position 65 to 66 is any amino acid
  Variant (68)..(69): Xaa in position 68 to 69 is any amino acid
  Variant (78)..(81): Xaa in position 78 to 81 is any amino acid
  Variant (83)..(92): Xaa in position 83 to 92 is any amino acid
  Variant (93)..(102): Xaa in position 93 to 102 is any or no amino acid
  Variant (104)..(106): Xaa in position 104 to 106 is any amino acid
  Variant (109)..(110): Xaa in position 109 to 110 is any amino acid
  Variant (116)..(116): Xaa in position 116 is any amino acid
  Variant (119)..(119): Xaa in position 119 is any amino acid
  Variant (121)..(143): Xaa in position 121 to 143 is any amino acid
  Variant (144)..(159): Xaa in position 144 to 159 is any or no amino acid
  Variant (161)..(163): Xaa in position 161 to 163 is any amino acid
  Variant (165)..(165): Xaa in position 165 is any amino acid
  Variant (167)..(167): Xaa in position 167 is any amino acid
  Variant (169)..(169): Xaa in position 169 is any amino acid
  Variant (172)..(174): Xaa in position 172 to 174 is any amino acid
  Variant (182)..(182): Xaa in position 182 is any amino acid
  Variant (184)..(192): Xaa in position 184 to 192 is any amino acid
  Variant (193)..(194): Xaa in position 193 to 194 is any or no amino acid
  Variant (196)..(198): Xaa in position 196 to 198 is any amino acid
  Variant (200)..(201): Xaa in position 200 to 201 is any amino acid
  Variant (202)..(203): Xaa in position 202 to 203 is any or no amino acid
  Variant (205)..(205): Xaa in position 205 is any amino acid
  Variant (208)..(208): Xaa in position 208 is any amino acid
  Variant (212)..(213): Xaa in position 212 to 213 is any amino acid
  Variant (215)..(215): Xaa in position 215 is any amino acid
  Variant (216)..(216): Xaa in position 216 is any or no amino acid
  Variant (221)..(221): Xaa in position 221 is any amino acid
  Variant (223)..(223): Xaa in position 223 is any amino acid
  Variant (225)..(231): Xaa in position 225 to 231 is any amino acid
  Variant (232)..(237): Xaa in position 232 to 237 is any or no amino acid
  Variant (240)..(240): Xaa in position 240 is any amino acid
  Variant (244)..(244): Xaa in position 244 is any amino acid
  Variant (246)..(248): Xaa in position 246 to 248 is any amino acid
  Variant (251)..(254): Xaa in position 251 to 254 is any amino acid
  Variant (258)..(266): Xaa in position 258 to 266 is any amino acid
  Variant (267)..(267): Xaa in position 267 is any or no amino acid
  Variant (269)..(271): Xaa in position 269 to 271 is any amino acid
  Variant (273)..(274): Xaa in position 273 to 274 is any amino acid
  Variant (276)..(280): Xaa in position 276 to 280 is any amino acid
  Variant (282)..(282): Xaa in position 282 is any amino acid
  Variant (284)..(284): Xaa in position 284 is any amino acid
  Variant (286)..(286): Xaa in position 286 is any amino acid
  Variant (289)..(289): Xaa in position 289 is any amino acid
  Variant (292)..(297): Xaa in position 292 to 297 is any amino acid
  Variant (298)..(304): Xaa in position 298 to 304 is any or no amino acid
  Variant (306)..(306): Xaa in position 306 is any amino acid
  Variant (309)..(309): Xaa in position 309 is any amino acid
  Variant (319)..(319): Xaa in position 319 is any amino acid
  Variant (322)..(323): Xaa in position 322 to 323 is any amino acid
  Variant (325)..(326): Xaa in position 325 to 326 is any amino acid
  Variant (327)..(327): Xaa in position 327 is any or no amino acid
  Variant (330)..(330): Xaa in position 330 is any amino acid
  Variant (332)..(332): Xaa in position 332 is any amino acid
  Variant (334)..(334): Xaa in position 334 is any amino acid
  Variant (337)..(339): Xaa in position 337 to 339 is any amino acid
  Variant (342)..(352): Xaa in position 342 to 352 is any amino acid
  Variant (353)..(356): Xaa in position 353 to 356 is any or no amino acid
  Variant (359)..(359): Xaa in position 359 is any amino acid
  Variant (361)..(361): Xaa in position 361 is any amino acid
  Variant (364)..(376): Xaa in position 364 to 376 is any amino acid
  Variant (377)..(383): Xaa in position 377 to 383 is any or no amino acid
  Variant (386)..(387): Xaa in position 386 to 387 is any amino acid
  Variant (389)..(394): Xaa in position 389 to 394 is any amino acid
  Variant (395)..(398): Xaa in position 395 to 398 is any or no amino acid
  Variant (400)..(400): Xaa in position 400 is any amino acid
  Variant (402)..(403): Xaa in position 402 to 403 is any amino acid
  Variant (404)..(404): Xaa in position 404 is any or no amino acid
  Variant (406)..(407): Xaa in position 406 to 407 is any amino acid
  Variant (414)..(418): Xaa in position 414 to 418 is any amino acid
  Variant (419)..(420): Xaa in position 419 to 420 is any or no amino acid
  Variant (422)..(428): Xaa in position 422 to 428 is any amino acid
  Variant (430)..(441): Xaa in position 430 to 441 is any amino acid
  Variant (442)..(490): Xaa in position 442 to 490 is any or no amino acid
  Variant (492)..(492): Xaa in position 492 is any amino acid
  Variant (494)..(495): Xaa in position 494 to 495 is any amino acid
  Variant (507)..(512): Xaa in position 507 to 512 is any amino acid
  Variant (514)..(515): Xaa in position 514 to 515 is any amino acid
  Variant (516)..(516): Xaa in position 516 is any or no amino acid
  Variant (518)..(521): Xaa in position 518 to 521 is any amino acid
  Variant (523)..(524): Xaa in position 523 to 524 is any amino acid
  Variant (526)..(526): Xaa in position 526 is any amino acid
  Variant (533)..(534): Xaa in position 533 to 534 is any amino acid
  Variant (536)..(537): Xaa in position 536 to 537 is any amino acid
  Variant (540)..(541): Xaa in position 540 to 541 is any amino acid
  Variant (543)..(544): Xaa in position 543 to 544 is any amino acid
  Variant (547)..(549): Xaa in position 547 to 549 is any amino acid
  Variant (566)..(567): Xaa in position 566 to 567 is any amino acid
  Variant (569)..(569): Xaa in position 569 is any amino acid
  Variant (578)..(581): Xaa in position 578 to 581 is any amino acid
  Variant (585)..(585): Xaa in position 585 is any amino acid
  Variant (589)..(589): Xaa in position 589 is any amino acid
  Variant (598)..(598): Xaa in position 598 is any amino acid
  Variant (604)..(604): Xaa in position 604 is any amino acid
  Variant (608)..(609): Xaa in position 608 to 609 is any amino acid
  Variant (612)..(612): Xaa in position 612 is any amino acid
  Variant (616)..(616): Xaa in position 616 is any amino acid
  Variant (618)..(618): Xaa in position 618 is any amino acid
  Variant (620)..(632): Xaa in position 620 to 632 is any amino acid
  Variant (633)..(636): Xaa in position 633 to 636 is any or no amino acid
  Variant (638)..(643): Xaa in position 638 to 643 is any amino acid
  Variant (644)..(645): Xaa in position 644 to 645 is any or no amino acid
  Variant (647)..(647): Xaa in position 647 is any amino acid
  Variant (648)..(648): Xaa in position 648 is any or no amino acid
  Variant (650)..(652): Xaa in position 650 to 652 is any amino acid
  Variant (654)..(655): Xaa in position 654 to 655 is any amino acid
  Variant (656)..(656): Xaa in position 656 is any or no amino acid
  Variant (658)..(659): Xaa in position 658 to 659 is any amino acid
  Variant (660)..(664): Xaa in position 660 to 664 is any or no amino acid
GXLGGGQLGRMXXXAAXXXXXXXXXLDXXXXXPAXXXXXXXXXXXXXXHXXGSFXXXXXXXXXAXXCXXLTVEIEHVXXXXLXXXXXXXXXXXXXXXXXXXXPXXXTIXXIQDKYXQKXHXXXXXXXXXXXXXXXXXXXXXXXXXXXXXXXXXXXXXXXGXXXGXPXMXKSXXXAYDGRGNXVXXXXXXXXXXXAXXXLXXXXRXLYXEKWXXFXXELAVXVXRXXXXXXXXXXXXXYPXVETXHXXXICXXXXAPAXXXXXXXXXXAXXXAXXAXXXXXGXGXFXVEXFLXXXXXXXXXXXXXLXNEXAPRPHNSGHXTIXXCXXXSQXEXHXRAXXXLPXXXXXXXXXXXXXXXIMXNXLGXXXXXXXXXXXXXXXXXXXXALXXPXXXXXXXXXXYXKXXXRXXRKMGHIXXXXXXXSXXXXXXXLXXXXXXXXXXXXXXXXXXXXXXXXXXXXXXXXXXXXXXXXXXXXXXXXXXXXXXXXXXXXXPXVXXIMGSDSDLPVMXXXXXXLXXXFXXXXEXXIXSAHRTPXXMXXYAXXAXXRGXXXIIAGAGGAAHLPGMVAXXTXLPVIGVPVXXXXLDGXDSLXSIVQMPRGXPVATVXINNXXNAXLLAXRXLXXXXXXXXXXXXXXXXXYXXXXXXXXLXXKXXXLXXXGXXXXXXXY

SEQ ID NO: 13103 - protein, 57 aa, Artificial sequence
  protein pattern
  Variant (12)..(12): Xaa in position 12 is Ala or Ser
  Variant (13)..(13): Xaa in position 13 is any amino acid
  Variant (15)..(15): Xaa in position 15 is Ala, Pro, Ser or Thr
  Variant (16)..(16): Xaa in position 16 is Leu or Val
  Variant (23)..(23): Xaa in position 23 is Ile or Val
  Variant (24)..(29): Xaa in position 24 to 29 is any amino acid
  Variant (31)..(31): Xaa in position 31 is any amino acid
  Variant (35)..(35): Xaa in position 35 is any amino acid
  Variant (42)..(42): Xaa in position 42 is Lys or Arg
  Variant (44)..(44): Xaa in position 44 is Ile or Val
  Variant (46)..(46): Xaa in position 46 is Cys or Val
  Variant (49)..(49): Xaa in position 49 is Met or Val
  Variant (50)..(50): Xaa in position 50 is Ala or Gly
  Variant (51)..(51): Xaa in position 51 is Ile or Val
  Variant (52)..(52): Xaa in position 52 is Gly, Asn or Gln
  Variant (54)..(54): Xaa in position 54 is Ala, Gly or Ser
  Variant (55)..(55): Xaa in position 55 is any amino acid
GGAAHLPGMVAXXTXXPVIGVPXXXXXXXGXDSLXSIVQMPXGXPXATXXXXNXXNA

SEQ ID NO: 13104 - protein, 20 aa, Artificial sequence
  protein pattern
  Variant (2)..(2): Xaa in position 2 is Ile, Leu or Val
  Variant (5)..(5): Xaa in position 5 is any amino acid
  Variant (15)..(15): Xaa in position 15 is any amino acid
  Variant (18)..(18): Xaa in position 18 is Asp or Glu
  Variant (19)..(19): Xaa in position 19 is Ala, Cys, Gly or Ser
  Variant (20)..(20): Xaa in position 20 is Ala, Cys or Val
LXNEXAPRPHNSGHXTIXXX

SEQ ID NO: 13105 - protein, 29 aa, Artificial sequence
  protein pattern
  Variant (2)..(4): Xaa in position 2 to 4 is any amino acid
  Variant (5)..(5): Xaa in position 5 is Gly, Asn or Gln
  Variant (6)..(6): Xaa in position 6 is Phe or Tyr
  Variant (8)..(9): Xaa in position 8 to 9 is any or no amino acid
  Variant (11)..(12): Xaa in position 11 to 12 is any or no amino acid
  Variant (14)..(14): Xaa in position 14 is Ala or Ser
  Variant (15)..(15): Xaa in position 15 is Lys or Arg
  Variant (16)..(17): Xaa in position 16 to 17 is any amino acid
  Variant (18)..(18): Xaa in position 18 is Ala or Ser
  Variant (22)..(22): Xaa in position 22 is Lys or Arg
  Variant (25)..(26): Xaa in position 25 to 26 is any amino acid
  Variant (27)..(27): Xaa in position 27 is Ala, Ile or Val
  Variant (28)..(28): Xaa in position 28 is any amino acid
  Variant (29)..(29): Xaa in position 29 is Asp, Asn, Gln, Ser or Thr
GXXXXXPXXLXXKXXXXXYDGXGNXXXXX

SEQ ID NO: 13106 - protein, 29 aa, Artificial sequence
  protein pattern
  Variant (2)..(2): Xaa in position 2 is any amino acid
  Variant (3)..(3): Xaa in position 3 is Ile or Val
  Variant (4)..(4): Xaa in position 4 is Pro, Gln or Thr
  Variant (5)..(5): Xaa in position 5 is any amino acid
  Variant (7)..(7): Xaa in position 7 is Leu or Val
  Variant (8)..(8): Xaa in position 8 is any amino acid
  Variant (10)..(10): Xaa in position 10 is Thr or Val
  Variant (17)..(18): Xaa in position 17 to 18 is any amino acid
  Variant (20)..(22): Xaa in position 20 to 22 is any amino acid
  Variant (24)..(24): Xaa in position 24 is any amino acid
  Variant (25)..(25): Xaa in position 25 is Ala, Asp, Glu, Asn, Ser or Thr
  Variant (26)..(26): Xaa in position 26 is Ala, Gly or Thr
  Variant (27)..(28): Xaa in position 27 to 28 is any amino acid
FXXXXEXXIXSAHRTPXXMXXXAXXXXXR

SEQ ID NO: 13107 - protein, 16 aa, Artificial sequence
  protein pattern
  Variant (2)..(2): Xaa in position 2 is Lys or Arg
  Variant (3)..(3): Xaa in position 3 is Phe, Trp or Tyr
  Variant (4)..(4): Xaa in position 4 is Ala, Cys, Thr or Val
  Variant (5)..(5): Xaa in position 5 is any amino acid
  Variant (7)..(8): Xaa in position 7 to 8 is any amino acid
  Variant (11)..(11): Xaa in position 11 is Ala or Ser
  Variant (13)..(13): Xaa in position 13 is Ile or Met
  Variant (14)..(14): Xaa in position 14 is Ile or Val
  Variant (15)..(15): Xaa in position 15 is Ala, Ile or Val
  Variant (16)..(16): Xaa in position 16 is Lys or Arg
EXXXXFXXELXVXXXX

SEQ ID NO: 13108 - protein, 39 aa, Artificial sequence
  protein pattern
  Variant (2)..(2): Xaa in position 2 is Ile, Leu, Met or Val
  Variant (3)..(3): Xaa in position 3 is any amino acid
  Variant (4)..(4): Xaa in position 4 is Asp or Gly
  Variant (5)..(5): Xaa in position 5 is Ala or Ser
  Variant (7)..(11): Xaa in position 7 to 11 is any amino acid
  Variant (12)..(12): Xaa in position 12 is Ile or Val
  Variant (13)..(14): Xaa in position 13 to 14 is any amino acid
  Variant (15)..(15): Xaa in position 15 is Phe, Ile or Leu
  Variant (17)..(18): Xaa in position 17 to 18 is any amino acid
  Variant (19)..(19): Xaa in position 19 is Ala, Cys or Val
  Variant (20)..(20): Xaa in position 20 is Asp or Gly
  Variant (21)..(21): Xaa in position 21 is Ile or Val
  Variant (22)..(22): Xaa in position 22 is Ile, Leu, Met or Val
  Variant (24)..(24): Xaa in position 24 is Ala, Ile or Val
  Variant (30)..(31): Xaa in position 30 to 31 is any or no amino acid
  Variant (33)..(33): Xaa in position 33 is any amino acid
  Variant (34)..(35): Xaa in position 34 to 35 is any or no amino acid
  Variant (37)..(38): Xaa in position 37 to 38 is any amino acid
  Variant (39)..(39): Xaa in position 39 is Ala, Ile, Leu or Val
HXXXXFXXXXXXXXXAXXXXXXTXEIEHVXXDXXXLXXX

SEQ ID NO: 13109 - protein, 30 aa, Artificial sequence
  protein pattern
  Variant (2)..(2): Xaa in position 2 is any or no amino acid
  Variant (4)..(4): Xaa in position 4 is Ile, Leu or Val
  Variant (12)..(12): Xaa in position 12 is Lys or Arg
  Variant (14)..(16): Xaa in position 14 to 16 is any amino acid
  Variant (17)..(17): Xaa in position 17 is any or no amino acid
  Variant (19)..(27): Xaa in position 19 to 27 is any amino acid
  Variant (28)..(28): Xaa in position 28 is any or no amino acid
VXGXLGGGQLGXMXXXXAXXXXXXXXXXLD

SEQ ID NO: 13110 - protein, 21 aa, Artificial sequence
  protein pattern
  Variant (3)..(3): Xaa in position 3 is any or no amino acid
  Variant (5)..(5): Xaa in position 5 is any or no amino acid
  Variant (8)..(8): Xaa in position 8 is Ile or Val
  Variant (9)..(10): Xaa in position 9 to 10 is any amino acid
  Variant (11)..(11): Xaa in position 11 is Asp, Glu or Asn
  Variant (12)..(12): Xaa in position 12 is Asn or Ser
  Variant (13)..(13): Xaa in position 13 is Ile or Val
  Variant (15)..(16): Xaa in position 15 to 16 is any amino acid
  Variant (17)..(17): Xaa in position 17 is Cys, Thr or Val
  Variant (18)..(19): Xaa in position 18 to 19 is any amino acid
  Variant (21)..(21): Xaa in position 21 is Ala, Leu or Pro
YPXVXETXXXXXXCXXXXXPX

SEQ ID NO: 13111 - protein, 32 aa, Artificial sequence
  protein pattern
  Variant (2)..(4): Xaa in position 2 to 4 is any amino acid
  Variant (5)..(5): Xaa in position 5 is Ala or Thr
  Variant (7)..(8): Xaa in position 7 to 8 is any or no amino acid
  Variant (10)..(10): Xaa in position 10 is any amino acid
  Variant (11)..(11): Xaa in position 11 is Asp or Asn
  Variant (13)..(13): Xaa in position 13 is Phe or Tyr
  Variant (14)..(14): Xaa in position 14 is any amino acid
  Variant (17)..(17): Xaa in position 17 is any amino acid
  Variant (18)..(18): Xaa in position 18 is His or Tyr
  Variant (19)..(23): Xaa in position 19 to 23 is any amino acid
  Variant (24)..(24): Xaa in position 24 is Ile, Leu or Val
  Variant (25)..(25): Xaa in position 25 is Ala, Asp, Pro or Ser
  Variant (26)..(31): Xaa in position 26 to 31 is any amino acid
  Variant (32)..(32): Xaa in position 32 is Ile, Leu or Val
PXXXXIXXIXXKXXQKXXXXXXXXXXXXXXXX

SEQ ID NO: 13112 - protein, 29 aa, Artificial sequence
  protein pattern
  Variant (2)..(4): Xaa in position 2 to 4 is any amino acid
  Variant (6)..(7): Xaa in position 6 to 7 is any amino acid
  Variant (9)..(9): Xaa in position 9 is Ile or Val
  Variant (10)..(11): Xaa in position 10 to 11 is any amino acid
  Variant (12)..(12): Xaa in position 12 is Phe or Leu
  Variant (13)..(13): Xaa in position 13 is any amino acid
  Variant (15)..(15): Xaa in position 15 is any amino acid
  Variant (17)..(17): Xaa in position 17 is Ile, Met or Val
  Variant (19)..(19): Xaa in position 19 is Ala or Gly
  Variant (22)..(22): Xaa in position 22 is Leu or Met
  Variant (24)..(24): Xaa in position 24 is any or no amino acid
  Variant (26)..(27): Xaa in position 26 to 27 is any amino acid
  Variant (28)..(28): Xaa in position 28 is Asp, Gly or Asn
  Variant (29)..(29): Xaa in position 29 is Asp, Glu, Gly, Asn or Ser
AXXXAXXAXXXXXGXGXFXVEXFXLXXXX

SEQ ID NO: 13113 - protein, 21 aa, Artificial sequence
  protein pattern
  Variant (2)..(2): Xaa in position 2 is Ala or Gly
  Variant (3)..(3): Xaa in position 3 is Ile or Val
  Variant (4)..(4): Xaa in position 4 is Ile or Met
  Variant (8)..(8): Xaa in position 8 is Asp or Gln
  Variant (9)..(9): Xaa in position 9 is Ser or Thr
  Variant (12)..(13): Xaa in position 12 to 13 is any amino acid
  Variant (14)..(14): Xaa in position 14 is Leu or Met
  Variant (15)..(16): Xaa in position 15 to 16 is any amino acid
  Variant (17)..(17): Xaa in position 17 is Ala or Gly
  Variant (18)..(19): Xaa in position 18 to 19 is any amino acid
  Variant (20)..(20): Xaa in position 20 is Ile, Leu, Met or Val
VXXXMGSXXDLXXXXXXXXXL

SEQ ID NO: 13114 - protein, 15 aa, Artificial sequence
  protein pattern
  Variant (2)..(3): Xaa in position 2 to 3 is any amino acid
  Variant (4)..(4): Xaa in position 4 is any or no amino acid
  Variant (6)..(7): Xaa in position 6 to 7 is any amino acid
  Variant (10)..(10): Xaa in position 10 is Leu, Met or Val
  Variant (14)..(14): Xaa in position 14 is Asn or Thr
  Variant (15)..(15): Xaa in position 15 is Ile, Leu or Val
KXXXRXXRKXGHIXX

SEQ ID NO: 13115 - DNA, 1716 bp, Saccharomyces cerevisiae; identical to SEQ ID NO: 13030
  CDS (1)..(1716)

SEQ ID NO: 13116 - protein, 571 aa, Saccharomyces cerevisiae; identical to SEQ ID NO: 13031

SEQ ID NO: 13117 - DNA, 537 bp, Klebsiella pneumoniae subsp. pneumoniae MGH 78578
  CDS (28)..(537): transl_table=11
aacacacccacaggagttttaagacgcatgtcttcccgcaataattcggcgcgtatcgccatcgtgatggggtccaaaagcgactgggctaccatgcaatttaccgcagaaatccttgatgccctgaacgttccgtaccatgtcgaagtggtctccgcccaccgcacgcccgataagctgttcagctttgctgaaagcgccgaaagccacggttatcaggtgattattgcaggagcaggcggcgcggcgcatctgccgggcatgattgcggcgaaaaccctggtgccggtgctcggcgtaccggttcagagcgcagccttaagcggtgtcgacagcctctactccattgtgcagatgccgcgcggcattccggtcggtaccctggccatcggcaaagctggcgctgcgaacgccggcttgctcgccgcgcagatccttgcccagcatgatgcagaactgcaccagcgcctgagcgcctggcgtcaggcgcaaaccgatgaagtgctggataatccggatccgcggggtgcggcatga

SEQ ID NO: 13118 - protein, 169 aa, Klebsiella pneumoniae subsp. pneumoniae MGH 78578
MSSRNNSARIAIVMGSKSDWATMQFTAEILDALNVPYHVEVVSAHRTPDKLFSFAESAESHGYQVIIAGAGGAAHLPGMIAAKTLVPVLGVPVQSAALSGVDSLYSIVQMPRGIPVGTLAIGKAGAANAGLLAAQILAQHDAELHQRLSAWRQAQTDEVLDNPDPRGAA

SEQ ID NO: 13119 - DNA, 483 bp, Xanthobacter autotrophicus Py2
  CDS (1)..(483): transl_table=11
atgagcacggctgacgttgccgtcatcatgggcagccagtccgattgggaaaccatgcgccacgcgtccgagacgctggaagcgctgaagatcccgcacgacagccgcatcgtctccgcccatcgcacgcccgagcgcatgtacgccttcgcccgcagcgcgaaggcggacggcttcaaggtgatcatcgccggcgccggcggggcggcccacctgccgggcatggtggcggcgctcaccaccctgcccgtgttcggcgtgccggtgcagtccaaggccctgtccggcctcgacagcctctattccatcgtccagatgccggccggcgttccggtagggacgctggccatcggcgtcgccggagcgaccaatgcggcgctgctggcggcttccgtgctggcgctctcggacccggccctgtcgcaacgcctcgaagcctggcgggcatcccgcaccgcggcggtggcggaacggccggcctga

SEQ ID NO: 13120 - protein, 160 aa, Xanthobacter autotrophicus Py2
MSTADVAVIMGSQSDWETMRHASETLEALKIPHDSRIVSAHRTPERMYAFARSAKADGFKVIIAGAGGAAHLPGMVAALTTLPVFGVPVQSKALSGLDSLYSIVQMPAGVPVGTLAIGVAGATNAALLAASVLALSDPALSQRLEAWRASRTAAVAERPA

SEQ ID NO: 13121 - DNA, 498 bp, Mesorhizobium loti MAFF303099
  CDS (1)..(498): transl_table=11
ttgaacgatcaacgcgccgacgtcgccatcatcatgggcagccagtccgactgggcgacgatgcgccaggcggccgaaacgctggaggcgctgggcgtcccgcacaaacggctgatcatctcggcgcatcgcacgcccgaccggctctatgaattcgccaagggcgcaaaggccgccggctacaaggtgatcatcgccggcgccggcggtgccgcgcacctgcccggcatgacggcggcgatgacgccgctgccggtgttcggcgtgccggtggaatcgaaggcgctgtcggggcaggattcgctgctctccatcgtccagatgccagccggcattcctgtcgggacattggccatcggcaaggcgggtgcggccaatgcggccctgttggcagccgccgtgctggcgctcaacgacgacaagcttgcccagcgcctcgacgcctggcgcgcctcgcagaccgccaaggtcgccgacgaaccgacggacacgccgtga

SEQ ID NO: 13122 - protein, 165 aa, Mesorhizobium loti MAFF303099
MNDQRADVAIIMGSQSDWATMRQAAETLEALGVPHKRLIISAHRTPDRLYEFAKGAKAAGYKVIIAGAGGAAHLPGMTAAMTPLPVFGVPVESKALSGQDSLLSIVQMPAGIPVGTLAIGKAGAANAALLAAAVLALNDDKLAQRLDAWRASQTAKVADEPTDTP

SEQ ID NO: 13123 - DNA, 471 bp, Thermoplasma volcanium GSS1
  CDS (1)..(471): transl_table=11
atgccaaaggttgcagtaatcatggggagttcaagcgattacgaagtaatgaaagccgccatagatacactcaacgagttcggtgtagatgtaatctcgaaagtggtctctgcacataggactccagagtttatgatgcagtttgcaaaggaggcagcttcctctggaatagaagctataatagctggagcaggcggagctgcacacctgcctggcatggttgctgcgatgactccattgccggtgattggagtgccagttcctacgaaaaacctaggagggatggattccctgctatcaatagtgcaaatgccttctggtgtgccagtagctactgttgctattggcaattcgaagaatgcagctctgttggcaattcgaatactgtcaataaaatatcccgatcttatggccaaaatgtctgaatttatggaatctgaaaaacagcgggttcttcaagaaaagatctga

SEQ ID NO: 13124 - protein, 156 aa, Thermoplasma volcanium GSS1
MPKVAVIMGSSSDYEVMKAAIDTLNEFGVDVISKVVSAHRTPEFMMQFAKEAASSGIEAIIAGAGGAAHLPGMVAAMTPLPVIGVPVPTKNLGGMDSLLSIVQMPSGVPVATVAIGNSKNAALLAIRILSIKYPDLMAKMSEFMESEKQRVLQEKI

SEQ ID NO: 13125 - DNA, 486 bp, Bacillus halodurans C-125
  CDS (1)..(486): transl_table=11
atggagccagtcgttggcgtcatcatgggaagtacatccgattgggagacgatgcagcacgcatgtgaaatactcgaagaattagaggtaccgtacgaaaaaaaagtcgtgtcagcccaccgtacacctgatttaatgtttcaatatgcagaaaccgcacaggaacgcgggttgaaggtgattatcgcaggtgctggaggagctgctcatcttccagggatggtagcggccaaaacggtcgttcctgtcattggggtgccggttcaatcaaaggcactgaacgggcttgactcattactttcaatcgtacaaatgccgggcggtgttccggttgcgaccgttgcgattggaaaagctggagccacaaacgcggggctactggcggcgcaaatgatcggtgcctttgatcatcaagtggctgagcgagttcgcctgcgccgtgaaaaagtggaacaagctgtgctggaaagtagtgaatcgctatga

SEQ ID NO: 13126 - protein, 161 aa, Bacillus halodurans C-125
MEPVVGVIMGSTSDWETMQHACEILEELEVPYEKKVVSAHRTPDLMFQYAETAQERGLKVIIAGAGGAAHLPGMVAAKTVVPVIGVPVQSKALNGLDSLLSIVQMPGGVPVATVAIGKAGATNAGLLAAQMIGAFDHQVAERVRLRREKVEQAVLESSESL

SEQ ID NO: 13127 - DNA, 501 bp, Pasteurella multocida subsp. multocida str. Pm70
  CDS (1)..(501): transl_table=11
atgtcaaattgcacacctcaaattgcgattgtaatgggctcaaaaagtgactgggcaaccatgcaagaagcaacccatattcttgatgaattacaaattccttaccacgttgaagtggtgtctgcacatcgtaccccagataaattatttacctttgcagaaacagcgagtgcgaaaggttacaaagtgattattgcaggtgccggcggtgctgcccatttaccgggtatgatcgcgtcaaaaactttagtccctgtattgggcgtaccggtcaaaagttcgatgttaagtggcgttgatagtttgtattcgattgtgcaaatgcctaaggggattcctgtcggaaccttagcgattggtcctgcaggagcggctaatgcaggcttattagcagctcaaatcttagcagcctttgacacttcgctcctgacaagattgacggcatttcgagaaaagcaaacaaatagcgtactagaaaatccagatccacggatgccatag

SEQ ID NO: 13128 - protein, 166 aa, Pasteurella multocida subsp. multocida str. Pm70
MSNCTPQIAIVMGSKSDWATMQEATHILDELQIPYHVEVVSAHRTPDKLFTFAETASAKGYKVIIAGAGGAAHLPGMIASKTLVPVLGVPVKSSMLSGVDSLYSIVQMPKGIPVGTLAIGPAGAANAGLLAAQILAAFDTSLLTRLTAFREKQTNSVLENPDPRMP

SEQ ID NO: 13129 - DNA, 486 bp, Lactococcus lactis subsp. lactis Il1403
  CDS (1)..(486): transl_table=11
atggcagaagtagcaattatcatgggttcgagctcagattgggcgacaatgaaagaaacagcaaaaattttagatgactttggtttagcttatgaaaaaaaggtcgtatcagcacaccgaacaccagctttgatggctgaattttcgagccaagcccgtgaggcaggttataaagttatcatcgcaggtgctggtggagccgctcatttgccaggaatggtatctgctcagactctcgttccagtcattggcgttccaataaaatcacgcgctttatctggtctggattcactttattcaattgttcaaatgccggcaggggttcctgtagcgacaatggcaattggagaggctggagcaaaaaatgctgctttatttgctttgcaacttttggcgaatacaaacgagaatttataccaaaaattgttggtctatcgggctgctgcgcaagaaatggttgaggaatcaaacaaagcattactttaa

SEQ ID NO: 13130 - protein, 161 aa, Lactococcus lactis subsp. lactis Il1403
MAEVAIIMGSSSDWATMKETAKILDDFGLAYEKKVVSAHRTPALMAEFSSQAREAGYKVIIAGAGGAAHLPGMVSAQTLVPVIGVPIKSRALSGLDSLYSIVQMPAGVPVATMAIGEAGAKNAALFALQLLANTNENLYQKLLVYRAAAQEMVEESNKALL

SEQ ID NO: 13131 - DNA, 492 bp, Streptococcus pyogenes M1 GAS
  CDS (1)..(492): transl_table=11
atgaaaactccaattatttctattatcatgggctccaaatctgactgggcaaccatgcaaaaaacggctgaagttctagacaactttggcattgcttacgagaagaaagtcgtctctgcccaccgtacgccagacctcatgttcaagcatgctgaggaagcacgtggtcgtggcatcaaaatcatcatcgcaggagcaggtggggcagctcacttgcctggtatggtggcagctaaaacaacgctgcctgttatcggtgtgcctgtcaaatcacgtgccctttcaggtttggattcgctatattccattgtgcagatgcctggcggtgtgcctgtggcaaccatggctatcggagaagcgggagcgactaacgctgccctgacagccctccgtatcctctctatcgaggaccaaaatctggctgatgcgctagctcatttccatgaggaacaaggaaaaatcgcagaggagtcaagtggtgaactcatttaa

SEQ ID NO: 13132 - protein, 163 aa, Streptococcus pyogenes M1 GAS
MKTPIISIIMGSKSDWATMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSGELI

SEQ ID NO: 13133 - DNA, 486 bp, Neisseria meningitidis MC58
  CDS (1)..(486): transl_table=11
atgatacaaatcggcatcatcatgggcagcaacagcgattggcccgttatgcggcaggcagcgcagtttcttgaagagttcggcgtagaatatgaggcgcgcgttgtttccgcacaccgcaccccggatttgatgttccaatacgccgaaaccgcacgggcgcgcggcatcaaagccatcatcgcgggtgcgggcggcgcggcgcatttacccggtatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctcgccaacgaaacccccgaactggcgcaaaaactggcagacttccgagccaaacaggaacaggctgttttgaatatggaattggaacaaatttaa

SEQ ID NO: 13134 - protein, 161 aa, Neisseria meningitidis MC58
MIQIGIIMGSNSDWPVMRQAAQFLEEFGVEYEARVVSAHRTPDLMFQYAETARARGIKAIIAGAGGAAHLPGMVAAKTTVPVLGVPVPSKYLRGEDSLLSIVQMPKGVPVATFAIGEAGAANAALFAVSMLANETPELAQKLADFRAKQEQAVLNMELEQI

SEQ ID NO: 13135 - DNA, 495 bp, Campylobacter jejuni subsp. jejuni NCTC 11168
  CDS (1)..(495): transl_table=11
atgaattttgtttctattttaatgggaagcaagagtgattatgagactatgaaagaggctgctaaaactttagaaagttttggtgtaaagtatgaacttatcatctcatcagctcatcgtagtccaaaaagaacaaaagagtatattgcaaatgctgaagaaaaaggtgtgaaggtttttatagcagcagctggaatggcagcgcatttagctggagctgttgcagcttatacaacaaaacctgttttaggagtgcctatgtcaggaagcaatcttgcaagtatggattctttgttttctacggtgcaaatgcctagtggaattcctgtaggaactttagctattggtaaggctggagcaatcaatgctgcttatttggctatgcaaattttagctatttatgatgttgatttagcacaaaagcttaaagaagatcgtcttgaaaaagaaaaaaaacttgtatctgattcaaaagaagtagaagttttattataa

SEQ ID NO: 13136 - protein, 164 aa, Campylobacter jejuni subsp. jejuni NCTC 11168
MNFVSILMGSKSDYETMKEAAKTLESFGVKYELIISSAHRSPKRTKEYIANAEEKGVKVFIAAAGMAAHLAGAVAAYTTKPVLGVPMSGSNLASMDSLFSTVQMPSGIPVGTLAIGKAGAINAAYLAMQILAIYDVDLAQKLKEDRLEKEKKLVSDSKEVEVLL

SEQ ID NO: 13137 - DNA, 486 bp, Neisseria meningitidis Z2491
  CDS (1)..(486): transl_table=11
atgatacaaatcggcatcatcatgggcagcaacagcgattggcccgttatgcggcaggcagcgcagtttcttgaagagttcggcgtagaatatgaggcgcgcgttgtttccgcacaccgcaccccggatttgatgttccaatacgccgaaaccgcacgggcgcgcggcatcaaagccatcatcgcgggtgcgggcggcgcggcgcatttacccggtatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctcgccaacgaaacccccgaactggcgcaaaaactggcagacttccgagccaaacaggaacaggctgttttgagtatggaattggaacagatttaa

SEQ ID NO: 13138 - protein, 161 aa, Neisseria meningitidis Z2491
MIQIGIIMGSNSDWPVMRQAAQFLEEFGVEYEARVVSAHRTPDLMFQYAETARARGIKAIIAGAGGAAHLPGMVAAKTTVPVLGVPVPSKYLRGEDSLLSIVQMPKGVPVATFAIGEAGAANAALFAVSMLANETPELAQKLADFRAKQEQAVLSMELEQI

SEQ ID NO: 13139 - DNA, 534 bp, Deinococcus radiodurans R1
  CDS (1)..(534): transl_table=11
atgagtgatctttctgctgactcggcgtccccccgcgtcggcgtggtgatgggcagccgcagcgactccgagacgatgcagggcgccttggacctcctgtcgcagcttgagattccctacgaggtgcgcgtgctctcggcccaccgtacgccggggctactgtcgacctacgcggcccgcgccgagcggctgggactcgcctgcatcattgccggggcggggggggccgcgcacctgccagggatgctggcggcctttacgcgggtgccggtgctcggcgtgccggtgcagtcgcgggccctcagcggtcaggacagcttgctgagcatcgtgcagatgcctgccggtgtccccgtcgccaccttcgccatcggacaggcgggggccaaaaacgctgcgctctttgccgccgccctgctcgccaccactgatgcgggggtgcggacccggctggaggccttccgcgctgctcaaactcaagccgtgctggatgacccctatttcgacggtcatccccaggcgggcaccgaatga

SEQ ID NO: 13140 - protein, 177 aa, Deinococcus radiodurans R1
MSDLSADSASPRVGVVMGSRSDSETMQGALDLLSQLEIPYEVRVLSAHRTPGLLSTYAARAERLGLACIIAGAGGAAHLPGMLAAFTRVPVLGVPVQSRALSGQDSLLSIVQMPAGVPVATFAIGQAGAKNAALFAAALLATTDAGVRTRLEAFRAAQTQAVLDDPYFDGHPQAGTE

SEQ ID NO: 13141 - DNA, 504 bp, Xylella fastidiosa 9a5c
  CDS (1)..(504): transl_table=11
atgatctccaatcaatcccccctgctggtcggtattgtcatgggttcctcttcggattggggagcgatgcagcacgccgcacaaaagcttgatgctctcggcgttgcgtatgaagtgaaggtcgtttcggcgcatcgtactccggataaattgtttgcttatgcggagcaggctgaagggcgtggtttgcgtgccatcattgctggggccggtggcgcagcgcaccttccaggtatgttggctgctaagacgatggtgccagtgttgggggtaccaatgcagtccaaggctctgaatggtttggattcgctgttatcgatcgtacagatgccggcgggtattccagtagccacgttcgcgattggggaagctggtgcagtcaatgccgccctgtttgccgcagcgctgttggtacccgaaaatccagcaatgcgtcggatgctgactgagttccgccaacgtcagacggatgaggtgaatgctgcggacgatccacgccaatga

SEQ ID NO: 13142 - protein, 167 aa, Xylella fastidiosa 9a5c
MISNQSPLLVGIVMGSSSDWGAMQHAAQKLDALGVAYEVKVVSAHRTPDKLFAYAEQAEGRGLRAIIAGAGGAAHLPGMLAAKTMVPVLGVPMQSKALNGLDSLLSIVQMPAGIPVATFAIGEAGAVNAALFAAALLVPENPAMRRMLTEFRQRQTDEVNAADDPRQ

SEQ ID NO: 13143 - DNA, 489 bp, Streptococcus pneumoniae TIGR4
  CDS (1)..(489): transl_table=11
atgaaaccagtaatttccatcatcatgggctcaaaatccgactgggcaaccatgcaaaaaacagcagaagtcctagaccgcttcggtgtagcctacgaaaagaaagttgtttccgcacaccgtacaccagacctcatgttcaaacatgcagaagaagcccgtagtcgtggcatcaagatcatcatcgcaggtgctggtggcgcagcgcatttgccaggcatggtagctgccaaaacaacccttccagtcattggtgtgccagtcaagtctcgtgctcttagtggagtggattcactctattctatcgttcagatgccgggtggggtgcctgttgcgaccatggctatcggtgaagctggagcgactaacgcagctctctttgccctccgtctcctctctgtagaagataagtccattgcggatgcacttgccaactttgctgaagaacaaggaaaaatcgcagaggagtcgtcaaatgagctcatctaa

SEQ ID NO: 13144 - protein, 162 aa, Streptococcus pneumoniae TIGR4
MKPVISIIMGSKSDWATMQKTAEVLDRFGVAYEKKVVSAHRTPDLMFKHAEEARSRGIKIIIAGAGGAAHLPGMVAAKTTLPVIGVPVKSRALSGVDSLYSIVQMPGGVPVATMAIGEAGATNAALFALRLLSVEDKSIADALANFAEEQGKIAEESSNELI

SEQ ID NO: 13145 - DNA, 480 bp, Clostridium acetobutylicum ATCC 824
  CDS (1)..(480): transl_table=11
atgaaagttgctattatatttggaagcaaatcagacactgaaaaaatgaagggtgcagctactgcgcttaaagaatttggagttgaatacaaagcttatgtattatcggctcacagagtaccagaaaaattaagtgaagttattaagagccttgaaaatgatggatttgaatgcataattgcaggtgctggtctagcagctcaccttccaggagttatagcttctcaaactacacttccagttataggagttcctataaatgcggcaattgacggacttgattctttgttttcaatagttcaaatgcccaaaaacataccggttgcaaccgtaggtatcaacaatagttataatgcaggaatgcttgcagcccaaatactttcgattaaatatcctgaaattaaagaaaagcttgttaaattcagacaagaaatgaaagagaattttataaaggataatgaagaaggagtgcaattataa

SEQ ID NO: 13146 - protein, 159 aa, Clostridium acetobutylicum ATCC 824
MKVAIIFGSKSDTEKMKGAATALKEFGVEYKAYVLSAHRVPEKLSEVIKSLENDGFECIIAGAGLAAHLPGVIASQTTLPVIGVPINAAIDGLDSLFSIVQMPKNIPVATVGINNSYNAGMLAAQILSIKYPEIKEKLVKFRQEMKENFIKDNEEGVQL

SEQ ID NO: 13147 - DNA, 501 bp, Agrobacterium tumefaciens str. C58
  CDS (1)..(501): transl_table=11
gtgacagcagaaacgccccccgtcgccatcatcatgggcagccagtccgactgggaaaccatgaagaacgccgccgatacgctggatgcgctcgacgtggaatatgaagcccgcatcatttccgcccaccgcaccccggaccggctttatgactttgccaatggcgcaaaggacgagggtttcaaggtcattatcgccggtgcgggcggggccgcccacctgcccggcatgacggccgccatgacgccgcttccggtcttcggggttcctgtgcagtcgaagaccatgtccggtcaggacagcctctattccatcgtgcagatgcccgccggcattcccgtcggcacgcttgccatcggcaaggccggtgccatcaatgccgcccttctggccgctgcggtcctggcgctcagcgacgaggacctggccgaccggctggatgcctggcgtgcccgccagtcggctgccgtcgcggaatatccgatggacagcgcccagtga

SEQ ID NO: 13148 - protein, 166 aa, Agrobacterium tumefaciens str. C58
MTAETPPVAIIMGSQSDWETMKNAADTLDALDVEYEARIISAHRTPDRLYDFANGAKDEGFKVIIAGAGGAAHLPGMTAAMTPLPVFGVPVQSKTMSGQDSLYSIVQMPAGIPVGTLAIGKAGAINAALLAAAVLALSDEDLADRLDAWRARQSAAVAEYPMDSAQ

SEQ ID NO: 13149 - DNA, 522 bp, Streptococcus pneumoniae R6
  CDS (1)..(522): transl_table=11
gtgattgttgaaaaagaggaaaaaggagaagaaatgaaaccagtaatttccatcatcatgggctcaaaatccgactgggcaaccatgcaaaaaacagcagaagtcctagaccgcttcggtgtagcctacgaaaagaaagttgtttccgcacaccgtacaccagacctcatgttcaaacatgcagaagaagcccgtagtcgtggcatcaagatcatcatcgcaggtgctggtggcgcagcgcatttgccaggcatggtagctgccaaaacaacccttccagtcattggtgtgccagtcaagtctcgtgctcttagtggagtggattcactctattctatcgttcagatgccgggtggggtgcctgttgcgaccatggctatcggtgaagctggagcgactaacgcagctctctttgccctccgtctcctctctgtagaagataagtccattgcggatgcacttgccaactttgctgaagaacaaggaaaaatcgcagaggagtcgtcaaatgagctcatctaa

SEQ ID NO: 13150 - protein, 173 aa, Streptococcus pneumoniae R6
MIVEKEEKGEEMKPVISIIMGSKSDWATMQKTAEVLDRFGVAYEKKVVSAHRTPDLMFKHAEEARSRGIKIIIAGAGGAAHLPGMVAAKTTLPVIGVPVKSRALSGVDSLYSIVQMPGGVPVATMAIGEAGATNAALFALRLLSVEDKSIADALANFAEEQGKIAEESSNELI

SEQ ID NO: 13151 - DNA, 474 bp, Sulfolobus tokodaii str. 7
  CDS (1)..(474): transl_table=11
atgcctaaagtagctgttattatgggtagtaaatcagactgggaatatatgaaagaagcagtagaacttttaaaacaatttggtgttgaagttgaggctagagtagtttcagcccacagaacaccagaatttatgatggaatttgctaaaaccgcatcagagaagggaatagaagttattatagctggtgcaggtggtgcggctcatttacctggtatgacagcatcattaactcatttgccagtaattggtgttccgattccttcaaagaatttgaatggcttagattctctcctctctattgttcaaatgccttatggtgtaccagtcgcgacagttgctattggtggggctaaaaatgctgcacttttggcattaagaattttaggactaaaatacccagatatagctgaaaaagttaaaaagtttatggaggatgtgaaaaatgaagtccttaacacaaaactcgattaa

SEQ ID NO: 13152 - protein, 157 aa, Sulfolobus tokodaii str. 7
MPKVAVIMGSKSDWEYMKEAVELLKQFGVEVEARVVSAHRTPEFMMEFAKTASEKGIEVIIAGAGGAAHLPGMTASLTHLPVIGVPIPSKNLNGLDSLLSIVQMPYGVPVATVAIGGAKNAALLALRILGLKYPDIAEKVKKFMEDVKNEVLNTKLD

SEQ ID NO: 13153 - DNA, 501 bp, Sinorhizobium meliloti 1021
  CDS (1)..(501): transl_table=11
gtgaccgatactacgcccccgcccgttgccatcatcatgggaagccagtcggactgggagacgatgaagaacgcggcagacacgctcgaggcgctcgacatcgcctacgaagcccggatcgtttccgcccatcgcacgcccgaccgcctggtccgcttcgccaagggcgcgcgcgacgaggggttccaggtgatcatcgccggcgcaggcggtgctgcgcatcttcccggcatgtgcgcggccatgacgccgcttccggtcttcggcgttccggtccagtcgaaagcgctttccggccaggacagcctgctgtcgatcgtgcagatgccggccggcattccggtcggcacgcttgcgatcggcaaggcgggggccatcaatgcggcacttctggccgccgccgtgctcgcgctcggtgacgaggatcttgccgaccgtctcgacgactggcgcgaacagcagaccgtatcggtcgcggaatatccggtagacgaggcatga

SEQ ID NO: 13154 - protein, 166 aa, Sinorhizobium meliloti 1021
MTDTTPPPVAIIMGSQSDWETMKNAADTLEALDIAYEARIVSAHRTPDRLVRFAKGARDEGFQVIIAGAGGAAHLPGMCAAMTPLPVFGVPVQSKALSGQDSLLSIVQMPAGIPVGTLAIGKAGAINAALLAAAVLALGDEDLADRLDDWREQQTVSVAEYPVDEA

SEQ ID NO: 13155 - DNA, 474 bp, Thermoplasma acidophilum DSM 1728
  CDS (1)..(474): transl_table=11
atgcctagggttgcggttataatgggcagttcaagcgactacgagaccatgaagcccgctgtggatttcctcagatccatgcacatagatgttgtgctcaagattgtctcagcgcacaggacacctgaatatatgtttcagttcgcgtccagcgccagagatcaaggcatagaggttataattgctggggcaggcggtgcagcgcatcttccgggtatggttgcatcgatgacaacgctgcctgttataggcgtccctgttccgagcaggaatttaaatgggctggattcgcttctttccatagtgcagatgccatccggaatacctgttgccacggtcgcgatagggaattcgaaaaatgccgccatactggcatgcaggatactctccataaagtatcctgagatcgagaaagccattaagaagtacatggatgacgagcgagacagggtgcttaacgaaaagcttgaatga

SEQ ID NO: 13156 - protein, 157 aa, Thermoplasma acidophilum DSM 1728
MPRVAVIMGSSSDYETMKPAVDFLRSMHIDVVLKIVSAHRTPEYMFQFASSARDQGIEVIIAGAGGAAHLPGMVASMTTLPVIGVPVPSRNLNGLDSLLSIVQMPSGIPVATVAIGNSKNAAILACRILSIKYPEIEKAIKKYMDDERDRVLNEKLE

SEQ ID NO: 13157 - DNA, 492 bp, Caulobacter crescentus CB15
  CDS (1)..(492): transl_table=11
atgccttcgaccacgcctcccgtcgctatcatcatgggcagccgctcggactggccgaccatgaagggcgccgccgacgcgctggacaatctgggcgtcgcctgggaggccaaggtggtctcggcgcaccggacgccccagcgcctgttcgacttcgcgacgggcgccgagaaggccggttacaaggtgatcatcgccggcgccggcggcgcggcgcacttgccgggcatggccgcctcgatgaccaacctgccggtgctgggcgtgccggtgcagtccaaggccctgtcgggcctcgatagcctgctttcgatcgtgcagatgccggggggcgttcctgtcgccaccctggcgatcggcgaggccggcgccaagaacgccggactgctcgcggcccagatcctggccctttccgatacagcgctggctggacgcctggcggccttccgcgccgcccaaaccgaaagcgtcgccgaaagcgtcgaggactga

SEQ ID NO: 13158 - protein, 163 aa, Caulobacter crescentus CB15
MPSTTPPVAIIMGSRSDWPTMKGAADALDNLGVAWEAKVVSAHRTPQRLFDFATGAEKAGYKVIIAGAGGAAHLPGMAASMTNLPVLGVPVQSKALSGLDSLLSIVQMPGGVPVATLAIGEAGAKNAGLLAAQILALSDTALAGRLAAFRAAQTESVAESVED

SEQ ID NO: 13159 - DNA, 510 bp, Salmonella enterica subsp. enterica serovar Typhi str. CT18
  CDS (1)..(510): transl_table=11
atgtcttcccgcaataatccggcgcgtgtcgccatcgtgatggggtccaaaagcgactgggctaccatgcaattcgccgccgaaatttttgaaattctggatgtcccgcaccatgtagaagtggtttccgcccatcgcacccccgataaactgttcagcttcgccgaaacggcggaagagaacggatatcaagtgattattgccggcgcgggcggcgcggcacacctgccgggaatgattgcggcaaaaacgctggtcccggtactcggcgtgccggtacaaagcgctgcgctcagcggcgtggatagcctctactccatcgtgcagatgccgcgcggcattccggtgggtacgctggcgatcggtaaagccggggcggcgaacgccgcactgctggcagcgcaaattttggctacgcatgatagcgcgctgcatcggcgcatcgccgactggcgcaaagcacaaaccgatgaggttctggaaaatcccgatccgcgggggacgctatga

SEQ ID NO: 13160 - protein, 169 aa, Salmonella enterica subsp. enterica serovar Typhi str. CT18
MSSRNNPARVAIVMGSKSDWATMQFAAEIFEILDVPHHVEVVSAHRTPDKLFSFAETAEENGYQVIIAGAGGAAHLPGMIAAKTLVPVLGVPVQSAALSGVDSLYSIVQMPRGIPVGTLAIGKAGAANAALLAAQILATHDSALHRRIADWRKAQTDEVLENPDPRGTL

SEQ ID NO: 13161 - DNA, 510 bp, Salmonella typhimurium LT2
  CDS (1)..(510): transl_table=11
atgtcttcccgcaataatccggcgcgtgtcgccatcgtgatggggtccaaaagcgactgggctaccatgcaattcgccgccgaaatttttgaaattctggatgtcccgcaccatgtagaagtggtttccgctcatcgcacccccgataaactgttcagcttcgccgaaacggcggaagagaacggatatcaagtgattattgccggcgcgggcggcgcggcgcacctgccgggaatgattgcggcaaaaacgctggtcccggtactcggcgtgccggtacaaagcgctgcgctaagcggcgtggatagcctctactccatcgtgcagatgccgcgcggcattccggtgggtacgctggcgatcggtaaagccggtgccgctaacgccgccctgctcgccgcgcagattctggcgcaacacgacgcggaactgcatcagcgcattgccgactggcgcaaagcgcaaaccgatgaagttctggaaaatcccgatccgcgggggacgctatga

SEQ ID NO: 13162 - protein, 169 aa, Salmonella typhimurium LT2
MSSRNNPARVAIVMGSKSDWATMQFAAEIFEILDVPHHVEVVSAHRTPDKLFSFAETAEENGYQVIIAGAGGAAHLPGMIAAKTLVPVLGVPVQSAALSGVDSLYSIVQMPRGIPVGTLAIGKAGAANAALLAAQILAQHDAELHQRIADWRKAQTDEVLENPDPRGTL

SEQ ID NO: 13163 - DNA, 489 bp, Listeria monocytogenes EGD-e
  CDS (1)..(489): transl_table=11
atgcctgctgtaattggtgtcattatggggagtacctcagattgggatacaatgaaaaaagcatgtgatgtattagatgaattagaaatagcttatgagaaaaaagtggtttctgctcatcgtacaccagatttaatgtttcaatatgcagaacaagcgcgggaacgtggtttgaaaattattattgctggtgctgggggcgcggcgcatttgccaggtatggttgcggcaaagacgactttgcctgttattggtgtgccaattaaatcaaaagcgttgaatggaatggattcattactttctattgtgcagatgcctggaggtgttccggtagcgacagttgctattggagaaagtggtgctgtaaatgctggacttctagccgcacaaattttatccataacagacgatgcaattactaacagattacaaaaaagacgtgctacactagaagaaacagttctagaaagtagtgattatcttggataa

SEQ ID NO: 13164 - protein, 162 aa, Listeria monocytogenes EGD-e
MPAVIGVIMGSTSDWDTMKKACDVLDELEIAYEKKVVSAHRTPDLMFQYAEQARERGLKIIIAGAGGAAHLPGMVAAKTTLPVIGVPIKSKALNGMDSLLSIVQMPGGVPVATVAIGESGAVNAGLLAAQILSITDDAITNRLQKRRATLEETVLESSDYLG

SEQ ID NO: 13165 - DNA, 489 bp, Listeria innocua Clip11262
  CDS (1)..(489): transl_table=11
atgcctgcggaaattggtgtcattatggggagtacctcagattgggatacaatgaaaaaagcatgtgatgtattggatgaacttgaaattgcttatgaaaaaaaagtcgtttctgctcatcgtacaccagatttaatgtttcaatatgcagaacaagcgcgggaacgtggtttgaaaattattattgcgggcgctggaggagcggcgcatttgccaggtatggttgctgctaaaacaactttgcctgttattggtgtgccaattaagtcaaaagcgttaagcggaatggattctctactgtccattgtacaaatgcctggtggtgttcctgttgctactgttgcaatcggtgaaagtggagcagtcaatgcgggtcttttagcggcgcaaattttatctattacaaacgatgcaattactaacagattacaaaaaagacgtgctacactagaagaaacagttctagaaagtagtgattctcttggataa

SEQ ID NO: 13166 - protein, 162 aa, Listeria innocua Clip11262
MPAEIGVIMGSTSDWDTMKKACDVLDELEIAYEKKVVSAHRTPDLMFQYAEQARERGLKIIIAGAGGAAHLPGMVAAKTTLPVIGVPIKSKALSGMDSLLSIVQMPGGVPVATVAIGESGAVNAGLLAAQILSITNDAITNRLQKRRATLEETVLESSDSLG

SEQ ID NO: 13167 - DNA, 528 bp, Nostoc sp. PCC 7120
  CDS (1)..(528): transl_table=11
atggctcccttggttggcattattatgggcagcgattcagatttgcccacaatgaaagaggcgatcgctatttgtgaggaatttggtgtagaaaatgaagtggcgatcgtttcagcccatcgcaccccagaacggatggtggaatatgcccaaacagcccatcatcggggtattaaggtgattattgctggtgctggtggtgccgcccatcttcccggcatggtagcatctttaactcctctaccagtgattggtgtgccagtcgctacacgaaacttacaaggtgtggattctttatattcaattgtacaaatgcctgggggtattcctgtggctacggtggcgatcggtaacgccaaaaatgctggactattagctgtgcaaatcctcgctactcaacagccagaattattaactaaagtccaagcataccgtcaaaacctatctgaatcagtaataacaaagcaagcaaagttagaacaactaggttacaagcagtatttggaacaggaaatatctggaaaatag

SEQ ID NO: 13168 - protein, 175 aa, Nostoc sp. PCC 7120
MAPLVGIIMGSDSDLPTMKEAIAICEEFGVENEVAIVSAHRTPERMVEYAQTAHHRGIKVIIAGAGGAAHLPGMVASLTPLPVIGVPVATRNLQGVDSLYSIVQMPGGIPVATVAIGNAKNAGLLAVQILATQQPELLTKVQAYRQNLSESVITKQAKLEQLGYKQYLEQEISGK

SEQ ID NO: 13169 - DNA, 510 bp, Ralstonia solanacearum GMI1000
  CDS (1)..(510): transl_table=11
atgaccgcatcgcaatccgcgccgctcgtcggcgtcgtcatgggttccagctccgactgggacgtcatgcagcacgccgtggtcctgctcaaggaattcgacattccgttcgaggcgcaggtggtctcggcgcaccgcatgccggacgacatgttccgctacgccgaggccgcacgcggccggggcctgcgcgccatcatcgccggtgccggcggcgcggcgcacctgccgggcatgatcgccgccaagaccatcgtgccggtgttcggcgtgccggtgccgtccaagtacctgcgcggcgaagactcgctgctgtccatcgtgcagatgcccaagggcattccggtggcgacctttgccatcggcgaggcgggcgcggccaacgcggcgctgtcggccatcgccatgctggcgaccaccgacgatgcgctggcggccaagctcgaagccttccgcgcccggcagaccgaagtggcgcgcggcatgacgctgcccgtgcacagtgcttaa

SEQ ID NO: 13170 - protein, 169 aa, Ralstonia solanacearum GMI1000
MTASQSAPLVGVVMGSSSDWDVMQHAVVLLKEFDIPFEAQVVSAHRMPDDMFRYAEAARGRGLRAIIAGAGGAAHLPGMIAAKTIVPVFGVPVPSKYLRGEDSLLSIVQMPKGIPVATFAIGEAGAANAALSAIAMLATTDDALAAKLEAFRARQTEVARGMTLPVHSA

SEQ ID NO: 13171 - DNA, 543 bp, Brucella melitensis 16M
  CDS (1)..(543): transl_table=11
ttgtcttttcaagaccttcctcatgccaaccgaaaagccaagcaggaaagaccgatgagcgttgatgtcgccattatcatgggaagccagtccgattgggaaaccatgcaccatgcagccgacacattggaggcgctcggcatctccttcgacgcacggatcgtttccgcccatcgcacccctgacaggctggtcgccttcgccaagggggcgaaagcggaaggcttcaaggtcatcatcgcaggcgccggcggcgcggcccacctgcccggcatggccgctgccatgacaccgcttcccgtctttggcgttccagttcaatccaaggcgctttcgggccaggattcgctactctccatcgtacagatgccagcgggtattcccgtcggcactctcgccatcggccgtgcaggcgcggtcaatgccgcccttctcgccgccgccgttctggcgctatatgatgaagcacttgccgcccgtcttgatgaatggcgcaaggcgcagaccgaaagcgttgcagaacgcccctcgaacgaagcctga

SEQ ID NO: 13172 - protein, 180 aa, Brucella melitensis 16M
MSFQDLPHANRKAKQERPMSVDVAIIMGSQSDWETMHHAADTLEALGISFDARIVSAHRTPDRLVAFAKGAKAEGFKVIIAGAGGAAHLPGMAAAMTPLPVFGVPVQSKALSGQDSLLSIVQMPAGIPVGTLAIGRAGAVNAALLAAAVLALYDEALAARLDEWRKAQTESVAERPSNEA

SEQ ID NO: 13173 - DNA, 489 bp, Pyrobaculum aerophilum str. IM2
  CDS (1)..(489): transl_table=11
atgaaggttgcggttataatggggtcgataaacgaccttgaggtcatgaaagaggcgcttgaggtcttggagcagctgggcattccctacgaggcgcgggtcgtcagcgcccacaggacgccggatttcatgtaccaattcgccaaggaggccgaggggaaattcgacgtgataatagccggcgccggcggggcggcccacctccccggcatgaccgcctccctaacgccgctgccggtcataggggtccccatccccacaaaacacttaggcgggctggactccctgttgtcaattgtacaaatgccccggggcactcccgtcgccacagtggccataggcaacgccgccaacgccgcctatctcgccgccaggatactgggcataaaatacccagaggtgaggcagaaggttaaagaacacatggaaaagatgagagaagaggtactgtccaagtccttcataaagtccttttcactagacgtttaa

SEQ ID NO: 13174 - protein, 162 aa, Pyrobaculum aerophilum str. IM2
MKVAVIMGSINDLEVMKEALEVLEQLGIPYEARVVSAHRTPDFMYQFAKEAEGKFDVIIAGAGGAAHLPGMTASLTPLPVIGVPIPTKHLGGLDSLLSIVQMPRGTPVATVAIGNAANAAYLAARILGIKYPEVRQKVKEHMEKMREEVLSKSFIKSFSLDV

SEQ ID NO: 13175 - DNA, 480 bp, Clostridium perfringens str. 13
  CDS (1)..(480): transl_table=11
atgaaggtagcaatattttttggaagtaaatcagatatagatgttatgaagggagcaggaaatgctcttaaagagtttggaattccttataatgcttatattttatcagctcatagggttccagaaaaacttattgaaactttagaaaaaattgagaaagaaggctgtgaagtaataatagctggagcaggattagctgctcatcttcctggagttatagcttctcatactatacttcctgtaataggagttccagtgagagcagcagtagagggaatggatgcattactatcaatagttcagatgccaaaatcaattcctgtagccactgttggaataaataatagttataatgcaggaatgttagcagtccaaatgctttcattaaaatatccagaactaagagaaaaattaattcaatttagaatcgacatgaaacataaattcatagcagaaaatggagaaggagtggaattataa

SEQ ID NO: 13176 - protein, 159 aa, Clostridium perfringens str. 13
MKVAIFFGSKSDIDVMKGAGNALKEFGIPYNAYILSAHRVPEKLIETLEKIEKEGCEVIIAGAGLAAHLPGVIASHTILPVIGVPVRAAVEGMDALLSIVQMPKSIPVATVGINNSYNAGMLAVQMLSLKYPELREKLIQFRIDMKHKFIAENGEGVEL

SEQ ID NO: 13177 - DNA, 513 bp, Pyrococcus furiosus DSM 3638
  CDS (1)..(513): transl_table=11
atgcctaaagttggaatcataatgggtagtgattcagatttgcccgtaatgaaggaagcagctaaagttctggaagagtttggagtagattatgaaataacaatagtctcggcacacagaacaccagagagaatgtacgagtatgcaaaaactgccagagagaggggaattgaagttattattgcaggtgctggaggtgcagcccatcttcctggaatgacggcctcgataacaactcttcctgtaataggagttccagttaaaagtagggccttgaatggactagattctctgctttccatagttcaaatgccagcaggtgttcctgttgctactgtagccataaacaatgctaagaatgctgctttacttgctctcagaattctttctataaagtatccagagattgccgaaaaactagaaaagtacaaagaagagatgagaaaaacagttgaggaaaaagctaaaaagctcgaagaggttggttggaaagaatatctgggagaggaatga

SEQ ID NO: 13178 - protein, 170 aa, Pyrococcus furiosus DSM 3638
MPKVGIIMGSDSDLPVMKEAAKVLEEFGVDYEITIVSAHRTPERMYEYAKTARERGIEVIIAGAGGAAHLPGMTASITTLPVIGVPVKSRALNGLDSLLSIVQMPAGVPVATVAINNAKNAALLALRILSIKYPEIAEKLEKYKEEMRKTVEEKAKKLEEVGWKEYLGEE

SEQ ID NO: 13179 - DNA, 498 bp, Corynebacterium glutamicum ATCC 13032
  CDS (1)..(498): transl_table=11
gtgggtcctctagttggtttgatcatgggttcggattcggattgggacactgtagcgccagctgcagaggtactcgctgagtttggcattccttttgaagtcggagttgtctctgcacaccgcaccccagagaagatgctcaactacgcaaagactgcacatgagcgcggcatcaagacgatcatcgcgtgtgctggcggcgctgcacacctgccaggcatggtggctgcagcaactccacttccagtcatcggtgttccacgcgcattgaaggatctcgacggtttggattccttgctgtccatcgtccagatgccaggcggcgttccagtcgccactgtctccatcggtggcgcgaagaatgcaggcctacttgccgttcgtattctcggtgctggtgatccttctttggtcacgaagatggccgattaccaagagaatatggcgaaggaagttgaagccaaggacgaagcactgaagaagcgcttgctcggctaa

SEQ ID NO: 13180 - protein, 165 aa, Corynebacterium glutamicum ATCC 13032
MGPLVGLIMGSDSDWDTVAPAAEVLAEFGIPFEVGVVSAHRTPEKMLNYAKTAHERGIKTIIACAGGAAHLPGMVAAATPLPVIGVPRALKDLDGLDSLLSIVQMPGGVPVATVSIGGAKNAGLLAVRILGAGDPSLVTKMADYQENMAKEVEAKDEALKKRLLG

SEQ ID NO: 13181 - DNA, 474 bp, Fusobacterium nucleatum subsp. nucleatum ATCC 25586
  CDS (1)..(474): transl_table=11
atgaaagtaggaattatatttggtagtaaatcagatgttgatgtaatgaagggagcagcagactgtttaaaaaagtttgggatagagtattctgcacatgttttatctgcacatagagttccagaacttttagaagaaactttggaaaaatttgaaaaagaagactatggagttatcattgctggagcaggacttgcagcacatttaccaggagttattgcttcaaaaactgttttacctgtgattggagtacctataaaagcagcagtagaaggtttagatgcactattttcaatagtacaaatgcctaaatcaattcctgttgcaactgtggcaattaataattcatataatgcaggaatgttagcagtagaaatattagcagttggaaataaagaattaagagcaaaacttttagagtttagaaaagaaatgaaagaagatttcaaaaaaaatatatatatggaattgtaa

SEQ ID NO: 13182 - protein, 157 aa, Fusobacterium nucleatum subsp. nucleatum ATCC 25586
MKVGIIFGSKSDVDVMKGAADCLKKFGIEYSAHVLSAHRVPELLEETLEKFEKEDYGVIIAGAGLAAHLPGVIASKTVLPVIGVPIKAAVEGLDALFSIVQMPKSIPVATVAINNSYNAGMLAVEILAVGNKELRAKLLEFRKEMKEDFKKNIYMEL

SEQ ID NO: 13183 - DNA, 612 bp, Streptococcus pyogenes MGAS8232
  CDS (1)..(612): transl_table=11
atgctaaagcacctagtcgccctgacgtgggttcatcttcgaaatcaaagatttcggacttaccgcatatttttctacggaaagtttcgacaagtcgaaacgcccctttatatcttaattatgaaaactccaattatttctattatcatgggctccaaatctgactgggcaaccatgcaaaaaacggctgaagttctagacaactttggcattgcttacgagaagaaagtcgtctctgctcaccgcacgcccgacctcatgttcaagcatgctgaggaagcacgtggtcgtggcatcaaaatcatcatcgcaggagcaggtggagcagctcacttgcctggtatggtagcagctaaaacaacgctgcctgttatcggtgtgcctgtcaaatcacgtgcccttttaggtttggattcactctattcgattgtgcagatgcctggcggtgtgcctgtggcaaccatggctatcggagaagcgggagcgactaacgctgccctgacggccctccgtattctctccatcgaggatcaaaatctggctgatgcgctagctcatttccatgaggaacaaggaaaaatcgcagaggagtcaagtggtgaactcatttaa

SEQ ID NO: 13184 - protein, 203 aa, Streptococcus pyogenes MGAS8232
MLKHLVALTWVHLRNQRFRTYRIFFYGKFRQVETPLYILIMKTPIISIIMGSKSDWATMQKTAEVLDNFGIAYEKKVVSAHRTPDLMFKHAEEARGRGIKIIIAGAGGAAHLPGMVAAKTTLPVIGVPVKSRALLGLDSLYSIVQMPGGVPVATMAIGEAGATNAALTALRILSIEDQNLADALAHFHEEQGKIAEESSGELI

SEQ ID NO: 13185 - DNA, 468 bp, Thermoanaerobacter tengcongensis MB4
  CDS (1)..(468): transl_table=11
ttgaaaatgccaaaaattgctgtggtagtgggtagcaagtcagacctccctgtaattgaaaggtgtacagatattttagatgaatttggaatttcatatgacgtaaaagttctgtctgcccatcgaactccttttgagacgcaggaatttgcagtagaagcagagaaatattacgaccttataatagcggcggcaggaaaagctgctcatctcccaggggtcattgcttcttacactttacttcctgtcattgggcttcccatcaagtcttccactctagatggactggattctctcctttcaattgtgcagatgccaaaaggagttccagtagctacggttgctatagatggagctgagaatgctgctcttttagcctgtcatattctctctttgaagtatccccatctaaaagaaaagcttgctaattacagggagaaaatggcggaggaagtgttaaataattaa

SEQ ID NO: 13186 - protein, 155 aa, Thermoanaerobacter tengcongensis MB4
MKMPKIAVVVGSKSDLPVIERCTDILDEFGISYDVKVLSAHRTPFETQEFAVEAEKYYDLIIAAAGKAAHLPGVIASYTLLPVIGLPIKSSTLDGLDSLLSIVQMPKGVPVATVAIDGAENAALLACHILSLKYPHLKEKLANYREKMAEEVLNN

SEQ ID NO: 13187 - DNA, 543 bp, Streptomyces coelicolor A3(2)
  CDS (1)..(543): transl_table=11
atgagccaggccagcccggtgaccccggtcgtgggcatcgtcatggggtcggactccgactggcccgtcatggaggccgccgccaaggccctcgacgagttcgaggtcccctacgaggtcgacgtcgtctccgcgcaccgcatgccgcacgagatgatcgcgtacggcgagcaggccgccggacgcggcctcaaggcgatcatcgcgggggccgggggcgccgcccacctgcccggcatgctcgcctcggtcacgccgctgccggtcatcggcgtcccggtgccgctgaagtacctggacggcatggacagcctgctgtccatcgtgcagatgccggccggcgtcccggtggccacggtctccgtcggcggcgcccgcaacgccggtctgctggccgcccgcatcctcgccgcccacgacgaggaactgctcggccggatgcgcgagttccagcaggacctcaacgaccaggccaccgagaagggcaagcggctgcgcaccaaggtcgagggctcagcggccggcttcggattcggaaagtga

SEQ ID NO: 13188 - protein, 180 aa, Streptomyces coelicolor A3(2)
MSQASPVTPVVGIVMGSDSDWPVMEAAAKALDEFEVPYEVDVVSAHRMPHEMIAYGEQAAGRGLKAIIAGAGGAAHLPGMLASVTPLPVIGVPVPLKYLDGMDSLLSIVQMPAGVPVATVSVGGARNAGLLAARILAAHDEELLGRMREFQQDLNDQATEKGKRLRTKVEGSAAGFGFGK

SEQ ID NO: 13189 - DNA, 504 bp, Xanthomonas campestris pv. campestris str. ATCC 33913
  CDS (1)..(504): transl_table=11
atgacctccaaccactccgcgccgctggtcggcatcgtgatgggttcccgttcggactgggacaccatgcaacacgcagctcagaagctcgatgcactgggcgtgccgtacgaggtcaaggtggtctcggcccaccgcacaccggatgtgttgttcacctacgccgaacaggcaggcgagcgcggcctgcgcgcgatcatcgccggcgctggcggtgccgcgcatctgcccggcatgctggcggccaagaccgcagtgcccgtgctgggcgtgccggtgcagtccaaggcgctcaacggcatggattcgctgctgtcgatcgtgcagatgccagccggtattccggtggccaccttcgcgatcggcaatgcgggcgctgccaatgcggccctgtttgcagcagcgatgctgtcgccggagcagccgcagatcggtcaggcattggcgcagttccgcgccaagcagaccgacgatgtgatggccagcgacgatccccgccaatga

SEQ ID NO: 13190 - protein, 167 aa, Xanthomonas campestris pv. campestris str. ATCC 33913
MTSNHSAPLVGIVMGSRSDWDTMQHAAQKLDALGVPYEVKVVSAHRTPDVLFTYAEQAGERGLRAIIAGAGGAAHLPGMLAAKTAVPVLGVPVQSKALNGMDSLLSIVQMPAGIPVATFAIGNAGAANAALFAAAMLSPEQPQIGQALAQFRAKQTDDVMASDDPRQ

SEQ ID NO: 13191 - DNA, 504 bp, Xanthomonas axonopodis pv. citri str. 306
  CDS (1)..(504): transl_table=11
atgacctccaaccactccgcgccgctggtcggcatcgtgatgggttcccgttcggattgggagaccatgcaacacgcagctcagaagctcgacgcgctgggcgtgccgtacgaagtcaaggtggtctcggcgcaccgcaccccggacgtcttgttcgcctacgccgaacaggcgggcgcccgtggactgcgcgcgatcatcgccggcgccggcggcgcggcgcatctgccgggcatgctggctgccaagactgcagtgccggtgcttggtgtgccggtgcagtccaaggcgcttaacggcatggattcgctgctgtcgatcgtgcagatgccggccggcattccggtggccaccttcgccatcggcaatgcgggtgcggccaatgcggcgttgtttgcggcggccatgctggcgccggagcagacgcagatcggtcaggcgctggcgcagttccgcgccaagcagaccgacgatgtcatggccagcgacgacccgcgccaatga

SEQ ID NO: 13192 - protein, 167 aa, Xanthomonas axonopodis pv. citri str. 306
MTSNHSAPLVGIVMGSRSDWETMQHAAQKLDALGVPYEVKVVSAHRTPDVLFAYAEQAGARGLRAIIAGAGGAAHLPGMLAAKTAVPVLGVPVQSKALNGMDSLLSIVQMPAGIPVATFAIGNAGAANAALFAAAMLAPEQTQIGQALAQFRAKQTDDVMASDDPRQ

SEQ ID NO: 13193 - DNA, 528 bp, Chlorobium tepidum TLS
  CDS (1)..(528): transl_table=11
atgacacaagtttcctttgacgcacaggcgccgctggtcggcatcctgatgggttccgattccgatttcgacatcatgaaagaggccgccacggtgctcaacgagttcggcattccgtttgaaatatcggtcatctcggcgcaccgaacgccgggcgatctcgaagcctacgcctcctcggcagaggagcgcggcctgaaagcgatcatcgccggagctggcggtgcggcacatctgccgggcgtcacggcggccatgactcccctgccggtcatcggcgtgccgatctacagcaaaaagctcagcggccaggattcgctctacgccatcgtgcagatgcccgccggaattcccgtagccaccgtcggcatcgacaacgcccgcaacgccgcgctgctcgccgtgcagatgctcgccctgtgcgacgccagtctgatgcagaagctcagggagttccgacagaagcttgccgaagcctcgcgccagaagaccgccaaaatccgggaaaaactgcgtgcgaacggctga

SEQ ID NO: 13194 - protein, 175 aa, Chlorobium tepidum TLS
MTQVSFDAQAPLVGILMGSDSDFDIMKEAATVLNEFGIPFEISVISAHRTPGDLEAYASSAEERGLKAIIAGAGGAAHLPGVTAAMTPLPVIGVPIYSKKLSGQDSLYAIVQMPAGIPVATVGIDNARNAALLAVQMLALCDASLMQKLREFRQKLAEASRQKTAKIREKLRANG

SEQ ID NO: 13195 - DNA, 492 bp, Thermosynechococcus elongatus BP-1
  CDS (1)..(492): transl_table=11
atgggcagtgattccgatttgcccaccatgcagggggcgatcgccatctgtgaacgctttcgcattccccatgaagtcgctatcctctcagctcaccgcactcccctggcaatggcagaatttgctcagcatgcccatcagcggggcctaaaagtcattattgccggtgccggcggtgctgctcacttgccgggcatgatagcttccctgacccccctacccgtgattggcgtccccgtgccgagccgccatttgcagggggtggactccctctactcaattgtgcagatgccggctgggattcctgtcgcaacggttgccattggcaatgcccaaaatgcaggtctattggccgtccaactgttggccagtcatgatccaaccttgctggagcaagtgattgcctatcgtcaagaattagcagccaccgtgagcgccaagaatcaaaaactgcaaacactgggggctagcgcttatctgcaacagcagtaa

SEQ ID NO: 13196 - protein, 163 aa, Thermosynechococcus elongatus BP-1
MGSDSDLPTMQGAIAICERFRIPHEVAILSAHRTPLAMAEFAQHAHQRGLKVIIAGAGGAAHLPGMIASLTPLPVIGVPVPSRHLQGVDSLYSIVQMPAGIPVATVAIGNAQNAGLLAVQLLASHDPTLLEQVIAYRQELAATVSAKNQKLQTLGASAYLQQQ

SEQ ID NO: 13197 - DNA, 489 bp, Streptococcus agalactiae 2603V/R
  CDS (1)..(489): transl_table=11
atgcaaccaattatttctattatcatgggttccaaatccgactggacaaccatgcaaaaaacggctgaagttctagataactttggcattgcttacgagaagaaagtcgtctctgcccaccgtacgccagacctcatgttcaagcatgctgaggaggcgcgtggtcgtggtatcaagattatcatcgctggagcaggtggagcagcccacttgccgggtatggtagcagctaaaacaaccctgcctgttatcggtgtgcctgtcaaatcacgtgccctctcaggtttggattcgctctactctattgtgcagatgcctggtggtgtgcctgtggcgaccatggctatcggagaagcaggagcgactaacgctgccctgacagccctccgtatcctctctatcgaggatcaaaatctggctgatgcgctagctcatttccatgaggaacaaggaaaaatcgcagaggagtcaagcaatgaactcatttaa

SEQ ID NO: 13198 - protein, 162 aa, Streptococcus agalactiae 2603V/R
MQPIISIIMGSKSDWTTMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSNELI

SEQ ID NO: 13199 - DNA, 492 bp, Oceanobacillus iheyensis HTE831
  CDS (1)..(492): transl_table=11
atggctcaagtaggggttattatgggaagtatttccgactgggaaacgatgcagtatacttgtaatgtgcttgatgaattacagatctcttatgagaaagaagtgatatccgcacatcgtactccggatgacatgtttgcttactcgaaacaagctcgtagtaaagggctaaaggttattattgctggggcagggggagcagcacacttaccaggaatggtagcttcacaaacaacgttacccgttataggtgtaccagttgaaagtaaatcattacaaggcttagattccctgttatctattgtgcaaatgcctggtggagtaccaaccgctacagttgcaattgggaaagccggagccaaaaatgctggtattcttgcggcacagattattagcacttttgatgaaggtgcagagaaatctctagagaaatatcgggaagaaatgcgagaatctgtaaaagaaatgagggaaaatcttgcagactactaa

SEQ ID NO: 13200 - protein, 163 aa, Oceanobacillus iheyensis HTE831
MAQVGVIMGSISDWETMQYTCNVLDELQISYEKEVISAHRTPDDMFAYSKQARSKGLKVIIAGAGGAAHLPGMVASQTTLPVIGVPVESKSLQGLDSLLSIVQMPGGVPTATVAIGKAGAKNAGILAAQIISTFDEGAEKSLEKYREEMRESVKEMRENLADY

SEQ ID NO: 13201 - DNA, 507 bp, Bifidobacterium longum NCC2705
  CDS (1)..(507): transl_table=11
atgataatggcaaatgaatccaagcccgaagtcgcggtggtcatgggatcctccagcgactgggagaccatgaagcgtgcctgcgatattctcgaccagttcggtgtcgtctaccacaagcaggtcatttccgcgcaccgcacgcccgagctcatggccgagttcgcgcacaatgcccgcgccaatggcctgaaggccattatcgccggtgccggcggtgccgcccacctgccgggcatgatcgccgcgcagaccacgctgcccgtaatcggcgtgcccgtgcgctcccacgccctgtccggctgggattcgctgctgtccatcgtgcagatgcctggcggcatcccggtggccaccaccgccgtcggcaactccggtgccaccaacgccggcctgctcgccgtgcagatgctctccgccttcgagccggaactggccgacaagcttgaggattaccgtaacgaactgaaggaaaaggtggccgaatccaatgcccagcttgtctga

SEQ ID NO: 13202 - protein, 168 aa, Bifidobacterium longum NCC2705
MIMANESKPEVAVVMGSSSDWETMKRACDILDQFGVVYHKQVISAHRTPELMAEFAHNARANGLKAIIAGAGGAAHLPGMIAAQTTLPVIGVPVRSHALSGWDSLLSIVQMPGGIPVATTAVGNSGATNAGLLAVQMLSAFEPELADKLEDYRNELKEKVAESNAQLV

SEQ ID NO: 13203 - DNA, 510 bp, Shigella flexneri 2a str. 301
  CDS (1)..(510): transl_table=11
atgtcttcccgcaataatccggcgcgtgtcgccatcgtgatggggtccaaaagcgactgggctaccatgcagttcgccgtcgaaatcttcgaaatcctgaatgtcccgcaccacgttgaagtggtttctgctcaccgcacccccgataaactgttcagcttcgccgaaagcgccgaagagaacggttatcaggtgattattgcgggcgcaggcggcgcagcgcacctgccaggcatgattgccgccaaaacgctggtgccggtgctgggcgtgccagtacagagcgccgcactgagcggtgtcgatagcctctactccatcgtacaaatgccgcgcggcattccggtgggtacgctggcgattggtaaagctggcgcggcaaacgcggcattactggcagcacaaattctcgcgactcacgataaagagctacaccagcgtctgaatggctggcgcaaagcccagaccgacgaagtgctggaaaacccggacccgcgaggtgcggcatga

SEQ ID NO: 13204 - protein, 169 aa, Shigella flexneri 2a str. 301
MSSRNNPARVAIVMGSKSDWATMQFAVEIFEILNVPHHVEVVSAHRTPDKLFSFAESAEENGYQVIIAGAGGAAHLPGMIAAKTLVPVLGVPVQSAALSGVDSLYSIVQMPRGIPVGTLAIGKAGAANAALLAAQILATHDKELHQRLNGWRKAQTDEVLENPDPRGAA

SEQ ID NO: 13205 - DNA, 492 bp, Shewanella oneidensis MR-1
  CDS (1)..(492): transl_table=11
atgcaagcccttgttgctgttgttatgggttctaagagtgattggcccacaatggaagccgccgctgagatcatggataaactgcaagtgccttaccatgttgaagttgtatcagcccatagaacgccagataaactgatggagtttgcagccggtgccgctgaccgtggttttaaaattattatcggtggtgcgggcggtgccgcgcacttacccggtatgatcgcctctaaaactcgcttacccgtattaggtgtacccgtgcaaagtaaagcactctcaggcatggatagcttactgtctatcgtgcaaatgcccaaagggatcgctgtaggcaccttagcaattggtactgctggtgcctttaacgccggtttactcgcctgccaaattttagccaataacgatgtagcgcttgctgctcgtttagacgccttcagagaagaacaaactcgtgctgtgctggataatcccgatccgagggaagtctaa

SEQ ID NO: 13206 - protein, 163 aa, Shewanella oneidensis MR-1
MQALVAVVMGSKSDWPTMEAAAEIMDKLQVPYHVEVVSAHRTPDKLMEFAAGAADRGFKIIIGGAGGAAHLPGMIASKTRLPVLGVPVQSKALSGMDSLLSIVQMPKGIAVGTLAIGTAGAFNAGLLACQILANNDVALAARLDAFREEQTRAVLDNPDPREV

SEQ ID NO: 13207 - DNA, 489 bp, Streptococcus mutans UA159
  CDS (1)..(489): transl_table=11
atgaaaccacttatttccattatcatgggctccaaatccgactggagcactatgcaaaaaaccgctcaagttttggataacttcggcgtggcttatgaaaagaaagtcgtctcagcccaccgcacaccagacctcatgttcaaacatgcagaaaaagcccgcagccgcggcatcaaggtcatcattgcaggtgcaggcggtgccgcgcatttaccgggtatggtggcagctaaaacaacactgcctgttatcggtgtacctgttaaatcacgcgccctcagcggcttggattcgctctattccattgtgcagatgccgggtggtgtgcctgtggcaactatggccattggtgaagcgggagcgaccaacgctgccctgacagccctgcgtatcttggccattgaagaccaagacttggcagccgcgttagcagatttcgcagaggaacagggaaaaatcgcagaggagtcaacgaatgaactcaactaa

SEQ ID NO: 13208 - protein, 162 aa, Streptococcus mutans UA159
MKPLISIIMGSKSDWSTMQKTAQVLDNFGVAYEKKVVSAHRTPDLMFKHAEKARSRGIKVIIAGAGGAAHLPGMVAAKTTLPVIGVPVKSRALSGLDSLYSIVQMPGGVPVATMAIGEAGATNAALTALRILAIEDQDLAAALADFAEEQGKIAEESTNELN

SEQ ID NO: 13209 - DNA, 492 bp, Streptococcus agalactiae NEM316
  CDS (1)..(492): transl_table=11
atgaaaactccaattatttctattatcatgggctccaaatccgactggggaaccatgcaaaaaacggctgaagttctagataactttggcattgcttacgagaagaaagtcgtctctgcccaccgtgcgccagacctcatgttcaagcatgctgaggaagcacgtggccgtggtatcaaaatcatcatcgctggagcaggtggggcagctcacttgcctggtatggtggcagctaagacaacactacctgttattggtgtgccggtcaaaacacgtgccctttcaggtttggattcgctctactctattgtgcagatgcctggtggtgtgcctgtggcgaccatggctatcggagaagcgggagcgactaacgctgccttgacagccctccgtatcctctctattgaggaccaaaatctggctgatgcgctagctcatttccatgaggaacaaggaaaaatcgcggaggagtcaagcaatgaacttatttaa

SEQ ID NO: 13210 - protein, 163 aa, Streptococcus agalactiae NEM316
MKTPIISIIMGSKSDWGTMQKTAEVLDNFGIAYEKKVVSAHRAPDLMFKHAEEARGRGIKIIIAGAGGAAHLPGMVAAKTTLPVIGVPVKTRALSGLDSLYSIVQMPGGVPVATMAIGEAGATNAALTALRILSIEDQNLADALAHFHEEQGKIAEESSNELI

SEQ ID NO: 13211 - DNA, 501 bp, Corynebacterium efficiens YS-314
  CDS (1)..(501): transl_table=11
atgacaccactcgtcgggctcatcatgggatctgattcggactgggacaccgtcgccccggccgccgaggccctcgccgaattcggcatccccttcgaggtcggcgtgctctccgcccaccgcaccccggaacgcatgctggcctacgccaagtcagcccacgagcgtggcctcaaggtcatcatcgcctgcgccggcggggccgcccacctgcccggcatggtcgctgccgccaccccgctgcccgtcatcggcatcccgcgggcactgaaggacctcgacggcatggactccctgctgtccatcgtgcagatgcccgccggtgtgcccgtggcgaccgtctccatcggtggtgccaagaacgccggcctgctcgccgtgcggatcctcggtgcgggtgaccccgcactggtgcagaagatggccgactaccaggctgacatggcagcccaggtggaggccaaggacgaggcgctcaaacagcgcctcatgggcgaatag

SEQ ID NO: 13212 - protein, 166 aa, Corynebacterium efficiens YS-314
MTPLVGLIMGSDSDWDTVAPAAEALAEFGIPFEVGVLSAHRTPERMLAYAKSAHERGLKVIIACAGGAAHLPGMVAAATPLPVIGIPRALKDLDGMDSLLSIVQMPAGVPVATVSIGGAKNAGLLAVRILGAGDPALVQKMADYQADMAAQVEAKDEALKQRLMGE

SEQ ID NO: 13213 - DNA, 492 bp, Pseudomonas putida KT2440
  CDS (1)..(492): transl_table=11
atgagtgcactggttggcgtgatcatgggctccaagtccgattggtccacccttagccacaccgccgatatgctggaaaaactcggcattccctacgaagtgaaggtggtttccgcccaccgcaccccggatctgctgttccagtatgccgaggaggctgagggccgtggcatcgaggtgatcatcgccggtgccggtggcgcagcccacctgccaggcatgtgcgccgccaagacccacctgccggtgctgggcgtgccggtgcagtcgtcgatgctgtcgggcgtcgattcgctgctgtcgatcgtgcagatgccagccggtgtgccggttgccaccctggccatcggccgtgccggtgcggtcaacgctgccctgctgtcggccagcattctgggcgccaagtacccgcagtaccacgcggcgttgaagcagttccgcacggaacagaccgacaccgtgctggacaacccagacccgcgccaggcttga

SEQ ID NO: 13214 - protein, 163 aa, Pseudomonas putida KT2440
MSALVGVIMGSKSDWSTLSHTADMLEKLGIPYEVKVVSAHRTPDLLFQYAEEAEGRGIEVIIAGAGGAAHLPGMCAAKTHLPVLGVPVQSSMLSGVDSLLSIVQMPAGVPVATLAIGRAGAVNAALLSASILGAKYPQYHAALKQFRTEQTDTVLDNPDPRQA

SEQ ID NO: 13215 - DNA, 537 bp, Escherichia coli CFT073
  CDS (1)..(537): transl_table=11
ttgtgcaccacaggagttttaagacgcatgtcttcccgcaataatccggcgcgtgtcgccatcgtgatggggtccaaaagcgactgggctaccatgcagttcgccgccgaaatcttcgaaatcctgaatgtcccgcaccacgttgaagtggtttctgctcaccgcacccccgataaactgttcagcttcgccgaaagcgccgaagagaacggttatcaggtgattattgcgggcgcaggcggcgcagcgcacctgcctggcatgattgccgccaaaacgctggtgccggtgctgggcgtgccagtacagagcgccgcactgagcggtgtcgatagcctctactccatcgtacaaatgccgcgcggcattccggtgggtacgctagcgattggtaaagctggcgcggcaaacgcggcgttactggcagcacaaattcttgcgaatcatgataaagaactgcaccagcgtctgaatgactggcgcaaagcacaaactgatgaagtgctggaaaacccggacccgcgaggtgcggcatga

SEQ ID NO: 13216 - protein, 178 aa, Escherichia coli CFT073
MCTTGVLRRMSSRNNPARVAIVMGSKSDWATMQFAAEIFEILNVPHHVEVVSAHRTPDKLFSFAESAEENGYQVIIAGAGGAAHLPGMIAAKTLVPVLGVPVQSAALSGVDSLYSIVQMPRGIPVGTLAIGKAGAANAALLAAQILANHDKELHQRLNDWRKAQTDEVLENPDPRGAA

SEQ ID NO: 13217 - DNA, 483 bp, Staphylococcus epidermidis ATCC 12228
  CDS (1)..(483): transl_table=11
gtgaaagtagcagtcattatgggcagttcctcagattggaaaattatgaaagaaagttgttcgatgcttgaagaatttgaaataccgtacgaaaagaaagtcgtttcagctcatcgtacgcctcaaatgatgttcaatttcgctagtcaagcacgccaaaatggttttgatattatcattgccggtgcagggggagcagcacacttacctggaatggtagcttccatgacaacattacctgtgattggtgtgccaattgaatctaaaagtctaaaaggattagattcattactatctatcgtccaaatgcctggtggtatcccagttgcaaccacagcaattggaaaatcaggtgctaaaaatgctgggatattagcggcaagaatgttaggaataacaaatgaatcagttcaaaataatttggaaaattatgaaaaatctttagtcgcaaaagtggaggaaatgcaaaatgaacttcagtaa

SEQ ID NO: 13218 - protein, 160 aa, Staphylococcus epidermidis ATCC 12228
MKVAVIMGSSSDWKIMKESCSMLEEFEIPYEKKVVSAHRTPQMMFNFASQARQNGFDIIIAGAGGAAHLPGMVASMTTLPVIGVPIESKSLKGLDSLLSIVQMPGGIPVATTAIGKSGAKNAGILAARMLGITNESVQNNLENYEKSLVAKVEEMQNELQ

SEQ ID NO: 13219 - DNA, 489 bp, Bradyrhizobium japonicum USDA 110
  CDS (1)..(489): transl_table=11
atgaccgcgccgatcgccatcatcatgggaagccagtcggactgggacacgatgcggcatgccgccgacacgctcgaggcgctcggcgttgccgccgagacccgcatcgtttcggcacaccgcacccccgaccggctggtcgctttcgccaagggcgccaaggcggcgggttacaagatcatcatcgccggcgcgggcggcgctgcacatttgccgggcatggcggcggcactgacggagctcccggtcttcggtgttcccgtcgaatcgaagacgctcaagggcgtcgattcgctctattcgatcgtgcagatgcccgcgggcatcccggtcggcacccttgccatcggcaaggccggcgcgatcaatgcggcgctgcttgctgccgccgtgctggcgctgtccgacccagccttgtccgaccgcctcgccgcctggcgcaaggcacagaccgaggcggtcgctgagcgcccggaggacaaggcgtga

SEQ ID NO: 13220 - protein, 162 aa, Bradyrhizobium japonicum USDA 110
MTAPIAIIMGSQSDWDTMRHAADTLEALGVAAETRIVSAHRTPDRLVAFAKGAKAAGYKIIIAGAGGAAHLPGMAAALTELPVFGVPVESKTLKGVDSLYSIVQMPAGIPVGTLAIGKAGAINAALLAAAVLALSDPALSDRLAAWRKAQTEAVAERPEDKA

SEQ ID NO: 13221 - DNA, 504 bp, Xylella fastidiosa Temecula1
  CDS (1)..(504): transl_table=11
atgatctccaatcaatcccccccgctggtcggtattgtcatgggttcctcttcggattggggggcgatgcagcacgccgcacaaaagctcgatgctctcagcgtcgcgtatgaagtgaaggtcgtttcggcgcatcgtactccggataaattgtttgcttatgctgagcaggctgaaggacgtggtttgcgtgccatcattgccggggccggtggcgcagcgcaccttccaggtatgttggctgctaagacgatagttccagtgttgggggtgccaatgcagtccagggctctgaatggtttggattcgctgttatcaatcgtacagatgccggcgggtattccagtagccacattcgcgattggggaagctggtgcagtcaatgccgccctgtttgccgccgcgctgttggtacccgaaaatccagcaatgcgtcggatgctgactgagttccgccaacgtcagacggatcaggtgaatgctgcggacgatccacgccaatga

SEQ ID NO: 13222 - protein, 167 aa, Xylella fastidiosa Temecula1
MISNQSPPLVGIVMGSSSDWGAMQHAAQKLDALSVAYEVKVVSAHRTPDKLFAYAEQAEGRGLRAIIAGAGGAAHLPGMLAAKTIVPVLGVPMQSRALNGLDSLLSIVQMPAGIPVATFAIGEAGAVNAALFAAALLVPENPAMRRMLTEFRQRQTDQVNAADDPRQ

SEQ ID NO: 13223 - DNA, 486 bp, Lactobacillus plantarum WCFS1
  CDS (1)..(486): transl_table=11
atgatggcgaaagttggtttgattatggggtcaatttctgattggccaaccatgcaattagcggcagaacagttaacggcactgggagtctcttatgagcgtcacgttatttcggcccaccgaatgccccagacattacaatcctatggtgaagaagcagcgtcacggggaattcaagttattattgcgggtgcggggggcgctgcccatttacccgggatgctagctgccaatacactactcccggtaattggggtgcccattaagacccatacgttgaacggagttgattcgttattgtcaatcgtacagatgccagctggcgtacccgtggcgacgatggcgattggtgatgcgggggctaagaatggtgcgctaatggccgcccaaattatcggtttacgggaaccacaagtacaacatgcaattggagaatttcgtgctcgtcaacgtcaggaggctgaacaaagtgaacgccaattttaa

SEQ ID NO: 13224 - protein, 161 aa, Lactobacillus plantarum WCFS1
MMAKVGLIMGSISDWPTMQLAAEQLTALGVSYERHVISAHRMPQTLQSYGEEAASRGIQVIIAGAGGAAHLPGMLAANTLLPVIGVPIKTHTLNGVDSLLSIVQMPAGVPVATMAIGDAGAKNGALMAAQIIGLREPQVQHAIGEFRARQRQEAEQSERQF

SEQ ID NO: 13225 - DNA, 543 bp, Tropheryma whipplei TW08/27
  CDS (1)..(543): transl_table=11
atgactggtaaaaacatcaacgatgaaggtagcaaatgccccgctcttgtttggctcctaatgggttctgattcggattggcccgttatgtcaggcgccgcagatatcctgcagcagatgaatatatctttcagagtaaatgttgtttctgcccatcgccagccggaaaagatgattagctgcgccaaacgcgctcgtgacatgggattcaaagttctgatagctgctgccggtggagccgcacacttgcccggaatgcttgcaagtgtcacaactctccctgttatcggagttccggttgggcagaaaaatctgtcaggcctcgattctcttttatcgattgttcaaatgccctctggtgttccggtggcctgtgtcggcatagattctgctaaaaacgctgcccttctggccgcaaggattttgggggttcaatcagccgacatagaagcatccagaatagcagatagtttgtctgcatatcagcaaagcctgtttgatcaatcaaatgaaaaggacagaatgataaatgagccgaaatag

SEQ ID NO: 13226 - protein, 180 aa, Tropheryma whipplei TW08/27
MTGKNINDEGSKCPALVWLLMGSDSDWPVMSGAADILQQMNISFRVNVVSAHRQPEKMISCAKRARDMGFKVLIAAAGGAAHLPGMLASVTTLPVIGVPVGQKNLSGLDSLLSIVQMPSGVPVACVGIDSAKNAALLAARILGVQSADIEASRIADSLSAYQQSLFDQSNEKDRMINEPK

SEQ ID NO: 13227 - DNA, 507 bp, Pseudomonas syringae pv. tomato str. DC3000
  CDS (1)..(507): transl_table=11
atgagaggcacgacgatgagcgcactggttggcgtgatcatgggctccaagtccgattggtccacccttagccacaccgccgacatgctggaaaagctcggcattccttttgaagtcaaagtggtgtcagctcaccgcacgccggacctgctgttccagtacgccgacgaagccgaaggccgtggcattgaagtgatcatcgccggtgccggtggtgccgctcacttgccgggtatgtgcgctgccaagactcacctgcctgtattgggcgttccggtgcagtcctccatgctctcgggtgtcgactccctgctgtcgatcgtgcagatgcccgctggcattccggtcgcgacgctggccatcggcaaggccggtgcgatcaacgcagcgctgctgtcggcaagcattctcggcgccaagcacccgcaatttcacgcagcgctgaagaaatttcgcactgagcagacagacagcgtcctggacaatccagacccacgccacgcctga

SEQ ID NO: 13228 - protein, 168 aa, Pseudomonas syringae pv. tomato str. DC3000
MRGTTMSALVGVIMGSKSDWSTLSHTADMLEKLGIPFEVKVVSAHRTPDLLFQYADEAEGRGIEVIIAGAGGAAHLPGMCAAKTHLPVLGVPVQSSMLSGVDSLLSIVQMPAGIPVATLAIGKAGAINAALLSASILGAKHPQFHAALKKFRTEQTDSVLDNPDPRHA

SEQ ID NO: 13229 - DNA, 612 bp, Streptococcus pyogenes SSI-1
  CDS (1)..(612): transl_table=11
atgctaaagcacctagtcgccctgacgtgggttcgtcttcgaaatcaaagatttcggacttaccgcatatttttctacggaaggtttcgacaagtcgaaacgcccctttatatcttaattatgaaaactccaattatttctattatcatgggctccaaatctgactgggcaaccatgcaaaaaacggctgaagttctagacaactttggcattgcttacgagaagaaagtcgtctctgctcaccgcacgcccgacctcatgttcaagcatgctgaggaagcacgtggtcgtggcatcaaaatcatcatcgcaggagcaggtggggcagctcacttgcctggtatagtggcagctaaaacaacgctgcctgttatcggtgtgcctgtcaaatcacgtgccctttcaggtttggattcactctattcgattgtgcagatgcctggcggtgtgcctgtggcaaccatggctatcggagaagcgggagcgactaacgctgccctgacagccctccgtattctctccatcgaggatcaaaatctggctgatgcgctagctcatttccatgaggaacaaggaaaaatcgcagaggagtcaagtggtgaactcatttaa

SEQ ID NO: 13230 - protein, 203 aa, Streptococcus pyogenes SSI-1
MLKHLVALTWVRLRNQRFRTYRIFFYGRFRQVETPLYILIMKTPIISIIMGSKSDWATMQKTAEVLDNFGIAYEKKVVSAHRTPDLMFKHAEEARGRGIKIIIAGAGGAAHLPGIVAAKTTLPVIGVPVKSRALSGLDSLYSIVQMPGGVPVATMAIGEAGATNAALTALRILSIEDQNLADALAHFHEEQGKIAEESSGELI

SEQ ID NO: 13231 - DNA, 516 bp, Bacteroides thetaiotaomicron VPI-5482
  CDS (1)..(516): transl_table=11
atgaaaatgactccaattgtaagtatcatcatgggtagcacgtccgaccttcctgttatggagaaggctgcgcaactgctgaatgatatgcatgtaccgttcgaaatgaacgccctttctgctcaccgcacgccggaggctgtggaagagtttgccaaaaatgcccgtagccgtggcattaaagtaatcatcgctgctgccggaatggctgccgcccttccgggtgtcatcgcagccaacacaacacttccggtgatcggagtacctgtaaaaggctctgtgctcgacggtgtagacgctctgtactccatcattcagatgcctccgggcattcctgtggctacggttgctatcaatggagcgatgaatgcggctatccttgccattcagatgcttgcattgagcgatgccgcattggctgaggcttttgctgcttacaaagaaggactgaaaaagaaaatcgtaaaggcaaacgaagaactgaaagaagtgaagttcgaatataaaaccaattaa

SEQ ID NO: 13232 - protein, 171 aa, Bacteroides thetaiotaomicron VPI-5482
MKMTPIVSIIMGSTSDLPVMEKAAQLLNDMHVPFEMNALSAHRTPEAVEEFAKNARSRGIKVIIAAAGMAAALPGVIAANTTLPVIGVPVKGSVLDGVDALYSIIQMPPGIPVATVAINGAMNAAILAIQMLALSDAALAEAFAAYKEGLKKKIVKANEELKEVKFEYKTN

SEQ ID NO: 13233 - DNA, 489 bp, Enterococcus faecalis V583
  CDS (1)..(489): transl_table=11
atgaaaccattagtcgctgtgattatgggaagtacctcagactgggcaacgatgaaagctgcttgtcttgtgttggaagagttgaaaattccttatgaaaaacgagtgatatcagcacataggacccctgacttgatgtttcgttttgcagaggaatcacgaacaaaaggattgaaggttattatcgctggcgctggtggagcggcccatttaccagggatggtagctgcaaagacaaccttacctgtcattggtgttccagttaaaacacgaacgttaaacggtattgattcactgttgtctattgtgcagatgccagggggagttcctgtagcaacaactgcgattggctcagcaggtgctaccaatgctgggttattagctgcagaaatactaagtattgatgatttacagttagcagaaagaatccaagcaagacgacaatcattggaaaaagcggttatggaaagtggggaacaacttgaataa

SEQ ID NO: 13234 - protein, 162 aa, Enterococcus faecalis V583
MKPLVAVIMGSTSDWATMKAACLVLEELKIPYEKRVISAHRTPDLMFRFAEESRTKGLKVIIAGAGGAAHLPGMVAAKTTLPVIGVPVKTRTLNGIDSLLSIVQMPGGVPVATTAIGSAGATNAGLLAAEILSIDDLQLAERIQARRQSLEKAVMESGEQLE

SEQ ID NO: 13235 - DNA, 534 bp, Streptomyces avermitilis MA-4680
  CDS (1)..(534): transl_table=11
atgaccgcacccgtagttggcatcgtcatggggtcggactccgactggcccgtcatggaggccgcagcgcaggccctcgacgagttcgagatcccgtacgaggtggacgtcgtctccgcgcaccggatgccgcacgagatgatcgcgtacggcgagcaggcggcggagcgcgggctgaaggcgatcatcgcgggtgcgggcggcgccgcccatctgcccggcatgctggcgtccgtgaccccgctgcccgtcatcggcgtgcccgtcccgctgaagtacctcgacggcatggactcgctgctgtcgatcgtgcagatgccggccggtgtcccggtcgcgaccgtctccgtcggcggcgcgcgcaacgcgggcctgctggccgcgcggatgctggccgcgcacgacgcggaactcctcacccgcatgcgggagttccagcaggaactgaacgaccaggccaccgagaagggcaagcggctgcgcgccaaggtcgacggcgcgtcgggcggcttcggcttcggctcggggaagtga

SEQ ID NO: 13236 - protein, 177 aa, Streptomyces avermitilis MA-4680
MTAPVVGIVMGSDSDWPVMEAAAQALDEFEIPYEVDVVSAHRMPHEMIAYGEQAAERGLKAIIAGAGGAAHLPGMLASVTPLPVIGVPVPLKYLDGMDSLLSIVQMPAGVPVATVSVGGARNAGLLAARMLAAHDAELLTRMREFQQELNDQATEKGKRLRAKVDGASGGFGFGSGK

SEQ ID NO: 13237 - DNA, 486 bp, Bacillus cereus ATCC 14579
  CDS (1)..(486): transl_table=11
atgaaatcactagttggagtcataatgggaagtacgtcagactgggaaacaatgaaatatgcttgtgacattttagatgaattaaatataccgtatgagaaaaaagttgtatccgctcatcggactccggattatatgtttgaatatgcagagacggctcgtgaacgtggattgaaagttattattgctggagctggtggagcagcacatttaccaggaatggttgcagcgaagacaaatcttcctgtaattggagttccagttcaatcaaaagcattaaacggcttagattcattattatccatcgcccaaatgccaggaggtgttccagttgcaactgttgcaattggtaaagccggttcaacgaatgctggattacttgccgcacaaatacttggatcatttcatgatgatatacatgatgcattagaattgagacgagaagcgattgaaaaagatgtgcgtgaaggtagtgagctagtatga

SEQ ID NO: 13238 - protein, 161 aa, Bacillus cereus ATCC 14579
MKSLVGVIMGSTSDWETMKYACDILDELNIPYEKKVVSAHRTPDYMFEYAETARERGLKVIIAGAGGAAHLPGMVAAKTNLPVIGVPVQSKALNGLDSLLSIAQMPGGVPVATVAIGKAGSTNAGLLAAQILGSFHDDIHDALELRREAIEKDVREGSELV

SEQ ID NO: 13239 - DNA, 498 bp, Nitrosomonas europaea ATCC 19718
  CDS (1)..(498): transl_table=11
gtggatcatccggtagtcagcatcgtaatgggcagcagcagtgactggcaggtaatgcgacatgctgcaagcgttttgaaaaacttctgtattccgcatgaaaccatgattatctcggcacatcgcacgcctgacaggatgtttgaatatgccgaaacagctcatgaccgtggaatcaggtgtatcatcgccggtgcgggaggtgctgcccatctccccggcatgattgctgccaaaaccacactccccgttctgggggttccggttacatcaaaacatttacagggtgtggattcactgttatccatcgtacagatgcccaagggtgtgccagttgccacttttgccatcggagaagcaggtgcagccaacgccgcactgtttgctgctgccattctggccgggggagatatctcactggccgaaaaactcgatcaatttcgcaaggatcaggctgcctctgtcgctgcgatgacgctccccgaatcatgtacataa

SEQ ID NO: 13240 - protein, 165 aa, Nitrosomonas europaea ATCC 19718
MDHPVVSIVMGSSSDWQVMRHAASVLKNFCIPHETMIISAHRTPDRMFEYAETAHDRGIRCIIAGAGGAAHLPGMIAAKTTLPVLGVPVTSKHLQGVDSLLSIVQMPKGVPVATFAIGEAGAANAALFAAAILAGGDISLAEKLDQFRKDQAASVAAMTLPESCT

SEQ ID NO: 13241 - DNA, 519 bp, Rhodopirellula baltica SH 1
  CDS (1)..(519): transl_table=11
atgactgaccaagacgattccgcgaccgattcgcttttgcctcgtgttggtgtgatcatgggcagccgcaatgactgggacaccatgtcagcggcctgcgagatgctggatcttctcggcgtagagcatgagcgatccgtcgtttccgctcaccgtacacccgaacgcatgttcgaatacgctcgatcggccgcgtcccgaggattgaaagtcatcattgcgggagccggtggcgccgcccatctgccgggaatggtcgcttcggaaacggttttgccagtgatcggcgtgcccattcaaagccgggctttgcagggattggattcgttgctttccatcgtccagatgccaggtggaattccggtagcgacgatgtcgatcggtgtggcgggagcgaagaacgcaggggtgatggcagctcgtattttggcgacccacgacgaggcactccgcggtcgtctcgaggcattcgttgcaaaacaacgtgacgacgtgatcgcatcggcagagcttccatga

SEQ ID NO: 13242 - protein, 172 aa, Rhodopirellula baltica SH 1
MTDQDDSATDSLLPRVGVIMGSRNDWDTMSAACEMLDLLGVEHERSVVSAHRTPERMFEYARSAASRGLKVIIAGAGGAAHLPGMVASETVLPVIGVPIQSRALQGLDSLLSIVQMPGGIPVATMSIGVAGAKNAGVMAARILATHDEALRGRLEAFVAKQRDDVIASAELP

SEQ ID NO: 13243 - DNA, 495 bp, Wigglesworthia glossinidia endosymbiont of Glossina brevipalpis
  CDS (1)..(495): transl_table=11
atgaataaaaacaataaagtagcaattattatgggctctaaaagcgattggaatacattgaaacatgcatctaatgctctaaaagatttaaaaattaaatttactacacatattatttctgctcataggactccagataaattatttgaatttgctgaacaagctaaaaaaaatggttactgtgtgattattgctggagctggtggagcagctcatttaccaggaatgttagcatctaaaacattaataccagttttaggagttcctgtagaaaatagtcctttgaatggattagatagtttatattctatagtacaaatgccatctgaagttccagtaggaactttagctattggaaaatctggtgctattaattccgctatactagcttctcaaattttatcattaaatgattacgaattatatattagattaaaattgagaagaaaagaaaaagaaaatcaaatattaaattatgagaactcaattttataa

SEQ ID NO: 13244 - protein, 164 aa, Wigglesworthia glossinidia endosymbiont of Glossina brevipalpis
MNKNNKVAIIMGSKSDWNTLKHASNALKDLKIKFTTHIISAHRTPDKLFEFAEQAKKNGYCVIIAGAGGAAHLPGMLASKTLIPVLGVPVENSPLNGLDSLYSIVQMPSEVPVGTLAIGKSGAINSAILASQILSLNDYELYIRLKLRRKEKENQILNYENSIL

SEQ ID NO: 13245 - DNA, 489 bp, Haemophilus ducreyi 35000HP
  CDS (1)..(489): transl_table=11
atgttacaacaaaaagcagaaattgcggtcgtaatgggttcaaaaagtgactgggcaacaatttcagaagcaacacaaatcttagaacaatttgatcttgcctatcatgtcgaagtagtatcggcacatcggacccccgataaactattttcgtttgctgaatctgccgaacaaaatggctataaagtaattattgcaggtgcaggtggcgcggcgcatttgccgggtatgattgctgcaaaaacaattgtaccggtattaggtgttccggttaaaagctcaatgttaaatggcatggatagcttatattctatcgttcaaatgccaaaaggtattccagttggaacattagcgataggtgctgcaaatgctgcactattagcggttcagattttagctgtttttcaacctgaattggctaaaaaacttcatgcctttcggcaacaacaaactcaactagtattagataaccccgattcacgtgattaa

SEQ ID NO: 13246 - protein, 162 aa, Haemophilus ducreyi 35000HP
MLQQKAEIAVVMGSKSDWATISEATQILEQFDLAYHVEVVSAHRTPDKLFSFAESAEQNGYKVIIAGAGGAAHLPGMIAAKTIVPVLGVPVKSSMLNGMDSLYSIVQMPKGIPVGTLAIGAANAALLAVQILAVFQPELAKKLHAFRQQQTQLVLDNPDSRD

SEQ ID NO: 13247 - DNA, 492 bp, Prochlorococcus marinus subsp. marinus str. CCMP1375
  CDS (1)..(492): transl_table=11
atgggaagtgattccgatttacctttccttgagccagctattaaagttttagaggggtttaacctccaagtagagacaagagtactttcagcacatcgaacaccactaaaaatggtctcgtttgctcgtgaagccgaagggaaaggtttaaaagtcattattgcaggagctggtggatcggcgcatcttccagggatggttgcttcacttacaagtcttccagtaattggggtccctatacaaagcaaatgcttaaaaggcattgactctttatattccattgttcagatgcctgcagggatcccagtagcaacagtagcgatcaatggtggattaaatgctggtctattagcagctcagatattaagcacgattcagccagaattaaaaattaaaatttcccaatatagaaaagaactacataatcaagttatacataaagacaaaaagctaatcgaattaggtgcatcaaagtatttagaagaaatgtaa

SEQ ID NO: 13248 - protein, 163 aa, Prochlorococcus marinus subsp. marinus str. CCMP1375
MGSDSDLPFLEPAIKVLEGFNLQVETRVLSAHRTPLKMVSFAREAEGKGLKVIIAGAGGSAHLPGMVASLTSLPVIGVPIQSKCLKGIDSLYSIVQMPAGIPVATVAINGGLNAGLLAAQILSTIQPELKIKISQYRKELHNQVIHKDKKLIELGASKYLEEM

SEQ ID NO: 13249 - DNA, 480 bp, Bordetella pertussis Tohama I
  CDS (1)..(480): transl_table=11
gtgggcgtgatcatgggatcttccagcgactgggaggtcatgaaacacgccgtggccatgctgcaggatttcggcgtggcgcacgaggcgcgcgtgatttcggcgcaccgcatgccgcaggacatggccgagtatggcgcggcggcgcgcgcgcgcggcttgcgcgccatcattgccggcgccggcggcgcggcccacctgcctggcatgatggccgcgctgaccgaggtgccggtattcggcgtgccggttccgtccaggtacctgcgcggcgaggactcgctgctttccatcgtgcagatgcccaagggcgtgccggtggccacctttgccatcggcgaggccggcgcggccaacgcggcgctgcatgccatcgccacgctggccaccaccgacgacgccctgcacgcccggctggtcgcgttccgcgcgcggcagaccgatgcggcgcgcgccatgaaagtgcctcccgaagcctga

SEQ ID NO: 13250 - protein, 159 aa, Bordetella pertussis Tohama I
MGVIMGSSSDWEVMKHAVAMLQDFGVAHEARVISAHRMPQDMAEYGAAARARGLRAIIAGAGGAAHLPGMMAALTEVPVFGVPVPSRYLRGEDSLLSIVQMPKGVPVATFAIGEAGAANAALHAIATLATTDDALHARLVAFRARQTDAARAMKVPPEA

SEQ ID NO: 13251 - DNA, 441 bp, Bordetella parapertussis 12822
  CDS (1)..(441): transl_table=11
atgaaacacgccgtggccatgctgcaggacttcggcgtggcgcacgaggcgcgcgtgatttcggcgcaccgcatgccgcaggacatggccgagtatggcgcggcggcgcgcgcgcgcggcttgcgcgccatcattgccggcgccggcggcgcggcccacctgcctggcatgatggccgcgctgaccgaggtgccggtattcggcgtgccggttccgtccaggtatctgcgcggcgaggactcgctgctttccatcgtgcagatgcccaagggcgtgccggtggccacctttgccatcggcgagtccggcgcggccaacgcggcgctgcatgccatcgccacgctggccaccaccgacgacgccctgcacgcccggctggtcgcgttccgcgcgcggcagaccgatgcggcgcgcgccatgaaagtgcctcccgaagcctga

SEQ ID NO: 13252 - protein, 146 aa, Bordetella parapertussis 12822
MKHAVAMLQDFGVAHEARVISAHRMPQDMAEYGAAARARGLRAIIAGAGGAAHLPGMMAALTEVPVFGVPVPSRYLRGEDSLLSIVQMPKGVPVATFAIGESGAANAALHAIATLATTDDALHARLVAFRARQTDAARAMKVPPEA

SEQ ID NO: 13253 - DNA, 492 bp, Prochlorococcus marinus subsp. pastoris str. CCMP1986
  CDS (1)..(492): transl_table=11
atgggaagtgattcagatctaaaaacattgaaacctgcaatagatatattgaacgaatttggaatagaaactgaggtttgtatactttctgcgcatagaacgccaatggaaatgatggaatatgcaaaaaaagcagaatcagaaaacataaaagttattatcgcaggagccggtggagctgctcacctgcctggcatgatagcttcgctaacatgcatacctgtcataggtgtaccggtggagagtaaaaccctgaaaggaattgactccctattatcaatagtgcaaatgcctgcgggtattcctgtagcaacagtagccataaacggtgcaaaaaatgctggtttattagcaattcaaatccttagtttatttgatgaagcattaagattaaaaatgaaaaaatttagagagaatctgcatacacaagtaagaactaaaaatagtaaattgtctgctctaggggctgataattatctgaaaactgactaa

SEQ ID NO: 13254 - protein, 163 aa, Prochlorococcus marinus subsp. pastoris str. CCMP1986
MGSDSDLKTLKPAIDILNEFGIETEVCILSAHRTPMEMMEYAKKAESENIKVIIAGAGGAAHLPGMIASLTCIPVIGVPVESKTLKGIDSLLSIVQMPAGIPVATVAINGAKNAGLLAIQILSLFDEALRLKMKKFRENLHTQVRTKNSKLSALGADNYLKTD

SEQ ID NO: 13255 - DNA, 492 bp, Prochlorococcus marinus str. MIT 9313
  CDS (1)..(492): transl_table=11
atgggtagtgattctgatttgccaaccctgcaaccggccgtcaccgtcttagaggagttcggtgtgaaggtggaggtgcgtgtgctttctgcgcaccgtacgccccttgagatggtggcctttgcaaaggaagctcatcagagaggtttgaaggtgatcgtggcaggtgccggcggtgctgctcatttgccgggcatggtggcgtcactcaccacgctgccagtgattggagtacctgtgcagagcagggctctttccggggtggattccttgcattcgattgtgcagatgcctgggggaatccctgtggcaacagtggcgattggtggagggcttaatgctggcttgctggcggctcagatcctggcgatctgtgatccacagcttgcagagcggttgagggcctaccgccaggatcttcacgatgctgtggtagccaaggatgctcgcttgttggagcttggcagtgaggcttatttggggcagatgtga

SEQ ID NO: 13256 - protein, 163 aa, Prochlorococcus marinus str. MIT 9313
MGSDSDLPTLQPAVTVLEEFGVKVEVRVLSAHRTPLEMVAFAKEAHQRGLKVIVAGAGGAAHLPGMVASLTTLPVIGVPVQSRALSGVDSLHSIVQMPGGIPVATVAIGGGLNAGLLAAQILAICDPQLAERLRAYRQDLHDAVVAKDARLLELGSEAYLGQM

SEQ ID NO: 13257 - DNA, 501 bp, Synechococcus sp. WH 8102
  CDS (1)..(501): transl_table=11
atgggcagtgattccgatctgccgaccatggaaccggccgcggcgatcctgcgggaactgggggttgaggtggaggtgcgggtgttgtcagcccaccgcacaccgctggaaatggtggcctttgcccaggcggcccgcactgagggattcggtgtgattgtggccggtgccggtggtgccgcccatctgccggggatggtggcggccctcaccaccctgccggtgatcggtgttcccgtccgaagccgttctctgtccggggtggattcgctgcactcgatcgtgcagatgcccggtggtattcccgttgccacggtggccatcggcggtggcctcaatgccggattgctggctgctcagatcctgtcggtggcagacgaggcactggcggcccgactggcggactaccgccgcaggttgcacgatgcagtggcagccaaggatgcccgtctgctcgatctcggcagtacggcctatctcgacggcatgtcgaccccttga

SEQ ID NO: 13258 - protein, 166 aa, Synechococcus sp. WH 8102
MGSDSDLPTMEPAAAILRELGVEVEVRVLSAHRTPLEMVAFAQAARTEGFGVIVAGAGGAAHLPGMVAALTTLPVIGVPVRSRSLSGVDSLHSIVQMPGGIPVATVAIGGGLNAGLLAAQILSVADEALAARLADYRRRLHDAVAAKDARLLDLGSTAYLDGMSTP

SEQ ID NO: 13259 - DNA, 489 bp, Chromobacterium violaceum ATCC 12472
  CDS (1)..(489): transl_table=11
atgattgaagtcggcatcgtgatgggtagcaacagcgactgggaagtgatgcagcacgccgcccgcgtgctgaaaaacttcggcgtcgcctgcgaaacccgcgtcgtctccgcccaccgcaccccggacctgctgttccagtacgccgaagaagccgcgccgcgcggcctgaaggccatcatcgccggcgccggcggggccgcccatctgccgggcatgctggccgccaagacccacgtgccggtgctgggcgtgccggtgccgtccaaatacctgcgcggcgaggattcgctgctgtccatcgtccagatgcccaagggcatcccggtggccaccttcgccatcggcgaggccggcgccgccaacgccgcgctgttcgcggtggcgatgctggcgaccacccggccggaactggccgagcaactgatcggcttccgcaagcaacaggaagcaaccgtgctggcgatgacattgccggaggtcgaataa

SEQ ID NO: 13260 - protein, 162 aa, Chromobacterium violaceum ATCC 12472
MIEVGIVMGSNSDWEVMQHAARVLKNFGVACETRVVSAHRTPDLLFQYAEEAAPRGLKAIIAGAGGAAHLPGMLAAKTHVPVLGVPVPSKYLRGEDSLLSIVQMPKGIPVATFAIGEAGAANAALFAVAMLATTRPELAEQLIGFRKQQEATVLAMTLPEVE

SEQ ID NO: 13261 - DNA, 507 bp, Porphyromonas gingivalis W83
  CDS (1)..(507): transl_table=11
atgcagcctttggtaagcatcatcatgggtagtacttccgatctgcccattatggagaaagccgccaaaatgctcgatgaaatgcagattccattcgagatgttggcgctttcggctcatcgtactccggctgaagtagagacttttgcacacgaggccagagctcgcggtatcaaggtaattatcgctgctgccggtatggcagctcatttgtgtggcgtaattgcttccatgacgtctattccggtaataggtgtacccatcaatgccactcttgacggaatggatgctctgttagccatcgttcaaatgcctccggggatccccgttgctactgtggggatcaatgctgcccagaatgcagcacttttggccgtccagatgatggctaccggcgacgaagctctctatgctcgactggaggcctataaggagtcgctcaaagaaaaagtcgttaaggccaatcgcgagctggcagaggtgaagtacaacttcaaaacgaattaa

SEQ ID NO: 13262 - protein, 168 aa, Porphyromonas gingivalis W83
MQPLVSIIMGSTSDLPIMEKAAKMLDEMQIPFEMLALSAHRTPAEVETFAHEARARGIKVIIAAAGMAAHLCGVIASMTSIPVIGVPINATLDGMDALLAIVQMPPGIPVATVGINAAQNAALLAVQMMATGDEALYARLEAYKESLKEKVVKANRELAEVKYNFKTN

SEQ ID NO: 13263 - DNA, 516 bp, Gloeobacter violaceus PCC 7421
  CDS (1)..(516): transl_table=11
atgacccatcctgcgctggtggggatcatcatgggcagcgattcggatctgcccacgatgaaggcggcggccgaggtctgcaccgaattcgaggtgccctgttcggtggcgatcgtctcggcccaccgcacgccggagcgcatgtttgaatttgcggcgaccgcccactcccggggcttgaaggtgatcgtggccggggcgggcggggcggcccacctgccggggatggtggcggccctcacacccctgccggtgattggagtgccggtaccggtcaccgccctggggggcgtcgatgcgctctattcgattgtccagatgcccgcaggcattccggtggccaccgtggcgatcggcaacgcccgcaacgccggtctgctcgctgtgcagatcctggcgacggcggacccggtgttgcagcaaaaaatcgtcgcttatcgcgagcggctgcgcacggcggtcgagaaaaaacaggcccgcctcgaagagctgggttggcggaactacgagccttaa

SEQ ID NO: 13264 - protein, 171 aa, Gloeobacter violaceus PCC 7421
MTHPALVGIIMGSDSDLPTMKAAAEVCTEFEVPCSVAIVSAHRTPERMFEFAATAHSRGLKVIVAGAGGAAHLPGMVAALTPLPVIGVPVPVTALGGVDALYSIVQMPAGIPVATVAIGNARNAGLLAVQILATADPVLQQKIVAYRERLRTAVEKKQARLEELGWRNYEP

SEQ ID NO: 13265 - DNA, 531 bp, Photorhabdus luminescens subsp. laumondii TTO1
  CDS (1)..(531): transl_table=11
atgactgcccaacctgatttagcaggaacagctcaacacaatgccaaaatcgccattgtcatgggttctaaaagcgattggacgactatgcagcacgcggctgatatcctcacttctcttaatgtaccttttcatgttgaaattgtttctgctcaccgtacacccgataaactattcagttttgccgagcaagctgagcaaaatggttttgatgtcattatcgccggtgccggtggtgccgctcatttacccggcatgctggctgctaaaacgctggtaccggttctcggcgtacccgtacaaagtgctgcactaaatgggatagacagtctttactctattgtacagatgccaaaagggattcctgtcggcacacttgccattgggaaagctggcgcggcaaacgcagctctactggctgcacagattttggctcgtcataataaagatttactgaaacgcctcagccattggcgtgaaacacaaactcaggatgtactcgataatcccgatccgcgggaggaagcatga

SEQ ID NO: 13266 - protein, 176 aa, Photorhabdus luminescens subsp. laumondii TTO1
MTAQPDLAGTAQHNAKIAIVMGSKSDWTTMQHAADILTSLNVPFHVEIVSAHRTPDKLFSFAEQAEQNGFDVIIAGAGGAAHLPGMLAAKTLVPVLGVPVQSAALNGIDSLYSIVQMPKGIPVGTLAIGKAGAANAALLAAQILARHNKDLLKRLSHWRETQTQDVLDNPDPREEA

SEQ ID NO: 13267 - DNA, 501 bp, Corynebacterium diphtheriae NCTC 13129
  CDS (1)..(501): transl_table=11
atgacaccactcgtaggccttatcatgggctccgactccgactggcccaccgttgaaccagccgccgaggtactcgccgaattcggcatccccttcgaagtaggcgtagtttctgcacaccgtactccagagaaaatgctggcatacgcaaaaaccgcacatgagcgcggtctaaaatgtatcattgcctgcgccggcggtgccgcacacctacctggcatggtcgcagcagccaccccgctacccgtcatcggaatcccacgcgctctcaaagaactcgacggcatggattctctgctctccatcgtccaaatgccaggcggggttcccgttgctaccgtctccattggaggcgctaaaaacgcaggactgttggccgcacgaattcttggcgccggtgatccagaactagtaaccaagatggctgactaccaagaaaacatgcgccaagaagttgagcgcaaagatgccaacctcaagaagaaattgatgggcgagtaa

SEQ ID NO: 13268 - protein, 166 aa, Corynebacterium diphtheriae NCTC 13129
MTPLVGLIMGSDSDWPTVEPAAEVLAEFGIPFEVGVVSAHRTPEKMLAYAKTAHERGLKCIIACAGGAAHLPGMVAAATPLPVIGIPRALKELDGMDSLLSIVQMPGGVPVATVSIGGAKNAGLLAARILGAGDPELVTKMADYQENMRQEVERKDANLKKKLMGE

SEQ ID NO: 13269 - DNA, 489 bp, Rhodopseudomonas palustris CGA009
  CDS (1)..(489): transl_table=11
atgacagctcccgtcgcgatcatcatgggcagccagtcggactgggaaacgatgcggcacgccgccgacaccctgaccgccctcggcgtcgcccatgacacccagatcgtttccgcgcaccgcacccccgaccgcctttatgctttcgccaaaggcgcgaaggcagccggccaccgtatcgtcattgccggcgccggcggagccgcgcatctgccggggatgaccgcggcgctgacggagctgccggtgttcggcgtgccggtggaatccaagaccatgtcgggcctggattcgctgtattcgatcgtgcagatgccggccggcatcccggtcggcacgctggcgatcggcaaggccggcgcagtcaacgccgccctgctggctgcgagcgtgctggcgctgacagattccgatctggcgacccgactggcggcgtggcgcaaggcacagaccgattcggttgcggcccggccggagggcgcggcgtga

SEQ ID NO: 13270 - protein, 162 aa, Rhodopseudomonas palustris CGA009
MTAPVAIIMGSQSDWETMRHAADTLTALGVAHDTQIVSAHRTPDRLYAFAKGAKAAGHRIVIAGAGGAAHLPGMTAALTELPVFGVPVESKTMSGLDSLYSIVQMPAGIPVGTLAIGKAGAVNAALLAASVLALTDSDLATRLAAWRKAQTDSVAARPEGAA

SEQ ID NO: 13271 - DNA, 510 bp, Geobacter sulfurreducens PCA
  CDS (1)..(510): transl_table=11
atggaaaacccgcaggtactcatcattatgggaagtgattcggacgttcccgtcatggaagaagcggcaaaggcccttgatgctttcggcgtgacctgggaaatgcgagtggcgtcggcccaccgttcgccgaaaaaagcggcagatctcgcctcgaacgcggccgcgcgcggcgtgaaggcgatcatcgccggtgccggcgtggctgcccaccttgcgggggtcctcgccgccgagactattctgccggttatcgcggtaccaatgccgggaggggcgctcaacggcgttgatgccctgtactccatggtgcagatgcctggcgggattccggtggctactatggccatcggcaaggcaggagccaaaaatgccgggctgttcgcggtgcagatcctggccctcggggatgccgccatggccggcaggctcgtggaatacaaggcgagtatggcggaagaggtggaggccaaggatcgggcccttcaggtcaagttgggccgcgcgtag

SEQ ID NO: 13272 - protein, 169 aa, Geobacter sulfurreducens PCA
MENPQVLIIMGSDSDVPVMEEAAKALDAFGVTWEMRVASAHRSPKKAADLASNAAARGVKAIIAGAGVAAHLAGVLAAETILPVIAVPMPGGALNGVDALYSMVQMPGGIPVATMAIGKAGAKNAGLFAVQILALGDAAMAGRLVEYKASMAEEVEAKDRALQVKLGRA

SEQ ID NO: 13273 - DNA, 552 bp, Geobacter sulfurreducens PCA
  CDS (1)..(552): transl_table=11
atggaaaaagtcgaaacatcgagcgcacccggcactctcgccgaccgctcgccgctggtgggaatcctgaccgggagccccaatgatctgcccacggtggtgaaggtgcgcgacaccctgaccgagctcggcatcccgagcgagatcgtggtggcttcggcccaccggacccccgacaaggtcctcgcctacctggaccgggcccataaggaaggggtgcaggtactgatcggctgcgccggcgtggccgctcacctggcgggtgtaatcgccgggcacacgagattgccggtcatcggtttgccgctcggcaacggccccttgtcagggatggacagcctcctctcgaccgtgcagatgcccccgggcgtgccggttgccacggtggccatcgacgggagccgcaatgcggccatgctggcggcccgcattctggccctcaagtacccggagattgacaaggccctggaagaggcggctcggaaggagcgggagcgctacgacctgaccgccgatgaggccctggcaaaactcacctcgtgcgtcaagtaa

SEQ ID NO: 13274 - protein, 183 aa, Geobacter sulfurreducens PCA
MEKVETSSAPGTLADRSPLVGILTGSPNDLPTVVKVRDTLTELGIPSEIVVASAHRTPDKVLAYLDRAHKEGVQVLIGCAGVAAHLAGVIAGHTRLPVIGLPLGNGPLSGMDSLLSTVQMPPGVPVATVAIDGSRNAAMLAARILALKYPEIDKALEEAARKERERYDLTADEALAKLTSCVK

SEQ ID NO: 13275 - DNA, 522 bp, Mycobacterium avium subsp. paratuberculosis K-10
  CDS (1)..(522): transl_table=11
atgagcgtgaccgaagctcctcgcgtcgcggtgatcatgggcagcgacagcgactggtcggtgatggccgacgccgcggccgcgctggccgagttcgacgtgcccgccgaggtgcgggtggtctcggcgcaccgcacgccgggggtgatgttcgactacgcgcgcgacgccgccgggcggggcatcgaggtgatcatcgccggcgccggaggcgccgcccacctgcccggcatggtcgcctcggcgacgccgctgccggtgatcggggtcccggtgccgctgggccggctggacgggctggactcgctgctgtcgatcgtgcagatgcccgcgggggtgccggtggccaccgtctccatcggcggcgcccgcaacgccggcctgctggcggtgcgcatcctcggcgcctccgacccggggctgcgggcccgcatcgtcgagttccagacccagctggccgacagcgtgcgggccaaggatgaggcgctgcaaaggctgcacggtaaagttaccggtcagtag

SEQ ID NO: 13276 - protein, 173 aa, Mycobacterium avium subsp. paratuberculosis K-10
MSVTEAPRVAVIMGSDSDWSVMADAAAALAEFDVPAEVRVVSAHRTPGVMFDYARDAAGRGIEVIIAGAGGAAHLPGMVASATPLPVIGVPVPLGRLDGLDSLLSIVQMPAGVPVATVSIGGARNAGLLAVRILGASDPGLRARIVEFQTQLADSVRAKDEALQRLHGKVTGQ

SEQ ID NO: 13277 - DNA, 501 bp, Wolbachia endosymbiont of Drosophila melanogaster
  CDS (1)..(501): transl_table=11
gtgttgaatatgacaaaaataaaaaaagatgttgctgttattatgggaagtgagtcagattacaccactatggtccatactgttgatatgttaaaagcattagaagtttcacatgatatattcataatatctgcacatagaacaccagaaagactcttcaattttgctaaatctgcacaagaagaaggttttaaggttattatagctggtgcaggaggtgcagctcatttacctggtatggttgcgtcactaacttgtttaccagttatcggcgttcctgtgcatagtaaacaattaaatgggctggacagcctactctctatagttcaaatgccaaagggtgttccagttgcaaccatgtctatagggggaaatggagcacataatgctgccattaccgccgtatctatattgtcaatttctaacagtgaaattgcaggtaggttaaaaaagtggagagagaagcagaccaaagaagtaaaagaaaaaccaatttcataa

SEQ ID NO: 13278 - protein, 166 aa, Wolbachia endosymbiont of Drosophila melanogaster
MLNMTKIKKDVAVIMGSESDYTTMVHTVDMLKALEVSHDIFIISAHRTPERLFNFAKSAQEEGFKVIIAGAGGAAHLPGMVASLTCLPVIGVPVHSKQLNGLDSLLSIVQMPKGVPVATMSIGGNGAHNAAITAVSILSISNSEIAGRLKKWREKQTKEVKEKPIS

SEQ ID NO: 13279 - DNA, 486 bp, Bacillus cereus ATCC 10987
  CDS (1)..(486): transl_table=11
atgaaatcactagttggagtcataatgggaagcacgtcagactgggaaacaatgaaatatgcttgtgacattttagatgaattaaatataccgtatgagaaaaaggttgtatccgctcatcggactccggattatatgtttgaatatgcagagacggctcgtgaacgtggattgaaagttattattgcgggagctggtggagcagcacatttaccaggaatggttgcagcgaagacgaatcttcctgtaatcggagttccagttcaatcaaaagcgttaaacggcttagattcattattatccatcgtccaaatgccaggaggggttccagttgcaactgttgcaattggtaaggctggttcaacaaatgctggtttacttgctgcacaaatacttggatcattccatgatgacatatatgatgcattagaattgagaagagaagcaattgaaaaagatgtgcgcgaaggtagtgagctagtatga

SEQ ID NO: 13280 - protein, 161 aa, Bacillus cereus ATCC 10987
MKSLVGVIMGSTSDWETMKYACDILDELNIPYEKKVVSAHRTPDYMFEYAETARERGLKVIIAGAGGAAHLPGMVAAKTNLPVIGVPVQSKALNGLDSLLSIVQMPGGVPVATVAIGKAGSTNAGLLAAQILGSFHDDIYDALELRREAIEKDVREGSELV

SEQ ID NO: 13281 - DNA, 492 bp, Prochlorococcus marinus str. AS9601
  CDS (1)..(492): transl_table=11
atgggtagtgattcagatctaaaaacattgaagccatccattgatattttaagagaatttggaataaaaactgaagtttgtatactttccgctcatcgaacacctattgaaatgatggaatatgcaaaaaatgcagaatcagaaaacataaaagtaataattgccggtgctgggggtgctgctcatcttccaggaatgctagcatctataacttgcattcctgtaattggtgtaccagtagagagtaagacacttaaggggattgactctcttttatcaatcgtacaaatgcccgctggaattccagttgcaacagttgcaattaatggaggtcaaaatgctggattattggcaatagagatgatcagtttatttgacgaatccataaagaaaaatttgaaagaattcagagaaaatctacatacaaaggtaagaactaaaaatagtaagttatcaaatattggacctgacaattatcttcaaaataaatga

SEQ ID NO: 13282 - protein, 163 aa, Prochlorococcus marinus str. AS9601
MGSDSDLKTLKPSIDILREFGIKTEVCILSAHRTPIEMMEYAKNAESENIKVIIAGAGGAAHLPGMLASITCIPVIGVPVESKTLKGIDSLLSIVQMPAGIPVATVAINGGQNAGLLAIEMISLFDESIKKNLKEFRENLHTKVRTKNSKLSNIGPDNYLQNK

SEQ ID NO: 13283 - DNA, 492 bp, Prochlorococcus marinus str. MIT 9515
  CDS (1)..(492): transl_table=11
atgggaagtgattcagatctaaaaactttgaaaccttcagttgatatattgcatgaatttggaatagaaacagaagtttgtatactttcagcacatcgaaccccaattgaaatgatggaatatgcaaaaaaggcagaatcaaaaaatataaaggttattgtagctggagctggtggggctgctcacttgcctgggatgttagcttcactaacatgtattcccgttataggggtgcccgtagaaagtaaaactctgaaaggaatcgactccctattatcaattgttcaaatgcctgcaggaattccagtagcaacagtagccataaacggagcaaaaaatgctgggcttttagcaattcaaatcctttgtttatttgacgaaggtttaaggataaaaatgaaaaaatttagagataatctgcatgcacaagtaagaactaaaaacagtaaattatttactttagggactgataattatctaaaaacttactaa

SEQ ID NO: 13284 - protein, 163 aa, Prochlorococcus marinus str. MIT 9515
MGSDSDLKTLKPSVDILHEFGIETEVCILSAHRTPIEMMEYAKKAESKNIKVIVAGAGGAAHLPGMLASLTCIPVIGVPVESKTLKGIDSLLSIVQMPAGIPVATVAINGAKNAGLLAIQILCLFDEGLRIKMKKFRDNLHAQVRTKNSKLFTLGTDNYLKTY

SEQ ID NO: 13285 - DNA, 537 bp, Prochlorococcus marinus str. NATL1A
  CDS (1)..(537): transl_table=11
ttgtctttaactgaagctaatacatttaagcaagtagctgtagtaatgggtagtgattcagatcttaaaactcttaagcctgcggtggcaattctagatcaatttggcatatctaatgaagtaaggattctgtctgctcataggactccaaaagaaatgatggattttgctcaaatggcagaatcaaatggttttggagtgataattgctggggctggcggggctgctcatctaccaggaatgatcgcatctcttacaacccttcctgtcataggcgttcccgtcaagagcaaggcactttcagggatagattcaatgtattcaatcttgcaaatgccctcaggcatccccgtagcaacagttgccatagaagggggcctaaatgctggccttttggctactcaaattttagccatcaacaatactgaattaaaaaataaattaaacgcctacagatgtgagctgcacgaccttgtcgttaaaaaagatcacacacttaaagagattggagctataacttatctagaaaaaatgtaa

SEQ ID NO: 13286 - protein, 178 aa, Prochlorococcus marinus str. NATL1A
MSLTEANTFKQVAVVMGSDSDLKTLKPAVAILDQFGISNEVRILSAHRTPKEMMDFAQMAESNGFGVIIAGAGGAAHLPGMIASLTTLPVIGVPVKSKALSGIDSMYSILQMPSGIPVATVAIEGGLNAGLLATQILAINNTELKNKLNAYRCELHDLVVKKDHTLKEIGAITYLEKM

SEQ ID NO: 13287 - DNA, 576 bp, Prochlorococcus marinus str. MIT 9303
  CDS (1)..(576): transl_table=11
ttgtcgtcattattcatcgtgacctctgcttctctgcctgtgcctttggcagctgctgaatcgccgccgcaggtggctgtggtgatgggtagtgattccgatttaccaaccctgcaaccggctgtcaccgtcttagaggagttcggtgtgaaggtggaggtgcgtgtgctttccgcgcaccgtacgccccttgagatggtggcctttgcaaaggaggctcatcagagaggtttgaaggtgatcgtggcaggtgccggcggtgctgctcatttgccgggcatggtggcgtcactgaccacgctgccagtgattggagtacctgtgcagagcagggctctttccggggtggattccctgcattcgattgtgcagatgcctgggggaatccctgtggcaacagtggcgattggtggagggcttaatgctggcttgctggcggctcagatcctggcgatctgtgatccacagcttgcagagcggttgagggcctaccgccaggatcttcacgatgctgtggtagccaaggatgctcgcttgttggagcttggcagtgaggcttatttggggcagatgtga

SEQ ID NO: 13288 - protein, 191 aa, Prochlorococcus marinus str. MIT 9303
MSSLFIVTSASLPVPLAAAESPPQVAVVMGSDSDLPTLQPAVTVLEEFGVKVEVRVLSAHRTPLEMVAFAKEAHQRGLKVIVAGAGGAAHLPGMVASLTTLPVIGVPVQSRALSGVDSLHSIVQMPGGIPVATVAIGGGLNAGLLAAQILAICDPQLAERLRAYRQDLHDAVVAKDARLLELGSEAYLGQM

SEQ ID NO: 13289 - DNA, 522 bp, Clostridium thermocellum ATCC 27405
  CDS (1)..(522): transl_table=11
atgggtgtgaccaatgttgaaaaaaaaccaaaagttgctgttgtaatggggagtgattccgatttttcagttttacagaactgcatcaaggtcttaaagcagtttgatgtggaggtttcggcaatagtttgctcggcccacaggacacccgacaaagcggctgagttcgctaaaggtgccgaagaaaacggttttgatgttataatagccggtgcgggaaaagcggctcatttgccgggagttctggcagcatttacgccccttccggttatcggtgtgccaattaaatcatctacaatggacgggcttgattcactgctgtctatagttcaaatgccttcaggaattccggttgccacggttgcgatagacggtgcggaaaatgctgctttgcttgcggttcagatattgtcaactgcttacaaggatctcagggacaaaatgaaggaatataaaaagcagcttgagaaaaaggttgaagagaagaacaaagctcttcaggaaaagataaaagaactttaa

SEQ ID NO: 13290 - protein, 173 aa, Clostridium thermocellum ATCC 27405
MGVTNVEKKPKVAVVMGSDSDFSVLQNCIKVLKQFDVEVSAIVCSAHRTPDKAAEFAKGAEENGFDVIIAGAGKAAHLPGVLAAFTPLPVIGVPIKSSTMDGLDSLLSIVQMPSGIPVATVAIDGAENAALLAVQILSTAYKDLRDKMKEYKKQLEKKVEEKNKALQEKIKEL

SEQ ID NO: 13291 - DNA, 492 bp, Prochlorococcus marinus str. MIT 9301
  CDS (1)..(492): transl_table=11
atgggtagtgattcagatcttaaaacattgaaaccagctatcaatattttaaaagaatttggaataaaaactgaagtttgtatactttctgctcatcgaactcctattgaaatgatggaatatgcaaaaaatgcagaatcagaaaacataaaagtaataattgccggtgctggtggtgctgctcatcttccaggaatgctggcatccataacttgtattcctattattggagtaccagtagaaagtaagacacttaaggggattgattctcttttatcaatagttcaaatgcccgctgggattccagttgcaacagttgcaattaatggagctcagaatgctggattattagcaatagagatgatcagtttatttgatgcatccataaagaaaactttaaaagaattcagagaaaatctacatacacaggtaagaactaaaaatagtaagttatcaactattggacctgacaattatcttcaaaataaatga

SEQ ID NO: 13292 - protein, 163 aa, Prochlorococcus marinus str. MIT 9301
MGSDSDLKTLKPAINILKEFGIKTEVCILSAHRTPIEMMEYAKNAESENIKVIIAGAGGAAHLPGMLASITCIPIIGVPVESKTLKGIDSLLSIVQMPAGIPVATVAINGAQNAGLLAIEMISLFDASIKKTLKEFRENLHTQVRTKNSKLSTIGPDNYLQNK

SEQ ID NO: 13293 - DNA, 492 bp, Herminiimonas arsenicoxydans
  CDS (1)..(492): transl_table=11
atggcgaatgcacctttgataggcgtggtgatgggctcttcatccgactgggatgtgatgcagcatgcagtcgcgatcctgaaagaattcggcgtcgcacatgaagcgcaggtaatttctgcgcatcggatgccggatcagatgtttgcctacgccgagtcggcgcgcgcgcgcggcgtgcgtgcgatcatcgccggcgccggcggtgcggcgcatctgccgggcatgctggcagccaaaaccatcgtgccgattctgggcgtgccggtaccgtccaaatatctgcgcggcgaagattcgctgttgtccatcgtgcaaatgccaaaaggcattccggtttccactttcgccatcggtgaagcgggtgcggcaaacgccgcgctggcagcgattgcgattctcgccaccaccgacgacaaactggctgccagtctcgaacaattccgcgtcaagcaaacgcaaatcgccgtagaaatgaaattacctgtatga

SEQ ID NO: 13294 - protein, 163 aa, Herminiimonas arsenicoxydans
MANAPLIGVVMGSSSDWDVMQHAVAILKEFGVAHEAQVISAHRMPDQMFAYAESARARGVRAIIAGAGGAAHLPGMLAAKTIVPILGVPVPSKYLRGEDSLLSIVQMPKGIPVSTFAIGEAGAANAALAAIAILATTDDKLAASLEQFRVKQTQIAVEMKLPV

SEQ ID NO: 13295 - DNA, 522 bp, Burkholderia vietnamiensis G4
  CDS (1)..(522): transl_table=11
atgactgaagtccagactgcccacacgcacagcgcgccgctcgtcggcgtgctgatgggttcgagttccgactgggacgtgatgaagaacgcggtcgcgatcctgcaggaattcggcgtgccgtacgaagcgaaggtcgtgtccgcgcaccggatgcccgacgagatgttcgactatgcggagaaggcgcgcgagcgcgggctgcgtgcgatcatcgcgggcgccggcggcgccgcgcatctgcccggcatgctggccgcgaaaaccacggtgccggtgctcggcgtgccggtcgccagcaagtacctgaagggcgtcgattcgctgcactcgatcgtgcagatgccgaagggcgtgccggtcgcgacgttcgcgatcggcgaggccggcgccgcgaacgccgcgctgttcgcggtgtcgatcctgtccggcacgtcggtcgactacgcgaaccggctcgccgcgttccgcgtgcgccagaacgaagccgcgcacgcgatggtgctgccgccgctcgcttga

SEQ ID NO: 13296 - protein, 173 aa, Burkholderia vietnamiensis G4
MTEVQTAHTHSAPLVGVLMGSSSDWDVMKNAVAILQEFGVPYEAKVVSAHRMPDEMFDYAEKARERGLRAIIAGAGGAAHLPGMLAAKTTVPVLGVPVASKYLKGVDSLHSIVQMPKGVPVATFAIGEAGAANAALFAVSILSGTSVDYANRLAAFRVRQNEAAHAMVLPPLA

SEQ ID NO: 13297 - DNA, 489 bp, Streptococcus pyogenes str. Manfredo
  CDS (1)..(489): transl_table=11
atgcaaccaattatttctattatcatgggctccaaatctgactgggcaaccatgcaaaaaacggctgaagttctagacaactttggcattgcttacgagaagaaagtcgtctctgctcaccgcacgcccgacctcatgttcaagtatgctgaggaagcacgtggtcgtggcatcaaaatcatcatcgcaggagcaggtggggcagctcacttgcctggtatggtggcagctaaaacaacgctgcctgttatcggtgtgcctgtcaaatcacgtgtcctttcaggtttggattcgctctattccattgtgcagatgcctggcggtgtgcctgtggcaaccatggctatcggagaagcgggagcgactaacgctgccctgacagccctccgtatcctttctatcgaggaccaaaatctggctgatgcgctagctcatttccatgaggaacaaggaaaaatcgcagaggagtcaagcaatgaactcatttaa

SEQ ID NO: 13298 - protein, 162 aa, Streptococcus pyogenes str. Manfredo
MQPIISIIMGSKSDWATMQKTAEVLDNFGIAYEKKVVSAHRTPDLMFKYAEEARGRGIKIIIAGAGGAAHLPGMVAAKTTLPVIGVPVKSRVLSGLDSLYSIVQMPGGVPVATMAIGEAGATNAALTALRILSIEDQNLADALAHFHEEQGKIAEESSNELI

SEQ ID NO: 13299 - DNA, 489 bp, Bradyrhizobium sp. ORS278
  CDS (1)..(489): transl_table=11
atgaccgccccgatcgccatcatcatgggaagccagtcggactgggataccatgcgccatgccgccgaaacactcggcgcgctgggcgtgagctatgacgcccgcatcgtctcggcccaccgcacgccggaccggctgtatgctttcgcgaaaggagccaaggcggccggattccaggtcgtgattgccggcgccggcggcgcagcccaccttcccggcatgacggcgtccctgaccgagctgcccgtgttcggcgttcccgtcgagtccaaggcgctgtccggggtcgattcgctgtattcgattgttcagatgcccgccggcattccggtcggcacgctcgccatcgggaagtccggcgcgatcaatgcggccctgctggcggcaagcgtcctggcgctgtcggacccggcgctggccgagcgtctctccgcctggcggcagtcgcagaccaacgccatcgccgaacgtccggagggcgcggcgtga

SEQ ID NO: 13300 - protein, 162 aa, Bradyrhizobium sp. ORS278
MTAPIAIIMGSQSDWDTMRHAAETLGALGVSYDARIVSAHRTPDRLYAFAKGAKAAGFQVVIAGAGGAAHLPGMTASLTELPVFGVPVESKALSGVDSLYSIVQMPAGIPVGTLAIGKSGAINAALLAASVLALSDPALAERLSAWRQSQTNAIAERPEGAA

SEQ ID NO: 13301 - DNA, 531 bp, Dichelobacter nodosus VCS1703A
  CDS (1)..(531): transl_table=11
atgactcaagcattagttggcattgtgatgggcagcgacagcgatttaaaaatcatggctgatgcggcaaaaatctgcaccacattccatattgattacgaattaaccattgtttccgcgcatcgcacgcccgaacgtttactcgattacggcaaaaccgctgccgaacgcggtttaaaagtgatcatcgccggcgccggcggcgcagcgcatttggcgggtatgttagcggcggtcacacctttgcccgttatcggcgtgccaattttgtcgcgcaattccattgacggctgggattcgattttatcaacgctacaaatgcctaacggcgtgcccgtggcaacggtagcgttaaatgcggcaaaaaatgcaggtttattggcggcaagaatgttagccgcacacgatgaacatttgttagctgccatgatcgcttatcaaaatcaaatgacggcagacgttttagaaaaagccgcgcgtttaaaagcggattatccctgcgcttacgcatcatcgccgcgcaatcgttaa

SEQ ID NO: 13302 - protein, 176 aa, Dichelobacter nodosus VCS1703A
MTQALVGIVMGSDSDLKIMADAAKICTTFHIDYELTIVSAHRTPERLLDYGKTAAERGLKVIIAGAGGAAHLAGMLAAVTPLPVIGVPILSRNSIDGWDSILSTLQMPNGVPVATVALNAAKNAGLLAARMLAAHDEHLLAAMIAYQNQMTADVLEKAARLKADYPCAYASSPRNR

SEQ ID NO: 13303 - DNA, 522 bp, Synechococcus sp. WH 7803
  CDS (1)..(522): transl_table=11
atgggcagtgattccgacctgccaacccttcacccagccgttgaggttctggaggggctccaggttgccgtggaggtgcgtgtgttgtcggcccatcgcacacctttggagatggtgaactttgcccgtgaggcccacaaccgcgggttgcaagtgatcgtggccggtgctggcggcgcggctcacttgccggggatggtggcgtctctgacgaccctgccggtgatcggcgtgccggtgcgcagcaccatgctctccggtgtggactccctgcattcgattgtgcagatgccgggtggtattcccgtggcgacggtcgccatcgggggcggactgaatgcaggactgctggcggcgcagattctggcgctccaagaccacgccttgatggagcgtctcggggcttatcgacgtcagctgcacgatgccgtgatcgcgaaggatcaacggctggtcgagctcggatcggcggcctatctggacaccacggccacaatgagagcaaaagacaacgccccatga

SEQ ID NO: 13304 - protein, 173 aa, Synechococcus sp. WH 7803
MGSDSDLPTLHPAVEVLEGLQVAVEVRVLSAHRTPLEMVNFAREAHNRGLQVIVAGAGGAAHLPGMVASLTTLPVIGVPVRSTMLSGVDSLHSIVQMPGGIPVATVAIGGGLNAGLLAAQILALQDHALMERLGAYRRQLHDAVIAKDQRLVELGSAAYLDTTATMRAKDNAP

SEQ ID NO: 13305 - DNA, 489 bp, Leptospira interrogans serovar Copenhageni str. Fiocruz L1-130
  CDS (1)..(489): transl_table=11
ttgaacacaaaagttgcaatcattatgggaagccattccgattgggaaacgatgaaagaagcggagatcattcttaaagaatttggcgtttctattcacaaagaaattgtttctgcacatagatctcctgagcttatgttagaattttctaaatctgcaaaagaaaaaggttactccgtaatcatcgcaggagcaggaggtgcggcccatcttcccggaatggttgcatcgatgactactcttcctgttttaggagttccaatacaaagtaaaactttaaacggattggatagtttattatccatcgttcaaatgccagggggagttccagtaggaactcttgcgatcggaactgcaggcgcaaaaaatgctggtttattggcagtcagaattcttgcacttcaagatcctatactttccgaaaaactagaacgatatcgtaatcaaattcgagaagacgcactttctaaaaataaggatttattgtga

SEQ ID NO: 13306 - protein, 162 aa, Leptospira interrogans serovar Copenhageni str. Fiocruz L1-130
MNTKVAIIMGSHSDWETMKEAEIILKEFGVSIHKEIVSAHRSPELMLEFSKSAKEKGYSVIIAGAGGAAHLPGMVASMTTLPVLGVPIQSKTLNGLDSLLSIVQMPGGVPVGTLAIGTAGAKNAGLLAVRILALQDPILSEKLERYRNQIREDALSKNKDLL

SEQ ID NO: 13307 - DNA, 495 bp, Thermus thermophilus HB27
  CDS (1)..(495): transl_table=11
atggcgccgttggtaggcctgatcatgggttcccgctccgactgggagaccatgcgccacgcggcggagaccctcgaggccctgggcatcccctacgaggtgcgcgtggtctccgcccaccgcaccccagacctcatggcggagtacgccaagaccgccgaggaacgggggatccaggtgatcatcgccggggccgggggggcggcccacctccccggcatgaccgcggcccacaccgccctgcccgtcctcggggtgccggtggaaagccgggccctagggggcctagactccctcctttccatcgtgcagatgcccgcgggcgtccccgtgggcaccctggccatcgggaaagcaggggcggtgaacgccgctttgcttgccgcaagcatcctgggcctcaagcaccccgagatcctaaagcgcctcaaggcctaccgcaaggcccagacggaggccgtcctcgcccaccccgaccccagggaggaggcgtga

SEQ ID NO: 13308 - protein, 164 aa, Thermus thermophilus HB27
MAPLVGLIMGSRSDWETMRHAAETLEALGIPYEVRVVSAHRTPDLMAEYAKTAEERGIQVIIAGAGGAAHLPGMTAAHTALPVLGVPVESRALGGLDSLLSIVQMPAGVPVGTLAIGKAGAVNAALLAASILGLKHPEILKRLKAYRKAQTEAVLAHPDPREEA

SEQ ID NO: 13309 - DNA, 489 bp, Listeria monocytogenes str. 4b F2365
  CDS (1)..(489): transl_table=11
atgcctgctgtaattggtgtcattatggggagtacctcagattgggatacaatgaaaaaagcatgtgatgtattagatgaattagaaatagcttatgagaaaaaagtggtttctgctcatcgtacaccagattttatgtttcaatatgcagaacaagcgcgggaacgtggtttgaaaattattattgccggtgctgggggcgcggcgcatttgccaggtatgattgcggcaaagacgactttgcctgttattggtgtgccaattaaatcaaaagcgttgaatggaatggattcgttactttctattgtacagatgcctggaggtgtcccggtagcgacagttgctattggagaaagtggtgctgtaaatgctggccttctagcggcgcaaattttatccataacggacgatgcaattactaacagattacaaaaaagacgtgctacactagaagaaacagttctagaaagtagtgattatcttggataa

SEQ ID NO: 13310 - protein, 162 aa, Listeria monocytogenes str. 4b F2365
MPAVIGVIMGSTSDWDTMKKACDVLDELEIAYEKKVVSAHRTPDFMFQYAEQARERGLKIIIAGAGGAAHLPGMIAAKTTLPVIGVPIKSKALNGMDSLLSIVQMPGGVPVATVAIGESGAVNAGLLAAQILSITDDAITNRLQKRRATLEETVLESSDYLG

SEQ ID NO: 13311 - DNA, 450 bp, Picrophilus torridus DSM 9790
  CDS (1)..(450): transl_table=11
atgggcagctcatctgatcttgaaaccatgaaacccgcaattgaaacccttgaatcatttggcgttgaggtcatatcaaaaatagtatcggcgcacagaaccccggattttatgtatgaatttgcaaaaggtgcattaaacaatggcatcgaggttattatagcaggtgcaggaggtgccgcgcatctgcccggaatggttgcatccatgacaacattgcctgtcataggcgttccggtgccatcgaggcatctaaacggcctcgattcattgctatcgatagtgcagatgccatcaggcgttccggttgcaaccgttgcaataggcaatgcaaaaaatgcggcattgctagcgctaagaatactgtcaataaagtatgataagataagatcgtatttagaaaaatataataatgatgaaagaaacagggttcttggtgaaaagatatga

SEQ ID NO: 13312 - protein, 149 aa, Picrophilus torridus DSM 9790
MGSSSDLETMKPAIETLESFGVEVISKIVSAHRTPDFMYEFAKGALNNGIEVIIAGAGGAAHLPGMVASMTTLPVIGVPVPSRHLNGLDSLLSIVQMPSGVPVATVAIGNAKNAALLALRILSIKYDKIRSYLEKYNNDERNRVLGEKI

SEQ ID NO: 13313 - DNA, 498 bp, Bartonella quintana str. Toulouse
  CDS (1)..(498): transl_table=11
atgacgaacgaatcatgtgacgtagcgattttaatgggtagccaatcggattggcaaacgatgcgccatagctcggatattttgacgtgtcttgatatttctcatagttcgcagattgtttcagcccaccgaacaccagaacgactttaccaatttgcaaaaggggcaaaagcagcaggttttaaagttttgatcgccggcgctggaggtgcagcccatcttcctggcatgctagcagcactgactccacttcctgtttttggagttccagtgcattcacaatttttatccggacaagattctttgctttcaattgtgcaaatgcctgcaggaataccggttggcacgctagcaattggcaaagcaggcgcaattaatgcagcgcttttagcagcagcagttatggcagtttatgatgatgatttggcacaacggttacaagattggcgtcagcaacaaacagccagtgtcgcgcaaatccccacaactgagatttaa

SEQ ID NO: 13314 - protein, 165 aa, Bartonella quintana str. Toulouse
MTNESCDVAILMGSQSDWQTMRHSSDILTCLDISHSSQIVSAHRTPERLYQFAKGAKAAGFKVLIAGAGGAAHLPGMLAALTPLPVFGVPVHSQFLSGQDSLLSIVQMPAGIPVGTLAIGKAGAINAALLAAAVMAVYDDDLAQRLQDWRQQQTASVAQIPTTEI

SEQ ID NO: 13315 - DNA, 498 bp, Bartonella henselae str. Houston-1
  CDS (1)..(498): transl_table=11
atgatgaaagaatcatgtgacgtagcgattttaatgggcagtcaatcggattggcaaacgatgcgccatagttcagatattttaacctgtcttggtatttctcatattgcacatattatctcagcccaccgaactcctgaacgactttaccaatttgcaaaaggagcaaaagcagcaggtttcaaagttttgattgccggagctggcggtgcagcgcatcttcctggtatgctagcagcactcacaccgcttcctgtttttggagttccagtgcactcacaatctctctctggtcaagattctttgctttcaattgtgcaaatgccggcaggaataccggttggcacgttagcaattggcaaagcaggagctattaatgcagcacttttagcagcagcagtaatggcagtttatgataatcatttggcacaacggttagacgattggcgtcagcaacaaacagccagtgtcgcgcaaacgcctgcaactgaggtttaa

SEQ ID NO: 13316 - protein, 165 aa, Bartonella henselae str. Houston-1
MMKESCDVAILMGSQSDWQTMRHSSDILTCLGISHIAHIISAHRTPERLYQFAKGAKAAGFKVLIAGAGGAAHLPGMLAALTPLPVFGVPVHSQSLSGQDSLLSIVQMPAGIPVGTLAIGKAGAINAALLAAAVMAVYDNHLAQRLDDWRQQQTASVAQTPATEV

SEQ ID NO: 13317 - DNA, 486 bp, Bacillus thuringiensis serovar konkukian str. 97-27
  CDS (1)..(486): transl_table=11
atgaaatcactagttggagtcataatgggaagcacgtcagactgggaaacaatgaaatatgcttgtgacattttagatgaattaaatataccgtatgagaaaaaggttgtatccgctcatcggactccagattatatgtttgaatatgcagagacggctcgtgaacgtggattgaaagttattattgctggagctggtggagcagcgcatttaccaggaatggttgcagcgaagacgaatcttcctgtaattggagttccagttcaatcaaaagcgttaaacggcttagattcattattatccatcgtccaaatgccaggaggggttccagttgcaactgttgcaattggtaaggctggttcaacaaatgctggtttacttgctgcacaaatacttggatcattccatgatgacatacatgatgcattagaattgagaagagaagcaattgaaaaagatgtgcgcgaaggtagtgagctagtatga

SEQ ID NO: 13318 - protein, 161 aa, Bacillus thuringiensis serovar konkukian str. 97-27
MKSLVGVIMGSTSDWETMKYACDILDELNIPYEKKVVSAHRTPDYMFEYAETARERGLKVIIAGAGGAAHLPGMVAAKTNLPVIGVPVQSKALNGLDSLLSIVQMPGGVPVATVAIGKAGSTNAGLLAAQILGSFHDDIHDALELRREAIEKDVREGSELV

SEQ ID NO: 13319 - DNA, 483 bp, Staphylococcus aureus subsp. aureus MRSA252
  CDS (1)..(483): transl_table=11
gtgaaagtagcagtcattatgggcagttcttccgattggaaaattatgcaagagagttgtaacatgttggattattttgaaattccgtacgaaaaacaagtagtatccgcacatcgtacgccaaaaacgatggttcaatttgcttctgaagcgagagaaagaggtatagacattatcattgcaggcgctggcggtgcggcacatttaccaggtatggttgcatcattaacgacgctaccagttattggagtgccgattgaaacaaaaagtttaaagggtatagattctttattatcaattgttcaaatgccaggaggtattccggttgcaacgactgcaattggtgcagcaggtgctaaaaatgcaggtatacttgcagcaagaatgttaagtattcaaaatccttctttagttgaaaaactaaatcagtatgaatcttcgttaattcaaaaagtggaggacatgcaaaatgaacttcaataa

SEQ ID NO: 13320 - protein, 160 aa, Staphylococcus aureus subsp. aureus MRSA252
MKVAVIMGSSSDWKIMQESCNMLDYFEIPYEKQVVSAHRTPKTMVQFASEARERGIDIIIAGAGGAAHLPGMVASLTTLPVIGVPIETKSLKGIDSLLSIVQMPGGIPVATTAIGAAGAKNAGILAARMLSIQNPSLVEKLNQYESSLIQKVEDMQNELQ

SEQ ID NO: 13321 - DNA, 516 bp, Acinetobacter sp. ADP1
  CDS (1)..(516): transl_table=11
atgaacgcggtcgcagcgaaagatgctcaacccttagtcggaattattatgggttctcaatcggattgggcaactctagaacatactgccaatatgttgaaacaacttggtgtaccttttgaagctgaagttgtttccgcacaccggacaccagaccgtttatttgaatacgcagaaactgcgcgtgaccgtggtattcaggtgatcattgcaggtgcaggtggtgccgcgcatttaccagggatgtgtgctgccaaaaccgatttacccgttttaggtgttcctgtgaaatcatcaattttaaatggtgtggattctttgctttcaattgtacaaatgcctgcaggtattgcagtgggtacattggcgataggccctgcgggtgcaaccaatgctgcgattatggcagcccagattcttggcttgacccgtccagagattgcaaaaaatgttgtagattttcgtgcggcccaaaccgacaaggttgctagcaataatattccaggccaagcgtga

SEQ ID NO: 13322 - protein, 171 aa, Acinetobacter sp. ADP1
MNAVAAKDAQPLVGIIMGSQSDWATLEHTANMLKQLGVPFEAEVVSAHRTPDRLFEYAETARDRGIQVIIAGAGGAAHLPGMCAAKTDLPVLGVPVKSSILNGVDSLLSIVQMPAGIAVGTLAIGPAGATNAAIMAAQILGLTRPEIAKNVVDFRAAQTDKVASNNIPGQA

SEQ ID NO: 13323 - DNA, 510 bp, Erwinia carotovora subsp. atroseptica SCRI1043
  CDS (1)..(510): transl_table=11
atgtcatccaacgttgccccggctaaaattgccatcgtcatgggttcaaagagtgactgggccactatgcagtttgctgcggaaatcctcaccacgctgaacattccttttcataccgaagtcgtttccgcacaccggacgccggataaactgttcagcttcgctgagcaggcggcacaaaatggttttgatgtgattatcgctggcgctggcggcgcagcacacctgccaggtatgctggcagcgaaaacgctggttcctgtgctcggcgtgccagtacaaagctcgacgctgagcggtgtcgacagcctgtattccatcgttcaaatgcctcgtggtatcccggtcggcacgttggcaatcggcaaggcaggcgcagcgaatgcggctctgctggccgcacaaattcttgccctgcatgacaatggaatagcctctcgactagccgactggcgtcaggcgcaaacggatgatgtgctgtctcatcccgatccgcgggaggaggcatga

SEQ ID NO: 13324 - protein, 169 aa, Erwinia carotovora subsp. atroseptica SCRI1043
MSSNVAPAKIAIVMGSKSDWATMQFAAEILTTLNIPFHTEVVSAHRTPDKLFSFAEQAAQNGFDVIIAGAGGAAHLPGMLAAKTLVPVLGVPVQSSTLSGVDSLYSIVQMPRGIPVGTLAIGKAGAANAALLAAQILALHDNGIASRLADWRQAQTDDVLSHPDPREEA

SEQ ID NO: 13325 - DNA, 591 bp, Propionibacterium acnes KPA171202
  CDS (1)..(591): transl_table=11
atgcctgagaccaccactgctagccgtaagccgcgccgaggtgagaaggtcaaaacaaccaccgggggagcacgccggctggcgtgcgacgccaatggccctcaagtgtcgatcatcatgggctcggactctgactggccgacgatggagcctgcggctcaggtgcttaccgacttcaatgtgggatttgaggctgacgtcgtgtcggcccaccgcatgcctgaggacatgatcgagttcggtcgaggcgcgcacaagcgcggtatcaaggtgatcatcgccggtgctggcggtgccgcccatctgccgggcatggtcgccgcgctgaccccgctgccggttatcggggttcccgtgccgctagcccacctcgacggtatggattccttgctatcgatcgttcagatgccaggtggtgtgccggtggcgacggtcggcgtcggtaatgccaagaacgccggcctgctagcggtacggattcttgccgcgtcgacccctgagctgtgcgaggccatggtcaagtaccagtccgatttgcacgatgtggctgcgggcaagggcgagaaagtgcgtcgtcactcctgtccctga

SEQ ID NO: 13326 - protein, 196 aa, Propionibacterium acnes KPA171202
MPETTTASRKPRRGEKVKTTTGGARRLACDANGPQVSIIMGSDSDWPTMEPAAQVLTDFNVGFEADVVSAHRMPEDMIEFGRGAHKRGIKVIIAGAGGAAHLPGMVAALTPLPVIGVPVPLAHLDGMDSLLSIVQMPGGVPVATVGVGNAKNAGLLAVRILAASTPELCEAMVKYQSDLHDVAAGKGEKVRRHSCP

SEQ ID NO: 13327 - DNA, 612 bp, Streptococcus pyogenes MGAS10394
  CDS (1)..(612): transl_table=11
atgctaaagcacctagtcgccctgacgtgggttcgtcttcgaaatcaaagatttcggacttaccgcatatttttctacggaaagtttcgacaagtcgaaacgcccctttatatcttaattatgaaaactccaattatttctattatcatgggctccaaatctgactgggcaaccatgcaaaaaacggctgaaattctagacaactttggcattgcttacgagaagaaagtcgtctctgctcaccgcacgcccgacctcatgttcaagcatgctgaggaagcacgtggtcgtggcatcaaaatcatcatcgcaggagcaggtggggcagctcacttgcctggtatggtggcagctaaaacaacgctgcctgttatcggtgtgccagtcaaatcacgtgtcctttcaggtttggattcgctctattccattgtgcagatgcctggcggtgtgcctgtggcaaccatggctatcggagaagcgggagcgactaacgctgccctaacagccctccgtatcctttctatcgaggaccaaaatctggctgatgcgctagctcatttccatgaggaacaaggaaaaatcgcagaggagtcaagcaatgaactcatttaa

SEQ ID NO: 13328 - protein, 203 aa, Streptococcus pyogenes MGAS10394
MLKHLVALTWVRLRNQRFRTYRIFFYGKFRQVETPLYILIMKTPIISIIMGSKSDWATMQKTAEILDNFGIAYEKKVVSAHRTPDLMFKHAEEARGRGIKIIIAGAGGAAHLPGMVAAKTTLPVIGVPVKSRVLSGLDSLYSIVQMPGGVPVATMAIGEAGATNAALTALRILSIEDQNLADALAHFHEEQGKIAEESSNELI

SEQ ID NO: 13329 - DNA, 504 bp, Leifsonia xyli subsp. xyli str. CTCB07
  CDS (1)..(504): transl_table=11
atgtccgttccacccccgcccttggtgtccgtcgtgatgggttccgactcggactggccggtgatgcaggaagcctcgcggctgctcgccgaattcggtgtcgcgcacgaggtcgaggtcgtctccgcccaccgcacgccggagaggatgatcggcttcggcaaggtcgcggcctcccgcggtgtccgtgtgatcatcgccggagcggggggagccgcccacctgcccgggatgctcgccgccgtcaccacgctgcccgtggtgggcgttcctgtgccgctggcccgtctcgatgggctcgactcgctgctctcgatcgtgcagatgccggcgggcgtgccggtcgcgaccgtctccatcggcggtgcgcgcaacgcgggtcttctggccgtgaagatcctcgccacggccgatcccaggctcgcgagcatgcttgagcgcttcgccgccgaactggaggcgagcgtcgacgagaagaaccgcgcactgcaagcgaagctatga

SEQ ID NO: 13330 - protein, 167 aa, Leifsonia xyli subsp. xyli str. CTCB07
MSVPPPPLVSVVMGSDSDWPVMQEASRLLAEFGVAHEVEVVSAHRTPERMIGFGKVAASRGVRVIIAGAGGAAHLPGMLAAVTTLPVVGVPVPLARLDGLDSLLSIVQMPAGVPVATVSIGGARNAGLLAVKILATADPRLASMLERFAAELEASVDEKNRALQAKL

SEQ ID NO: 13331 - DNA, 498 bp, Symbiobacterium thermophilum IAM 14863
  CDS (1)..(498): transl_table=11
atggcgcagacggagaggaccggaccgcttgtgggcatcatcatgggcagccgctcggacctggagaccatgcaggaggccgccgccgttctggacgagctcggcattccctacgagatgaaggtcgtctcggcccaccgcacacccgacgcgatgttcgcctacgccgagtcggccgcggcgcggggactgaaggtgatcatcgccggcgccggcggagccgcgcacctgccgggcatgaccgcgtccaagaccctccttccggtgatcggcgtgccggtgaagtcctcgaccctgaacgggatcgactcgctgctctccatcgtgcagatgcccgggggcgtgcctgtggcgaccatggccatcggcaaggccggcgcccgcaatgccgggctgctggcagcccagatcctcgccctggaggacccggggctgagggccatcctggaggagtaccgggcctacatgcggcagcaggtggaggagagccagccatga

SEQ ID NO: 13332 - protein, 165 aa, Symbiobacterium thermophilum IAM 14863
MAQTERTGPLVGIIMGSRSDLETMQEAAAVLDELGIPYEMKVVSAHRTPDAMFAYAESAAARGLKVIIAGAGGAAHLPGMTASKTLLPVIGVPVKSSTLNGIDSLLSIVQMPGGVPVATMAIGKAGARNAGLLAAQILALEDPGLRAILEEYRAYMRQQVEESQP

SEQ ID NO: 13333 - DNA, 498 bp, Mannheimia succiniciproducens MBEL55E
  CDS (1)..(498): transl_table=11
atgtcaaatactcatgctcaaattgcaattgttatgggttcgaaaagcgattggtcgaccatgcaggaagcgactggtatgcttgatcaactcaatgtgccttatcatgttgaaattgtttccgcacatcgcacgccggataaacttttcagctttgccgaaaatgcgcaagctaaaggatataaagtgattattgccggtgcaggcggcgccgcccatttaccgggcatgattgcggctaaaaccttagtacctgttttaggcgtgccggttaaaagctcaatgttaagcggtgttgacagtctctattctatcgtgcaaatgccgaaagggattcccgtagggacattagctatcggtcctgccggcgctgccaatgcaggcttacttgcggcgcagattttagccgcatgggacagtgaattgtccgctcgtctgcaaaaattccgcgaacagcaaaccaatgcggtgttaaacaatccggatccacgaaattaa

SEQ ID NO: 13334 - protein, 165 aa, Mannheimia succiniciproducens MBEL55E
MSNTHAQIAIVMGSKSDWSTMQEATGMLDQLNVPYHVEIVSAHRTPDKLFSFAENAQAKGYKVIIAGAGGAAHLPGMIAAKTLVPVLGVPVKSSMLSGVDSLYSIVQMPKGIPVGTLAIGPAGAANAGLLAAQILAAWDSELSARLQKFREQQTNAVLNNPDPRN

SEQ ID NO: 13335 - DNA, 489 bp, Bacillus licheniformis ATCC 14580
  CDS (1)..(489): transl_table=11
atgcagcctcttcttggtgttatcatgggaagcacatctgactgggaaacgatgaaacatgcctgcggcatactcgatgaactgggaattccgttcgaaaaaaaggtcgtttccgcacatcggacgcctgatttaatgtttgaatatgccgaaaaggctcgggaaagaggcttgaaagtcatcattgccggagcgggcggagccgctcacctgccgggaatggtcgcagccaaaacgacgctgcccgtcatcggtgtgccggttcagtcaaaagcgctgaacggtctcgattcgctgctttcaatcgttcaaatgccgggcggagtacccgttgcgaccgttgccatcggcaaagcgggagcggtcaacgcaggactgcttgcggcgcagattttgtcagcttttgacaaagagcttgccgaaagattggacgaacgaagggaaagcatcagacaaaccgtgttggaaagcagtgatcagcttgtataa

SEQ ID NO: 13336 - protein, 162 aa, Bacillus licheniformis ATCC 14580
MQPLLGVIMGSTSDWETMKHACGILDELGIPFEKKVVSAHRTPDLMFEYAEKARERGLKVIIAGAGGAAHLPGMVAAKTTLPVIGVPVQSKALNGLDSLLSIVQMPGGVPVATVAIGKAGAVNAGLLAAQILSAFDKELAERLDERRESIRQTVLESSDQLV

SEQ ID NO: 13337 - DNA, 501 bp, Legionella pneumophila subsp. pneumophila str. Philadelphia 1
  CDS (1)..(501): transl_table=11
atgaaacccattttaataggtctaattatgggttctcaaagtgattggcaaacattaatccatgccgcccacacactggatgcgctaaacattggctatgaggcagaaattgtctccgctcataggacaccggacaaacttttccggtatgccgaacaggctgaggcaagaggtttggaagtgattattgctggtgcaggaggagcggctcatctccctggcatggtagcagccaaaacatctttgcctgttttaggtgtcccagtcatgtcacaaactttaaacggcgtcgattccttgctatccattgtgcaaatgcctgcggggatacctgtaggcactttatcgataggtaaagcaggtgccatcaactccgcactgtttgcagccgcaattcttgctaataaatatcctgatattcgagctgccttaaaacactatagagaacaacaaacacaaaaagtgctcgacaatccaaaccctaaagaggaaaagtcatga

SEQ ID NO: 13338 - protein, 166 aa, Legionella pneumophila subsp. pneumophila str. Philadelphia 1
MKPILIGLIMGSQSDWQTLIHAAHTLDALNIGYEAEIVSAHRTPDKLFRYAEQAEARGLEVIIAGAGGAAHLPGMVAAKTSLPVLGVPVMSQTLNGVDSLLSIVQMPAGIPVGTLSIGKAGAINSALFAAAILANKYPDIRAALKHYREQQTQKVLDNPNPKEEKS

SEQ ID NO: 13339 - DNA, 489 bp, Methylococcus capsulatus str. Bath
  CDS (1)..(489): transl_table=11
atggttcaggtcggtatcgtgatggggagtaccagcgactgggaggtcatgcagcacgctgtccgcaagctcgaggagttcggtatcccctgcgaggccaaggtggtgtccgcccatcgtacgccggacctgttgttcgactatgcggaacgggcccggtcccgcggcctcaagtgcatcatcgccggtgcaggcggcgcggcccatctgcccggaatgatggcggccaagaccactgtgccggttttgggcgtaccggtgcccggcagacatctcggcgggcaggattcactgtattcgatcgtgcagatgcccaagggcgtgcccgtggcgacgtttgccatcggcgaggcgggagcggtcaacgccgcgctgttcgcggtggccctgctggcgaacggcgatccggccctgcagcttcgtctcgacgagttccgccggcatcaggccgaatccgtattggcggcacgattgccggaggtgccctga

SEQ ID NO: 13340 - protein, 162 aa, Methylococcus capsulatus str. Bath
MVQVGIVMGSTSDWEVMQHAVRKLEEFGIPCEAKVVSAHRTPDLLFDYAERARSRGLKCIIAGAGGAAHLPGMMAAKTTVPVLGVPVPGRHLGGQDSLYSIVQMPKGVPVATFAIGEAGAVNAALFAVALLANGDPALQLRLDEFRRHQAESVLAARLPEVP

SEQ ID NO: 13341 - DNA, 501 bp, Anaplasma marginale str. St. Maries
  CDS (1)..(501): transl_table=11
gtgagtaagagcggcgcgcgggtatcagtggtgatgggcagcaagtctgactttcccaccatgagcgctgcgacgtcggttttggatgagctgcgcattgaatttgaggtgatggtagtctcagcccacagaacaccagacaggctgtacgattttgcgaaaactgcgcacacgagaggaatcaaagttataatagccggcgcgggtggggcggcgcatttaccggggatggttgcctcgctaacgagcgttcctgtcataggtgtgcccgtaaagagcgagtgtttgaatggcctggatagcttgttgtctatagtacaaatgcctaaaggcaccccggtcgctactatgtctatcggagtagcgggggcggcaaatgccgccgtgtttgcggcatccatactagggctaagcgatgctggcgtgcagcacaggcttggggagtggaaggcgagtcttacagctgcggttgaggtgtcgccttttgagcggaagcattag

SEQ ID NO: 13342 - protein, 166 aa, Anaplasma marginale str. St. Maries
MSKSGARVSVVMGSKSDFPTMSAATSVLDELRIEFEVMVVSAHRTPDRLYDFAKTAHTRGIKVIIAGAGGAAHLPGMVASLTSVPVIGVPVKSECLNGLDSLLSIVQMPKGTPVATMSIGVAGAANAAVFAASILGLSDAGVQHRLGEWKASLTAAVEVSPFERKH

SEQ ID NO: 13343 - DNA, 495 bp, Azoarcus sp. EbN1
  CDS (1)..(495): transl_table=11
atgagcgacaagcccctcgtcgggatcatcatgggctcgaattccgactggccgacgatgcaggcggcggcgaagatgctcgccgaattcgacgtgccgtacgaggcccgcgtggtgtccgcccaccgcacgcccgacctgatgttcgtctatgctgacagcgcgcgcgaacgcggcctcaaggcgatcatcgccggcgcaggcggcgcggcccatctacccggcatggtcgcggcgaagacgacgctgcccgtgctcggcgtgccggtgcagtcgaaggcgctgtcggggcaggattcgctgctgtcgatcgtgcagatgccgaaaggcatcccggtcgcgactttcgcgatcggtgaagccggtgcggcaaatgcggcgcttttcgccatcgcgctgctcgccaacgaggataccgcgctcgccgaaaaactcgccgcgttccgcgcccgccagacgcaggcggtgctcgatatgaccctggacccgatatga

SEQ ID NO: 13344 - protein, 164 aa, Azoarcus sp. EbN1
MSDKPLVGIIMGSNSDWPTMQAAAKMLAEFDVPYEARVVSAHRTPDLMFVYADSARERGLKAIIAGAGGAAHLPGMVAAKTTLPVLGVPVQSKALSGQDSLLSIVQMPKGIPVATFAIGEAGAANAALFAIALLANEDTALAEKLAAFRARQTQAVLDMTLDPI

SEQ ID NO: 13345 - DNA, 489 bp, Silicibacter pomeroyi DSS-3
  CDS (1)..(489): transl_table=11
atggccggggtcaaggtagggatcatcatgggcagccagtcggactggccgaccatgaagggtgcagcggaaattctggatgagctgggcgtggcttacgaggcgcggatcgtctcggcgcatcgcaccccggaccggctgtgggactatggccgcgccgccgtggggcgcggcttgcaggtgatcatcgccggggccggcggggccgcgcatctgccgggcatgatggcgtccaagacgcgggtgccggtcattggcgtgccggtgcagacccgggcgctgtcgggggtcgattcgctttactccatcgtgcagatgcccaagggctatccggttgcgaccatggcgatcggcgcggcgggtgccgccaatgcggggctgatggcggccggcatcctcgccctgcaggacgcaggcctggccgaacggctggacgcctggcgcgcggcgctttctgcctcgatccccgaggagccggtcgatgagtga

SEQ ID NO: 13346 - protein, 162 aa, Silicibacter pomeroyi DSS-3
MAGVKVGIIMGSQSDWPTMKGAAEILDELGVAYEARIVSAHRTPDRLWDYGRAAVGRGLQVIIAGAGGAAHLPGMMASKTRVPVIGVPVQTRALSGVDSLYSIVQMPKGYPVATMAIGAAGAANAGLMAAGILALQDAGLAERLDAWRAALSASIPEEPVDE

SEQ ID NO: 13347 - DNA, 492 bp, Bacillus clausii KSM-K16
  CDS (1)..(492): transl_table=11
atgaaacagccgattgtcggcatcattatgggcagtacttctgattgggaaacgatgcgccatgccagtgagattttagacgaacttggcgttccttatgaaaaaaaagtcgtgtccgcccaccgtactcctgattatatgtttgaatacgcggaacaagcggaagagcgtgggcttcgtgtcattattgcaggggcagggggagcggcccatttgccaggaatggtcgcggcaaagacgcttcttccagtcattggcgttcctgttgaatcacgtgccttaaaagggttggactccttgttgtcgattgtgcaaatgccaggaggagtacctgtggctactgtggcaattggcaaagcaggtgcaaccaatgcagcgcttttggctgcgcaaatgattgcaacaacggacaaggtcttgcaacaacgattggcaacgcgccgtgaacgcattaaaaagaccgttctagaaagcagtggtgaactcgtatga

SEQ ID NO: 13348 - protein, 163 aa, Bacillus clausii KSM-K16
MKQPIVGIIMGSTSDWETMRHASEILDELGVPYEKKVVSAHRTPDYMFEYAEQAEERGLRVIIAGAGGAAHLPGMVAAKTLLPVIGVPVESRALKGLDSLLSIVQMPGGVPVATVAIGKAGATNAALLAAQMIATTDKVLQQRLATRRERIKKTVLESSGELV

SEQ ID NO: 13349 - DNA, 465 bp, Dehalococcoides ethenogenes 195
  CDS (1)..(465): transl_table=11
atgccgctagtaagtattgtaatgggctctaaatctgatgccgaggttatgaaacctactgaggaaatactggagaaaatgggcatttcttttgagacgctggttatgtctgctcaccgtactcccgaaaaagtgcaggagttttgtctgggtgcgtccgcacggggggttgaactggttatagctgccgctgggggggcagcccatttgccgggagtaattgccagctggctgacactgccggttataggcgtaccggtggcttcaggtgaactcaaaggggttgatgccctttattccatagtccagatgcccgccggtataccggtagcaaccgtagctatcggagcggccggtgccaagaatgcggcttatctggcggctgaaatactgggtttaaaatatcaaaatatccgtcaggcttatgaaagctaccgtcgggaactaaaaggtgagaacaaatga

SEQ ID NO: 13350 - protein, 154 aa, Dehalococcoides ethenogenes 195
MPLVSIVMGSKSDAEVMKPTEEILEKMGISFETLVMSAHRTPEKVQEFCLGASARGVELVIAAAGGAAHLPGVIASWLTLPVIGVPVASGELKGVDALYSIVQMPAGIPVATVAIGAAGAKNAAYLAAEILGLKYQNIRQAYESYRRELKGENK

SEQ ID NO: 13351 - DNA, 525 bp, Thermococcus kodakarensis KOD1
  CDS (1)..(525): transl_table=11
atgcccaaagtgggaataataatgggtagcgactccgacctcccggtcatgaaggccgcggccgaggtgctcgaggagttcggtgttgactacgagataaccatagtttcagcccacagaacccccgagaggatgttcgagtacgccaaaacggcagaagaaagggggatagaggtaataatagccggagctggaggtgccgcccaccttccgggcatgacggcatccataaccacgctccctgtgataggagtccccgtaaagacatccacgctgaacgggcttgactcgctcctctccatagtccagatgccgaggggagtgcccgttgcaaccgtcgccataaacaacgccaagaacgcggccctgctggccctctcaatcctcggggtgaagtacccggagataagggagaagctcaaggagtacaggaggaggatgagggaagaagtggaggagaaggcggagaggcttgaggagatgggctacgaggagtacctccaagtgacagggcaaggaaagtga

SEQ ID NO: 13352 - protein, 174 aa, Thermococcus kodakarensis KOD1
MPKVGIIMGSDSDLPVMKAAAEVLEEFGVDYEITIVSAHRTPERMFEYAKTAEERGIEVIIAGAGGAAHLPGMTASITTLPVIGVPVKTSTLNGLDSLLSIVQMPRGVPVATVAINNAKNAALLALSILGVKYPEIREKLKEYRRRMREEVEEKAERLEEMGYEEYLQVTGQGK

SEQ ID NO: 13353 - DNA, 483 bp, Staphylococcus epidermidis RP62A
  CDS (1)..(483): transl_table=11
gtgaaagtagcagtcattatgggcagttcctcagattggaaaattatgaaagaaagttgttcgatgcttgaagaatttgaaataccgtacgaaaagaaagtcgtttcagctcatcgtacgcctcaaatgatgttcaatttcgctagtcaagcacgccaaaatggttttgatattatcattgccggtgcagggggagcagcacacttacctggaatggtagcttccatgacaacattacctgtgattggtgtgccaattgaatctaaaagtctaaaaggattagattcattactatctatcgtccaaatgcctggtggtatcccagttgcaaccacagcaattggaaaatcaggtgctaaaaatgctgggatattagcggcaagaatgttaggaataacaaatgaatcagttcaaaataatttggaaaattatgaaaaatatttagtcgcaaaagtggaggaaatgcaaaatgaacttcagtaa

SEQ ID NO: 13354 - protein, 160 aa, Staphylococcus epidermidis RP62A
MKVAVIMGSSSDWKIMKESCSMLEEFEIPYEKKVVSAHRTPQMMFNFASQARQNGFDIIIAGAGGAAHLPGMVASMTTLPVIGVPIESKSLKGLDSLLSIVQMPGGIPVATTAIGKSGAKNAGILAARMLGITNESVQNNLENYEKYLVAKVEEMQNELQ

SEQ ID NO: 13355 - DNA, 513 bp, Ehrlichia ruminantium str. Welgevonden
  CDS (1)..(513): transl_table=11
atgtcgattaacgaagatattgccgatgttgcagtaattatgggaagccaatcagattttccaacaatgaataattcaatatcaatactggaagaattaaacatcagctataaaacaatgatcatatctgctcatagaacaccagaaagactctatacatttgcaaaatcagcagaaacaaatggattcaaaataattatcgctggagcaggaggcgcagctcatctaccaggattagtagcgtctttaacatatcttcccgtaataggagttccaataaaaagcagcaatcttaatggaatagatagtttactatcaatagtacagatgccaaaaggaatacctgtagcaacaatgtcaataggatcttcaggaggatataatgcagcaataatggcagcttctattctagctttatcgaataacataataaaaacaaacttacaaatatggagagataacttatctgcttctgtaaaactattaccagatacatctttgcagacttcataa

SEQ ID NO: 13356 - protein, 170 aa, Ehrlichia ruminantium str. Welgevonden
MSINEDIADVAVIMGSQSDFPTMNNSISILEELNISYKTMIISAHRTPERLYTFAKSAETNGFKIIIAGAGGAAHLPGLVASLTYLPVIGVPIKSSNLNGIDSLLSIVQMPKGIPVATMSIGSSGGYNAAIMAASILALSNNIIKTNLQIWRDNLSASVKLLPDTSLQTS

SEQ ID NO: 13357 - DNA, 486 bp, Neisseria gonorrhoeae FA 1090
  CDS (1)..(486): transl_table=11
atgatacaaatcggcatcatcatgggcagcaacagcgattggcccgttatgcggcaggcagcgcagtttcttgaagagttcggcgtagaatatgaggcgcgcgtcgtttccgcacaccgcactccggatttgatgtttgaatacgccgaaaccgcacgggcgcgcggcatcaaagccatcatcgcgggtgcgggcggcgcggcgcatttacccggcatggttgccgccaagaccaccgtccccgttttgggcgtacccgtcccaagcaaatacctgcgcggcgaagattcgcttttatcgattgtacaaatgcccaaaggcgtacccgtcgccacattcgccatcggcgaggcaggcgcggcaaatgccgcattgttcgccatctccatgctcgccaacgaaaaccccgaactggcgcaaaaactggcagacttccgagccaaacaggaacaaaccgttttaaacatggaattggaacagatttaa

SEQ ID NO: 13358 - protein, 161 aa, Neisseria gonorrhoeae FA 1090
MIQIGIIMGSNSDWPVMRQAAQFLEEFGVEYEARVVSAHRTPDLMFEYAETARARGIKAIIAGAGGAAHLPGMVAAKTTVPVLGVPVPSKYLRGEDSLLSIVQMPKGVPVATFAIGEAGAANAALFAISMLANENPELAQKLADFRAKQEQTVLNMELEQI

SEQ ID NO: 13359 - DNA, 507 bp, Bacteroides fragilis NCTC 9343
  CDS (1)..(507): transl_table=11
atgactccaatcgtaagcattatcatgggtagcacttccgaccttcctgtcatggaaaaggccgcacagttgctcaacgatctccatgtaccgttcgaaatgaacgccctctcggctcaccgcactcccgaagctgtggaagagtttgccaagaatgcccgctcacgcggcattaaagtaattattgctgctgccggtatggctgcccatctgccgggcgtgattgccgcatcgaccccgcttccggtcatcggtgtacccatcaaatcgtctcttgacggaatggacgcccttctggcgatcgtacagatgcctccggggattcctgtagcgactgtgggtatcaatggcgcactgaacgccgccatccttgccgtacaaatgctttcattggaagataaagaactcgaaacaaaattcatagcctataaagaaggactgaaaaagaaaatcgtaaaggctaacgaagaactgaaagaaattaagtacgagtttaaaacaaactaa

SEQ ID NO: 13360 - protein, 168 aa, Bacteroides fragilis NCTC 9343
MTPIVSIIMGSTSDLPVMEKAAQLLNDLHVPFEMNALSAHRTPEAVEEFAKNARSRGIKVIIAAAGMAAHLPGVIAASTPLPVIGVPIKSSLDGMDALLAIVQMPPGIPVATVGINGALNAAILAVQMLSLEDKELETKFIAYKEGLKKKIVKANEELKEIKYEFKTN

SEQ ID NO: 13361 - DNA, 492 bp, Pseudomonas syringae pv. syringae B728a
  CDS (1)..(492): transl_table=11
atgagcgcactggttggcgtgatcatgggctccaagtccgattggtccacccttagccacaccgccgatatgctggaaaagctcggcatcccttttgaagtcaaggtggtgtcagctcaccgcacaccggatctgctgtttcagtacgccgacgaagcggaaggccgtggcattgaagtgatcatcgccggtgccggcggtgccgctcacttgccgggcatgtgcgctgccaagacccacctgcctgtgctgggcgttccggtgcagtcttcgatgctttcgggggtcgattcgctgttgtcgatcgtgcagatgccggccggtatcccggtcgcgaccctggccatcggcaaggcgggtgcaatcaacgcagcgctgctttcagccagcatccttggcgcaaagcacccgcaattccacgcagcgctgaagaaatttcgcactgaacagacagacagcgtcctggataatccagacccacgccacgcctga

SEQ ID NO: 13362 - protein, 163 aa, Pseudomonas syringae pv. syringae B728a
MSALVGVIMGSKSDWSTLSHTADMLEKLGIPFEVKVVSAHRTPDLLFQYADEAEGRGIEVIIAGAGGAAHLPGMCAAKTHLPVLGVPVQSSMLSGVDSLLSIVQMPAGIPVATLAIGKAGAINAALLSASILGAKHPQFHAALKKFRTEQTDSVLDNPDPRHA

SEQ ID NO: 13363 - DNA, 495 bp, Haemophilus influenzae 86-028NP
  CDS (1)..(495): transl_table=11
atgtcaaaaactgcacaaattgctgttgtgatgggttccaaaagcgattgggctaccatgcaagaggcaactcagattttagatgaattaaaagtaccttatcatgtggaaatcgtctctgctcatcgtacgcctgataaactttttgaatttgctgaaaatgcacaaaaaaatggctataaagtaattattgctggggctggcggtgcggcacatttacccggcatgatcgcagccaaaacccttgtgcctgtgctgggtgtgccagtaaaaagttctatgttaagtggcgtagatagcctttattcaattgtgcaaatgccaaaaggaatcccagtcggaacattggctattggccctgcgggtgcggcaaatgctggattgttagccgcacaaattctagcaagttgggatgcagaattgctttcacgcttgcaatctttccgtgaaagccaaacgagtaatgtgcttgataatcccgatccacgcacataa

SEQ ID NO: 13364 - protein, 164 aa, Haemophilus influenzae 86-028NP
MSKTAQIAVVMGSKSDWATMQEATQILDELKVPYHVEIVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILASWDAELLSRLQSFRESQTSNVLDNPDPRT

SEQ ID NO: 13365 - DNA, 492 bp, Pseudomonas fluorescens Pf-5
  CDS (1)..(492): transl_table=11
atgagtgcactggttggcgtgatcatgggctccaagtccgattggtccacccttagccacaccgccgatatgctggaaaagctcggcatcccttacgaggtgaaggtggtttccgcacaccgcaccccggacctgctgttccagtacgccgatgaggctgaggcgcgaggcatcgaggtgatcatcgccggtgccggcggcgcggcgcacctgccgggcatgtgcgcggccaagacccacctgccggtgctgggcgtgccggtgcagtcgtcgatgctctcaggcgtggattcgctgctgtccatcgtgcagatgccggccggcatccccgtggccaccctggccatcggcaaggccggcgcgatcaacgcggcgctgctctcggcgagcatcctgggcgccaagcacccgcagttccatgcggtgctgaaaaaattccgtgctgaacagacagacagcgtcctggacaatccagacccgcgcgtcgcctga

SEQ ID NO: 13366 - protein, 163 aa, Pseudomonas fluorescens Pf-5
MSALVGVIMGSKSDWSTLSHTADMLEKLGIPYEVKVVSAHRTPDLLFQYADEAEARGIEVIIAGAGGAAHLPGMCAAKTHLPVLGVPVQSSMLSGVDSLLSIVQMPAGIPVATLAIGKAGAINAALLSASILGAKHPQFHAVLKKFRAEQTDSVLDNPDPRVA

SEQ ID NO: 13367 - DNA, 561 bp, Psychrobacter arcticus 273-4
  CDS (1)..(561): transl_table=11
atgagcaccacatcagcgactgttaacgctattgatcagaacggacctattacctcgcctgctggtcaaccaaaagttggtattatcatgggctcacaatctgactgggcgaccatgagcgcggcggcacaattgcttgcagactttgatatcgcctttgaatgtgaagtagtatcagcgcaccgtacgcctgatagattgtttgattatgccaaaagtgcaaaaggtaacggcttacaagtgattatcgctggtgccggtggtgccgcccacctacctggtatgtgcgccagtcaaacgccgctacctgtttttggtgtccccgtaaaatcttctatgctgagtggttgggacagcttactttctatcgttcagatgcctaaaggcgtggcagttggaacgttagcgattggatccgctggtgcttataatgctgcactgcttgccatccaagtgttggcattacatgatgaatcgattgcgactaagcttggccatctgcgtcatacccaaactaataccattcttgccagtccaatacccggtattatcaatccttaa

SEQ ID NO: 13368 - protein, 186 aa, Psychrobacter arcticus 273-4
MSTTSATVNAIDQNGPITSPAGQPKVGIIMGSQSDWATMSAAAQLLADFDIAFECEVVSAHRTPDRLFDYAKSAKGNGLQVIIAGAGGAAHLPGMCASQTPLPVFGVPVKSSMLSGWDSLLSIVQMPKGVAVGTLAIGSAGAYNAALLAIQVLALHDESIATKLGHLRHTQTNTILASPIPGIINP

SEQ ID NO: 13369 - DNA, 483 bp, Colwellia psychrerythraea 34H
  CDS (1)..(483): transl_table=11
atgacagtcggtatcatcatgggatcaaaatcagattggccaacaatgcagcatacagcagaaatgcttgattctttaggtgtacagtacgaaaccaaagtagtttctgcacaccgtactcctcacttacttgctgagtatgctgaaagtgcaaaagatagaggtattaaggtaattattgcaggcgctggtggtgcagctcatttaccaggtatggccgcagcttatacttctttacctgttttaggtgtgccagtgcaatctaaagcgcttaatggacaagattctttattatctattgtgcaaatgccaaaaggtattgcagtaggtacattggccatcggcaatgccggtgctgccaacgcaggtttacttgcagcacaaattattggcactcataacactgagatccaacaaaatatcgaagagtttcgtcgaaagcagacagaaaccatacttgctaacccaaacccggcagaataa

SEQ ID NO: 13370 - protein, 160 aa, Colwellia psychrerythraea 34H
MTVGIIMGSKSDWPTMQHTAEMLDSLGVQYETKVVSAHRTPHLLAEYAESAKDRGIKVIIAGAGGAAHLPGMAAAYTSLPVLGVPVQSKALNGQDSLLSIVQMPKGIAVGTLAIGNAGAANAGLLAAQIIGTHNTEIQQNIEEFRRKQTETILANPNPAE

SEQ ID NO: 13371 - DNA, 648 bp, Pseudomonas syringae pv. phaseolicola 1448A
  CDS (1)..(648): transl_table=11
gtgatcgcaggtgctttaaactcaccactttgcggtatactgcgcggcctttggccggctaaatcggtcactattcgtacaacaagccacgccggttcccctgcgtggcttgttgttttcagacgcgcctgcgggcgcccgatgagaggcacgacgatgagcgcactggttggcgtgatcatgggctccaagtccgattggtccacccttagccacactgccgacatgctggaaaagctcggcatcccttatgaagtcaaggtggtgtcagctcaccgcacgccggacctgctgttccagtacgccgacgaagcagagggccgtggcattgaagtgatcatcgccggtgctggcggtgctgctcacttgcctggcatgtgtgccgccaagacccacctgcctgtgctgggcgttccggtgcagtcgtcgatgctgtcgggggtcgactccctgctgtcgatcgtgcagatgcctgcgggtattccggtagcgaccctggccatcggcaaagcgggggcgatcaacgctgcgctgctttcggccagtatcctgggcgccaaacaccctcaattccacgcagcgctgaagaaattccgcgctgagcagacagacagcgtcctggacaatccagacccacgccacgcctga

SEQ ID NO: 13372 - protein, 215 aa, Pseudomonas syringae pv. phaseolicola 1448A
MIAGALNSPLCGILRGLWPAKSVTIRTTSHAGSPAWLVVFRRACGRPMRGTTMSALVGVIMGSKSDWSTLSHTADMLEKLGIPYEVKVVSAHRTPDLLFQYADEAEGRGIEVIIAGAGGAAHLPGMCAAKTHLPVLGVPVQSSMLSGVDSLLSIVQMPAGIPVATLAIGKAGAINAALLSASILGAKHPQFHAALKKFRAEQTDSVLDNPDPRHA

SEQ ID NO: 13373 - DNA, 501 bp, Dechloromonas aromatica RCB
  CDS (1)..(501): transl_table=11
atgaacgccgtgcaacaacccgtcgtcggtatcgtcatgggttccgattccgactggccgaccatgcaggccgccgccgtcatcctcaaggatttcggcgtgcccttcgaggcccgtgtcgtttccgctcaccgcaccccggatctgctattcgattacgccgccatggctggcgagcgtggcctcaaggcaatcattgccggggccggcggtgccgcccacctgccgggcatgctggccgccaagaccatcgtgccggtgctcggcgtgccggtgcaatcgaaagccctgtccggtgtcgattcgctgcattccatcgtccagatgccgaagggtattcccgtcgccaccttcgccatcggtgaagccggtgccgccaatgcagcactgtttgccgttgccatgctggccaacgagaacccggcgttgaatgccaagctgcaggccttccgccaggctcagaccgaaaaggtcctggccatgaaactccccggggtttaa

SEQ ID NO: 13374 - protein, 166 aa, Dechloromonas aromatica RCB
MNAVQQPVVGIVMGSDSDWPTMQAAAVILKDFGVPFEARVVSAHRTPDLLFDYAAMAGERGLKAIIAGAGGAAHLPGMLAAKTIVPVLGVPVQSKALSGVDSLHSIVQMPKGIPVATFAIGEAGAANAALFAVAMLANENPALNAKLQAFRQAQTEKVLAMKLPGV

SEQ ID NO: 13375 - DNA, 534 bp, Thermobifida fusca YX
  CDS (1)..(534): transl_table=11
gtgagccagagcccgcccgccgtcggcatcgtgatgggaagcgactccgactggccgttcatggaagaggcagccgaggcactggacgagttcagtgtcccctacgaggttgacgtggtctcggcgcaccggatgccgcacgagatgatcgcctacggctcccaggcagcggagcggggcctgaaagtcctcattgccggggccggcggggcagcccacctgccgggcatgctcgcctcggtcactccgctgccggtcatcggggtgccggtcccgctgaagtacctcgacgggctcgactcgctgctgtccatcgtgcagatgcccgcgggagtcccggtggccacggtggcggtgggcgcggcccgcaatgcgggcctgctggcagtgcggatcctcggcgcccacgacgaggagctgcgcgcgaagatggccgacttccaggacgacctcaaccagcaggccaaagccaagggggagcggctgcgccgcaaactcacggaaggctcctcgttcggcttcggcgcccgctga

SEQ ID NO: 13376 - protein, 177 aa, Thermobifida fusca YX
MSQSPPAVGIVMGSDSDWPFMEEAAEALDEFSVPYEVDVVSAHRMPHEMIAYGSQAAERGLKVLIAGAGGAAHLPGMLASVTPLPVIGVPVPLKYLDGLDSLLSIVQMPAGVPVATVAVGAARNAGLLAVRILGAHDEELRAKMADFQDDLNQQAKAKGERLRRKLTEGSSFGFGAR

SEQ ID NO: 13377 - DNA, 498 bp, Ralstonia eutropha JMP134
  CDS (1)..(498): transl_table=11
gtgagcaagcaagaaaagccggtcgtcggcgtcgtaatgggcagcagttccgactgggacgtgatgcagcacgccgtggccatgctgaaggatttcggcgtgccgttcgaggcacaggtcgtttcggcgcaccgcatggccgacgacatgttccgctatgcggagaccgcgcgcagccgtggcatccgcgcgatcatcgccggtgccggcggtgccgcgcatctgccgggcatgatcgccgccaagaccatcgtgccggtgttcggcgtgccggtgccgtccaagtacctgcgcggcgaggactcgctgctgtcgatcgtgcagatgcccaagggcgtgcccgtcgcgacgttcgcgatcggcgaagccggcgcggccaatgcggcgctgcatgcgatcgccacgctggccaccaccgacgacgcgctggccagcgcgctggaagcattccgcgccaggcagaccgaagccgcgcgcgcgatgacgctgccgctgtaa

SEQ ID NO: 13378 - protein, 165 aa, Ralstonia eutropha JMP134
MSKQEKPVVGVVMGSSSDWDVMQHAVAMLKDFGVPFEAQVVSAHRMADDMFRYAETARSRGIRAIIAGAGGAAHLPGMIAAKTIVPVFGVPVPSKYLRGEDSLLSIVQMPKGVPVATFAIGEAGAANAALHAIATLATTDDALASALEAFRARQTEAARAMTLPL

SEQ ID NO: 13379 - DNA, 504 bp, Ehrlichia canis str. Jake
  CDS (1)..(504): transl_table=11
atgtcaattaatcaaaacacagtagacgtcgcagtaatcatgggaagtcaatcagattttccaacaatgaataattcgatctcaatactaaaagaactcaatataacacacaaagtaatgattatatctgcacatagaacaccagacaggctttacacatttgcaaaatctgcagaagacaatgggtttaaagtaattatagcaggagcaggaggagcagcgcatttaccaggattagtagcatctttaacacatataccagttataggggtaccaataaaaagtagtaatttaaacggaatagatagcttgctatcaatagtacaaatgcccaaaggaatacctgttgcaacaatgtccataggatcatcaggagcatacaacgcagctatcatagcagcatctattttatctttagaaaatgatattatcaaagacaatctaaaaacatggagaaaaaatctatctgattcagtaaaactgataccagacacatcactataa

SEQ ID NO: 13380 - protein, 167 aa, Ehrlichia canis str. Jake
MSINQNTVDVAVIMGSQSDFPTMNNSISILKELNITHKVMIISAHRTPDRLYTFAKSAEDNGFKVIIAGAGGAAHLPGLVASLTHIPVIGVPIKSSNLNGIDSLLSIVQMPKGIPVATMSIGSSGAYNAAIIAASILSLENDIIKDNLKTWRKNLSDSVKLIPDTSL

SEQ ID NO: 13381 - DNA, 465 bp, Dehalococcoides sp. CBDB1
  CDS (1)..(465): transl_table=11
atgccattagttagtattgttatggggtccaagtctgacgccgagtttatgaagcccactgaagaaatactggagaaaatggctatttcttttgaaactctggttatgtctgcccatcgtactccggaaaaagtgcaggagttttgtttgaatgcacctgaccgggggattgaactgattatagctgctgccgggggcgcagcgcatctgccgggggtaattgccagctgggtaacactgccggttattggtgtccctattgcttccagtgaactcaaaggagttgacgccctgtactctatagtccagatgccggccggtataccggtagctacagtagctattggtgctgcgggtgctaaaaatgcggcttatctggcggccgaaattctgggtttaaaatatcaaaatatccgtcaggcttacgtaagctaccgtcaggaactaaaaggtgaaaacaaatga

SEQ ID NO: 13382 - protein, 154 aa, Dehalococcoides sp. CBDB1
MPLVSIVMGSKSDAEFMKPTEEILEKMAISFETLVMSAHRTPEKVQEFCLNAPDRGIELIIAAAGGAAHLPGVIASWVTLPVIGVPIASSELKGVDALYSIVQMPAGIPVATVAIGAAGAKNAAYLAAEILGLKYQNIRQAYVSYRQELKGENK

SEQ ID NO: 13383 - DNA, 498 bp, Thiobacillus denitrificans ATCC 25259
  CDS (1)..(498): transl_table=11
atgatgagcgcgcctgaggtaggggtggtgatgggatcttccagcgactgggaggtgatgaagcatgcggcgattctgctcaagcagctcggcatccacttcgaaaccaaggtggtgtcggcgcaccgtacccccgacctgctctacgaatacgcggcgagcgccgaggcgcgcggcatcaaggcgatcatcgcgggcgcgggcggcgcggcgcacctgccgggcatgatcgcggcgaagacgatcgttccggtgctcggcgtgccggtgccgtcgaaatatctcaagggcgtcgattcgctgctctcgatcgtgcagatgccgcgcggcatcccggtcgcgaccttcgcgatcggcgaggccggcgccgccaacgccgcgctcttcgcggcggcgctgatcgcgcgcgccgaccccggcctcgcggcgcagctcaacgaattccgccgcggccagtccgattcggtgctcgcgatggagctgcccgatgtcgaatga

SEQ ID NO: 13384 - protein, 165 aa, Thiobacillus denitrificans ATCC 25259
MMSAPEVGVVMGSSSDWEVMKHAAILLKQLGIHFETKVVSAHRTPDLLYEYAASAEARGIKAIIAGAGGAAHLPGMIAAKTIVPVLGVPVPSKYLKGVDSLLSIVQMPRGIPVATFAIGEAGAANAALFAAALIARADPGLAAQLNEFRRGQSDSVLAMELPDVE

SEQ ID NO: 13385 - DNA, 528 bp, Anabaena variabilis ATCC 29413
  CDS (1)..(528): transl_table=11
atggctcccttagttggcattattatgggtagcgattcagatttgcccacgatgaaagaggcgatcgctatttgtgaggaatttggtgtagaaaatgaagtggcgatcgtttctgcccatcgcaccccagaacgtatggtggaatatgcccaaacagcccaccatcggggtatcaaggtgattattgctggtgcaggcggtgcagcccatcttcccggcatggtagcatctttaactcctctaccagtaattggtgtgccagtcgctaccagaaacttacaaggtgtggattctttatattcaattgtacagatgcctgggggtattcctgtggctacggtggcgatcggtaacgccaaaaatgccggactattggctgtgcaaatcctcgctactcaacagccagaattattaactaaagtccaagcataccgtcaaaacctatctgactcagtaatgacaaagcaagcaaagttagaacaactaggttacaagcagtatttgcaacaggagatgcttggaaaataa

SEQ ID NO: 13386 - protein, 175 aa, Anabaena variabilis ATCC 29413
MAPLVGIIMGSDSDLPTMKEAIAICEEFGVENEVAIVSAHRTPERMVEYAQTAHHRGIKVIIAGAGGAAHLPGMVASLTPLPVIGVPVATRNLQGVDSLYSIVQMPGGIPVATVAIGNAKNAGLLAVQILATQQPELLTKVQAYRQNLSDSVMTKQAKLEQLGYKQYLQQEMLGK

SEQ ID NO: 13387 - DNA, 489 bp, Streptococcus agalactiae A909
  CDS (1)..(489): transl_table=11
atgcaaccaattatttctattatcatgggatccaaatctgactggacaaccatgcaaaaaacggctgaagttctagataactttggcattgcttacgagaagaaagtcgtctctgcccaccgcacaccagacctcatgttcaagcatgctgaggaagcacgtgaccgtggcatcaaaatcatcatcgctggtgcaggtggagcagctcacttgcctggtatggtggcagctaaaacaacgctacctgttatcggtgtgcctgtcaaatcacgtgctctttcaggtttggattcgctctattccattgtgcagatgcctggcggtgtgcctgtggcaaccatggctatcggagaagcgggagcgactaacgctgccctgacagccctccgtatcctctctatcgaagaccaaaatttggctgatgcgctagctcatttccatgaggaacaaggaaaaatcgcagaggagtcaagcaatgaactcatttaa

SEQ ID NO: 13388 - protein, 162 aa, Streptococcus agalactiae A909
MQPIISIIMGSKSDWTTMQKTAEVLDNFGIAYEKKVVSAHRTPDLMFKHAEEARDRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSNELI

SEQ ID NO: 13389 - DNA, 492 bp, Pseudomonas fluorescens PfO-1
  CDS (1)..(492): transl_table=11
atgagtgcactggttggcgtgatcatgggctccaagtccgattggtccacccttagccacaccgccgatatgctggaaaagctcggcatcccttacgaggtcaaggtggtttccgcccaccgcaccccggatctgctgttccagtacgccgaagaggctgaaggccgcggcatcgaggtgatcatcgccggtgccggtggcgcagcccacctgccaggcatgtgtgcggccaaaacccacctgccggtgctgggcgtgccggtgcagtcagccatgctttcgggcgtcgactcgctgctttcgatcgtgcagatgccggccggtattccggttgccactctggccatcggcaaggccggtgcgatcaacgcagccctgctgtcggcgagcatcctgggcgccaagcatccgcaattccacgcggtactgaaaaccttccgtgccgagcagacagacagcgtcctggacaatccagacccacgtattgcctga

SEQ ID NO: 13390 - protein, 163 aa, Pseudomonas fluorescens PfO-1
MSALVGVIMGSKSDWSTLSHTADMLEKLGIPYEVKVVSAHRTPDLLFQYAEEAEGRGIEVIIAGAGGAAHLPGMCAAKTHLPVLGVPVQSAMLSGVDSLLSIVQMPAGIPVATLAIGKAGAINAALLSASILGAKHPQFHAVLKTFRAEQTDSVLDNPDPRIA

SEQ ID NO: 13391 - DNA, 486 bp, Rhodobacter sphaeroides 2.4.1
  CDS (1)..(486): transl_table=11
atgactgtggacgttgggatcatcatgggcagccagtcggactgggccacgatgaaggaggccgcggcgatcctcgacgagctcggcatctctcacgaggcgaggatcgtctcggcgcaccgcacgcccgaccggctctggaactacggcaagaccgccgtcgggcgcgggctcaaggtcatcatcgcgggcgcgggcggtgcggcgcaccttcccggcatgatggcctcgaaaacgcgggtgcccgtcatcggcgtgcccgtccagacccgcgcgctctcgggcgtcgacagcctctattccatcgtccagatgcccaagggttttccggtcgccaccatggcgatcggcagcgccggcgcggcgaacgcgggcctgatggccgcgggcatcctcgccctctccgatccggcgctcggccagcggctcgacgcctggcgcgcagccctctccgcctccatccccgaggagccctccgatgactga

SEQ ID NO: 13392 - protein, 161 aa, Rhodobacter sphaeroides 2.4.1
MTVDVGIIMGSQSDWATMKEAAAILDELGISHEARIVSAHRTPDRLWNYGKTAVGRGLKVIIAGAGGAAHLPGMMASKTRVPVIGVPVQTRALSGVDSLYSIVQMPKGFPVATMAIGSAGAANAGLMAAGILALSDPALGQRLDAWRAALSASIPEEPSDD

SEQ ID NO: 13393 - DNA, 489 bp, Carboxydothermus hydrogenoformans Z-2901
  CDS (1)..(489): transl_table=11
atgcacaaagttgcggtggttatgggaagcgactccgactgggagattgtaaaaaaggcggtagaggttttaaaagagtttggggtggagtatgaagttaaggtggcatcggcccaccgaactccggataaagctttaaattttgcccggacggcccgggaaaaaggttttggcgttataattgccgcggcggggatggcggcccacttgccgggagtgctggcagcggtgaccacgttaccggtgataggtttaccgattaaagcttccatagagggaattgacagcttactatccattgcccagatgccacccggcgttccggtggcaacggtagggataaatgcggctaaaaatgccgggcttttagcggtgcaaattctaagcttaaatgacaaaaaccttgcgggaaaacttcaagcttataaagaaaagctggcccgggaagtggaagaaaaggagcaaaaacttttagaaaaattgttttag

SEQ ID NO: 13394 - protein, 162 aa, Carboxydothermus hydrogenoformans Z-2901
MHKVAVVMGSDSDWEIVKKAVEVLKEFGVEYEVKVASAHRTPDKALNFARTAREKGFGVIIAAAGMAAHLPGVLAAVTTLPVIGLPIKASIEGIDSLLSIAQMPPGVPVATVGINAAKNAGLLAVQILSLNDKNLAGKLQAYKEKLAREVEEKEQKLLEKLF

SEQ ID NO: 13395 - DNA, 522 bp, Burkholderia sp. 383
  CDS (1)..(522): transl_table=11
atgagtgaaatccagactgcccacacgcacagcgcgccgctcgtcggcgtgctgatgggatcgagttccgattgggacgtgatgaagcacgcggttgccatcctgcaggaattcggcgtgccgtacgaagcgaaggtcgtgtccgcgcaccggatgcccgacgagatgttcgactatgcggagaaggcgcgcgagcgcgggctgcgcgcgatcatcgcgggggccggcggcgccgcgcacctgccgggcatgctggccgcgaagaccacggtgccggtgctcggcgtgccggtcgcgagcaagtacctgaagggcgtcgattcgctgcactcgatcgtgcagatgccgaagggcgtgcccgtcgcgacgttcgcgatcggcgaggccggcgctgcgaacgccgcgctgttcgcggtgtcgatcctgtccggcaactcggtcgactatgcgaaccgcctcgccgcgttccgcgtgcgccagaacgaagccgcgcacgcgatggtgctgccgccgctggaatga

SEQ ID NO: 13396 - protein, 173 aa, Burkholderia sp. 383
MSEIQTAHTHSAPLVGVLMGSSSDWDVMKHAVAILQEFGVPYEAKVVSAHRMPDEMFDYAEKARERGLRAIIAGAGGAAHLPGMLAAKTTVPVLGVPVASKYLKGVDSLHSIVQMPKGVPVATFAIGEAGAANAALFAVSILSGNSVDYANRLAAFRVRQNEAAHAMVLPPLE

SEQ ID NO: 13397 - DNA, 552 bp, Synechococcus sp. CC9605
  CDS (1)..(552): transl_table=11
atggcagtcttgcccctctgcgttgtgccgccagtgctcccccgtgttgccgttgtgatgggcagtgactctgacctgcccatcatggaacccgccgccgccatcctgcgcgagctgggattggaggtggaggttcgggtgctctcggctcaccgaacccctttggagatggtgaacttcgctcaagccgcccgggatcaggggtttggggtgatcgtcgccggcgccggtggggcggcccatctccccggcatggtggccgccctcaccacgctgcccgtgatcggcgtgccggtgaagagccgggcgctgtccggggtcgattccctccactcgatcgtgcagatgccgggggggattccggtggccaccgtcgccatcggtggaggcctcaatgccggcttgctggcagcccagatcctgtcagtggccgatgctggcttggcccagaaacttgaggcctaccgcagcagcctccacgatgctgtggtggccaaggatgcgcgcctggttgatctgggcagcacggactacctctcccagatgacttga

SEQ ID NO: 13398 - protein, 183 aa, Synechococcus sp. CC9605
MAVLPLCVVPPVLPRVAVVMGSDSDLPIMEPAAAILRELGLEVEVRVLSAHRTPLEMVNFAQAARDQGFGVIVAGAGGAAHLPGMVAALTTLPVIGVPVKSRALSGVDSLHSIVQMPGGIPVATVAIGGGLNAGLLAAQILSVADAGLAQKLEAYRSSLHDAVVAKDARLVDLGSTDYLSQMT

SEQ ID NO: 13399 - DNA, 510 bp, Geobacter metallireducens GS-15
  CDS (1)..(510): transl_table=11
atgggtaatccacaggttcttattgtcatggggagcgattcggacctctctatcatggaggaggccgcgaaggttctcgacgagttcggtgtggcgtgggagatgcgcgtcgcctcggcccaccgttcgccgaagaaggctgcggcactggctgcaggcgctgcggcaaggggggtcaaggcgatcatcgccggtgccggcatggctgcccacctggccggggtcatcgccgccgataccgttctgccggtgatcgccgtgccgatccccggcggagcccttaacggcgtcgatgccctctacgccatggtccagatgccgggcggaattcccgtggccaccatggccatcggcaaggctggggccaaaaacgcaggacttcttgcggtgcagatcattgccctcggcgacccggcgctcaccgcggagcttgttgcccacaagcaggccatggccgacgaggtggaggcgaaggacaacgctctccaggagcgattgcgcagatcctag

SEQ ID NO: 13400 - protein, 169 aa, Geobacter metallireducens GS-15
MGNPQVLIVMGSDSDLSIMEEAAKVLDEFGVAWEMRVASAHRSPKKAAALAAGAAARGVKAIIAGAGMAAHLAGVIAADTVLPVIAVPIPGGALNGVDALYAMVQMPGGIPVATMAIGKAGAKNAGLLAVQIIALGDPALTAELVAHKQAMADEVEAKDNALQERLRRS

SEQ ID NO: 13401 - DNA, 537 bp, Prochlorococcus marinus str. MIT 9312
  CDS (1)..(537): transl_table=11
ttgtcagaattgaattctaaagatatttataaaatcgctgtcgtaatgggtagtgattcagatctaaaaacattgaaacctgctattgacattttaagagaatttggaatacaaactgaagtttgtatactttctgcccatagaacacctattgagatgatggaatatgcaaaaaatgcagaatcagaaaaaataaaagtaataattgccggtgctggtggtgccgctcatcttccaggaatgttggcatcgataacttgcattcctgtaattggtgtaccagtagagagtaaaacacttaaggggattgactctcttttatcaattgttcaaatgcctgctgggataccagtagcaacagttgcaattaatggaggtcaaaatgctggattattggcaatagagatgatcagtttatttgatgaatccataaagaaaaatttaaaagaattcagagaaaatcttcatacacaggtaagaactaaaaatagtaagttatcaaatattggagcggacaattatcttcaaaataaatga

SEQ ID NO: 13402 - protein, 178 aa, Prochlorococcus marinus str. MIT 9312
MSELNSKDIYKIAVVMGSDSDLKTLKPAIDILREFGIQTEVCILSAHRTPIEMMEYAKNAESEKIKVIIAGAGGAAHLPGMLASITCIPVIGVPVESKTLKGIDSLLSIVQMPAGIPVATVAINGGQNAGLLAIEMISLFDESIKKNLKEFRENLHTQVRTKNSKLSNIGADNYLQNK

SEQ ID NO: 13403 - DNA, 669 bp, Synechococcus elongatus PCC 7942
  CDS (1)..(669): transl_table=11
atgcgaatattcgtcagcagggtaggagcagcggtcatcatcggtctgcatgtaacggccgacccagcaactcaggccgatcgccccaatcttacgtcagtgaccatgtcttctcctgttcctgctgcaccctctgcgctcacccagcctgccgttggcatcatcatgggcagcgactctgatttacccaccatgcgtggcgcgatcgccatctgccagcagtttggcattgcccacgaggtcgaaattgtctccgctcaccgtactccggtgcggatggtggagtacgcccaaacagcccatcagcgcagcctcaaggtgatcattgccggcgcaggcggtgcggcccatttaccgggcatggtggctgccctaactcccctgccggtgattggcgtacctgtgcagacccgcacgttgcagggagtggactcgctctattcgatcgtgcaaatgccggctggcatcccagtagcaaccgtcgcgatcggtaatgccaccaatgcagggctcctagcagtgcaaatgctggctagccacaaccccgaactactccaagcggtgcagacctatcgccaagaattggcgcaaatggtgcaagataagcagactcgcctcagtgcgatcggtgttgaggcctacctcgaaaatgctggtggtcatcactag

SEQ ID NO: 13404 - protein, 222 aa, Synechococcus elongatus PCC 7942
MRIFVSRVGAAVIIGLHVTADPATQADRPNLTSVTMSSPVPAAPSALTQPAVGIIMGSDSDLPTMRGAIAICQQFGIAHEVEIVSAHRTPVRMVEYAQTAHQRSLKVIIAGAGGAAHLPGMVAALTPLPVIGVPVQTRTLQGVDSLYSIVQMPAGIPVATVAIGNATNAGLLAVQMLASHNPELLQAVQTYRQELAQMVQDKQTRLSAIGVEAYLENAGGHH

SEQ ID NO: 13405 - DNA, 504 bp, Rhodospirillum rubrum ATCC 11170
  CDS (1)..(504): transl_table=11
atgcataccccctcggaggcgccgctggtcggcgtcatcatgggcagccagtcggactgggctaccctgcgccatgcctgggacatcctggagatgctgggcgttccggcggaaaagcgcattatttccgcccatcggaccccggcgcggctggttgattacgcgacgacggcgcgggcgcgcggcctaagggcgatcgtcgccggcgccggcggcgcggcccatctaccgggcatggtggcggcgatgaccaccttgccggtctttggggttccggttgaaagcaaggcgctttcgggaatggacagcctgctgtcgatcgtgcagatgccgggcggcgtgccggtgggaaccctggccatcggcaaggccggggcgatcaacgccgggctgatcgccgcctcggtggtcgcgctgtcgcgacccgatatcgaggcgaagctgatctcctggcgcgaccgccagacggccgaggtcgccgaagaaccggtggatgagggttaa

SEQ ID NO: 13406 - protein, 167 aa, Rhodospirillum rubrum ATCC 11170
MHTPSEAPLVGVIMGSQSDWATLRHAWDILEMLGVPAEKRIISAHRTPARLVDYATTARARGLRAIVAGAGGAAHLPGMVAAMTTLPVFGVPVESKALSGMDSLLSIVQMPGGVPVGTLAIGKAGAINAGLIAASVVALSRPDIEAKLISWRDRQTAEVAEEPVDEG

SEQ ID NO: 13407 - DNA, 525 bp, Moorella thermoacetica ATCC 39073
  CDS (1)..(525): transl_table=11
atgaacctggcacatgttggtattgttatgggcagcgactccgacctgccaattatggcccgggcagcggccatgctggaccgtttccagattccttatgaagtaagaatcctctcggcccaccgttccccggacgccgccctggattacgcccgcaatgctgccggccgggggctcaaagtcattatcgccggcgccgggggcgcggcccacctggccggcgtcctggccgcagtcaccaccctaccggtaatcggcgtccccatccgcacggcggccctgggcggcgtcgattccctctatgccatggtccagatgccccggggcatcccggtggccacggtggccattgacggcgcaaccaacgccgccatactcgcggcccagatcctggccgtccacaatgacgcccttcaggagcggctggcggcctataagcaggaactggcccaggaagtggcggtcaaagatgcccggctggcgcaactgggtattgaaggttatctgggggaggagaaaaaatga

SEQ ID NO: 13408 - protein, 174 aa, Moorella thermoacetica ATCC 39073
MNLAHVGIVMGSDSDLPIMARAAAMLDRFQIPYEVRILSAHRSPDAALDYARNAAGRGLKVIIAGAGGAAHLAGVLAAVTTLPVIGVPIRTAALGGVDSLYAMVQMPRGIPVATVAIDGATNAAILAAQILAVHNDALQERLAAYKQELAQEVAVKDARLAQLGIEGYLGEEKK

SEQ ID NO: 13409 - DNA, 519 bp, Burkholderia thailandensis E264
  CDS (1)..(519): transl_table=11
atgagcgaagtccagaccgcccacacgcacagcgcgccgctcgtcggcgtgctgatgggttccagctccgactgggacgtgatgaagcatgccgtcgcgatcctgcaggaattcgacgtgccgtacgaggcgaaggtcgtgtccgcgcaccggatgcccgacgagatgttcgactacgcggagaaggcgcgcgagcgcggcctgcgcgcgatcatcgcgggcgcgggcggcgccgcgcacctgcccggcatgctcgcggcgaagacgaccgtgcccgtgctcggcgtgcccgtcgcgagcaagtatctgaaaggcgtcgattcgctgcactcgatcgtgcagatgccgaaaggcgtgcccgtggcgacgttcgcgatcggcgaggccggcgcggcgaacgcggcgctcttcgcggtgtcgatcctgtccggcacgtcggtcgactatgcgaaccggctcgccgcgttccgcgtgcggcagaacgaggccgcgcacgcgatgacgctgccgccgctgtga

SEQ ID NO: 13410 - protein, 172 aa, Burkholderia thailandensis E264
MSEVQTAHTHSAPLVGVLMGSSSDWDVMKHAVAILQEFDVPYEAKVVSAHRMPDEMFDYAEKARERGLRAIIAGAGGAAHLPGMLAAKTTVPVLGVPVASKYLKGVDSLHSIVQMPKGVPVATFAIGEAGAANAALFAVSILSGTSVDYANRLAAFRVRQNEAAHAMTLPPL

SEQ ID NO: 13411 - DNA, 516 bp, Syntrophus aciditrophicus SB
  CDS (1)..(516): transl_table=11
gtggaaaagaatatggatattgccgtcagcgttgtcatgggaagtgattccgactattcggtaatggaggaaaccgtcaaaattttaaagacttttcacgtttcccatgaaatctttctcacctcggcacaccgaagcccggaccgaacatctgatttttcccggaaagcggcggaaagaaacgtgaaagtgatcatcgtcggcgcaggcgcagccgctcatctcgccggggtcatcgcttcacagacaacactgcctgtcatcggagtgcctgttgattcgacagcactcaacggtctggatgcccttttttccactgttcagatgcccgggggcatcccggtagcaactatggccataggaaaagccggcgccaggaatgccgcgctgctcgccattcgcattttatctttgacggacgccgaacttcatcagaggcttaccgtttatattgacaatatggcccatgaagtcgagaaaaagcacgatgacctcatcctcaagagccgtttatga

SEQ ID NO: 13412 - protein, 171 aa, Syntrophus aciditrophicus SB
MEKNMDIAVSVVMGSDSDYSVMEETVKILKTFHVSHEIFLTSAHRSPDRTSDFSRKAAERNVKVIIVGAGAAAHLAGVIASQTTLPVIGVPVDSTALNGLDALFSTVQMPGGIPVATMAIGKAGARNAALLAIRILSLTDAELHQRLTVYIDNMAHEVEKKHDDLILKSRL

SEQ ID NO: 13413 - DNA, 525 bp, Frankia sp. CcI3
  CDS (1)..(525): transl_table=11
gtgtcgcagagcacccccgggccggatcatccccaggtggcgatcgtcttcggatcaccgtcggacacccagaccatgagcaaggccggcgccactctggaacgcttcggtgtgccctacgagcaggtgtcgctgtcggcgcaccgcgcgccgcgcaccctcgccgactacgtgggtcagctacgggcccgcgacatctcggtggtcatcgccggggcaggcctggccgccgcgctgcccggcaccattgcggccctcaccacgctgccggtaatcggcgtgccgatctccggcggggcgctggacggcatggactcgctgctcgccatcgcgcagatgccgccgggcgtcccggtcgcgaccgtgggtctgaacaactcgacgaacgcggcgatcctggcgatccagatcctggcgctggccgatcccgatctggggctgaagctggccgcgttcaaggacgagttcgagcaggccgcggcggacgggctgagcgcggcggccgcggccggcagccagccatga

SEQ ID NO: 13414 - protein, 174 aa, Frankia sp. CcI3
MSQSTPGPDHPQVAIVFGSPSDTQTMSKAGATLERFGVPYEQVSLSAHRAPRTLADYVGQLRARDISVVIAGAGLAAALPGTIAALTTLPVIGVPISGGALDGMDSLLAIAQMPPGVPVATVGLNNSTNAAILAIQILALADPDLGLKLAAFKDEFEQAAADGLSAAAAAGSQP

SEQ ID NO: 13415 - DNA, 486 bp, Novosphingobium aromaticivorans DSM 12444
  CDS (1)..(486): transl_table=11
atgacggatagacctttggttgccatcgtaatgggcagccagtccgattgggaaacgatgaagaatgccgctgccgtgctggaaaagctcggcgtcgcgcatgaatgccgcatcgtctctgcccaccgcacgccggatcgtctcgtcagctttgccaagggcgcccacgaggaaggcttcaaggtcgtgattgccggtgccggcggcgctgcgcacctgccgggcatggtcgcatcgatgacgcaccttcccgttcttggcgtgcctgttgaatccaaggcgctcaagggcatggattcgctgctctcgatcgtccagatgcccggcggcatcccggtcggcacgcttgccatcggcgtacccggcgcaaccaatgcaggcatcctcgccgcatcgatccttgccacctcggacgaggccctggcgaagcggttgatcgatttccgcaccgcgcagaccgaatcggtcgccgagcgcccctcctga

SEQ ID NO: 13416 - protein, 161 aa, Novosphingobium aromaticivorans DSM 12444
MTDRPLVAIVMGSQSDWETMKNAAAVLEKLGVAHECRIVSAHRTPDRLVSFAKGAHEEGFKVVIAGAGGAAHLPGMVASMTHLPVLGVPVESKALKGMDSLLSIVQMPGGIPVGTLAIGVPGATNAGILAASILATSDEALAKRLIDFRTAQTESVAERPS

SEQ ID NO: 13417 - DNA, 420 bp, Staphylococcus aureus subsp. aureus NCTC 8325
  CDS (1)..(420): transl_table=11
atgttggattattttgaaattccgtacgaaaaacaagtagtatccgcacatcgtacgccaaaaatgatggttcaatttgcttctgaagcgagagaaagaggtataaacattatcattgcaggcgctggcggtgcggcacatttaccaggtatggttgcatcattaacgacgctaccagttattggagtgccgattgaaacaaaaagtttaaagggtatagattctttattatcaattgttcaaatgccaggaggtattccggttgcaacgactgcaattggtgcagcaggtgctaaaaacgcaggtatacttgcagcaagaatgttaagtattcaaaatccttctttagttgaaaaactaaatcagtatgaatcttcgttaattcaaaaagtggaggacatgcaaaatgaacttcaataa

SEQ ID NO: 13418 - protein, 139 aa, Staphylococcus aureus subsp. aureus NCTC 8325
MLDYFEIPYEKQVVSAHRTPKMMVQFASEARERGINIIIAGAGGAAHLPGMVASLTTLPVIGVPIETKSLKGIDSLLSIVQMPGGIPVATTAIGAAGAKNAGILAARMLSIQNPSLVEKLNQYESSLIQKVEDMQNELQ

SEQ ID NO: 13419 - DNA, 498 bp, Anaplasma phagocytophilum HZ
  CDS (1)..(498): transl_table=11
atgaatgaacctaaattgcctcctgtgcccgtggctgtgataatgggtagtaaatcagatcttcctactatgagtgcagcaatttctgtgctagatgagctcatgatagcccatgaggcgcttgttgtgtctgctcatagaacacctgaaaggttatttaatttcgccaagtcagctcatgaaacagggtttaaggtcattatcgccggagcaggtggagcagctcacttgcccggtatggtagcagcacttactcatattccagtaataggtgtgcctgtaatgagtgagtgtttgaaagggatggatagcctgctttctatagtgcaaatgcctaaggggacgcctgtggcaactatggctattggccccgcaggggcttttaatgctgcagtacttgccgcgtctattattggactgtgggatgaaaatgtctctttgcgactacaaaactggaagcagaaaattactgattctgtctcaataacaccttactag

SEQ ID NO: 13420 - protein, 165 aa, Anaplasma phagocytophilum HZ
MNEPKLPPVPVAVIMGSKSDLPTMSAAISVLDELMIAHEALVVSAHRTPERLFNFAKSAHETGFKVIIAGAGGAAHLPGMVAALTHIPVIGVPVMSECLKGMDSLLSIVQMPKGTPVATMAIGPAGAFNAAVLAASIIGLWDENVSLRLQNWKQKITDSVSITPY

SEQ ID NO: 13421 - DNA, 480 bp, Neorickettsia sennetsu str. Miyayama
  CDS (1)..(480): transl_table=11
atgggttctgaaaaagtagcgatagtaatgggcagtacgtctgattatcctactatgcagcatgcggagaaaatactagaacagctggtagtacactttgagacttatgtgatatcagcgcacagaactccagcaaggttatatgagttttcaaaaaacgcagcagacaaaggaattaggacaataatagcaggtgctggaggagcagctcatttaccaggaatgattgcagccataagcgatattccggtcctaggagtaccagtagaaagtaagacgctcaacggtttggatagcttactttcaatatgccagatgcctgcaggcacgccagtcggcactctttctataggaaaggccggcgcagaaaacgcagcactcctcgcctgtaggatactcgccctacaagataaggacctacaagacagactgcgaatctggatcagaaaacaaacagagactgtacctgaaagaccctaa

SEQ ID NO: 13422 - protein, 159 aa, Neorickettsia sennetsu str. Miyayama
MGSEKVAIVMGSTSDYPTMQHAEKILEQLVVHFETYVISAHRTPARLYEFSKNAADKGIRTIIAGAGGAAHLPGMIAAISDIPVLGVPVESKTLNGLDSLLSICQMPAGTPVGTLSIGKAGAENAALLACRILALQDKDLQDRLRIWIRKQTETVPERP

SEQ ID NO: 13423 - DNA, 504 bp, Ehrlichia chaffeensis str. Arkansas
  CDS (1)..(504): transl_table=11
atgtcaaccaataaaaacattgcagatgttgctgttattatgggaagtcaatcagatttttcaacaatgaacaactcaatatcaatactaaaagagctaaacataactcatgaagtaatgatcatatctgctcacagaacaccagaaaggctttatacatttgcaaaatctgcagaagacaatggttttaaagttattatagcaggagcaggaggagcagctcatttaccagggttagtagcatccttaacacacataccagtcataggagtacccgtaaaaagtagtaatttaaatggaatagatagtttactatcaatagtacaaatgcctaaaggtatacctgtagcaacaatgtccataggatcatcaggaggatacaatgcagccataatggcagcatctattctatccttagaaaatgatgaaatcagaaaaaacttaaaaatatggagaaagaacttgtctgattcagtaaaattaattccagatataccgctataa

SEQ ID NO: 13424 - protein, 167 aa, Ehrlichia chaffeensis str. Arkansas
MSTNKNIADVAVIMGSQSDFSTMNNSISILKELNITHEVMIISAHRTPERLYTFAKSAEDNGFKVIIAGAGGAAHLPGLVASLTHIPVIGVPVKSSNLNGIDSLLSIVQMPKGIPVATMSIGSSGGYNAAIMAASILSLENDEIRKNLKIWRKNLSDSVKLIPDIPL

SEQ ID NO: 13425 - DNA, 492 bp, Francisella tularensis subsp. holarctica
  CDS (1)..(492): transl_table=11
atgagtgtacaagttggtgtaataatgggctctaaatctgattggagtacaatgaaagaatgttgtgatatcttggataatttaggtattggttatgaatgtgaagtagtgtctgctcatcgaactccagataagatgtttgactatgccaaaactgctaaagaaagaggccttaaggttataatagcaggagctggcggtgctgcacatttacctggaatggttgcggcaaaaactgctttaccagtattaggtgtaccagttaaatcaagtacacttaatggccaagatagtttattatcaatagtacagatgccagcgggtattccagtagctacttttgcaattggtatggcaggagcaaaaaacgcggcgctttttgctgcaagtatcttgcaacatacagatataaatattgcaaaagcactagctgagtttagagctgagcaaacacgatttgttttggaaaatcctgatcctagggagcactaa

SEQ ID NO: 13426 - protein, 163 aa, Francisella tularensis subsp. holarctica
MSVQVGVIMGSKSDWSTMKECCDILDNLGIGYECEVVSAHRTPDKMFDYAKTAKERGLKVIIAGAGGAAHLPGMVAAKTALPVLGVPVKSSTLNGQDSLLSIVQMPAGIPVATFAIGMAGAKNAALFAASILQHTDINIAKALAEFRAEQTRFVLENPDPREH

SEQ ID NO: 13427 - DNA, 495 bp, Desulfitobacterium hafniense Y51
  CDS (1)..(495): transl_table=11
atgaatttggttggtatcgtcatgggcagtgattcggattttaacgtgatggaggatgctatcaaagtcctgaaggaattcggggtaagttttgaggtcaaggtgtcctctgctcatcgaactctggaaagaaccttgaattgggttaaggaatttgaaggacaggggggcaaggtgattattgcgggggcaggaatggctgcccacttgcccggtgtcgtggccggagcgacgactctgccggtgatcggggtgcctattcgcagcggcgccttggagggtgtggacgccctctatgccatcgtccagatgcctcccggcattcctgtggcaactgtagggatcaacgcggctaagaatgccggactcttaggggttcagatgctggccaatgctgatgatcagttgaaagaagctttgcataactaccgggtcaagatggcgcaaggggtggaagagaaggataaagctctgcaggagaaacttcagaagtaa

SEQ ID NO: 13428 - protein, 164 aa, Desulfitobacterium hafniense Y51
MNLVGIVMGSDSDFNVMEDAIKVLKEFGVSFEVKVSSAHRTLERTLNWVKEFEGQGGKVIIAGAGMAAHLPGVVAGATTLPVIGVPIRSGALEGVDALYAIVQMPPGIPVATVGINAAKNAGLLGVQMLANADDQLKEALHNYRVKMAQGVEEKDKALQEKLQK

SEQ ID NO: 13429 - DNA, 507 bp, Saccharophagus degradans 2-40
  CDS (1)..(507): transl_table=11
atgagtaatacgccaaacactcccattgtgggcgtgataatgggctccaagtccgattgggaaaccatgcagcacgctatcaatatattggagcagctaggtgttccatacgaaaccgaggttgtatcggctcatcgcaccccagataagctctttcaatacgctgaagccgcagatggtcgcggtattgaagtgatcatcgccggcgcaggtggcgcagcacacttacctggcatggttgccgcgaaaacccatttacctgtattgggcgtgccggtgcaatccaaagcattaaacggcatggattcgttgttatccattgcgcaaatgccagctggtattcctgtaggaacattggctattggtaaagctggggcggctaattccgcgttattgtcagcgagcatgctttctaataagtacccagctattaaagaagcgctgttagcgtttagaaaaaatcaaacagaaaccgttctagataatccagacccgcgagagcagtaa

SEQ ID NO: 13430 - protein, 168 aa, Saccharophagus degradans 2-40
MSNTPNTPIVGVIMGSKSDWETMQHAINILEQLGVPYETEVVSAHRTPDKLFQYAEAADGRGIEVIIAGAGGAAHLPGMVAAKTHLPVLGVPVQSKALNGMDSLLSIAQMPAGIPVGTLAIGKAGAANSALLSASMLSNKYPAIKEALLAFRKNQTETVLDNPDPREQ

SEQ ID NO: 13431 - DNA, 495 bp, Methylobacillus flagellatus KT
  CDS (1)..(495): transl_table=11
atgtccaaaccattggttggtatcatcatgggctcagacagcgactggcccgtcatgcgcgccgcggcgcagacgttggccgatttaggcattgtctacgaggcacgcgtggtctctgcgcaccgtacgcctgacctgatgtttgagtttgccgagcaagcggccgaacgcggcttgcgtgtcattattgctggcgctggcggcgccgcccacctgcctggcatggtggcggccaagacgacattgccggtactaggcgtgccggtgccatcacgccatctacaggggcaggattccctgctatccatcgtccagatgcctaaagggattccagtcgcgacgtttgcgatcggtgaggcaggggctgccaacgccggtttgtttgccgccgccatcctggcgacgacggatagcgcacttgcgcagcagctggcagattttcgtgccgcacaggcggcccgggtgctggacatgacattgccggaccagccctga

SEQ ID NO: 13432 - protein, 164 aa, Methylobacillus flagellatus KT
MSKPLVGIIMGSDSDWPVMRAAAQTLADLGIVYEARVVSAHRTPDLMFEFAEQAAERGLRVIIAGAGGAAHLPGMVAAKTTLPVLGVPVPSRHLQGQDSLLSIVQMPKGIPVATFAIGEAGAANAGLFAAAILATTDSALAQQLADFRAAQAARVLDMTLPDQP

SEQ ID NO: 13433 - DNA, 519 bp, Burkholderia xenovorans LB400
  CDS (1)..(519): transl_table=11
atgagtgaagctcaaaccgcccatacgcatggcgcgccggttgtcggcgtgctgatgggctccagttccgactgggaagtcatgaagaacgccgtggccattctgcaggaattcggcgtgccctacgaagcgaaggtcgtgtccgcgcaccgcatgcccgacgaaatgttcgcctatgctgaaagcgcgcgtgaacgcggcattcgcgcgatcatcgccggcgcgggcggcgcggcgcatctgccgggcatgctggcggccaagaccacggtgccggtgctcggcgtgccggtggcgagcaagtacctgaagggcgtcgattcgctgcattcgatcgtgcagatgcccaagggcgtgccggtcgccacgtttgcgattggcgaagccggcgcggcgaacgcggcactgttcgccgtgtcgctgctgagcggcacgagcaatgaatacgcggagaagctggctgcgttccgcgtgcgccagaacgaagcggctcacgctatggtgttgccggcgctataa

SEQ ID NO: 13434 - protein, 172 aa, Burkholderia xenovorans LB400
MSEAQTAHTHGAPVVGVLMGSSSDWEVMKNAVAILQEFGVPYEAKVVSAHRMPDEMFAYAESARERGIRAIIAGAGGAAHLPGMLAAKTTVPVLGVPVASKYLKGVDSLHSIVQMPKGVPVATFAIGEAGAANAALFAVSLLSGTSNEYAEKLAAFRVRQNEAAHAMVLPAL

SEQ ID NO: 13435 - DNA, 498 bp, Ralstonia metallidurans CH34
  CDS (1)..(498): transl_table=11
atgagcaacgaatcgaagcctgtggttggcgtggtaatgggcagcagttccgattgggacgtgatgcagcacgccgtggccatgctcaaggatttcaacgtgccgttcgaagcgcaggtggtgtcggcgcaccggatggccgatgacatgttccgctatgccgaagcggcgcgcggccgtggcatccgcgcgatcatcgccggcgccggcggtgccgcgcacctgccgggcatgatcgccgccaagaccatcgtgccggtgttcggcgtgccggtgccgtcgaagtacctgcgcggcgaggactcgctgctgtcgatcgtgcagatgccgaagggtgtgcccgtggccaccttcgccatcggcgaggccggcgccgccaacgcggcgctgcacgcgatcgccacgctggccaccactgacgacgcgctggccagcgcgctggaagcgttccgcgcaaagcagaccgaagccgcgcgcgcgatgacgctgcccgtataa

SEQ ID NO: 13436 - protein, 165 aa, Ralstonia metallidurans CH34
MSNESKPVVGVVMGSSSDWDVMQHAVAMLKDFNVPFEAQVVSAHRMADDMFRYAEAARGRGIRAIIAGAGGAAHLPGMIAAKTIVPVFGVPVPSKYLRGEDSLLSIVQMPKGVPVATFAIGEAGAANAALHAIATLATTDDALASALEAFRAKQTEAARAMTLPV

SEQ ID NO: 13437 - DNA, 510 bp, Acidobacteria bacterium Ellin345
  CDS (1)..(510): transl_table=11
atgtccgatacaccgcttgtgtccattgttatgggcagtgattccgatttggagatcatgaacgaagccgcgaaggcgctcgagggcttcgggattgcgtatgaaattgacatcacgtcggcgcaccgttcgccggcacgcaccagcgaatactcgcgcgcgctggtttcgcgtggcgtgaaggttgtgattgccggcgcaggtggcgcggcacaccttgcaggcgtgattgccgctgagacgaccctgccggtaattgccgtgccgattccatccacggcgctgctcggcctcgattcgctgttagcgatggtgcagatgcctgcgggcattccctgcgcgaccgtggcgatcggcaagccgggtgcgacgaatgccggcattctcgcggcacagatcatcgggacgcatgatgcgggcgttgcgaagaaactcgtggcgcacaaagagaagttggccaagggcgtggaagagaagtcgaagaagttgaaggaatcggcgaagaagtag

SEQ ID NO: 13438 - protein, 169 aa, Acidobacteria bacterium Ellin345
MSDTPLVSIVMGSDSDLEIMNEAAKALEGFGIAYEIDITSAHRSPARTSEYSRALVSRGVKVVIAGAGGAAHLAGVIAAETTLPVIAVPIPSTALLGLDSLLAMVQMPAGIPCATVAIGKPGATNAGILAAQIIGTHDAGVAKKLVAHKEKLAKGVEEKSKKLKESAKK

SEQ ID NO: 13439 - DNA, 489 bp, Silicibacter sp. TM1040
  CDS (1)..(489): transl_table=11
atggccgacatcaaagtagggatcatcatggggagccagtccgactggcccacgatgaaggaagcagccaacatccttgacgaactgggcgttgcctatgaaacgcggatcgtttcggctcaccgcacgccggaccggttgtgggactatggcaagaccgcagcagagcgcggcctgcatgtgattatcgcaggcgcgggcggcgcggcgcatttgcccggcatgatggcgtcaaagacccgtgtgcccgtggttggcgtgcccgtccagacccgtgccttgtccggtgtcgacagcctttattcgatcgtgcagatgcccaaaggatttccagttgccaccatggcgattggtgccgcgggcgctgccaacgcaggcctgatggccgccggcattctcgccaccagcgacgccgcgctggcagaacgtcttgacgcctggcgcgacgcgcttgccgcctccattcccgaggagcctaccgatgactga

SEQ ID NO: 13440 - protein, 162 aa, Silicibacter sp. TM1040
MADIKVGIIMGSQSDWPTMKEAANILDELGVAYETRIVSAHRTPDRLWDYGKTAAERGLHVIIAGAGGAAHLPGMMASKTRVPVVGVPVQTRALSGVDSLYSIVQMPKGFPVATMAIGAAGAANAGLMAAGILATSDAALAERLDAWRDALAASIPEEPTDD

SEQ ID NO: 13441 - DNA, 498 bp, Myxococcus xanthus DK 1622
  CDS (1)..(498): transl_table=11
atggcgagcacggtcaccccctgggtcggggtcatcatgggcggtaggagcgacctggagcacctgcagcccgcggtcgacattctcaaggaactgggcatcccgcacgaggtgcgcgtggtgtccgctcaccgcaccccggactggatgatggagtacgcgtccaccgcggagtcgcgggggctgtccgtcatcatcgccgccgcgggcggcgcggcgcacctgccgggcatggtgtcgagcaagacgctgctgcccgtcattggcgtgcccatgcccaccacgctgctcagcggcctggacgcgctgctgtccatcgtccagatgcccaagggcgtgccggtgggaacgcaggccattggcaagccgggcgccgccaacgcggccctgcacgccgcggccatcctctgcctcaagtaccccgagctgcgcgagcggctcgcggcctggcgcaaggcgcgtacggacgaagtgctggcgcaccgggagctgtcatga

SEQ ID NO: 13442 - protein, 165 aa, Myxococcus xanthus DK 1622
MASTVTPWVGVIMGGRSDLEHLQPAVDILKELGIPHEVRVVSAHRTPDWMMEYASTAESRGLSVIIAAAGGAAHLPGMVSSKTLLPVIGVPMPTTLLSGLDALLSIVQMPKGVPVGTQAIGKPGAANAALHAAAILCLKYPELRERLAAWRKARTDEVLAHRELS

SEQ ID NO: 13443 - DNA, 513 bp, Mycobacterium sp. MCS
  CDS (1)..(513): transl_table=11
gtgaacgcacccgccccgcgcgtcggggtcatcatgggcagcgacagcgactggtcggtgatggccgacgccgccgaagcgctcgccgagttcgaggtggccttcgaggtgggcgtggtatccgcgcaccgcacccccggccgcatgctcgattacgcgcgcaccgccgccgaccgggggatcgaggtcatcatcgccggtgccggcggggcggcccacctgccgggcatggtggcttcggcgacaccgttgccggtcatcggcgtgccggtgccgctggcccggctggacgggatggattcgctgctgtcgatcgtgcagatgcccgccggggtgccggtggccacggtgtcgatcggcggcgcgcgcaacgccggactgctggccgtgcggatcctcgcctcggccgaccgcgcgctgcgggcgcgcatggtccggttccaggcgggcctcgagcagatggtgctcgagaaggatgaagcgctgcggaaccggctactcggtgcggactga

SEQ ID NO: 13444 - protein, 170 aa, Mycobacterium sp. MCS
MNAPAPRVGVIMGSDSDWSVMADAAEALAEFEVAFEVGVVSAHRTPGRMLDYARTAADRGIEVIIAGAGGAAHLPGMVASATPLPVIGVPVPLARLDGMDSLLSIVQMPAGVPVATVSIGGARNAGLLAVRILASADRALRARMVRFQAGLEQMVLEKDEALRNRLLGAD

SEQ ID NO: 13445 - DNA, 486 bp, Rubrobacter xylanophilus DSM 9941
  CDS (1)..(486): transl_table=11
gtggcggcgcgtgtgggcgtgatcatgggcagcgcctcggactgggagacgatgaggcatgcctgcgaggtgctggaggagctgggcgtcccccacgagaagcgggtggtctcggcgcaccggacgccggatctcatgttcgagtacgcctccggcgcggcggagaggggcatcggggtgatcatcgccggcgccggcggcgcggcacacctgcccgggatggtggcctccaagacggtgctgccggtgatcggggtgccggtgaagtcctcgagcctcaacgggctggactccctgctctcgatcgtgcagatgccgggcggggtgccggtggccacggtggccatcggccgggcgggggcgacgaacgccggcctgctggcggcccagatcctcgccgttcgcgacccggagctccggcgcaggctcgaggagcgccgcgagcggatgcgccggtcggtcctcgaggggggcgacctctcgtga

SEQ ID NO: 13446 - protein, 161 aa, Rubrobacter xylanophilus DSM 9941
MAARVGVIMGSASDWETMRHACEVLEELGVPHEKRVVSAHRTPDLMFEYASGAAERGIGVIIAGAGGAAHLPGMVASKTVLPVIGVPVKSSSLNGLDSLLSIVQMPGGVPVATVAIGRAGATNAGLLAAQILAVRDPELRRRLEERRERMRRSVLEGGDLS

SEQ ID NO: 13447 - DNA, 498 bp, Mesorhizobium sp. BNC1
  CDS (1)..(498): transl_table=11
atggatcggcaaaaggctgatgtcgcaatcatcatggggagccagtcggactgggaaaccatgcggcatgcggcagatatccttgaaacgctcgaaatctcccatgacgtgcggattgtctcggcgcatcgcacgccagataggctctatgccttcgccaagggcgccaaggcggagggcattcgcgtgatcatcgccggcgcaggcggcgctgcgcatctgccgggcatgacggcggccctgacatcgcttcctgtcttcggcgtacctgtgcaatccaaggctttgtctggccaggactcgctcctctccatcgtccagatgccggccggcatcccggtagggaccttggccatcggccgctccggcgccgttaacgcggcattgctcgcagcggcggtgctggctctttccgatgaagcgcttgccgcgcggctcgacgcctggcgtgcacgccaggctgccgatgttgccgaacgccctgtggacgaggcatga

SEQ ID NO: 13448 - protein, 165 aa, Mesorhizobium sp. BNC1
MDRQKADVAIIMGSQSDWETMRHAADILETLEISHDVRIVSAHRTPDRLYAFAKGAKAEGIRVIIAGAGGAAHLPGMTAALTSLPVFGVPVQSKALSGQDSLLSIVQMPAGIPVGTLAIGRSGAVNAALLAAAVLALSDEALAARLDAWRARQAADVAERPVDEA

SEQ ID NO: 13449 - DNA, 516 bp, Cytophaga hutchinsonii ATCC 33406
  CDS (1)..(516): transl_table=11
atgagcaagccattagttggaatcattatgggcagccagtcagacttaaaaatcatgtcggctgccgcagatatgctggataaatttggaataccttttgaactgacgattgtatcagctcacagaacacccgaacgtatggttgagtacggacaggcagcggttgataaaggattgaaatgtatcattgccggagcaggcggtgcagcacatttgcctggaatggttgcagcattaacaacacttcctgtaataggagtgcctgttaaatcatccaattcgattgatggctgggattcagtattgtctattttgcagatgccatcaggcgtacctgttgcaacggtagcactggatggggcagcaaacgcaggcattattgctgcgcagatcatcggcgcatttgacgcagccgttcagaaaaaactgcaggcatataaaattgaattaaaaactaaagtagaggagtcggttgaagcaattgataaaaatggatttcggtctttattaaaataa

SEQ ID NO: 13450 - protein, 171 aa, Cytophaga hutchinsonii ATCC 33406
MSKPLVGIIMGSQSDLKIMSAAADMLDKFGIPFELTIVSAHRTPERMVEYGQAAVDKGLKCIIAGAGGAAHLPGMVAALTTLPVIGVPVKSSNSIDGWDSVLSILQMPSGVPVATVALDGAANAGIIAAQIIGAFDAAVQKKLQAYKIELKTKVEESVEAIDKNGFRSLLK

SEQ ID NO: 13451 - DNA, 519 bp, Rhodococcus sp. RHA1
  CDS (1)..(519): transl_table=11
gtgagtgacacggcagcacggcagggcgcacaggtcgggctcatcatgggcagcgactccgactggcccaccatggaggccgccgccgaggcgctcgccgagttcggggtgcgtttcgaggtcggtgtcgtgtccgcgcaccgcacaccgcagcgcatgctcgactacgcgaaggacgcggccggccgcggcatccaggtgatcatcgccggcgccgggggcgccgcacacctgccgggcatggtggcatcggccaccccactgcccgtcatcggtgtgcccgtcccgctgaaatacctcgacgggatggactcgctgctctcgatcgtgcagatgcccgcaggtgtccccgtcgcgaccgtgtccatcggtggcgcccgcaacgcgggcctgctcgccgtccgcatcctcggcgcctccgaccccgccctgcagcagcagatggtcgcgttccaggacgggctcgagaagatggtcctggacaaggacaaggcactccgcgacaagctgctgggctga

SEQ ID NO: 13452 - protein, 172 aa, Rhodococcus sp. RHA1
MSDTAARQGAQVGLIMGSDSDWPTMEAAAEALAEFGVRFEVGVVSAHRTPQRMLDYAKDAAGRGIQVIIAGAGGAAHLPGMVASATPLPVIGVPVPLKYLDGMDSLLSIVQMPAGVPVATVSIGGARNAGLLAVRILGASDPALQQQMVAFQDGLEKMVLDKDKALRDKLLG

SEQ ID NO: 13453 - DNA, 498 bp, Haemophilus somnus 129PT
  CDS (1)..(498): transl_table=11
atgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgccggtggtgccgcacatttacctggtatgattgcagcaaaaactatcttgcctgtattaggtgtaccagtaaaaagctcaatgttaaatggtgtagatagtttatattctattgtgcaaatgcccaaaggcattcctgtgggaaccttggctatcggatctgccggagctgcaaatgccgctttgttagcctcacaaattctcgctgctttcgatccgcacttagcacaaaaattgcaccaatttcgccaagctcaaactgacagtgttttgaataattccgatccgagagaataa

SEQ ID NO: 13454 - protein, 165 aa, Haemophilus somnus 129PT
MQDNKPQIAIVMGSKSDWSTMQETAIILDSLDLPYHVEVVSAHRTPDKLFEFAENAEAKGYKVIIAGAGGAAHLPGMIAAKTILPVLGVPVKSSMLNGVDSLYSIVQMPKGIPVGTLAIGSAGAANAALLASQILAAFDPHLAQKLHQFRQAQTDSVLNNSDPRE

SEQ ID NO: 13455 - DNA, 510 bp, Trichodesmium erythraeum IMS101
  CDS (1)..(510): transl_table=11
atgaatgccatagtcggaattataatgggcagtgactcagacttgcccacaatgaaagaagcgatcgctatttgcgaagaatttaacataccctcagaagtcgccatcctatcagctcaccgcacaccccaaagaatgtttgaatatgcccaaactgcccataaaagaggattaaaagtcatcattgccggagcaggaggggcagcacatctaccaggaatggtcgcatctttaacgccactccctgtaataggtgtaccagtacaaactcgaaccttacaaggagtagactcattatattctatagtgcaaatgccagggggaataccagtcgccacagtagccatcggcaatgccaaaaatgctggcttattggccattcaaatcttagcatcccaccaaccagaattattagaacaagtgcaaaagtaccgtcacaccttagctgagtcagtaatagataagcaaaataaactagatcaaattggatatcaagaatatttaatataa

SEQ ID NO: 13456 - protein, 169 aa, Trichodesmium erythraeum IMS101
MNAIVGIIMGSDSDLPTMKEAIAICEEFNIPSEVAILSAHRTPQRMFEYAQTAHKRGLKVIIAGAGGAAHLPGMVASLTPLPVIGVPVQTRTLQGVDSLYSIVQMPGGIPVATVAIGNAKNAGLLAIQILASHQPELLEQVQKYRHTLAESVIDKQNKLDQIGYQEYLI

SEQ ID NO: 13457 - DNA, 555 bp, Synechococcus sp. CC9311
  CDS (1)..(555): transl_table=11
gtgtccaagccatcggagcccacgatcgtcgcgactccccttgttgcagtgatcatgggaagtgattctgacttaccgaccctgacgccagcggtttcggctctcgaagaattaggcgtcagcgttgaggtgcgtgtgctttcggcccatcgcactccactggaaatggtggactttgcacgtcaggccaaacagctgggattccgggtgatcgttgctggtgccggtggcgctgctcatctcccaggaatggtcgcctcactcaccacgcttcccgtgatcggtgtccctgtgaagagtcgagctctctctggagtggactccttgcattccattgtgcagatgcctggtggaattcctgtggccacggttgcgattggcggaggtttaaacgctggtttgctggccgctcagattctggcgatcagtgattcgtccctgtctgaacgactggaggcgtaccgccagcaactccacgacatggtggttgccaaggatgcccgcctcaaagatctcggtgctgacgcgtatctggattcaatgtcgagtagctga

SEQ ID NO: 13458 - protein, 184 aa, Synechococcus sp. CC9311
MSKPSEPTIVATPLVAVIMGSDSDLPTLTPAVSALEELGVSVEVRVLSAHRTPLEMVDFARQAKQLGFRVIVAGAGGAAHLPGMVASLTTLPVIGVPVKSRALSGVDSLHSIVQMPGGIPVATVAIGGGLNAGLLAAQILAISDSSLSERLEAYRQQLHDMVVAKDARLKDLGADAYLDSMSSS

SEQ ID NO: 13459 - DNA, 492 bp, Shewanella sp. MR-4
  CDS (1)..(492): transl_table=11
atgcaagcccttgttgctgttgttatgggttctaagagtgattggcccacaatggaagccgccgctgagatcatggataaactgcaagtgccttaccatgttgaagtcgtatctgcccatagaacgccagataaactgatggagtttgcagccagtgcagctgaccgtggttttaaaattattatcggtggtgcgggcggtgctgctcacttacccggtatgattgcctcaaaaactcgcttacccgtattaggtgtaccagtacaaagcaaagcgctgtcgggcatggatagcttactgtctatcgtgcagatgccaaaaggcattgccgtaggcacactggccatcggaaccgctggagcctttaacgccggattactcgcctgccaaattcttgcgaataacgatgccgaacttgccacgcgtttagaagcctttagagaagaacaaacccgcgcagtgctggacaatcccgatccgagggaagcctaa

SEQ ID NO: 13460 - protein, 163 aa, Shewanella sp. MR-4
MQALVAVVMGSKSDWPTMEAAAEIMDKLQVPYHVEVVSAHRTPDKLMEFAASAADRGFKIIIGGAGGAAHLPGMIASKTRLPVLGVPVQSKALSGMDSLLSIVQMPKGIAVGTLAIGTAGAFNAGLLACQILANNDAELATRLEAFREEQTRAVLDNPDPREA

SEQ ID NO: 13461 - DNA, 492 bp, Shewanella sp. MR-7
  CDS (1)..(492): transl_table=11
atgcaagcccttgttgctgttgttatgggttctaagagtgattggcccacaatggaagccgccgctgagatcatggataaactgcaagtgccttaccatgttgaagtcgtatctgcccatagaacgccagataaactgatggagtttgcagccggtgccgctgaccgtggttttaaaattattatcggtggtgcgggcggtgctgctcacttacccggtatgattgcctcaaaaactcgcttacccgtattaggtgttccagtacaaagcaaagcgctgtcaggtatggatagcttactgtctatcgtgcagatgccaaaaggcattgcggtaggcacactggccatcggaaccgctggagcctttaacgccggactactcgcctgccaaattcttgcgaataacgatgccgaacttgccgcacgtttagaagcctttagagaagaacaaacccgcgcagtgctggacaatcccgatccgagggaagcctaa

SEQ ID NO: 13462 - protein, 163 aa, Shewanella sp. MR-7
MQALVAVVMGSKSDWPTMEAAAEIMDKLQVPYHVEVVSAHRTPDKLMEFAAGAADRGFKIIIGGAGGAAHLPGMIASKTRLPVLGVPVQSKALSGMDSLLSIVQMPKGIAVGTLAIGTAGAFNAGLLACQILANNDAELAARLEAFREEQTRAVLDNPDPREA

SEQ ID NO: 13463 - DNA, 495 bp, Alkalilimnicola ehrlichei MLHE-1
  CDS (1)..(495): transl_table=11
atgagcgagtcgcagccgttggtgggcgtcatcatgggcagtcgctcggactgggagaccatgtcggaggcctgccaggttctggacgacttccaggtgccttatgaggcccggattgtgtccgcgcaccgcaccccggagttgatgcgtgactatgcgcaccaggccgaggagcgtggcctgaaggcgattatcgccggtgccggcggcgccgcccacctgccgggcatggtggcggccatgaccaccgtgccggtgctgggcgtgccggtacagagccgcgcgctgaaggggttggactcgctgctctccattgtgcagatgccgggcggcgtgccagtggctactctggccatcggcagcgccggggcacgcaatgccggcctgctggcctgcagtatcctggccaacgaggatgccggcctgcgcgagcggttgcgtgccttccgcgagcgccaggcacaaaaggttctggaggacgagctgccgcaatga

SEQ ID NO: 13464 - protein, 164 aa, Alkalilimnicola ehrlichei MLHE-1
MSESQPLVGVIMGSRSDWETMSEACQVLDDFQVPYEARIVSAHRTPELMRDYAHQAEERGLKAIIAGAGGAAHLPGMVAAMTTVPVLGVPVQSRALKGLDSLLSIVQMPGGVPVATLAIGSAGARNAGLLACSILANEDAGLRERLRAFRERQAQKVLEDELPQ

SEQ ID NO: 13465 - DNA, 495 bp, Hyphomonas neptunium ATCC 15444
  CDS (1)..(495): transl_table=11
atgaacaaggcgcgctctccggtcgtgggcatcatcatgggcagccagtcggactggccggtgatgcgcgaggccgcgaagatactcgaagatatgggcgtcgctttcgaagcgaagatcgtttcggcgcaccgcacgccccagcggctggtcgaatatgcgaccactgccaaggatcgcgggttgaaggtgatcatcgccggcgcgggcggggcagcccacctgccgggcatggccgcttcgatgacgcccctgcccgttctgggcgtgccggttcagtccaaggcgcttaaaggcctcgatagtcttctctctattgtgcagatgcccaagggcgttccggtgggcacgctggccattggcgaagcgggcgcggccaatgcgggcattctggcggcctcgatcattgcgctgcaggacgacgcggtggccgcaaagctggacgcgttccgcacggcgcagaccgagagcgtgaaagaggttcccgaggaatga

SEQ ID NO: 13466 - protein, 164 aa, Hyphomonas neptunium ATCC 15444
MNKARSPVVGIIMGSQSDWPVMREAAKILEDMGVAFEAKIVSAHRTPQRLVEYATTAKDRGLKVIIAGAGGAAHLPGMAASMTPLPVLGVPVQSKALKGLDSLLSIVQMPKGVPVGTLAIGEAGAANAGILAASIIALQDDAVAAKLDAFRTAQTESVKEVPEE

SEQ ID NO: 13467 - DNA, 495 bp, Rhizobium leguminosarum bv. viciae 3841
  CDS (1)..(495): transl_table=11
atgacagacagaccacccgtcgccatcatcatgggcagccagtccgactgggagaccatgaaaaacgccgccgacacgctggaggcgctggaaattccctatgacgcgcgcatcatttcggcgcaccgcacagtcgaccggctggtcaatttcgccaagggcgcacgcgcggagggcttcaaggtcatcatcgccggcgccggcggcgccgcccatctgccgggtatgaccgccgcgatgacgccgctgccggtcttcggcgtgccggtccagtcgaaagccctgtccggccaggacagcctcctttccatcgtgcagatgccggccggcattcctgtcggtacgctcgccataggcaaggccggcgcagtcaacgccgcccttctcgccgccgccgtgcttgccctttccgacgaagaaatcgccgaccggctcgacgaatggcgcgagcgccagagtgctgccgtcgccgaatacccgatggacgatctatga

SEQ ID NO: 13468 - protein, 164 aa, Rhizobium leguminosarum bv. viciae 3841
MTDRPPVAIIMGSQSDWETMKNAADTLEALEIPYDARIISAHRTVDRLVNFAKGARAEGFKVIIAGAGGAAHLPGMTAAMTPLPVFGVPVQSKALSGQDSLLSIVQMPAGIPVGTLAIGKAGAVNAALLAAAVLALSDEEIADRLDEWRERQSAAVAEYPMDDL

SEQ ID NO: 13469 - DNA, 483 bp, Pediococcus pentosaceus ATCC 25745
  CDS (1)..(483): transl_table=11
atgagaaaagtcgcagtagttatgggttcaatttctgattggtcaaccatgaaactggccacagatatacttgatgaatttgaagtcgattatgatcgtcatattatttcagcacatcggatgccgaaagtattacagaagtttggtgaacaagcacaagaaaatggatatgccgtgctgattgcaggagctggcggagcagctcatttaccgggaatgttagcagccaacacaatttcacctgtaattggggttcctattgaaagtcatgcattacacggaatggattcattactatcaattgtccaaatgcctagtggagtccccgttgcgactacggctattgggagtgcaggtgctaaaaatgccgctttattagcagctgaaattttagcgttaaccgataaaaaagttgctgaaaaattaattgaattccgtcaaaaacagactcaggaggctattgagagtgaaaagcaattctga

SEQ ID NO: 13470 - protein, 160 aa, Pediococcus pentosaceus ATCC 25745
MRKVAVVMGSISDWSTMKLATDILDEFEVDYDRHIISAHRMPKVLQKFGEQAQENGYAVLIAGAGGAAHLPGMLAANTISPVIGVPIESHALHGMDSLLSIVQMPSGVPVATTAIGSAGAKNAALLAAEILALTDKKVAEKLIEFRQKQTQEAIESEKQF

SEQ ID NO: 13471 - DNA, 495 bp, Oenococcus oeni PSU-1
  CDS (1)..(495): transl_table=11
atgtcaaacacgaagattgctgttgtaatgggatcagtttctgactgggaaacgatgaaaaatgcggtcaatattttgaaggattttggagttgagattgaaaaacatgttatttccgcacacagaatgcctgaccaactgagtgaattttccaaaggagctcgtcaacgaggtctgcagatgatgatcgctggtgctggtggtgcagctcatttacctggcatgctggctgccaacacaacccttccagtaattggcgttccgattcaatcgcatgctttaaatggtttggattctcttttgtcgattgtacagatgccggccgggattccggttgccacgacggcgatcggtaattccggcgctaaaaatgcagcttacttggctttatcgattcttagccggcaagaccaagaaattgaaaataaattaatcatgtttcgtcgggagcagacaaaaaaatcacttgaaagcgatgcacagctcaatgattaa

SEQ ID NO: 13472 - protein, 164 aa, Oenococcus oeni PSU-1
MSNTKIAVVMGSVSDWETMKNAVNILKDFGVEIEKHVISAHRMPDQLSEFSKGARQRGLQMMIAGAGGAAHLPGMLAANTTLPVIGVPIQSHALNGLDSLLSIVQMPAGIPVATTAIGNSGAKNAAYLALSILSRQDQEIENKLIMFRREQTKKSLESDAQLND

SEQ ID NO: 13473 - DNA, 486 bp, Leuconostoc mesenteroides subsp. mesenteroides ATCC 8293
  CDS (1)..(486): transl_table=11
atgcctcaagttgcagttgtcatgggatcaactagtgattggtccagcatgaaaaaaactacagaaattttggatatattaggtgttacttacgaaaaacacgtcatttcagcgcatcgcatgcctcaagaattacaagcatttggcacacaagcaagagacaataagcttcaagtaattattgctggtgccggcggcgcggctcatttgcctggtatgctggcagctaatacaacgctaccagtcatcggcgtgccgatgcaatcacgggcactaaatggactggattctttactctctattgttcaaatgccagcaggggtccccgttgctacagttgcaataggtgatgcaggtgcaaaaaatgcggcaattctagctgcacaaattattgctttaaatgataatgacgtattgcaggccttgaatgaatatcgagaacgccaaacaaagacttctattgaaagcgaggcagaattgatatga

SEQ ID NO: 13474 - protein, 161 aa, Leuconostoc mesenteroides subsp. mesenteroides ATCC 8293
MPQVAVVMGSTSDWSSMKKTTEILDILGVTYEKHVISAHRMPQELQAFGTQARDNKLQVIIAGAGGAAHLPGMLAANTTLPVIGVPMQSRALNGLDSLLSIVQMPAGVPVATVAIGDAGAKNAAILAAQIIALNDNDVLQALNEYRERQTKTSIESEAELI

SEQ ID NO: 13475 - DNA, 471 bp, Solibacter usitatus Ellin6076
  CDS (1)..(471): transl_table=11
atggtcggcataatcatgggcagcaaatccgattgggagaccatgcagcacgctgcgcagacgctgcaacaattcgacgtcgcacacgaatgccgtgttgtctccgcgcaccgcacgccgctgcgtatggccgagtacgccgccaccgcagaagagcgcggcgtccaggtgatcatcgccggagccggcggggccgcgcaccttcccggcatggtggccgcgcagactctcgttcccgtcctcggcgtcccggtggaatcccacgctttgaaaggcatggattcgctgctctccatcgtccagatgcccagcggcatcccggtcggtaccctcgccatcggcaaggccggcgccatcaacgccgcgctcctcgccgtcgccatcctcgccaacactcgccccgaactgcgcgaaaaactccgccgttatcgccaggagcagaccgcgcgcgtggagcgggagacgctatga

SEQ ID NO: 13476 - protein, 156 aa, Solibacter usitatus Ellin6076
MVGIIMGSKSDWETMQHAAQTLQQFDVAHECRVVSAHRTPLRMAEYAATAEERGVQVIIAGAGGAAHLPGMVAAQTLVPVLGVPVESHALKGMDSLLSIVQMPSGIPVGTLAIGKAGAINAALLAVAILANTRPELREKLRRYRQEQTARVERETL

SEQ ID NO: 13477 - DNA, 513 bp, Magnetococcus sp. MC-1
  CDS (1)..(513): transl_table=11
atgaataacaccccacagatcgccattttaatgggctctgactccgactgggatgtgatgtccgaagccggtaaggttctcaaagggtttgatattccctttgagatgctggttacttcagcccaccgtaccccagaacgaacccatgcctacgccaaatccgccgccgcacgaggcattctcgcctttattgtcggggcaggtgccgcggcccatttggctggggtgatcgcctcagaaagtaatctaccggtgattggcgtgcccttgtccgcgactgaactcaaagggatggatgccctgctcgcgaccgtgcaaatgccagggggcgttcctgtggcaaccatggccatcggtaaagctggggcgaaaaatgcgggtatcttcgccgcgcaaatactggcacttagcgatccccagttggcggcaaagttggtccgctatcgtgaagaaatggccgctgcggtgactaagaaaaatgaagccctacaggccaaactggccgatttttaa

SEQ ID NO: 13478 - protein, 170 aa, Magnetococcus sp. MC-1
MNNTPQIAILMGSDSDWDVMSEAGKVLKGFDIPFEMLVTSAHRTPERTHAYAKSAAARGILAFIVGAGAAAHLAGVIASESNLPVIGVPLSATELKGMDALLATVQMPGGVPVATMAIGKAGAKNAGIFAAQILALSDPQLAAKLVRYREEMAAAVTKKNEALQAKLADF

SEQ ID NO: 13479 - DNA, 522 bp, Mycobacterium avium 104
  CDS (1)..(522): transl_table=11
atgagcgtgaccgaagctcctcgcgtcgcggtgatcatgggcagcgacagcgactggtcggtgatggccgacgccgcggccgcgctggccgagttcgacgtgcccaccgaggtgcgggtggtctcggcgcaccgcacgccgggggtgatgttcgactacgcgcgcgacgcggccgggcggggcatcgaggtgatcatcgccggcgccggcggcgccgcccacctgcccggcatggtcgcctcggcgacgccgctgccggtgatcggggtcccggtgccgctgggccggctggacgggctggactcgctgctgtcgatcgtgcagatgcccgcgggggtgccggtggccaccgtctccatcggcggcgcccgcaacgccggcctgctggcggtgcgcatcctcggcgcctccgacccggggctgcgggcccgcatcgtcgagttccagacccagctggccgacagcgtgcgggccaaggatgaggcgctgcaaaggctgcacggtaaagttaccggtcagtag

SEQ ID NO: 13480 - protein, 173 aa, Mycobacterium avium 104
MSVTEAPRVAVIMGSDSDWSVMADAAAALAEFDVPTEVRVVSAHRTPGVMFDYARDAAGRGIEVIIAGAGGAAHLPGMVASATPLPVIGVPVPLGRLDGLDSLLSIVQMPAGVPVATVSIGGARNAGLLAVRILGASDPGLRARIVEFQTQLADSVRAKDEALQRLHGKVTGQ

SEQ ID NO: 13481 - DNA, 480 bp, Mycobacterium smegmatis str. MC2 155
  CDS (1)..(480): transl_table=11
atgggcagcgacagcgactggacggtgatggtcgacgccgcagaggcgctcgccgagttcgaggtgccgttcgaggtcggcgtggtctcggcgcaccgcacccccggtcgcatgctggactacgcgaagaacgccgccgaccgcggcatcgaggtgatcatcgccggcgcgggcggtgccgcgcacctgcccgggatggtcgcgtccgcgacgccgctgcccgtcatcggcgtccccgtcccgctggcccgattggacggattggattcgctgctgtcgatcgtgcagatgccggccggggtcccggtggcgacggtgtcgatcggcggggcgcgcaacgcgggcctgctcgcggtgcggatcctcggtgccacggacccgcagttgcggggcaggatggcgaagttccaggccgacctggaggccatggttctggaaaaggacgcagccctgcggtcgcgtctcctcggcgacgggtag

SEQ ID NO: 13482 - protein, 159 aa, Mycobacterium smegmatis str. MC2 155
MGSDSDWTVMVDAAEALAEFEVPFEVGVVSAHRTPGRMLDYAKNAADRGIEVIIAGAGGAAHLPGMVASATPLPVIGVPVPLARLDGLDSLLSIVQMPAGVPVATVSIGGARNAGLLAVRILGATDPQLRGRMAKFQADLEAMVLEKDAALRSRLLGDG

SEQ ID NO: 13483 - DNA, 540 bp, Nocardioides sp. JS614
  CDS (1)..(540): transl_table=11
gtgagtaaccccttggaaggacgggccgtggagccacgagtcggcatcgtgatggggtcggactccgactggccggtgatgaaggccgccgccgaggcgctggccgagttcgacatcggctacgaggcggacgtggtctcggcgcaccggatgcccgaggagatgctggcctacggcagggaggccgcggaccgcggcctgtccgtgatcgtggccggcgccggtggggccgcccacctgccgggcatgctcgctgcggtgacgccgctgcccgtgatcggcgtaccggtgccgctgaagaacctggacggtctggactccctcctctcgatcgtccagatgcccgcgggcgtcccggtcgccaccgtcgcggtcggcggcgcccgcaacgcgggcctgctcgccgtgcggatcctggccgccaccgaccccgagctccaggacaagatgcgcgccttccaggcggagctgcgaaccaccgcgcagcacaagggtgaggcggtccgcaacgaccggcccggccggcgcctcggcttctag

SEQ ID NO: 13484 - protein, 179 aa, Nocardioides sp. JS614
MSNPLEGRAVEPRVGIVMGSDSDWPVMKAAAEALAEFDIGYEADVVSAHRMPEEMLAYGREAADRGLSVIVAGAGGAAHLPGMLAAVTPLPVIGVPVPLKNLDGLDSLLSIVQMPAGVPVATVAVGGARNAGLLAVRILAATDPELQDKMRAFQAELRTTAQHKGEAVRNDRPGRRLGF

SEQ ID NO: 13485 - DNA, 513 bp, Azoarcus sp. BH72
  CDS (1)..(513): transl_table=11
atgagcgaacagcagacgtccgccgcgcccgtcgtcggaatcatcatgggctcgaactccgactggcccaccatgcaggcagccgccaagatcctcgccgacttcggcgtgccttacgaggcgcgggtcgtgtcggcgcaccgcaccccggacctgatgttcgagtacgcagccggcgcgcgtggccgcggcctcaaggccatcatcgcgggcgctggcggcgcggcacatctgccgggcatggtggcggccaagaccacgctgccggtgctgggcgttccggtccagtcgcgcgcgctgtccgggcaggattcgctgctctccatcgtgcagatgccgaagggcgtgccggttgccacctttgccatcggtgaagcgggggcggcaaacgccggcctcttcgcggtggcactgctcgcaaccggaaatcccgaactggcagagcggcttgaccgcttccgccaggtgcagaccgacaccgtgctggcgatggagttgccgccgcccgtctga

SEQ ID NO: 13486 - protein, 170 aa, Azoarcus sp. BH72
MSEQQTSAAPVVGIIMGSNSDWPTMQAAAKILADFGVPYEARVVSAHRTPDLMFEYAAGARGRGLKAIIAGAGGAAHLPGMVAAKTTLPVLGVPVQSRALSGQDSLLSIVQMPKGVPVATFAIGEAGAANAGLFAVALLATGNPELAERLDRFRQVQTDTVLAMELPPPV

SEQ ID NO: 13487 - DNA, 486 bp, Neisseria meningitidis FAM18
  CDS (1)..(486): transl_table=11
atgacacaaatcggcatcatcatgggcagcaacagcgattggcccgttatgcggcaggcagcgcagtttcttgaagagttcggcgtagaatatgaggcgcgcgtcgtttccgcacaccgcactccggatttaatgttccaatacgccgaaaccgcacgggcgcgcggcatcaaagccatcatcgcgggtgcgggcggcgcggcgcatttacccggcatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctggccaacgaaaaccccgaactggcgcaaaaactggcagacttccgagccaaacaggaacaggctgttttgagtatggaattggaacagatttaa

SEQ ID NO: 13488 - protein, 161 aa, Neisseria meningitidis FAM18
MTQIGIIMGSNSDWPVMRQAAQFLEEFGVEYEARVVSAHRTPDLMFQYAETARARGIKAIIAGAGGAAHLPGMVAAKTTVPVLGVPVPSKYLRGEDSLLSIVQMPKGVPVATFAIGEAGAANAALFAVSMLANENPELAQKLADFRAKQEQAVLSMELEQI

SEQ ID NO: 13489 - DNA, 498 bp, Acidovorax sp. JS42
  CDS (1)..(498): transl_table=11
atgaaccccatccagatcggcgtggtcatgggctccagcagcgactgggagaccatgcagcacgcagttgccatcctccagcaattcggcatcgcgcacgaggcgcaggtggtctccgcccaccgcatgcccgacgacatgttccgctacgccgaggccgcggccggccggggcctgaaggccatcatcgcgggcgccggcggcgccgcgcacctgcccggcatgatcgccgccaagaccaccgtgccggtgctgggcgtgccggtcgccagccgccacctgcagggagtggactcgctgcactccatcgtgcagatgcccaagggcgtgcccgtggccacgttcgccatcggcgcggccggcgcggccaacgcggcgctgttcgccgtggcgctgctggcgggcgagaacccggcgctgcgcgagcagctggacgccttccgcgccgagcagaccgccgccgcgcgcgccatgacgctgccgccggtgtccgcatga

SEQ ID NO: 13490 - protein, 165 aa, Acidovorax sp. JS42
MNPIQIGVVMGSSSDWETMQHAVAILQQFGIAHEAQVVSAHRMPDDMFRYAEAAAGRGLKAIIAGAGGAAHLPGMIAAKTTVPVLGVPVASRHLQGVDSLHSIVQMPKGVPVATFAIGAAGAANAALFAVALLAGENPALREQLDAFRAEQTAAARAMTLPPVSA

SEQ ID NO: 13491 - DNA, 522 bp, Magnetospirillum magnetotacticum MS-1
  CDS (1)..(522): transl_table=11
atgggcaaagtagtgcctccccaggtcggcatcatcatgggcagccagtccgactgggaaaccatgcgtcacgcagcccaggtgctgagcgatctgggcatcgccttcgagaccagggttgtctcggccctccgcacgcccaagcgcctctacgactacgccacctcggccaagggccgcgtcctcaaggtcatcatcgccggggctggcggcgccgcccatctgcctggcatggccgccgccatgaccacgcttccggtcttcggcgtgcccgtggaaagcaaggcgctgaagggcatggactcgctgctgtccatcgtccagatgcccggcggcattcccgtgggaaccctggccatcggtaaagcgggcgccaccaatgccgccctgctggccggagcggtcatcgccctgatggagcccggtgtggacaaggctctggaagcctggcgcgcccgccagaccgaatccgtggccgaggcgcccgtagaccccgattctcccgacctgatccgcccgtga

SEQ ID NO: 13492 - protein, 173 aa, Magnetospirillum magnetotacticum MS-1
MGKVVPPQVGIIMGSQSDWETMRHAAQVLSDLGIAFETRVVSALRTPKRLYDYATSAKGRVLKVIIAGAGGAAHLPGMAAAMTTLPVFGVPVESKALKGMDSLLSIVQMPGGIPVGTLAIGKAGATNAALLAGAVIALMEPGVDKALEAWRARQTESVAEAPVDPDSPDLIRP

SEQ ID NO: 13493 - DNA, 519 bp, Nostoc punctiforme PCC 73102
  CDS (1)..(519): transl_table=11
atgactcccctagttggtattatcatgggcagcgattctgatttgcccaccatgaaagacgcgatcgcagtttgtgacgaatttggtgttgagagcgaagtggcgatcgtttctgctcaccgtaccccagaacggatggtgcaatatgctcaacttgcacaccaacgcggtattaaggtgattattgccggtgccggtggtgctgcccatctgcctggaatggtagcgtctttaacaccacttcctgttattggtgttcctgtagtcaccaggaacttacaaggtgtagattctttgtattctattttacaaatgcctgcgggtattcctgtagcaacagtggcgatcggtaatgccaaaaatgccggacttttagcagtacaaatactggcaactcaacaaccagaattgctagaaaaagtccaacaatatcgccaaaccctatgtgaatcagtaattgcaaagcaagaaaagctagaacaactaggctatgagcaatatttaaagcagatgttttag

SEQ ID NO: 13494 - protein, 172 aa, Nostoc punctiforme PCC 73102
MTPLVGIIMGSDSDLPTMKDAIAVCDEFGVESEVAIVSAHRTPERMVQYAQLAHQRGIKVIIAGAGGAAHLPGMVASLTPLPVIGVPVVTRNLQGVDSLYSILQMPAGIPVATVAIGNAKNAGLLAVQILATQQPELLEKVQQYRQTLCESVIAKQEKLEQLGYEQYLKQMF

SEQ ID NO: 13495 - DNA, 501 bp, Bifidobacterium longum DJO10A
  CDS (1)..(501): transl_table=11
atggcaaatgaatccaagcccgaagtcgcagtggtcatgggatcggccagcgactgggagaccatgaagcgcgcctgcgatattctcgaccagttcggcgtcgcctaccacaagcaggtcatctccgcgcaccgcacgcccgagctcatggccgagttcgcgcacaacgcccgcgccaatggcctgaaggtcattatcgccggtgccggcggtgccgcccacctgccgggcatgatcgccgcgcagaccacactgcccgtgatcggcgtgcccgtgcgctcccacgccctgtccggctgggattcgctgctgtccatcgtgcagatgcccggcggcattccggtggccaccaccgccgtcggcaactccggtgccaccaacgccggcctgctcgccgtgcagatgctctccgccttcgagcccgaactggccgacaagcttgaggattaccgtaacgaactgaaggaaaaggtggccgaatccaatgcccagcttgtctga

SEQ ID NO: 13496 - protein, 166 aa, Bifidobacterium longum DJO10A
MANESKPEVAVVMGSASDWETMKRACDILDQFGVAYHKQVISAHRTPELMAEFAHNARANGLKVIIAGAGGAAHLPGMIAAQTTLPVIGVPVRSHALSGWDSLLSIVQMPGGIPVATTAVGNSGATNAGLLAVQMLSAFEPELADKLEDYRNELKEKVAESNAQLV

SEQ ID NO: 13497 - DNA, 498 bp, Haemophilus somnus 2336
  CDS (1)..(498): transl_table=11
atgcaagataataaacctcaaatagccattgtcatgggatcaaaaagtgactggtcgactatgcaagaaaccgctatcattttagatagcttggatttaccttaccatgttgaagttgtatcggcacatcgcactcccgataaactctttgagtttgcagaaaatgcagaagcaaaaggttataaagtgattattgctggtgctggtggtgccgcacatttacccggtatgattgcagcaaaaactatcgtgcctgtattaggtgtgccagtaaaaagctcaacgttaaatggtgtagatagtttatattctattgtgcaaatgcccaaaggcattcctgtgggaaccttggctatcggatctgccggagctgcaaatgccgctttgttagcctcacaaattctcgctgctttcgatccgcacttagcacaaaaattgcaccaatttcgccaagctcaaactgacagtgttttgaataattccgatccgagagaataa

SEQ ID NO: 13498 - protein, 165 aa, Haemophilus somnus 2336
MQDNKPQIAIVMGSKSDWSTMQETAIILDSLDLPYHVEVVSAHRTPDKLFEFAENAEAKGYKVIIAGAGGAAHLPGMIAAKTIVPVLGVPVKSSTLNGVDSLYSIVQMPKGIPVGTLAIGSAGAANAALLASQILAAFDPHLAQKLHQFRQAQTDSVLNNSDPRE

SEQ ID NO: 13499 - DNA, 474 bp, Fusobacterium nucleatum subsp. vincentii ATCC 49256
  CDS (1)..(474): transl_table=11
atgaaagtaggaattatatttggaagtaagtcagatgttgatgtgatgaaaggagcagcagactgtttaaaaaagtttgggatagaatattctacacatgttttatcagcacatagagttcctgaacttttagaagaaacattagaaaagtttgagaaagaagattatggagttatcattgctggagcaggacttgcagcacatttaccaggagttattgcttctaaaacaattttacctgtgataggaatacctattaaggcagcagttgaaggtttggatgcactgttttcaatagtacaaatgcctaaatcaattcctgttgcaacagtagggataaataattcatataatgcaggaatgttagcagtggaaatattagcagttggaaacaaagaattaagagataaacttttagagtttagaaaagaaatgaaagaagattttaaaaaaaatatacatgtggaattatag

SEQ ID NO: 13500 - protein, 157 aa, Fusobacterium nucleatum subsp. vincentii ATCC 49256
MKVGIIFGSKSDVDVMKGAADCLKKFGIEYSTHVLSAHRVPELLEETLEKFEKEDYGVIIAGAGLAAHLPGVIASKTILPVIGIPIKAAVEGLDALFSIVQMPKSIPVATVGINNSYNAGMLAVEILAVGNKELRDKLLEFRKEMKEDFKKNIHVEL

SEQ ID NO: 13501 - DNA, 495 bp, Haemophilus influenzae R2846
  CDS (1)..(495): transl_table=11
atgtcaaacactgcacaaattgccgttgtaatgggttccaaaagcgattgggctaccatgcaagaggcaactcagattttagatgaattaaaagtaccttatcatgtggaagtcgtctctgctcatcgtacgcctgataaactttttgaatttgctgaaaatgcacaaaaaaatggatacaaagtaattattgctggggcaggcggtgcggcacatttaccaggtatgatcgcagcgaaaacccttgtgccagtgctgggcgtgccagtaaaaagttctatgttaagtggcgtagatagcctttattcaattgtgcaaatgccaaaagggattccagtcggaacattagcaattggccctgcgggtgccgcaaatgctggattgttagccgcacaaattctagcaagttgggatgcagaattattttcacgcttgcaatctttccgtgaaagccaaactcgtactgtactggacaatcccgatccacgcacataa

SEQ ID NO: 13502 - protein, 164 aa, Haemophilus influenzae R2846
MSNTAQIAVVMGSKSDWATMQEATQILDELKVPYHVEVVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILASWDAELFSRLQSFRESQTRTVLDNPDPRT

SEQ ID NO: 13503 - DNA, 489 bp, Listeria monocytogenes str. 4b H7858
  CDS (1)..(489): transl_table=11
atgcctgctgtaattggtgtcattatggggagtacctcagattgggatacaatgaaaaaagcatgtgatgtattagatgaattagaaatagcttatgagaaaaaagtggtttctgctcatcgtacaccagatttaatgtttcaatatgcagaacaagcgcgggaacgtggtttgaaaattattattgccggtgctgggggcgcggcgcatttgccaggtatgattgcggcaaagacgactttgcctgttattggtgtgccaattaaatcaaaagcgttgaatggaatggattcgttactttctattgtacagatgcctggaggtgttccggtagcgacagttgctattggagaaagtggtgctgtaaatgctggccttctagcggcgcaaattttatccataacggacgatgcaattactaacagattacaaaaaagacgtgctacactagaagaaacagttctagaaagtagtgattatcttggataa

SEQ ID NO: 13504 - protein, 162 aa, Listeria monocytogenes str. 4b H7858
MPAVIGVIMGSTSDWDTMKKACDVLDELEIAYEKKVVSAHRTPDLMFQYAEQARERGLKIIIAGAGGAAHLPGMIAAKTTLPVIGVPIKSKALNGMDSLLSIVQMPGGVPVATVAIGESGAVNAGLLAAQILSITDDAITNRLQKRRATLEETVLESSDYLG

SEQ ID NO: 13505 - DNA, 492 bp, Wolbachia endosymbiont of Drosophila simulans
  CDS (1)..(492): transl_table=11
atgacaaaaataaaaaaagatgttgctgttattatgggaagtgagtcagattacaccactatggtccatactgttgatatgttaaaagcattagaagtttcacatgatatattcataatatctgcacatagaacaccagaaaggctcttcaattttgctaaatctgcacaagaagaaggttttaaggttattatagctggtgcaggaggtgcagctcatttacctggtatggttgcgtcactaacttgtttaccagttatcggcgttcctgtgcatagtaaacaattaaatgggctggacagcctactctctatagttcaaatgccaaagggtgttccagttgcaaccatgtctataggagaaaatggagcatataatgctgccattactgccgtatctatattgtcaatttccaacagtgaaattgcaggtaggttaaaaaagtggagagagaaacagaccaaagaagtaaaagaaaaaccagtttcataa

SEQ ID NO: 13506 - protein, 163 aa, Wolbachia endosymbiont of Drosophila simulans
MTKIKKDVAVIMGSESDYTTMVHTVDMLKALEVSHDIFIISAHRTPERLFNFAKSAQEEGFKVIIAGAGGAAHLPGMVASLTCLPVIGVPVHSKQLNGLDSLLSIVQMPKGVPVATMSIGENGAYNAAITAVSILSISNSEIAGRLKKWREKQTKEVKEKPVS

SEQ ID NO: 13507 - DNA, 462 bp, Bacillus anthracis str. A2012
  CDS (1)..(462): transl_table=11
atgggaagcacgtcagactgggaaacaatgaaatatgcttgtgacattttagatgaattaaatataccgtatgagaaaaaggttgtatccgctcatcggactccggattatatgtttgaatatgcagagacggctcgtgaacgtggattgaaagttattattgctggagctggtggagcagcgcatttaccaggaatggttgcagcgaagacgaatcttcctgtaatcggagttccagttcaatcaaaagcgttaaacggcttagattcattattatccatcgtccaaatgccaggaggggttccagttgcaactgttgcaattggtaaggctggttcaacaaatgctggtttacttgctgcacaaatacttggatcattccatgatgacatacatgatgcattagaattgagaagagaagcaattgaaaaagatgtgcgcgaaggtagtgagctagtatga

SEQ ID NO: 13508 - protein, 153 aa, Bacillus anthracis str. A2012
MGSTSDWETMKYACDILDELNIPYEKKVVSAHRTPDYMFEYAETARERGLKVIIAGAGGAAHLPGMVAAKTNLPVIGVPVQSKALNGLDSLLSIVQMPGGVPVATVAIGKAGSTNAGLLAAQILGSFHDDIHDALELRREAIEKDVREGSELV

SEQ ID NO: 13509 - DNA, 567 bp, Crocosphaera watsonii WH 8501
  CDS (1)..(567): transl_table=11
atgatagcatcaaatggaagtctattctactatttaaccctgatgagttcttcttctcccctaatcggtattattatgggcagtgattcagatttgcccacaatggacaaagcgatcgccgtttgccaaaggtttgaagtaccctgggaagtggctattgtttcagcacatcgaaccccccaaaggatggttaactacgctcaaactgcccatgaaagaggattaaaggtaattattgcgggggcagggggggcggcacatcttccaggaatggtggcttctttgaccccattacctgtcatcggggttccggttgccactcgtcacctacaaggggtagattctctctattccattgtacagatgcccagaggtattcctgtggctacggtagctattggtaacgaccaaaatgcaggactattagccattcaaatgttagctgctcacgatcctattttattgaaaaaagtacaaaactatcgacaagaattagaacaaatggtgttagataaacaagaaaatctagataaattaggttatgaagcttatttaaaacagatgtaa

SEQ ID NO: 13510 - protein, 188 aa, Crocosphaera watsonii WH 8501
MIASNGSLFYYLTLMSSSSPLIGIIMGSDSDLPTMDKAIAVCQRFEVPWEVAIVSAHRTPQRMVNYAQTAHERGLKVIIAGAGGAAHLPGMVASLTPLPVIGVPVATRHLQGVDSLYSIVQMPRGIPVATVAIGNDQNAGLLAIQMLAAHDPILLKKVQNYRQELEQMVLDKQENLDKLGYEAYLKQM

SEQ ID NO: 13511 - DNA, 492 bp, Exiguobacterium sibiricum 255-15
  CDS (1)..(492): transl_table=11
atgagtaaggtagaaatcggagtcatcatgggcagccaatcggattgggtgaccatgcagaaaacgtgtgatgtactggatcaattggacattggttatgaaaagaaagttgtatcggcacaccggacacctgacttaatgtttcgatatgccgagtcagcccgggaacgagggctcaaggtcatcattgccggggcaggcggagccgctcatcttccgggaatggttgctgcgaagacgacattaccggtaatcggtgtcccaattcaaagcaaagcacttcaaggcatcgattccttactctccattgtccaaatgcccggtggtgttccagtcgcgacagttgcaattggtgacgccggagccaaaaatgcgggtttacttgctgctcagattcttggaacggttgacgaacggattgcccgagctcttgatcatatgcgtgtcgaactggaaggagacgtcatcgcttccgaggtgtatctgacatga

SEQ ID NO: 13512 - protein, 163 aa, Exiguobacterium sibiricum 255-15
MSKVEIGVIMGSQSDWVTMQKTCDVLDQLDIGYEKKVVSAHRTPDLMFRYAESARERGLKVIIAGAGGAAHLPGMVAAKTTLPVIGVPIQSKALQGIDSLLSIVQMPGGVPVATVAIGDAGAKNAGLLAAQILGTVDERIARALDHMRVELEGDVIASEVYLT

SEQ ID NO: 13513 - DNA, 525 bp, Prosthecochloris aestuarii DSM 271
  CDS (1)..(525): transl_table=11
atgacaaaacagaccaatgacgcaacgcctgttgtaggcatcatcatgggttcggattccgactttgaaataatgaaagaggccgccctggtccttgacgaattcaatatcgcctaccaggtatcggtcatatcggcacaccgcactcccaaagaactggagcagtatgctggaagtgcaaaagagcggggaatgaaaatcatcattgccggcgcaggcggtgcagctcaccttcccggcgtcactgcagctcttactgtcattccggttatcggtgtaccgatcttcagtaaaaaactcaatgggcaggattcgctctattctatcgtgcagatgccggcaggcattcctgtggcgactgtcgggatcgataacgcccgcaacgcagcgctgcttgccgtacagatccttgcgctgagcgataccgggatcatgaaggatattgaatcgttccgggaaaaacttgctgacgcatcgaaactgaaaaacaaaaaaatacaggaaaagcttcatgctgacagctga

SEQ ID NO: 13514 - protein, 174 aa, Prosthecochloris aestuarii DSM 271
MTKQTNDATPVVGIIMGSDSDFEIMKEAALVLDEFNIAYQVSVISAHRTPKELEQYAGSAKERGMKIIIAGAGGAAHLPGVTAALTVIPVIGVPIFSKKLNGQDSLYSIVQMPAGIPVATVGIDNARNAALLAVQILALSDTGIMKDIESFREKLADASKLKNKKIQEKLHADS

SEQ ID NO: 13515 - DNA, 504 bp, Xylella fastidiosa Ann-1
  CDS (1)..(504): transl_table=11
atgatctccaatcaatcccccccgctggtcggtattgtcatgggttcctcttcggattggggggcgatgcagcatgccgcacaaaagctcgatgctctcagcgtcgcgtatgaagtgaaggtcgtttcggcgcatcgtactccggataaattgtttgcttatgctgagcaggctgaaggacgtggtttgcgtgccatcattgccggggccggtggcgcagcgcaccttccaggtatgttggctgctaagacgatagttccagtgttgggggtgccaatgcagtccagggctctgaatggtttggattcgctgttatcgatcgtacagatgccggcgggtattccagtagccacgttcgcgattggggaagctggtgcagtcaatgccgccctgtttgccgccgcgctgttggtacccgaaaatccagtaatgcgtcggatgctgactgagttccgccaacgtcagacggatcaggtgaatgctgcggacgatccacgccaatga

SEQ ID NO: 13516 - protein, 167 aa, Xylella fastidiosa Ann-1
MISNQSPPLVGIVMGSSSDWGAMQHAAQKLDALSVAYEVKVVSAHRTPDKLFAYAEQAEGRGLRAIIAGAGGAAHLPGMLAAKTIVPVLGVPMQSRALNGLDSLLSIVQMPAGIPVATFAIGEAGAVNAALFAAALLVPENPVMRRMLTEFRQRQTDQVNAADDPRQ

SEQ ID NO: 13517 - DNA, 504 bp, Xylella fastidiosa Ann-1
  CDS (1)..(504): transl_table=11
atgatctccaatcaatcccccccgctggtcggtattgtcatgggttcctcttcggattggggagcgatgcagcacgccgcacaaaagctcgatgctctcagcgtcgcgtatgaagtgaaggtcgtttcggcgcatcgtactccggataaattgtttgcttatgctgagcaggctgaaggacgtggtttgcgtgccatcattgccggggccggtggtgcagcgcaccttccaggtatgttggcggctaagacgatggttccagtgttgggggtgccaatgcagtccagggctctgaatggtttggattcgctgttatcgatcgtacagatgccggcgggtattccagtagccacgttcgcgattggggaagctggtgcagtcaatgccgccctgtttgccgcagcgctgttggtacccgaaaatccagcaatgcgtcggatgctgactgagttccgccaacgtcagacggatcaggtgaatgctgcggacgatccacgccaatga

SEQ ID NO: 13518 - protein, 167 aa, Xylella fastidiosa Ann-1
MISNQSPPLVGIVMGSSSDWGAMQHAAQKLDALSVAYEVKVVSAHRTPDKLFAYAEQAEGRGLRAIIAGAGGAAHLPGMLAAKTMVPVLGVPMQSRALNGLDSLLSIVQMPAGIPVATFAIGEAGAVNAALFAAALLVPENPAMRRMLTEFRQRQTDQVNAADDPRQ

SEQ ID NO: 13519 - DNA, 489 bp, Streptococcus suis 89/1591
  CDS (1)..(489): transl_table=11
atgaatattccaatttccatcatcatgggctctagttccgactggaaaaccatgaaaaaagcagccgatgtgctggacaaatttggcgtagcctatgaaaagaaagtggtctctgcccaccgcaccccagacctcatgttccgtcatgccgaagaggcgcgtggtcgtggtattaaggttattatcgcgggagcgggtggtgcggctcatttgccaggtatggtagcagccaagaccaccctgcctgttatcggtgttcctgtccaatcccgtgccctcagcggtgtggattcgctctattctatcgtgcaaatgccaggcggcgtacctgtggcaacgatggcaattggagaagcgggagcaaccaatgcggctttgactgccctgcgtatcctgtccatcgaagatagcggtatagcagatcaactggccagctttgctattgaacaaggaaaaatcgcggaggctatgagcgatgaactcaactaa

SEQ ID NO: 13520 - protein, 162 aa, Streptococcus suis 89/1591
MNIPISIIMGSSSDWKTMKKAADVLDKFGVAYEKKVVSAHRTPDLMFRHAEEARGRGIKVIIAGAGGAAHLPGMVAAKTTLPVIGVPVQSRALSGVDSLYSIVQMPGGVPVATMAIGEAGATNAALTALRILSIEDSGIADQLASFAIEQGKIAEAMSDELN

SEQ ID NO: 13521 - DNA, 492 bp, Croceibacter atlanticus HTCC2559
  CDS (1)..(492): transl_table=11
atgccaaaagttggaattatcatgggaagtactagcgatatgccagttatgcaagacgctatagatattttaagggaatttaatatagatattgaagttgatattgtttctgctcacagaacaccagagaagttatttgattacagtaagaatgctcacaatcggggcataaatgtaattatagctggtgctggtggtgcagcacatttaccaggaatggttgcttcactttcacctttacctgttattggtgttcctgtaaaatcaagcaattcaattgatggttgggattctgttctttctattttacaaatgcctggaggcgtacctgtagcaacagtagctctcaacggagctaaaaatgcaggaatactcgccgctcaaattataggtagtagtaattctgaaatacttgaaacaattattgactataaagaaagtttgaaacaaaaggtaattgatggcgcaaaatccataagtactaataagtaa

SEQ ID NO: 13522 - protein, 163 aa, Croceibacter atlanticus HTCC2559
MPKVGIIMGSTSDMPVMQDAIDILREFNIDIEVDIVSAHRTPEKLFDYSKNAHNRGINVIIAGAGGAAHLPGMVASLSPLPVIGVPVKSSNSIDGWDSVLSILQMPGGVPVATVALNGAKNAGILAAQIIGSSNSEILETIIDYKESLKQKVIDGAKSISTNK

SEQ ID NO: 13523 - DNA, 489 bp, Sulfitobacter sp. EE-36
  CDS (1)..(489): transl_table=11
atggaaaatccacctgtcggcatcatcatgggctcgcagtccgattgggctacgatgcgtgaggcagcgacgctgctggatgaacttggtatcgcgtacgaagccaagatcgtatcggcacaccgcacccccgaccggttgtggagctatgggaaaaccgccgccgaccgtggcctgcaggtgatcatcgccggtgcgggcggtgctgcgcatttgcccggcatgatggcgtccaagacccgcgtgccggtgatcggcgtgccagtgcagaccaaggcgctatcgggtgtggattcgctctattctatcgtgcagatgccccggggctttccggtcgcgacgatggcgatcggtgcggcaggtgctgcgaatgccgcgttgatggcggcaggcattctagccctccaggatcctgcccttgccacccgccttgacgcttggcgcgatgcgcttagcgcgtctatcccagaggagccttcggatgactga

SEQ ID NO: 13524 - protein, 162 aa, Sulfitobacter sp. EE-36
MENPPVGIIMGSQSDWATMREAATLLDELGIAYEAKIVSAHRTPDRLWSYGKTAADRGLQVIIAGAGGAAHLPGMMASKTRVPVIGVPVQTKALSGVDSLYSIVQMPRGFPVATMAIGAAGAANAALMAAGILALQDPALATRLDAWRDALSASIPEEPSDD

SEQ ID NO: 13525 - DNA, 489 bp, Roseovarius nubinhibens ISM
  CDS (1)..(489): transl_table=11
atggccgaaatcaacgtgggcatcatcatgggcagtcaatcggactggccgaccatgaaaaaggcagccgaagttctcgacgaactgggcgtggcctatgaaaccaagatcgtctcggcgcatcgcacgcccgaccggctttgggactatggccgcgaggccgcaggccgtgggctcaaggtgatcatcgcgggcgctggcggtgccgcgcatctgccgggcatgatggcctcgaaaacccgcgtgcctgtcgtcggcgtgccggtgcagacccgcgccctgtcgggggtcgacagcctctattccatcgtgcagatgcccaaaggctatcccgtggccaccatggccattggcgaggcgggcgccgccaacgcgggcctcatggccgcgggcattctcgccacgtccgacgcggcgctggccgaacggctcgacgcctggcgcgcggcgctctcggcctcgatccccgaggagcccaaggatgactga

SEQ ID NO: 13526 - protein, 162 aa, Roseovarius nubinhibens ISM
MAEINVGIIMGSQSDWPTMKKAAEVLDELGVAYETKIVSAHRTPDRLWDYGREAAGRGLKVIIAGAGGAAHLPGMMASKTRVPVVGVPVQTRALSGVDSLYSIVQMPKGYPVATMAIGEAGAANAGLMAAGILATSDAALAERLDAWRAALSASIPEEPKDD

SEQ ID NO: 13527 - DNA, 489 bp, Oceanicola batsensis HTCC2597
  CDS (1)..(489): transl_table=11
atgagcgacacgaaggtaggcatcatcatgggcagccagtccgactggcccacgatgaaggaggcggcgaccatcctcgacgaactgggcgtggcctacgaggccaggatcgtctcggcgcaccgcacgcccgaccggctctggtcctacggcaaggcggcggccggccgcggccttcaggtgatcatcgcgggcgccggcggcgccgcccacctgcccggcatgatggcctcgaagacacgggtcccggtcatcggcgtgcccgtccagacccgggcgctgtcgggcgtggactcgctctattccatcgtccagatgcccaagggcttcccggtcgccaccatggccatcggcgcggcaggagccgccaatgcgggcctcatggccgccggcatcctcgcgctgaacgaccccgacctcgccgtccgcctcgacgcctggcgcgaggccctctccgcctccattcccgacgagcccgcagatgactga

SEQ ID NO: 13528 - protein, 162 aa, Oceanicola batsensis HTCC2597
MSDTKVGIIMGSQSDWPTMKEAATILDELGVAYEARIVSAHRTPDRLWSYGKAAAGRGLQVIIAGAGGAAHLPGMMASKTRVPVIGVPVQTRALSGVDSLYSIVQMPKGFPVATMAIGAAGAANAGLMAAGILALNDPDLAVRLDAWREALSASIPDEPADD

SEQ ID NO: 13529 - DNA, 558 bp, Prochlorococcus marinus str. MIT 9211
  CDS (1)..(558): transl_table=11
atgatccctgcttctagaaacttgccttcagcagatgctgaacaaacaccagttgtagctgttgtaatgggcagtgactctgatttacctactctaaagccagccatcgaagctttagaagatttccaaatcaaagtagaagtacgcgtgctctcggctcatagaacacctagagaaatgatttgcttcgcccaagaagccgaagcaaaatgtcttaaagtcattattgctggagcaggtggagcagcccacctaccagggatgattgcatcactaactactcttccagtaattggagtacctgtaaaaacaaaatctctttctggagttgattccctacactcaattgtgcaaatgcctggaggaattcccgtggcaactgtggccataggaggggggttaaatgcaggcttactagcagctcaaattttagctctatctgatcagaatcttcaaattcagctcgtaagttatagaaaaaaaatgcatgaccaagtcattaataaagatcaaaaacttaatgaaatgggggccaatgattatttatcaaaaatgtaa

SEQ ID NO: 13530 - protein, 185 aa, Prochlorococcus marinus str. MIT 9211
MIPASRNLPSADAEQTPVVAVVMGSDSDLPTLKPAIEALEDFQIKVEVRVLSAHRTPREMICFAQEAEAKCLKVIIAGAGGAAHLPGMIASLTTLPVIGVPVKTKSLSGVDSLHSIVQMPGGIPVATVAIGGGLNAGLLAAQILALSDQNLQIQLVSYRKKMHDQVINKDQKLNEMGANDYLSKM

SEQ ID NO: 13531 - DNA, 429 bp, Erythrobacter sp. NAP1
  CDS (1)..(429): transl_table=11
atgtgctgcgcgagcgagatactcgacgaactcgaagtcgaacacgaggcgcggatcgtctcagcccaccgaacgccagaccggatgagcgcttttgccaagggcgctgaaggcgaagggttcgatgtcattatcgcgggcgctggcggcgcggcgcaccttcccggaatgatcgctgcaatgacacaccttcccgtgctcggcgtgcccgttcagtccaaggcgctgtcgggaatggatagccttctctctatcgtgcaaatgccagccggaattccggtcggaaccctcgcaatcggcgaggctggcgcgaccaatgcggcgctgatggcggccgcgatccttgccatcaacgacgaggaattgtccgagaggctgcaagactggcgagcagcgcgcagcaatgcggttgcagaggcgccggaatga

SEQ ID NO: 13532 - protein, 142 aa, Erythrobacter sp. NAP1
MCCASEILDELEVEHEARIVSAHRTPDRMSAFAKGAEGEGFDVIIAGAGGAAHLPGMIAAMTHLPVLGVPVQSKALSGMDSLLSIVQMPAGIPVGTLAIGEAGATNAALMAAAILAINDEELSERLQDWRAARSNAVAEAPE

SEQ ID NO: 13533 - DNA, 513 bp, Synechococcus sp. RS9917
  CDS (1)..(513): transl_table=11
gtggcggtgatcatgggcagtgattccgatctgcccaccctgcaacccgctgtggaggtgctggagcgtttgggtgtggcggtggaggtgcgcgtgttgtcggcccatcgcacaccgttggagatggtcgactttgctcagcaggccagggatcgcggtctgcgggtgatcgtggccggtgccggtggcgcggcccatctgcccggcatggtcgcttccctcactaccctgccggtgatcggcgtgccagtgcagagccgggcgctctccggtgtggattcactgcattcgatcgtgcagatgcccggcggaatacccgtggccacggtggcgatcggcggtggcctcaatgccggcctgctggcggcccagattctcgccaccaccgatggggagctgacgcaacgcctggccgactatcgccacgagttgcacgccacggtggtggccaaggatgcccgcctccagtcgatcggagccgcccggtatctcgaggcgatgcctggacgctga

SEQ ID NO: 13534 - protein, 170 aa, Synechococcus sp. RS9917
MAVIMGSDSDLPTLQPAVEVLERLGVAVEVRVLSAHRTPLEMVDFAQQARDRGLRVIVAGAGGAAHLPGMVASLTTLPVIGVPVQSRALSGVDSLHSIVQMPGGIPVATVAIGGGLNAGLLAAQILATTDGELTQRLADYRHELHATVVAKDARLQSIGAARYLEAMPGR

SEQ ID NO: 13535 - DNA, 678 bp, Synechococcus sp. WH 5701
  CDS (1)..(678): transl_table=11
ttgctgatccagcgcacggtcatcggctccggggcgaacgggcggggagaatgccatcctcgccgcacggcccctgccgcccctgccttgaccctcgaacccgtttccgctgccgccgccgttgagggagtcaacccgccggcgcccagctcaggggcggcgcccctggtggccgtggtgatgggcagcgattccgatctgccgaccatgcagccggcggtgaaggtgctccaggacttcggtgtggacgtggaggtgcgggtgctctcggcccatcgcaccccgcgggagatggtgaacttcgcggaagctgccgccggccgcggcctcaaggtgatcgtggcgggggcaggcggcgccgcccatctgccgggaatggtggcggcactcaccaccctgccggtgatcggtgtgccggtgttgagccgggccctgtcgggggtggattcgctccattcgatcgtgcagatgccggccggaatccccgtggccacggtggccatcggcaatggcaccaatgccggtctgctggcggtccagatcctggccacggccgatcctgccctggccgagcagctcaggcagcatcgcctggggctccatgatcaggtctgcgccaaggacgcccgcctgagtgagcttggcagcacggcctatctggccgccatggagggctga

SEQ ID NO: 13536 - protein, 225 aa, Synechococcus sp. WH 5701
MLIQRTVIGSGANGRGECHPRRTAPAAPALTLEPVSAAAAVEGVNPPAPSSGAAPLVAVVMGSDSDLPTMQPAVKVLQDFGVDVEVRVLSAHRTPREMVNFAEAAAGRGLKVIVAGAGGAAHLPGMVAALTTLPVIGVPVLSRALSGVDSLHSIVQMPAGIPVATVAIGNGTNAGLLAVQILATADPALAEQLRQHRLGLHDQVCAKDARLSELGSTAYLAAMEG

SEQ ID NO: 13537 - DNA, 558 bp, Synechococcus sp. WH 7805
  CDS (1)..(558): transl_table=11
atgacgccttccgatccagttcagtcaccgatgtcaccgcaggtggccgtgatcatgggcagtgattccgatctccccacccttcatccggcggttgaggttctggagacgctgaacgttgctgtggaggtgcgcgtgttgtcggcccatcgcacacccctggagatggtggactttgcccgtgaggcccgtaaccgcggtctgcaggtgatcgtggccggtgccggcggcgccgctcacttgccaggaatggtggcgtctctcaccaccttgccggtgatcggcgtgccggtgcgcagcagggccctgtccggtgtggactccctccattcgattgtgcagatgccgggtggcattcccgtggccacggttgccatcgggggcgggctgaatgctgggttgctggcggcgcagatcctggcgctccaagaccacgccttgtcggagcgtctcggggcttatcgacgtcagcttcacgacgccgtgaccgcgaaggatcaacgcctggtcgagctcgggtctgcggcctatctcgacgccatggccaccgatcgctga

SEQ ID NO: 13538 - protein, 185 aa, Synechococcus sp. WH 7805
MTPSDPVQSPMSPQVAVIMGSDSDLPTLHPAVEVLETLNVAVEVRVLSAHRTPLEMVDFAREARNRGLQVIVAGAGGAAHLPGMVASLTTLPVIGVPVRSRALSGVDSLHSIVQMPGGIPVATVAIGGGLNAGLLAAQILALQDHALSERLGAYRRQLHDAVTAKDQRLVELGSAAYLDAMATDR

SEQ ID NO: 13539 - DNA, 483 bp, Pseudoalteromonas tunicata D2
  CDS (1)..(483): transl_table=11
atgactgttggcataatcatgggatcaaaatctgactggcctaccatggaacatgcggcgcaaatgttagaacgttttggcatagcatacgaaactaaagtcgtttctgcacatcgcactcctcatttattagctgagtacgcatcaagcgcagcggaacgtggtatcaaagtgattatcgcaggcgctggcggcgcggcacatttaccaggcatggctgcagcatttactagcttacctgtgcttggcgtaccagttaaatcaaaagcacttaatggcatcgattcgctattatcaatttgccaaatgccaaaaggtgtagcggttggtactcttgcaattggtgagccgggtgcggcaaacgctggtttattagcggctcaaattctaggttgtcaacaacctgaaattttcgcaaaaatcgaagcatttcgtaaagaacaaactgattcagtattagcaaacccagatccagcgatttaa

SEQ ID NO: 13540 - protein, 160 aa, Pseudoalteromonas tunicata D2
MTVGIIMGSKSDWPTMEHAAQMLERFGIAYETKVVSAHRTPHLLAEYASSAAERGIKVIIAGAGGAAHLPGMAAAFTSLPVLGVPVKSKALNGIDSLLSICQMPKGVAVGTLAIGEPGAANAGLLAAQILGCQQPEIFAKIEAFRKEQTDSVLANPDPAI

SEQ ID NO: 13541 - DNA, 489 bp, Photobacterium sp. SKA34
  CDS (1)..(489): transl_table=11
atgaaagttggaattatcatgggttcaaaatctgattggccaaccatgcaacatgcggctgagatgcttgatcgtttcaatgttccttatgagacaaaggtcgtttcggctcaccgcacaccacatttattagccgaatacgctgaaagtgcacaagagcgtggcattaaagtgatcatcgcaggtgctggcggtgctgctcacttaccggggatgacagcggcttttactagcgtgcctgtattaggcgtaccagttcaatcacgtgcactaaaagggatggattcattgctttctattgttcaaatgcctaaaggtatagctgttggtaccttagcaattggtgatgcaggggctgccaatgcaggtctcttagccgcacaaattatcggcactcaagatgagcaagtactggccgctattgatactttccgaaaagagcaaacagaaacggtattaagcaacccaaatccagcagaggatgcataa

SEQ ID NO: 13542 - protein, 162 aa, Photobacterium sp. SKA34
MKVGIIMGSKSDWPTMQHAAEMLDRFNVPYETKVVSAHRTPHLLAEYAESAQERGIKVIIAGAGGAAHLPGMTAAFTSVPVLGVPVQSRALKGMDSLLSIVQMPKGIAVGTLAIGDAGAANAGLLAAQIIGTQDEQVLAAIDTFRKEQTETVLSNPNPAEDA

SEQ ID NO: 13543 - DNA, 483 bp, Oceanospirillum sp. MED92
  CDS (1)..(483): transl_table=11
atgagtaaagtatccgtcagtatcattatgggctcacgctctgactggccaaccatgcaagaagcaaccaaaccattggaagagctgggtgtagagtttgaagcaaaagttgtttctgctcaccgtacacctgagcgccttttcaagcatgcttctgaagcacacactcgtggagtcgaagtaattattgccggtgctggcggcgctgctcacctggcagggatggcagcatctatgactcaccttccggtaattgcggtacctgttgccagcaaaaacattaagggcctggatagcctgctatcgatggttcagatgccacgtggcgttgcagtcgcttgtcaggcgattggcggtgcaggcgcatacaatgcaggtctgatggcggcacagatgctagcccttaaagatgaagcactgagccagcgtctacaggagtggcgtaaagcacaaactgacagcgttcctgttgaggtagaataa

SEQ ID NO: 13544 - protein, 160 aa, Oceanospirillum sp. MED92
MSKVSVSIIMGSRSDWPTMQEATKPLEELGVEFEAKVVSAHRTPERLFKHASEAHTRGVEVIIAGAGGAAHLAGMAASMTHLPVIAVPVASKNIKGLDSLLSMVQMPRGVAVACQAIGGAGAYNAGLMAAQMLALKDEALSQRLQEWRKAQTDSVPVEVE

SEQ ID NO: 13545 - DNA, 495 bp, Flavobacteria bacterium BBFL7
  CDS (1)..(495): transl_table=11
atgaataaaaaagtagcaataataatgggctctactagtgacttgccagtgatgcaggacgctatagacgttttaaaagaattaggaataaagaccgatgtagatgttgtaagtgcacatcgtacaccagagaaaatgtatgattttggtaaaaacgcccataagaatgggattgctgtaatcatagctggtgctggtggcgctgctcatttaccaggtatggtagcaagtttatctcctttacctgtagtaggtgtccctgtaaaatcatcaaactctattgatggatgggatagtgttctttcaattttacaaatgcctggtggcgtacctgtcgcaacggttgcactaaatggtgcaaaaaacgcaggaattcttgcggcacaaatcataggtgctacccaagaagacgtacgtgaacgcattatcacttacaaagaaagccttaaagaaaaggtgactaaggccgcacaagagatgcgcaataatggctag

SEQ ID NO: 13546 - protein, 164 aa, Flavobacteria bacterium BBFL7
MNKKVAIIMGSTSDLPVMQDAIDVLKELGIKTDVDVVSAHRTPEKMYDFGKNAHKNGIAVIIAGAGGAAHLPGMVASLSPLPVVGVPVKSSNSIDGWDSVLSILQMPGGVPVATVALNGAKNAGILAAQIIGATQEDVRERIITYKESLKEKVTKAAQEMRNNG

SEQ ID NO: 13547 - DNA, 507 bp, delta proteobacterium MLMS-1
  CDS (1)..(507): transl_table=11
atggaccccgtggtcggagtaatcatgggctcccgcagtgactgggagaccatggaacatgctgtcaagatcctggaagaattcgccattgcccacgaggtgcgggtggtgtcggcccaccggaccccggagctgctcttcgactatgccggcagtgcccggcggcgggggcttaaagtaatcatcgccggggccgggggcgcggcccatctgcccggcatggtggcctcccgcagcagcttgccggtgctgggggtgccggtgcaatccagggccttaaacggcctggattcactgctctccattgtgcagatgccggccggggtgccggtggcaaccctggccatcggcccggccggggccaaaaatgccgccctgctggcggtttccatcctggccggcgatgatcccgccctggccactgccctggatgagcatcgccggcggcagaccgagagcgtgctggccgatcccgacccccggcaaccggcggggggcgtgtcatga

SEQ ID NO: 13548 - protein, 168 aa, delta proteobacterium MLMS-1
MDPVVGVIMGSRSDWETMEHAVKILEEFAIAHEVRVVSAHRTPELLFDYAGSARRRGLKVIIAGAGGAAHLPGMVASRSSLPVLGVPVQSRALNGLDSLLSIVQMPAGVPVATLAIGPAGAKNAALLAVSILAGDDPALATALDEHRRRQTESVLADPDPRQPAGGVS

SEQ ID NO: 13549 - DNA, 537 bp, Oceanobacter sp. RED65
  CDS (1)..(537): transl_table=11
atgatagaatccgccctccataatcaacaggccttatccgaaatgaaaaaccctcaagtcggtatcattatgggttccacttccgattgggataccatgaaaaaagctgaagaagttctgcagcagcttggtgttaacttcgaagtaaaagtggtttccgcgcatcgcaccccggatttgcttttcgagtattcggaaaccgccgcagaacgaggcattcaagttattattgctggcgcaggtggagctgcgcatttgccaggcatggttgcaagcaaaactcacttgcccgtctttggcgtgcccgtcaaaagtaaggccctcaacggcatagactcactgctttcgattgctcaaatgccagcgggcatctcggtaggtacacttgctattgggcctgccggtgccgccaacgccggcttactggcatcgcaggttatcgcccttcatgacgaggatgttcgcgcaaagcttatcgagtttcgtcgcaaacagactgaaaaagtattatcgatccccgatcctagagagatgtaa

SEQ ID NO: 13550 - protein, 178 aa, Oceanobacter sp. RED65
MIESALHNQQALSEMKNPQVGIIMGSTSDWDTMKKAEEVLQQLGVNFEVKVVSAHRTPDLLFEYSETAAERGIQVIIAGAGGAAHLPGMVASKTHLPVFGVPVKSKALNGIDSLLSIAQMPAGISVGTLAIGPAGAANAGLLASQVIALHDEDVRAKLIEFRRKQTEKVLSIPDPREM

SEQ ID NO: 13551 - DNA, 513 bp, Synechococcus sp. RS9916
  CDS (1)..(513): transl_table=11
gtggcggtgattatgggcagcgattccgacctgcccaccatgcacccggcggtgcaggccctgcaggatcttggggtggcggtggaggtgcgggtgctctccgcccatcgcactccgcttgagatggtggccttcgcccagcaggcccgcgatcagggctttggtgtgatcgtggcgggcgctggtggtgcggcccatctccccggcatggtcgcctccctcaccaccctgcccgtgatcggggtgccggtgaagagtcgggcactgtccggggtggattcactgcattccatcgtgcagatgcctggtggcatccctgtggccacggtggcgattgggggtggactcaatgccggtctgctggctgcccagatcctggcggtggcggatgcgtctctggcggcacggttggaggcctatcgccagaccctgcacgacacggtcgtggccaaggacgcgcggctggtggatcttggcgccactgcctatctggagcgcatgccggggcgctga

SEQ ID NO: 13552 - protein, 170 aa, Synechococcus sp. RS9916
MAVIMGSDSDLPTMHPAVQALQDLGVAVEVRVLSAHRTPLEMVAFAQQARDQGFGVIVAGAGGAAHLPGMVASLTTLPVIGVPVKSRALSGVDSLHSIVQMPGGIPVATVAIGGGLNAGLLAAQILAVADASLAARLEAYRQTLHDTVVAKDARLVDLGATAYLERMPGR

SEQ ID NO: 13553 - DNA, 483 bp, Alteromonadales bacterium TW-7
  CDS (1)..(483): transl_table=11
atgactgttggcattattatgggttctaagtcagattggccaaccatggaacacgctgcactgatgctagagcagtttggtattaagtacgaaaccaaagttgtatctgcacaccgcactcctcaattacttgctgattatgcaagctctgctgcagaacgtggcattaaagttattattgccggcgcaggtggcgcagcccatttaccgggtatggcagcggcttttacatctgttcctgttttaggcgttcctgtgaaatcaaaggcattaaatggtgttgattctctattgtcaatttgccaaatgccaaaaggggtagcagtaggtaccttagcaattggtgaaccaggcgctgcaaacgcaggcttattagccgcacaaattttagggtgccataaccccgacatttttgaaaaaatcgaagcgtttcgtaaaaatcaaacagacactatattagccaacccaaaccctgcagagtaa

SEQ ID NO: 13554 - protein, 160 aa, Alteromonadales bacterium TW-7
MTVGIIMGSKSDWPTMEHAALMLEQFGIKYETKVVSAHRTPQLLADYASSAAERGIKVIIAGAGGAAHLPGMAAAFTSVPVLGVPVKSKALNGVDSLLSICQMPKGVAVGTLAIGEPGAANAGLLAAQILGCHNPDIFEKIEAFRKNQTDTILANPNPAE

SEQ ID NO: 13555 - DNA, 504 bp, marine gamma proteobacterium HTCC2143
  CDS (1)..(504): transl_table=11
atgaccaaacctttcgtagccatcctgatgggctcagattccgacttgccacaaatggaagcggcatttggcgtattacaatcatttgatattgattttgaagtaaagattacgtcggcccatcgcaccccaaaggtgacccacgattttgttaccagcgctgatcagcgcggctgtggggcattcatttgtgccgcaggtatggcggctcacttggcaggtgctgttgccgcggcaacgttaaagccggtcatcggtgtacctattaacgcttcgctagatggcttggatgctctattatcgacggtacaaatgcccggtggtattcctgtcgcgactgttgcaattggtaaagcgggtgcaaaaaatgccgcttatctcgcggctcaaatactggcgacagctgacccgtcgctgcatcaaaaactgatagacgagcgtgagtcgaatgcccaagctatcattgctaaagatttggctttgcaggaaaaacttaaaggttaa

SEQ ID NO: 13556 - protein, 167 aa, marine gamma proteobacterium HTCC2143
MTKPFVAILMGSDSDLPQMEAAFGVLQSFDIDFEVKITSAHRTPKVTHDFVTSADQRGCGAFICAAGMAAHLAGAVAAATLKPVIGVPINASLDGLDALLSTVQMPGGIPVATVAIGKAGAKNAAYLAAQILATADPSLHQKLIDERESNAQAIIAKDLALQEKLKG

SEQ ID NO: 13557 - DNA, 483 bp, marine gamma proteobacterium HTCC2080
  CDS (1)..(483): transl_table=11
atggatatttcggtcggtatcattatgggatcgcgctcagattggagtgtgatggaagcggcggccaatatgctcgacgctcttggtattcgctatgagtgcaaagtcgtctcagcccacagaactccagatcgactttatgcctatgcgcgcgaagcgagaggtcggggcttaaaagcgattattgccggcgcggggggggcagctcacttacccggtatgtgtgccgcaatgactccggtgccagttcttggcgtgccggtcgctgccacggtactcaatggcgctgatgccatgctttccatcgctcagatgcctaaaggtgtgccagtggctacttttgccatagggcagcccggcgccgccaatgcagcgctgtttgctgcagccatgttggccaacaacgattcaacgattgctgcagccctcgatcgttttcgagaagagcaaacagcctctgttccagagagcgttaccgattga

SEQ ID NO: 13558 - protein, 160 aa, marine gamma proteobacterium HTCC2080
MDISVGIIMGSRSDWSVMEAAANMLDALGIRYECKVVSAHRTPDRLYAYAREARGRGLKAIIAGAGGAAHLPGMCAAMTPVPVLGVPVAATVLNGADAMLSIAQMPKGVPVATFAIGQPGAANAALFAAAMLANNDSTIAAALDRFREEQTASVPESVTD

SEQ ID NO: 13559 - DNA, 492 bp, Marinobacter sp. ELB17
  CDS (1)..(492): transl_table=11
atgcaaccgctggtaggactcatcatgggttccaaatccgactggcccaccatggaaaacgccgccaacatgctcgacaaacttggcgtggcctatgaaaccaaagtcgtttccgcccaccgcacccccgacctgctgttcgaatacgccaaaactgcagccgatcgcggcctgaaagttatcatagccggcgccggcggtgcagcccacctaccaggcatggtagcctcgcagacctccttacctgtgctaggcgttcccgttcagtccaaagccctgaacggactggattcactgctgtctatcgtgcagatgcccggcggcattgccgtgggcactctggccatcggcaacgcaggcgccactaatgccggtttgctggctgcacaaattattggcacctttgacccgaccgtgcgccaagctgttgaccaattccgcagcacgcaaacacaaacgattctggacaacccggacccggcggttccgtaa

SEQ ID NO: 13560 - protein, 163 aa, Marinobacter sp. ELB17
MQPLVGLIMGSKSDWPTMENAANMLDKLGVAYETKVVSAHRTPDLLFEYAKTAADRGLKVIIAGAGGAAHLPGMVASQTSLPVLGVPVQSKALNGLDSLLSIVQMPGGIAVGTLAIGNAGATNAGLLAAQIIGTFDPTVRQAVDQFRSTQTQTILDNPDPAVP

SEQ ID NO: 13561 - DNA, 489 bp, Bacillus sp. SG-1
  CDS (1)..(489): transl_table=11
atgcagccaaaagtgggagttgtcatgggaagtacttctgattggaaaacaatgaagcatgcatgtgatattcttgatgagtatggcatcatttacgagaaaaaagtggtctctgcccacagaacccctgacttgatgttcgactatgcagagagcgccaggggaagaggcttgaaagtaatcatcgccggtgccggcggagcagcacatctaccgggaatggttgccgccaagacgactcttccagtcatcggagttcctgtacagtctaaggcattgaatggcctggattcacttttatccatcgtccaaatgccgggcggtgtaccggttgcgacagtggccatcggtgaagcgggtgccaagaatgccgggctgcttgctgcgcagattctttcaacagaggatgatggaattgccaataaactggacagcagcagggaagccctgagacaaaaagtgatggaaagcagtgatgagcttgaataa

SEQ ID NO: 13562 - protein, 162 aa, Bacillus sp. SG-1
MQPKVGVVMGSTSDWKTMKHACDILDEYGIIYEKKVVSAHRTPDLMFDYAESARGRGLKVIIAGAGGAAHLPGMVAAKTTLPVIGVPVQSKALNGLDSLLSIVQMPGGVPVATVAIGEAGAKNAGLLAAQILSTEDDGIANKLDSSREALRQKVMESSDELE

SEQ ID NO: 13563 - DNA, 495 bp, Erythrobacter sp. SD-21
  CDS (1)..(495): transl_table=11
atggcgcaagggggaggagcaaagattgcaatcgtcatggggagccagtcggactggtcgaccatgaaatgcgccgccgacgtgctggaggagctgggcgtcgccaccgatgtgcgcatcgtttcggctcaccggacgcccgaaaggatgtacgatttcgcaaaggccgccgagaacgagggcttccatgtcatcatcgcgggcgcaggcggggcggcgcatctgccgggcatgatcgccgcgctgacgcatgtccccgtgctgggcgtcccggtccagtcgcgcgcgctttcggggcaggacagcctgctctccatcgtccagatgcccgccggcgtccccgtcggcacgctggccatcggcgaggccggcgcgaccaacgcgggcctgctggccgctgccatccttgccaataacgacgcggaactcgggcagcgcctgaaggactggcgcagcgcccggagcgccgccgtcaccgaaaggcctgccgactga

SEQ ID NO: 13564 - protein, 164 aa, Erythrobacter sp. SD-21
MAQGGGAKIAIVMGSQSDWSTMKCAADVLEELGVATDVRIVSAHRTPERMYDFAKAAENEGFHVIIAGAGGAAHLPGMIAALTHVPVLGVPVQSRALSGQDSLLSIVQMPAGVPVGTLAIGEAGATNAGLLAAAILANNDAELGQRLKDWRSARSAAVTERPAD

SEQ ID NO: 13565 - DNA, 492 bp, unidentified eubacterium SCB49
  CDS (1)..(492): transl_table=11
atgacagtagcaataataatgggaagcactagcgacatgccggtgatgcaagatgccatagacatcttaaaaggttttgacattgagattgaagtagacatcgtctctgctcacagaacgccagaaaagctatttgattttagtaaaaatgcgcatacacgtggcattaaagtaattattgcaggagcaggtggcgcagcacatttacctggaatggtagcttctctttctccgctacccgttattggtgttcccgtaaaatctagcaatagtattgacggatgggattctgttttatctatcttacaaatgccaggcggtgttcctgtagcaactgttgccttaaatggcgcaaaaaatgcaggtatattagctgcacaaatagtaagcacaggagaccaatgcgtacttgataaagtgattgcttacaaagaagggcttaagataaaagtagaagaaggtgccgagaaaattaaaaatataaaaggttaa

SEQ ID NO: 13566 - protein, 163 aa, unidentified eubacterium SCB49
MTVAIIMGSTSDMPVMQDAIDILKGFDIEIEVDIVSAHRTPEKLFDFSKNAHTRGIKVIIAGAGGAAHLPGMVASLSPLPVIGVPVKSSNSIDGWDSVLSILQMPGGVPVATVALNGAKNAGILAAQIVSTGDQCVLDKVIAYKEGLKIKVEEGAEKIKNIKG

SEQ ID NO: 13567 - DNA, 492 bp, Pseudomonas fluorescens
  CDS (1)..(492): transl_table=11
atgagtgcactggttggcgtgatcatgggctccaagtccgattggtccacccttagccacaccgccgatatgctggaaaagctcggcatcccgtacgaggtcaaggtggtttccgcccaccgcaccccggatctgctgttccagtacgccgaagaggctgagggccgtggcatcgaggtgatcatcgccggtgccggtggcgcagcccacctgccaggcatgtgtgcggccaagacccacctgccggtactgggcgttccggtgcagtcgtcgatgctctcgggtgtcgattcgctgctgtccatcgtgcagatgccagcgggcattccggtcgccaccctggccatcggcaaagcgggcgcgatcaacgcggccctgctctcggcgagcatcctcggcgccaagcatccacagttccacgcggtactgaaaaccttccgtgccgagcagacagacagcgtcctggacaatccagacccacgtattgcctga

SEQ ID NO: 13568 - protein, 163 aa, Pseudomonas fluorescens
MSALVGVIMGSKSDWSTLSHTADMLEKLGIPYEVKVVSAHRTPDLLFQYAEEAEGRGIEVIIAGAGGAAHLPGMCAAKTHLPVLGVPVQSSMLSGVDSLLSIVQMPAGIPVATLAIGKAGAINAALLSASILGAKHPQFHAVLKTFRAEQTDSVLDNPDPRIA

SEQ ID NO: 13569 - DNA, 522 bp, Magnetospirillum gryphiswaldense
  CDS (1)..(522): transl_table=11
atggatatgagccaaagcacccccgtcatcggcatcatcatgggtagccaatccgattgggagaccatgcgccacgccgtagaagtgctggtggacctcggcgtttcctacgaaacccgcgtggtatccgcccatcgcacgcccaagcggctgtacgactatgccaccggggccaaggctcgcggtctcaaggtcatcatcgccggtgccggcggcgctgcccacctgccgggcatggccgccgccatgaccaccttgccggtgctcggcgtgccggtggaaagccgggtgctgaagggtgtcgacagcttgcattccatcgttcagatgcccggcggcgtgccggtgggtaccttggccatcggcaaggccggagccaccaatgccggcctgctggcggcgtcgatcatcgccctgatggacccgggcctggcccagcggctggaagactggcgcacccgccaaaccgaatcggtggcggaaatgcccgtcgatgccgacaacccgcatctggtcgtctga

SEQ ID NO: 13570 - protein, 173 aa, Magnetospirillum gryphiswaldense
MDMSQSTPVIGIIMGSQSDWETMRHAVEVLVDLGVSYETRVVSAHRTPKRLYDYATGAKARGLKVIIAGAGGAAHLPGMAAAMTTLPVLGVPVESRVLKGVDSLHSIVQMPGGVPVGTLAIGKAGATNAGLLAASIIALMDPGLAQRLEDWRTRQTESVAEMPVDADNPHLVV

SEQ ID NO: 13571 - DNA, 549 bp, Acetobacter aceti
  CDS (1)..(549): transl_table=11
gtgagcgaaaccgcccccctgccctctgcttccagtgctttagaagataaagcagcctctgcccccgttgtgggcattatcatgggcagccagtcagactgggaaaccatgcgccatgcagacgcattgctgacagagctggaaattccgcatgaaaccctcattgtttcagcacatcgtacgccagaccggttggcggattatgcgcgtacggcagccgaacgcggcctgaatgtgattattgctggggccggtggagctgcacatctgccgggtatgtgtgcggcatggacacgcctgcccgtgctgggtgttccagtagaatctcgcgctcttaaaggcatggacagcctgctttccattgtgcagatgcccggcggcgtgcctgtgggcactttggctattggggcatccggcgccaaaaatgccgccttgctggccgcctccattcttgcactgtataacccggcccttgccgcacgccttgaaacatggcgcgcattgcagacggcctctgtccccaactctcccattaccgaagataaatga

SEQ ID NO: 13572 - protein, 182 aa, Acetobacter aceti
MSETAPLPSASSALEDKAASAPVVGIIMGSQSDWETMRHADALLTELEIPHETLIVSAHRTPDRLADYARTAAERGLNVIIAGAGGAAHLPGMCAAWTRLPVLGVPVESRALKGMDSLLSIVQMPGGVPVGTLAIGASGAKNAALLAASILALYNPALAARLETWRALQTASVPNSPITEDK

SEQ ID NO: 13573 - DNA, 480 bp, Thermoplasma volcanium
  CDS (1)..(480): transl_table=11
ttgcgattcatgccaaaggttgcagtaatcatggggagttcaagcgattacgaagtaatgaaagccgccatagatacactcaacgagttcggtgtagatgtaatctcgaaagtggtctctgcacataggactccagagtttatgatgcagtttgcaaaggaggcagcttcctctggaatagaagctataatagctggagcaggcggagctgcacacctgcctggcatggttgctgcgatgactccattgccggtgattggagtgccagttcctacgaaaaacctaggagggatggattccctgctatcaatagtgcaaatgccttctggtgtgccagtagctactgttgctattggcaattcgaagaatgcagctctgttggcaattcgaatactgtcaataaaatatcccgatcttatggccaaaatgtctgaatttatggaatctgaaaaacagcgggttcttcaagaaaagatctga

SEQ ID NO: 13574 - protein, 159 aa, Thermoplasma volcanium
MRFMPKVAVIMGSSSDYEVMKAAIDTLNEFGVDVISKVVSAHRTPEFMMQFAKEAASSGIEAIIAGAGGAAHLPGMVAAMTPLPVIGVPVPTKNLGGMDSLLSIVQMPSGVPVATVAIGNSKNAALLAIRILSIKYPDLMAKMSEFMESEKQRVLQEKI

SEQ ID NO: 13575 - DNA, 489 bp, Streptococcus suis
  CDS (1)..(489): transl_table=11
atgaatattccaatttccatcatcatgggctctagttccgactggaaaaccatgaaaaaagcagccgatgtgctggacaaatttggcgtagcctatgaaaagaaagtggtttttgcccaccgcaccccagacctcgtgttccgtcatgccgaagaggcgcgtggtcgtggtattaaggttattatcgcgggagcgggtggtgcggctcatttgccaggtatggtagcagccaagaccaccctgcctgttatcggtgttcctgtccaatcccgtgccctcagcggtgtggattcgctctattctatcgtgcaaatgccaggcggcgtacctgtggcaacgatggcaattggagaagcgggagcaaccaatgcggctttgactgccctgcgtatcctgtccatcgaagatagcggtatagcagatcaactggccagctttgctattgaacaaggaaaaatcgcggaggctatgagcgatgaactcaactaa

SEQ ID NO: 13576 - protein, 162 aa, Streptococcus suis
MNIPISIIMGSSSDWKTMKKAADVLDKFGVAYEKKVVFAHRTPDLVFRHAEEARGRGIKVIIAGAGGAAHLPGMVAAKTTLPVIGVPVQSRALSGVDSLYSIVQMPGGVPVATMAIGEAGATNAALTALRILSIEDSGIADQLASFAIEQGKIAEAMSDELN

SEQ ID NO: 13577 - DNA, 483 bp, Thermoplasma acidophilum
  CDS (1)..(483): transl_table=11
gtgagtcttatgcctagggttgcggttataatgggcagttcaagcgactacgagaccatgaagcccgctgtggatttcctcagatccatgcacatagatgttgtgctcaagattgtctcagcgcacaggacacctgaatatatgtttcagttcgcgtccagcgccagagatcaaggcatagaggttataattgctggggcaggcggtgcagcgcatcttccgggtatggttgcatcgatgacaacgctgcctgttataggcgtccctgttccgagcaggaatttaaatgggctggattcgcttctttccatagtgcagatgccatccggaatacctgttgccacggtcgcgatagggaattcgaaaaatgccgccatactggcatgcaggatactctccataaagtatcctgagatcgagaaagccattaagaagtacatggatgacgagcgagacagggtgcttaacgaaaagcttgaatga

SEQ ID NO: 13578 - protein, 160 aa, Thermoplasma acidophilum
MSLMPRVAVIMGSSSDYETMKPAVDFLRSMHIDVVLKIVSAHRTPEYMFQFASSARDQGIEVIIAGAGGAAHLPGMVASMTTLPVIGVPVPSRNLNGLDSLLSIVQMPSGIPVATVAIGNSKNAAILACRILSIKYPEIEKAIKKYMDDERDRVLNEKLE

SEQ ID NO: 13579 - DNA, 486 bp, Lactococcus lactis
  CDS (1)..(486): transl_table=11
atggcagaagtagcaattatcatgggttgcagctcagattgggcgacaatgaaagaaacagcaaaaattttagatgactttggtttagcttatgaaaaaaaggtcgtatcagcacaccgaacaccagctttgatggctgaattttcgagccaagcccgtgagcgaggttataaagttatcatcgcaggtgctggtggagccgctcatttgccaggaatggtatctgctcagactctcgttccagtcattggcgttccaataaaatcacgcgctttatctggtctggattcactttattcaattgttcaaatgccggcaggggttcctgtagcgacaatggcaattggagaggctggagcaaaaaatgctgctttatttgctttgcaacttttggcgaatacaaacgagaatttaatccaaaaattgttggtctatcgggctgctgcgcaagaaatggttgaggaatcaaacaaagcattactttaa

SEQ ID NO: 13580 - protein, 161 aa, Lactococcus lactis
MAEVAIIMGCSSDWATMKETAKILDDFGLAYEKKVVSAHRTPALMAEFSSQARERGYKVIIAGAGGAAHLPGMVSAQTLVPVIGVPIKSRALSGLDSLYSIVQMPAGVPVATMAIGEAGAKNAALFALQLLANTNENLIQKLLVYRAAAQEMVEESNKALL

SEQ ID NO: 13581 - DNA, 504 bp, Aquifex aeolicus
  CDS (1)..(504): transl_table=11
atgaaaccactcgttggcgtaataatgggaagtatttccgactgggagtatatgaaaaaggctgttgaagttttaaaggaattcggagttcctcacgaggttaaagtggtctccgcacacagaacgcccgaactcatgtatgaatacgcaaaaaccgcaagggagaggggaatagaggtgataatagcgggagcgggaggctccgcccatcttccgggaatgaccgcctctatgactacacttcccgttataggcgttcccatacccactaaaaacctcggaggagtggactcgttgtactcgatagtccagatgccagcgggtattcccgtggctacggtggctataggaaacgcaacaaatgccgggctcttagcggtaagaattctctcaataaagtaccccgagtatgctaagaaattggacgagtacacggaaaaactgaaggagaaagtggctaaaatgaacgaagaactgcaaaaggaggtggaaaatggaatttga

SEQ ID NO: 13582 - protein, 167 aa, Aquifex aeolicus
MKPLVGVIMGSISDWEYMKKAVEVLKEFGVPHEVKVVSAHRTPELMYEYAKTARERGIEVIIAGAGGSAHLPGMTASMTTLPVIGVPIPTKNLGGVDSLYSIVQMPAGIPVATVAIGNATNAGLLAVRILSIKYPEYAKKLDEYTEKLKEKVAKMNEELQKEVENGI

SEQ ID NO: 13583 - DNA, 489 bp, Bacillus subtilis
  CDS (1)..(489): transl_table=11
atgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgccggtgccggaggagcggcgcatctgccagggatgacggctgcgaaaacaacactgccagtcattggagttccggttcagtccaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaagaccttgcccgtaagctggatgagagaagagaaaatacaaaacagacagtgttagaaagcagtgatcagcttgtctaa

SEQ ID NO: 13584 - protein, 162 aa, Bacillus subtilis
MQPLVGIIMGSTSDWETMKHACDILDELNVPYEKKVVSAHRTPDFMFEYAETARERGIKVIIAGAGGAAHLPGMTAAKTTLPVIGVPVQSKALNGMDSLLSIVQMPGGVPVATTSIGKAGAVNAGLLAAQILSAFDEDLARKLDERRENTKQTVLESSDQLV

SEQ ID NO: 13585 - DNA, 489 bp, Brucella melitensis
  CDS (1)..(489): transl_table=11
atgagcgttgatgtcgccattatcatgggaagccagtccgattgggaaaccatgcaccatgcagccgacacattggaggcgctcggcatctccttcgacgcacggatcgtttccgcccatcgcacccctgacaggctggtcgccttcgccaagggggcgaaagcggaaggcttcaaggtcatcatcgcaggcgccggcggcgcggcccacctgcccggcatggccgctgccatgacaccgcttcccgtctttggcgttccagttcaatccaaggcgctttcgggccaggattcgctactctccatcgtacagatgccagcgggtattcccgtcggcactctcgccatcggccgtgcaggcgcggtcaatgccgcccttctcgccgccgccgttctggcgctatatgatgaagcacttgccgcccgtcttgatgaatggcgcaaggcgcagaccgaaagcgttgcagaacgcccctcgaacgaagcctga

SEQ ID NO: 13586 - protein, 162 aa, Brucella melitensis
MSVDVAIIMGSQSDWETMHHAADTLEALGISFDARIVSAHRTPDRLVAFAKGAKAEGFKVIIAGAGGAAHLPGMAAAMTPLPVFGVPVQSKALSGQDSLLSIVQMPAGIPVGTLAIGRAGAVNAALLAAAVLALYDEALAARLDEWRKAQTESVAERPSNEA

SEQ ID NO: 13587 - DNA, 489 bp, Brucella suis
  CDS (1)..(489): transl_table=11
atgagcgttgatgtcgccattatcatgggaagccagtccgattgggaaaccatgcgccatgcagcccacacattggaggcgctcggcatctccttcgacgcacggatcgtttccgcccatcgcacccctgacaggctggtcgccttcgccaagggggcgaaagcggaaggcttcaaggtcatcatcgcaggcgccggcggcgcggcccacctgcccggcatggccgctgccatgacaccgcttcccgtctttggcgttccagttcaatccaaggcgctttcgggccaggattcgctactctccatcgtacagatgccagcgggtattcccgtcggcactctcgccatcggccgtgcaggcgcggtcaatgccgcccttctcgccgccgccgttctggcgctatatgatgaagcacttgccgcccgtcttgatgaatggcgcaaggcgcagaccgaaagcgttgcagaacgcccctcgaacgaagcctga

SEQ ID NO: 13588 - protein, 162 aa, Brucella suis
MSVDVAIIMGSQSDWETMRHAAHTLEALGISFDARIVSAHRTPDRLVAFAKGAKAEGFKVIIAGAGGAAHLPGMAAAMTPLPVFGVPVQSKALSGQDSLLSIVQMPAGIPVGTLAIGRAGAVNAALLAAAVLALYDEALAARLDEWRKAQTESVAERPSNEA

SEQ ID NO: 13589 - DNA, 534 bp, Corynebacterium ammoniagenes
  CDS (1)..(534): transl_table=11
atgactgcaccgctagttgggctcatcatgggctctgattctgattggccaaccgttgaaccagcagctgaggttctcgacgaattcggtgttccttttgaggtgggcgtggtctctgcgcaccgcacgccggaaaagatgctggattacgccaagcaagcccacactcgcggcatcaaggtgattgttgcttgtgccggtggggcagcgcacctaccaggcatggtggctgcagcaactcctttgccagttattggtattccacgtgccttgaaagatttggaaggtctggactctttgctgtctatcgtgcagatgccagctggggttccggttgcgaccgtgtctatcggcggcgctaagaatgctggcttgctcgccatccgtaccctgggcgtgcagtactcagaattggttgaacgcatggccgattaccaagaaaatatggccgattaccaaccgaaaatatggccaaggaagttgagcaaaaagacgccaatcttcgcgccaagctcatgggggactagaccttag

SEQ ID NO: 13590 - protein, 177 aa, Corynebacterium ammoniagenes
MTAPLVGLIMGSDSDWPTVEPAAEVLDEFGVPFEVGVVSAHRTPEKMLDYAKQAHTRGIKVIVACAGGAAHLPGMVAAATPLPVIGIPRALKDLEGLDSLLSIVQMPAGVPVATVSIGGAKNAGLLAIRTLGVQYSELVERMADYQENMADYQPKIWPRKLSKKTPIFAPSSWGTRP

SEQ ID NO: 13591 - DNA, 510 bp, Escherichia coli O157
  CDS (1)..(510): transl_table=11
atgtcttcccgcaataatccggcgcgtgtcgccatcgtgatggggtccaaaagcgactgggctaccatgcagttcgccgccgaaatcttcgaaatcctgaatgtcccgcaccacgttgaagtggtttctgctcaccgcacccccgataaactattcagcttcgccgaaagtgccgaagagaacggttatcaggtgattattgcgggcgcaggcggcgcagcgcacctgccaggcatgattgccgccaaaacgctggtgccagtgctgggcgtgccagtacagagcgccgcactgagcggtgtcgatagcctctactccatcgtacaaatgccacgcggcattccggtgggtacgctggcgattggtaaagctggcgcggcaaacgcggcattactggcagcacaaattcttgcgactcatgataaagaactgcaccagcgtctgaatgactggcgcaaagcacaaactgatgaagtgctggaaaacccggacccgcgaggtgcggcatga

SEQ ID NO: 13592 - protein, 169 aa, Escherichia coli O157
MSSRNNPARVAIVMGSKSDWATMQFAAEIFEILNVPHHVEVVSAHRTPDKLFSFAESAEENGYQVIIAGAGGAAHLPGMIAAKTLVPVLGVPVQSAALSGVDSLYSIVQMPRGIPVGTLAIGKAGAANAALLAAQILATHDKELHQRLNDWRKAQTDEVLENPDPRGAA

SEQ ID NO: 13593 - DNA, 495 bp, Haemophilus influenzae
  CDS (1)..(495): transl_table=11
atgtcaaaaactgcacaaattgccgttgtaatgggttccaaaagcgattgggctactatgcaagaggcaactcagattttagatgaattaaacgtgccttatcatgtggaagtcgtctcggctcatcgtacgcctgataaactttttgaatttgctgaaaatgcacaaaaaaatggctataaagtaattattgctggtgcagggggggcggcacatttacccggtatgatcgcagcgaaaacacttgtgccagtgctgggggtgccagtaaaaagttctatgttaagtggtgtggatagcctttattcaattgtgcaaatgccaaaagggattcctgtcggaacattagcgattggccctgcgggtgcggcaaatgctgggttgttagcagcccaaattctagcaggttgggatgatgcgttattcactcgcctacaagcattccgcgaaaatcaaaccaatatggtattggacaatcctgatccacgcacataa

SEQ ID NO: 13594 - protein, 164 aa, Haemophilus influenzae
MSKTAQIAVVMGSKSDWATMQEATQILDELNVPYHVEVVSAHRTPDKLFEFAENAQKNGYKVIIAGAGGAAHLPGMIAAKTLVPVLGVPVKSSMLSGVDSLYSIVQMPKGIPVGTLAIGPAGAANAGLLAAQILAGWDDALFTRLQAFRENQTNMVLDNPDPRT

SEQ ID NO: 13595 - DNA, 516 bp, Mycobacterium leprae
  CDS (1)..(516): transl_table=11
atgaccaggcagccccgagtcggggtgatcatgggcagcgacagcgactggtcggtgatgcaagatgcggcccatgcactggcggagtttgacatcccgatcgaggttcgggtggtgtcggcgcatcgcacccctgctgagatgttcgactatgcgcgcaatgctgtcgaccgcagcatcgcggtgatcattgccggcgccggcggcgcagctcacctgcctggaatggtcgcttccgcgactccgctgccggtgatcggggtgccggtgccgctggccaggctcgacggcctggactcgctgctgtcgatcgtgcagatgccagcgggagttccggttgccacagtgtctatcggtggtgcccgcaacgcgggtttgttggcggtgcgtattttgggatcgtcggacctgcagcttcgagcgcagctggtcgcgttccaggaccggttggccgataccgtgcgggccaaggatgcggatttacagcggtttcgaggtaagttaatcggcgactaa

SEQ ID NO: 13596 - protein, 171 aa, Mycobacterium leprae
MTRQPRVGVIMGSDSDWSVMQDAAHALAEFDIPIEVRVVSAHRTPAEMFDYARNAVDRSIAVIIAGAGGAAHLPGMVASATPLPVIGVPVPLARLDGLDSLLSIVQMPAGVPVATVSIGGARNAGLLAVRILGSSDLQLRAQLVAFQDRLADTVRAKDADLQRFRGKLIGD

SEQ ID NO: 13597 - DNA, 525 bp, Mycobacterium tuberculosis
  CDS (1)..(525): transl_table=11
atgactcctgccggcgagcggccccgggtcggggtgatcatgggcagcgacagcgactggccggtgatggccgacgctgcggcggcgctggccgagttcgacattccggccgaggttcgggttgtttcggcccatcgcacccctgaggcgatgttcagttatgcgcgcggcgcggccgagcgcggtctcgaggtgatcatcgccggagcgggcggggccgcgcacttgcccggtatggtcgccgccgcgacgccgctgccggtgatcggggtgccggtaccgctgggcaggctggacggccttgactccctgctgtcgatcgtgcaaatgccggccggggttccggtggccacggtgtccatcgggggcgccggtaatgccggactgctggcggtgcggatgctgggagccgccaacccccagctgagggcccggatcgtcgcattccaggaccggctggccgacgtcgtggcggccaaggatgcggaactgcagcggcttgcgggtaagttaacccgcgactag

SEQ ID NO: 13598 - protein, 174 aa, Mycobacterium tuberculosis
MTPAGERPRVGVIMGSDSDWPVMADAAAALAEFDIPAEVRVVSAHRTPEAMFSYARGAAERGLEVIIAGAGGAAHLPGMVAAATPLPVIGVPVPLGRLDGLDSLLSIVQMPAGVPVATVSIGGAGNAGLLAVRMLGAANPQLRARIVAFQDRLADVVAAKDAELQRLAGKLTRD

SEQ ID NO: 13599 - DNA, 492 bp, Pseudomonas aeruginosa
  CDS (1)..(492): transl_table=11
atgagcgcactggttggcgtgatcatgggttccaaatcggactggagcaccctcagtcacaccgcggacatgctggacaagctgggcatcccctacgaagtgaaggtggtttccgcccaccgcaccccggacctgctcttccagtacgccgaggaagccgaaggccgcggcctcgaagtgatcatcgccggcgctggcggcgccgcccacctgccgggcatgtgcgcggccaagacccacctgccggtactcggcgtgccggtacagtcgtcgatgctgtcgggtgtcgactcgctgctctccatcgtgcagatgcccgccggcgtaccggtcgccaccctggccatcggcaaggccggcgcggtcaacgcggcgctgctctcggcgagcatcctcggcgccaagcacccgcagtaccacgaggcgctgaagcagttccgcgccaaccagaccgaaaccgtgctggacaatcccgacccgcgcgatgcgtga

SEQ ID NO: 13600 - protein, 163 aa, Pseudomonas aeruginosa
MSALVGVIMGSKSDWSTLSHTADMLDKLGIPYEVKVVSAHRTPDLLFQYAEEAEGRGLEVIIAGAGGAAHLPGMCAAKTHLPVLGVPVQSSMLSGVDSLLSIVQMPAGVPVATLAIGKAGAVNAALLSASILGAKHPQYHEALKQFRANQTETVLDNPDPRDA

SEQ ID NO: 13601 - DNA, 525 bp, Pyrococcus abyssi
  CDS (1)..(525): transl_table=11
ttggtgaaggttgggatgcctaaggtagggataataatgggtagcgattctgacctcccagtaatgaaagaggccgcaaaggttctcgaagactttgaagttgattacgagatgaaggtgatctcagcgcacagaacaccagaaaggttacacgagtacgcaagaacagcagaagagaggggaatagaagttataatcgcaggagctggaggcgctgcccatctcccaggagttttagctgcgctaacgatgattccagttataggggttcccataaaaagcaaagcactaaacggtcttgactcgctcctatcgatagtccaaatgcccccaggaattccagttgcaactgtaggaatagatggagcaaagaacgccgcactcttagctttggagattttatcaataaagtatcctgagataaaggagaagctgaagaagtacagagaagacatgaagagaaaggtagaagaaaaatccaaaaagttggaagagctaggatggaggaaatacttggagggctag

SEQ ID NO: 13602 - protein, 174 aa, Pyrococcus abyssi
MVKVGMPKVGIIMGSDSDLPVMKEAAKVLEDFEVDYEMKVISAHRTPERLHEYARTAEERGIEVIIAGAGGAAHLPGVLAALTMIPVIGVPIKSKALNGLDSLLSIVQMPPGIPVATVGIDGAKNAALLALEILSIKYPEIKEKLKKYREDMKRKVEEKSKKLEELGWRKYLEG

SEQ ID NO: 13603 - DNA, 534 bp, Pyrococcus horikoshii
  CDS (1)..(534): transl_table=11
gtggtgataagcatgaaaagtgaaaagccactcgttggaattataatgggtagtgactctgatttaccagtaatgaaagaggccgcaaggattttggaagagtttggggttccgtatgagataacgataatatcggcccataggactccagagagagcttatgaatacgcaaagaaagcggaggaaaggggaatagaagtaataatagctggagctggaggagcggcccacctcccagggattattgcatcactaacggttctacccgttattggagtgccaataaagagtaaagccttgaatggtctcgactccttgttatcgatagttcaaatgccaagtgggatcccggttgctaccgtagctatagataacgcgaagaacgctgcacttttagccctgaggatcctgggaataaaataccccgagatcaaagaaaagcttagaaggtacatgaaagatatgaaaaggaaagtcgaagaaaaggcaaaaagattagaagagatgggatgggaaaggtatctatcggagtaa

SEQ ID NO: 13604 - protein, 177 aa, Pyrococcus horikoshii
MVISMKSEKPLVGIIMGSDSDLPVMKEAARILEEFGVPYEITIISAHRTPERAYEYAKKAEERGIEVIIAGAGGAAHLPGIIASLTVLPVIGVPIKSKALNGLDSLLSIVQMPSGIPVATVAIDNAKNAALLALRILGIKYPEIKEKLRRYMKDMKRKVEEKAKRLEEMGWERYLSE

SEQ ID NO: 13605 - DNA, 477 bp, Sulfolobus solfataricus
  CDS (1)..(477): transl_table=11
gtgccaaaagtagctgtaattatgggaagtaaaaatgactgggaatatatgagagaagctgtagagattttgaaacaattcgggatagactatgaggctagagtggtttcagctcatagaacaccagaatttatgatgcaatacgctaaagaagcagaaaaaagaggaatagaagtaattattgctggggctggtggagcagctcatttgccaggcatggttgcttcacttacaagtcttccagttattggtgttcctattccctcaaagaatctaaatggtcttgactcgcttctttcaatagtgcaaatgccctatggagtcccagtagctactgtggcaataggtggtgccaaaaacgctgcgctactggcaattaggattttaggaataaaatataaggaattagcagataaaattaaaaaattctcagaggatatgaggaacgatgttctcagtactagactggaagcctaa

SEQ ID NO: 13606 - protein, 158 aa, Sulfolobus solfataricus
MPKVAVIMGSKNDWEYMREAVEILKQFGIDYEARVVSAHRTPEFMMQYAKEAEKRGIEVIIAGAGGAAHLPGMVASLTSLPVIGVPIPSKNLNGLDSLLSIVQMPYGVPVATVAIGGAKNAALLAIRILGIKYKELADKIKKFSEDMRNDVLSTRLEA

SEQ ID NO: 13607 - DNA, 531 bp, Synechocystis sp
  CDS (1)..(531): transl_table=11
atgacttccccctctcccctggtcggcatcatcatgggaagcgattccgatctccccaccatggcagcggcgatcgccgtctgtgaagaatttgccgtaccaacggaggtggccattatctctgcccatcgcaccccggaaagaatggtggagtatgcccaaactgcccaccagcggggcttgcggataattattgccggggctgggggagcggcccatttaccgggcatggtggcggccctgacccctttaccagtcatcggtgtgccggtgcagactaaaaccttacagggagtggattccctctattccattgtgcaaatgccggggggaatacctgtagctaccgtggcgatcggtaatgccaaaaatgcggggttattggcggtgcaaatactggctagccataatcccgtgctgttggaaaaagtacagcaatatcgccaaagtctagaaaccatggttttggacaaacaagcggagttggagcgactgggctacagggcctatctggaccagcaaaatcagtga

SEQ ID NO: 13608 - protein, 176 aa, Synechocystis sp
MTSPSPLVGIIMGSDSDLPTMAAAIAVCEEFAVPTEVAIISAHRTPERMVEYAQTAHQRGLRIIIAGAGGAAHLPGMVAALTPLPVIGVPVQTKTLQGVDSLYSIVQMPGGIPVATVAIGNAKNAGLLAVQILASHNPVLLEKVQQYRQSLETMVLDKQAELERLGYRAYLDQQNQ

SEQ ID NO: 13609 - DNA, 516 bp, Thermotoga maritima
  CDS (1)..(516): transl_table=11
gtgccaagggtaggaatcatcatgggaagtgactccgatcttcctgtaatgaagcaggcagctgaaattttggaagaattcggaatagattacgagattacgatcgtttccgctcacaggacaccggatcgcatgttcgagtacgcaaagaacgccgaagaacggggaatagaagtgatcattgcgggagcggggggagcggctcaccttccaggaatggtggcaagcatcacccaccttcctgtgataggtgttcccgtgaaaacatccacactgaacggtctggattctcttttctccatagttcagatgccagggggtgtgcccgttgccaccgttgccataaacaacgcgaagaacgcgggaatccttgctgcgtctattctgggaatcaaatatccggagatcgcaaggaaggtaaaagagtataaagaaagaatgaaacgggaagttctggaaaaagcccaaagattagaacaaattggttacaaagaatatctgaaccagaaagagtaa

SEQ ID NO: 13610 - protein, 171 aa, Thermotoga maritima
MPRVGIIMGSDSDLPVMKQAAEILEEFGIDYEITIVSAHRTPDRMFEYAKNAEERGIEVIIAGAGGAAHLPGMVASITHLPVIGVPVKTSTLNGLDSLFSIVQMPGGVPVATVAINNAKNAGILAASILGIKYPEIARKVKEYKERMKREVLEKAQRLEQIGYKEYLNQKE

SEQ ID NO: 13611 - DNA, 486 bp, Vibrio cholerae
  CDS (1)..(486): transl_table=11
atgacagtcggtattatcatgggttccaagtcagactggccaaccatgaaacacgcagcagagatgcttgaccagtttggtgtggcttacgagactaaagtggtttctgcgcaccgaactcctcatcttttggccgactatgcctctagcgccaaagaacgcggtttacaagtgatcatcgctggagcgggcggcgctgcgcatcttcccggaatgaccgccgcattcactagcttgccagtgttaggcgtgcccgttcaatctcgcgctctgtctgggctcgactcgttatactccattgtgcagatgccaaaaggcattgcggtgggtacgctcgccattggtgaagctggtgccgctaatgcaggattacttgccgcacaaatcatcggcattcataacccagaagtgatgagtaaagtggaagctttccgcgctaagcagactcaatctgtgttggataacccaaatccggctgaggagtaa

SEQ ID NO: 13612 - protein, 161 aa, Vibrio cholerae
MTVGIIMGSKSDWPTMKHAAEMLDQFGVAYETKVVSAHRTPHLLADYASSAKERGLQVIIAGAGGAAHLPGMTAAFTSLPVLGVPVQSRALSGLDSLYSIVQMPKGIAVGTLAIGEAGAANAGLLAAQIIGIHNPEVMSKVEAFRAKQTQSVLDNPNPAEE

SEQ ID NO: 13613 - DNA, 486 bp, Vibrio parahaemolyticus
  CDS (1)..(486): transl_table=11
atgaaagtcggtatcatcatgggttctaaatccgattggccaaccatgaaactagcagcagacatgctggatcaatttggcgtgtcttacgaaacaaaggtggtgtcagctcaccgtactcctcaactattagccgattacgctagcagcgcgaaagaacgcggcatcaaagtgatcatcgcaggtgccggtggtgcagctcacctaccgggaatggcggcagccttcaccagtttgcctgtacttggtgttccggttcaatctcgcgctctaaaaggcatggactctttgctatctattgtacaaatgccaaaaggcattgcagtcggcacgttagcgattggcgaagcgggcgctgcaaacgcgggcatcttagcggcacaaatcctaggcactcatgacgaaagcatcatggcgaaggtagaagcgttccgcaatgaacagacggaaaccgtactggctaacccaaatccagctgaggattaa

SEQ ID NO: 13614 - protein, 161 aa, Vibrio parahaemolyticus
MKVGIIMGSKSDWPTMKLAADMLDQFGVSYETKVVSAHRTPQLLADYASSAKERGIKVIIAGAGGAAHLPGMAAAFTSLPVLGVPVQSRALKGMDSLLSIVQMPKGIAVGTLAIGEAGAANAGILAAQILGTHDESIMAKVEAFRNEQTETVLANPNPAED

SEQ ID NO: 13615 - DNA, 486 bp, Vibrio vulnificus
  CDS (1)..(486): transl_table=11
atgaaagtcggtatcatcatgggttctaaatcagattggccaaccatgaaactggcagcagaaatgctggacagatttggcgtggaatacgaaaccaaagtggtttcagcacatcgaactcctcatctcctcgctgaatatgcctcaaccgccaaagagcgtgggttgaaagtgattattgccggtgcaggtggcgcggcgcatttgccgggcatggcagcggcatttaccagcttgcccgttttgggcgtacccgtgcaatcacgtgctttatcagggctcgactctctctactctattgtgcaaatgccaaaaggcatcgcagtaggtacattggccattggtgaagccggtgccgcgaacgcgggtcttctcgctgcgcaaatccttggaactcacgacgaaaatatcatggccaaagttgaagccttccgcagtgagcaaactgaaagcgtcctcgctaacccaaatcctgcagaggactaa

SEQ ID NO: 13616 - protein, 161 aa, Vibrio vulnificus
MKVGIIMGSKSDWPTMKLAAEMLDRFGVEYETKVVSAHRTPHLLAEYASTAKERGLKVIIAGAGGAAHLPGMAAAFTSLPVLGVPVQSRALSGLDSLYSIVQMPKGIAVGTLAIGEAGAANAGLLAAQILGTHDENIMAKVEAFRSEQTESVLANPNPAED

SEQ ID NO: 13617 - protein, 125 aa, Artificial sequence
  consensus sequence
  Variant (4)..(4): Xaa in position 4 is any amino acid
  Variant (7)..(9): Xaa in position 7 to 9 is any amino acid
  Variant (11)..(12): Xaa in position 11 to 12 is any amino acid
  Variant (14)..(14): Xaa in position 14 is any amino acid
  Variant (15)..(16): Xaa in position 15 to 16 is any or no amino acid
  Variant (18)..(29): Xaa in position 18 to 29 is any amino acid
  Variant (36)..(41): Xaa in position 36 to 41 is any amino acid
  Variant (43)..(44): Xaa in position 43 to 44 is any amino acid
  Variant (46)..(47): Xaa in position 46 to 47 is any amino acid
  Variant (48)..(48): Xaa in position 48 is any or no amino acid
  Variant (50)..(52): Xaa in position 50 to 52 is any amino acid
  Variant (67)..(67): Xaa in position 67 is any amino acid
  Variant (69)..(70): Xaa in position 69 to 70 is any amino acid
  Variant (72)..(73): Xaa in position 72 to 73 is any amino acid
  Variant (76)..(76): Xaa in position 76 is any amino acid
  Variant (80)..(83): Xaa in position 80 to 83 is any amino acid
  Variant (84)..(85): Xaa in position 84 to 85 is any or no amino acid
  Variant (87)..(87): Xaa in position 87 is any amino acid
  Variant (89)..(89): Xaa in position 89 is any amino acid
  Variant (93)..(93): Xaa in position 93 is any amino acid
  Variant (100)..(100): Xaa in position 100 is any amino acid
  Variant (102)..(102): Xaa in position 102 is any amino acid
  Variant (105)..(105): Xaa in position 105 is any amino acid
  Variant (107)..(107): Xaa in position 107 is any amino acid
  Variant (111)..(112): Xaa in position 111 to 112 is any amino acid
  Variant (115)..(115): Xaa in position 115 is any amino acid
  Variant (118)..(118): Xaa in position 118 is any amino acid
  Variant (120)..(120): Xaa in position 120 is any amino acid
  Variant (122)..(124): Xaa in position 122 to 124 is any amino acid
MGSXSDXXXMXXAXXXLXXXXXXXXXXXXSAHRTPXXXXXXAXXAXXXGXXXIIAGAGGAAHLPGMXAXXTXXPVXGVPXXXXXXLXGXDSLXSIVQMPXGXPVXTXAIGXXGAXNAXLXAXXXL

SEQ ID NO: 13618 - protein, 28 aa, Artificial sequence
  protein pattern
  Variant (2)..(2): Xaa in position 2 is any or no amino acid
  Variant (15)..(15): Xaa in position 15 is any amino acid
  Variant (17)..(17): Xaa in position 17 is Ala or Ser
  Variant (18)..(18): Xaa in position 18 is any amino acid
  Variant (19)..(19): Xaa in position 19 is Ser or Thr
  Variant (20)..(20): Xaa in position 20 is any amino acid
  Variant (21)..(21): Xaa in position 21 is Ile, Leu or Val
  Variant (24)..(24): Xaa in position 24 is Phe, Ile, Leu or Val
  Variant (28)..(28): Xaa in position 28 is Ile, Met or Val
IXAGAGGAAHLPGMXAXXXXXPVXGVPX

SEQ ID NO: 13619 - protein, 29 aa, Artificial sequence
  protein pattern
  Variant (2)..(4): Xaa in position 2 to 4 is any amino acid
  Variant (8)..(8): Xaa in position 8 is any amino acid
  Variant (15)..(15): Xaa in position 15 is any amino acid
  Variant (17)..(17): Xaa in position 17 is Phe, Ile or Val
  Variant (18)..(18): Xaa in position 18 is Ala or Pro
  Variant (20)..(20): Xaa in position 20 is Ala, Gly or Ser
  Variant (22)..(22): Xaa in position 22 is any amino acid
  Variant (23)..(23): Xaa in position 23 is Ala, Gly or Ser
  Variant (24)..(24): Xaa in position 24 is Ile or Val
  Variant (25)..(25): Xaa in position 25 is Asp, Gly or Asn
  Variant (26)..(26): Xaa in position 26 is any amino acid
  Variant (27)..(27): Xaa in position 27 is Ala, Asp, Gly, Asn, Pro or Ser
  Variant (28)..(28): Xaa in position 28 is any amino acid
  Variant (29)..(29): Xaa in position 29 is Ala, Gly, Asn or Ser
LXXXDSLXSIVQMPXGXXVXTXXXXXXXX

SEQ ID NO: 13620 - protein, 13 aa, Artificial sequence
  protein pattern
  Variant (7)..(8): Xaa in position 7 to 8 is any amino acid
  Variant (9)..(9): Xaa in position 9 is Leu or Met
  Variant (10)..(11): Xaa in position 10 to 11 is any amino acid
  Variant (12)..(12): Xaa in position 12 is Phe, His or Tyr
  Variant (13)..(13): Xaa in position 13 is Ala, Gly or Ser
SAHRTPXXXXXXX

SEQ ID NO: 13621 - protein, 10 aa, Artificial sequence
  protein pattern
  Variant (4)..(4): Xaa in position 4 is any amino acid
  Variant (7)..(8): Xaa in position 7 to 8 is any amino acid
  Variant (9)..(9): Xaa in position 9 is Thr or Val
  Variant (10)..(10): Xaa in position 10 is Ile, Leu, Met or Val
MGSXSDXXXX

SEQ ID NO: 13622 - DNA, 1716 bp, Saccharomyces cerevisiae; identical to SEQ ID NO: 13030
  CDS (1)..(1716)

SEQ ID NO: 13623 - protein, 571 aa, Saccharomyces cerevisiae; identical to SEQ ID NO: 13031

SEQ ID NO: 13624 - DNA, 1134 bp, Kineococcus radiotolerans SRS30216
  CDS (1)..(1134): transl_table=11
atgatgcagcccccggcgatcgcgctcggcctgcggctgcgggtcctcgccgaggggcccggcgccagcgccgcccaggtcatcacccccgcgccggtcggcgcggccgacgacctcgaggccctggtcgccttcgcctccgagtgcgacgcggtcaccttcgaccacgagcacgtgccccccgcggggctgcgcgccatggccgaggtcacctccgtgcagccgggcgcggacgccctcgtgcacgcccaggacaagatcgtcatgcgcgagcgcctcaccgcgctcggggtcccgtgcccgcgctgggcccgggtcggggaccgcgccgcggtcgaggccttcgccgccggcgccggctggccggtcgtgctgaagaccccgcgcggggggtacgacggcaagggcgtcctcgtcctggactccgccggggacccggcctggagcacggccgaggcgtggctggccgactgggccggacgcggcgggctgctggccgaggagcacgtcgccttcacccgcgagctcgccgccctcgtcgtgcgcagcccctccggccaggccgcggcgtggccggtggtcgagaccgtccagcgcggcggggtctgccacgaggtcaccgcccccgcccccggcctcgacgaggagctcggcgcgcacctgaccgacgtcgccctgcgcgtcgccggcggcctcggggtcaccggggtgctggccgtggaggtgttcgaggtgctccgcgacggccgcccgaccgtgctggtgaacgagctcgcgatgcgcccgcacaactccgggcactggaccatcgacggcgccgagaccagccagttcgagaaccacctgcgcgcggtgctggacctgccgctgggctcgacgcgcgcccgcgccccgtggacggtcatggtcaacgtcctgggaccgcgcgagatcgaggcccgccacgaggacctctaccgctcctacctgcacgtcatggcccacgacccgggcgtgaaggtgcacctgtacggcaaggagcagcgcccgggccgcaagctcggccacgtcaccgtccacggcgacgacctggaatccgtccgcgcgcgtgcccggcacgcggcggccttcatcgcgggggagatcgacgagtga

SEQ ID NO: 13625 - protein, 377 aa, Kineococcus radiotolerans SRS30216
MMQPPAIALGLRLRVLAEGPGASAAQVITPAPVGAADDLEALVAFASECDAVTFDHEHVPPAGLRAMAEVTSVQPGADALVHAQDKIVMRERLTALGVPCPRWARVGDRAAVEAFAAGAGWPVVLKTPRGGYDGKGVLVLDSAGDPAWSTAEAWLADWAGRGGLLAEEHVAFTRELAALVVRSPSGQAAAWPVVETVQRGGVCHEVTAPAPGLDEELGAHLTDVALRVAGGLGVTGVLAVEVFEVLRDGRPTVLVNELAMRPHNSGHWTIDGAETSQFENHLRAVLDLPLGSTRARAPWTVMVNVLGPREIEARHEDLYRSYLHVMAHDPGVKVHLYGKEQRPGRKLGHVTVHGDDLESVRARARHAAAFIAGEIDE

SEQ ID NO: 13626 - DNA, 1110 bp, Xanthobacter autotrophicus Py2
  CDS (1)..(1110): transl_table=11
atgctgaaacccggaagcgtcatcggcatcctcggcggcggccagctcggccgcatgatcgcgctcgctgcggcggagctgggcctgaagacccatatcctgtgccccgacaaggatagccccgccttccatgtgagcgaacaccacatctgcgcgccctacgacgacttcgcggcgctggagcgcttcgcggccggcgtggacgtggtgacctacgaattcgagaacgtgccgctggccaccgccgagttcctcgccgcccgggtgcccctgaggccgggcgcgaaggccctcgccatcacccaggaccgactggcggaaaagagcttcgtgcgcgacctcggcatcgagaccgcgccgttcgccgccgtggacgacctcgccggccttgaggcgggcgtggcggcgcttggcctgccggcggtgctgaagacccggcgcttcgggtatgacggcaagggccaggtcatcatccgcccggaggaagacctcaccgccgcctggcacgccctgggccggcagagcgcgatcctggagggcttcgtcgccttcgagcgcgaggtctcggtggtggcggcgcggcgggccgatggcgccttccaggccttcgacgtgaccgagaacgtgcatcgcgagcacatcctgcacacctccaccgtgcccgccaccctgtcggccggcgcggcgcgccaggcccggtccatcgcccgcgccatcggcgatgccctcgactatgagggggtgttcgcggtggaattgttcgtggtgggatgcggcgcggacgaacgggtgatcgtcaacgagatcgccccgcgcgtgcacaacagcgggcactggacccaggacggcgccgtgacctcccagttcgagcagcatgtgcgcgccatcgccggctggccgctgggcgaggtggcgcgcatcggccgggttgagatgaccaacctcatcggcgccgacgtgcatgactggcatgcgctgctcgccgagcccggcgcccacgtccatctctacggcaaggacgaggcccgcgccggccgcaagatgggccacgtggtgcgggtgcgccgcgatccggaagcctgcaccaacattccggaagccggctgctag

SEQ ID NO: 13627 - protein, 369 aa, Xanthobacter autotrophicus Py2
MLKPGSVIGILGGGQLGRMIALAAAELGLKTHILCPDKDSPAFHVSEHHICAPYDDFAALERFAAGVDVVTYEFENVPLATAEFLAARVPLRPGAKALAITQDRLAEKSFVRDLGIETAPFAAVDDLAGLEAGVAALGLPAVLKTRRFGYDGKGQVIIRPEEDLTAAWHALGRQSAILEGFVAFEREVSVVAARRADGAFQAFDVTENVHREHILHTSTVPATLSAGAARQARSIARAIGDALDYEGVFAVELFVVGCGADERVIVNEIAPRVHNSGHWTQDGAVTSQFEQHVRAIAGWPLGEVARIGRVEMTNLIGADVHDWHALLAEPGAHVHLYGKDEARAGRKMGHVVRVRRDPEACTNIPEAGC

SEQ ID NO: 13628 - DNA, 1077 bp, Mesorhizobium loti MAFF303099
  CDS (1)..(1077): transl_table=11
gtgagcctgcccgccggatcgaccatcggcattatcggcggcggccagctcggccgcatgctggcaatggccgccgcccgcctcggttatcgcaccatcgtgctggagccgcagccggattgtccggcggcacaagtcgccaaccggcagattacatcagcctatgacgacccggccgcccttgctgaactggcggcggcaagtaccgtcgtcacctacgagttcgagaatgttcccgttgccgccgcagaagcgcttgccgccgaggttgcagtctacccgccggcgcgcgcgctcgacgtggcgcaggaccgggtgagcgaaaaaacattcctcaatggcatcggcattgccaccgccgatttttgtccggtcgacacggacgcggaactgacagcggcgctgaagagattcggcggcagcggcatcctgaagacgcggcgcatgggctatgacggcaagggccagcgcgtctttcgcaacatggaagcgggcggcttcgccggcacttgcgaggcgatgggcaatgtgccgctgatcctggaaagctttgtccccttcgagcgcgagatctcggtgattgcagcgcgcggcttggatggcgccgtggccgcctacgacccggccgagaatgtccaccgccacggcattctccacacctcgaccctgccggcgggcgtcaaacttgaaacggctgaagcggcacgaacggctgcggcaaaaatcctgtcggcgctcgattatgtcggcgtcatcggtgtcgagttcttcgtgctttccgacggttcgctgctggccaacgagattgcgccgcgcgtccacaattccggccattggaccgaggccgcctgcatcgtttcgcagttcgagcagcatatccgcgcggttgctggcttgccgctgggcaaccctggccgccactctgattgcgtgatggagaacctgatcggcgacgacgtgctgcgcgtgccggccctgctcgccgagcccgatctgatgctgcatctctatggcaaggcggaggcgcgccctggccgcaagatgggccatttcacccgcatcagccgccgcgtttaa

SEQ ID NO: 13629 - protein, 358 aa, Mesorhizobium loti MAFF303099
MSLPAGSTIGIIGGGQLGRMLAMAAARLGYRTIVLEPQPDCPAAQVANRQITSAYDDPAALAELAAASTVVTYEFENVPVAAAEALAAEVAVYPPARALDVAQDRVSEKTFLNGIGIATADFCPVDTDAELTAALKRFGGSGILKTRRMGYDGKGQRVFRNMEAGGFAGTCEAMGNVPLILESFVPFEREISVIAARGLDGAVAAYDPAENVHRHGILHTSTLPAGVKLETAEAARTAAAKILSALDYVGVIGVEFFVLSDGSLLANEIAPRVHNSGHWTEAACIVSQFEQHIRAVAGLPLGNPGRHSDCVMENLIGDDVLRVPALLAEPDLMLHLYGKAEARPGRKMGHFTRISRRV

SEQ ID NO: 13630 - DNA, 1077 bp, Thermoplasma volcanium GSS1
  CDS (1)..(1077): transl_table=11
atgaacgtaggtattataggaagcgggcagctgggctatatgatgataaatgaaggtcgaaggctcggaaacaagtattttgtcctcgattctaacggagtcggtccggcatctcttattgcagacgcccatttctctgtcgatcagtataaggaattcgttgataagtgcgatgttgtaacttatgaatttgagcacgtgcttgaagaagctctcttgtatgctgaggatcagcacaaattaaagccttcaataaggcccgtagagttaaagaaagaccgttctcttgaaaaagactatttgacaggaatcgggctaaaggtcgctaattacagagttgcccatagtttcagcgaagctgtaagatacgccaaggattttggcaaagcgatgattaagaactctttcgggggctatgacggaaaaggtcagaccatatacgataacggaaattacgaggaacttaaaggtgaaaaattcgtagtagaggaatttgttgactttgattatgaagcctcaataatagcttcaaggagcgaagataaatcgttcaggtaccacgatccttccttcaactataacaggaatgccatatttatatacaactatgccccaataatgcctgctaatatgccggatatagcgaagaagcttatggattctctggattacgtcggtgttatgggcatagaattctacgttaagaatggcgaagttataataaatgagtttgcgccaagagtccataattctggccatcataccctgctaggctcatcaatatcacaattcgaggaacacgtacgcgctataacaggaatccccatatctcagccaatcctgtacaggccatcttcttcaataaatatattaggaacaaaacttagcacggacgcgtggaattccatattatccatgagctcgacccagatatattggtatgggaaggaagagataaggaggaggcgcaaagtcgggcacgttaatgtaactgctggtacagttgaggcgctgatagataagataggaaagatcatggaaataatatacccagatggtattgaaaactatatttga

SEQ ID NO: 13631 - protein, 358 aa, Thermoplasma volcanium GSS1
MNVGIIGSGQLGYMMINEGRRLGNKYFVLDSNGVGPASLIADAHFSVDQYKEFVDKCDVVTYEFEHVLEEALLYAEDQHKLKPSIRPVELKKDRSLEKDYLTGIGLKVANYRVAHSFSEAVRYAKDFGKAMIKNSFGGYDGKGQTIYDNGNYEELKGEKFVVEEFVDFDYEASIIASRSEDKSFRYHDPSFNYNRNAIFIYNYAPIMPANMPDIAKKLMDSLDYVGVMGIEFYVKNGEVIINEFAPRVHNSGHHTLLGSSISQFEEHVRAITGIPISQPILYRPSSSINILGTKLSTDAWNSILSMSSTQIYWYGKEEIRRRRKVGHVNVTAGTVEALIDKIGKIMEIIYPDGIENYI

SEQ ID NO: 13632 - DNA, 1143 bp, Thermotoga maritima MSB8
  CDS (1)..(1143): transl_table=11
ttgaaaaagatcggtatcatcggcggtggccagcttggcaagatgatgaccctcgaagcgaagaagatgggtttttacgtgatagtgctcgatccaactcccagaagccccgctggacaggtggcggacgaacagatagtcgcgggcttttttgactcagaaagaattgaagatctggtgaaaggttcagatgtcaccacttacgatcttgaacacatcgacgttcagacgttgaagaaactctacaacgagggttacaaaatacatccctctccgtacaccctggaaatcatacaggataagttcgttcaaaaagaatttttgaagaaaaacggcatcccagttcctgaatacaaacttgtgaaggatctggaaagcgacgtcagggagttcggtttccctgttgttcaaaaggcgagaaagggaggatacgacggcagaggggtgttcatcataaaaaacgaaaaagatcttgaaaacgctataaaaggcgagacctaccttgaggagttcgttgagatagagaaagaactcgctgtcatggtggcgagaaacgaaaaaggagaaatagcatgttatcccgtggtggagatgtacttcgacgaagatgcgaacatctgcgatacagtgatagcccctgccaggatagaagaaaaatactcgaagatcgccagagaaattgcaacgagtgttgtagaagcgttagaaggtgtcggtatctttggaatagagatgtttctcacaaaacagggtgagatactcgtcaacgagatcgctccacggccacacaactccggccattacaccatcgaagcgtgtgtgacgagccagttcgaacagcacattagagcgatcatgaacctgcctctcggatcaacggagcttctcatccccgcggtgatggtgaatctcctcggtgaggaaggatattatggaaaacccgccctcattggattggaagaagctctggccatagaaggtctttcgcttcatttctatggaaaaaaagaaaccaggccgtacagaaaaatgggacatttcacggtggtggatagagacgttgaaagagcgctcgaaaaagcgctcagagcgaagaaaatactgaaagtcgtctcggaggagggagcgatgtgccaagggtag

SEQ ID NO: 13633 - protein, 380 aa, Thermotoga maritima MSB8
MKKIGIIGGGQLGKMMTLEAKKMGFYVIVLDPTPRSPAGQVADEQIVAGFFDSERIEDLVKGSDVTTYDLEHIDVQTLKKLYNEGYKIHPSPYTLEIIQDKFVQKEFLKKNGIPVPEYKLVKDLESDVREFGFPVVQKARKGGYDGRGVFIIKNEKDLENAIKGETYLEEFVEIEKELAVMVARNEKGEIACYPVVEMYFDEDANICDTVIAPARIEEKYSKIAREIATSVVEALEGVGIFGIEMFLTKQGEILVNEIAPRPHNSGHYTIEACVTSQFEQHIRAIMNLPLGSTELLIPAVMVNLLGEEGYYGKPALIGLEEALAIEGLSLHFYGKKETRPYRKMGHFTVVDRDVERALEKALRAKKILKVVSEEGAMCQG

SEQ ID NO: 13634 - DNA, 1140 bp, Bacillus halodurans C-125
  CDS (1)..(1140): transl_table=11
atgacgatcattgaacctggaaagacgattggtatccttggtggcggtcagctaggacggatgatggcgctagcagctcgagcgatgggctatcgcatcgccgtgctggaccctaatccagatgggccatgtgcccaagtggctgatgtggtgattgaagccgcgtacgatgacatggaagctgcgaaaaaactcgtcagtgtatcagatgtggtcacatatgagtttgaaaatgtgaacttagacgtagccaattatattgaacaaaaaggctgcttaccgcaaggggcgaacttgttgcgagtcactcagcatcgggcggtcgaaaaagagaccataactactctcggtttacctgtcgcactgtacaaatatgtaaacgaagcgcctgattttatcgaactggcacaaacgattggctttccagccgtgttaaaaacgtgccggggtggctatgatggcaaaggccaacgggttgttcgtacggtcgatgagctcaaaagcgcttacgatgaattgaagctagctggggaactcgtgttggaggcttgggtaccatttgacaaagaaatctctgtgatcgtcgcccgaaacgagcgaaatgacacgaaaacattcccggtagcggaaaacattcacgaggcgaatattcttcaccagtcgattgttccagcaaggattggggatgatctgagagataaagccgagcagcttgcgattcgcttagcggaagggctaaatttaatcggtacgctcgccgtggaaatgttcgtcacaacgagtggggacatttatattaacgaacttgccccgcgcccgcacaattcgggacactacacgattgaagcctgcgaaacatcacagtttgaacagcacgttcgtgccatctgtggttggcctctaggtcatgtaggactgtataaaccagttgtgatggggaatttattaggagagcacttacctggtgtcttgaatgaaatcagtgagatgaaggatgcgaaactccacctttatggaaaggcggaagccaaagaaaaaagaaaaatggggcatatcaccgtccttgctgatgatctgaacagagccattgaccgggtaggacagatccaagaaaaggcttgtgctaaaataggctcgtag

SEQ ID NO: 13635 - protein, 379 aa, Bacillus halodurans C-125
MTIIEPGKTIGILGGGQLGRMMALAARAMGYRIAVLDPNPDGPCAQVADVVIEAAYDDMEAAKKLVSVSDVVTYEFENVNLDVANYIEQKGCLPQGANLLRVTQHRAVEKETITTLGLPVALYKYVNEAPDFIELAQTIGFPAVLKTCRGGYDGKGQRVVRTVDELKSAYDELKLAGELVLEAWVPFDKEISVIVARNERNDTKTFPVAENIHEANILHQSIVPARIGDDLRDKAEQLAIRLAEGLNLIGTLAVEMFVTTSGDIYINELAPRPHNSGHYTIEACETSQFEQHVRAICGWPLGHVGLYKPVVMGNLLGEHLPGVLNEISEMKDAKLHLYGKAEAKEKRKMGHITVLADDLNRAIDRVGQIQEKACAKIGS

SEQ ID NO: 13636 - DNA, 1089 bp, Pasteurella multocida subsp. multocida str. Pm70
  CDS (1)..(1089): transl_table=11
atgcaaaaaagtgctttatatccaacagtgtatgtcctcggtaatggacagctcgggcgaatgttacgttatgcgggtgcccctttagatattgatgtccaaccgcttgcttttaatactccacgctttgacttagcagcggacagtatcatcaccgcagaaattgaacgttgggaaaaaacacctttaacggaaatgcttgctcatcacgccaattttgtgaatcaaagtgtgtttgccaaattagctgatcggttatcacaaaaaactttgcttgatgcactccagttacccacttccccatggtgcttattaaaagacaaaaatcaatggtcaacggtattcgatagcattggcgagaaagtcgtcgtcaaacgtcgtatggggggctatgatggtcgaggtcagtggattgttcaacaacaaaataccgatgccattaccgacgatttatacggtgaaaccattgctgaaaaatttattccttttgattatgaaatttctcttgtaggcgcacgttttaaaaatggtgaaacacgtttctatcctgtcacgcacaatttacagcaaaatggtattttgcgttatagcgtggtcgatataaatttcccacagcaagtacaacagcaagccagcgctgaagccatgctaagtaaaattatgcaccaattaaattatgttggggtgatggcgatggaatgttttgtggtcggtgatcagctattaattaatgaattggcgcctcgtgttcataacagtggacattggacacaactaggttgtgccattagtcaatttgaattgcatttgcgtgcgttattggatttacccacaccaacgcttggcacctttgcgccgagtgtgatggtcaatctgattggaacagaacacaatccagcttggttaaatacgccattcagccaactacattggtatggcaaagaagtgcgtctcggacgtaaagtgggacacattaactttacacatattgataaaaaagtattgatcgcaagcttaaccacattagcacaggcgttacctgcggattatcaatctggtttaaattgggcaatagaaaaattacaataa

SEQ ID NO: 13637 - protein, 362 aa, Pasteurella multocida subsp. multocida str. Pm70
MQKSALYPTVYVLGNGQLGRMLRYAGAPLDIDVQPLAFNTPRFDLAADSIITAEIERWEKTPLTEMLAHHANFVNQSVFAKLADRLSQKTLLDALQLPTSPWCLLKDKNQWSTVFDSIGEKVVVKRRMGGYDGRGQWIVQQQNTDAITDDLYGETIAEKFIPFDYEISLVGARFKNGETRFYPVTHNLQQNGILRYSVVDINFPQQVQQQASAEAMLSKIMHQLNYVGVMAMECFVVGDQLLINELAPRVHNSGHWTQLGCAISQFELHLRALLDLPTPTLGTFAPSVMVNLIGTEHNPAWLNTPFSQLHWYGKEVRLGRKVGHINFTHIDKKVLIASLTTLAQALPADYQSGLNWAIEKLQ

SEQ ID NO: 13638 - DNA, 1050 bp, Lactococcus lactis subsp. lactis Il1403
  CDS (1)..(1050): transl_table=11
atgatggcaattgctgctcaatacatgggacataaagtcattacacttgacccaaatccaaactgttctgcggcaaaagtatctgatgaactgattgttgcaccttatgatgacgttgaaaatttattaagactggcctatgcttgtgacgtcattacttatgagtttgaaaatgtatcagcaaaagctttgcacgaaattgaaggctgtgtaaggattcctcaaggaatacgtctgttagagattacgcaaaaccgtcgctttgaaaaagaatttttgaccaacgaagctaaagttaatgttgcaccttggcaactcgtagattcagcggaaaaactcccagaaacagtaactagaaaacaagttttaaaaacaacaactggaggctatgacggtcatggacaagtggttttaaatactgatgaaaaattgtcagctgcaaaatcactgacagaactttcagaatgtgttttagaagattttatttcttttgaacgtgaaatttctgttattattagtggaaatggtcacgaatatgtggtttttcctctagctgaaaacgaacatagagaaaacatcttacatcaaacgatttctccggctcgtatatctgctgaaattacagagaatgcttataaaattgcgacctcaattgcggaaaaattagagctatctggcgtgctttgtgtggaaatgttcttaacagcagatggtcaaatctatgtcaatgaactagcaccaagaccacataatagtggccactttaccattgaagcttgtgatttcaaccaatttgatttgcatattaaaggaattttaggagaagacctaccagaacctaaacttttgaaacctgccattatgctgaacgttttagggcaacacgttgaggcagttaagaaacttaatcatgagcatgccgattggcatcaacatgattatggaaaagcagatgctaaacataaccgaaaaatgggacatgttacgatcttaacaaatgattttgaccaaacgattaatgaaattaaagcaactaaaatttgggattaa

SEQ ID NO: 13639 - protein, 349 aa, Lactococcus lactis subsp. lactis Il1403
MMAIAAQYMGHKVITLDPNPNCSAAKVSDELIVAPYDDVENLLRLAYACDVITYEFENVSAKALHEIEGCVRIPQGIRLLEITQNRRFEKEFLTNEAKVNVAPWQLVDSAEKLPETVTRKQVLKTTTGGYDGHGQVVLNTDEKLSAAKSLTELSECVLEDFISFEREISVIISGNGHEYVVFPLAENEHRENILHQTISPARISAEITENAYKIATSIAEKLELSGVLCVEMFLTADGQIYVNELAPRPHNSGHFTIEACDFNQFDLHIKGILGEDLPEPKLLKPAIMLNVLGQHVEAVKKLNHEHADWHQHDYGKADAKHNRKMGHVTILTNDFDQTINEIKATKIWD

SEQ ID NO: 13640 - DNA, 1110 bp, Streptococcus pyogenes M1 GAS
  CDS (1)..(1110): transl_table=11
atgaggaacaaggaaaaatcgcagaggagtcaagtggtgaactcatttaagaccattgggattatcggtggtggtcagctggggcagatgatggccattgcggctatctatatgggtcacaaggtcatcacgctggatcctgctagcgacagccctgcctcccgcgttagcgaggtaattgtggcgccttacgatgatgttgaggctttgggacaattggctgcgcgttgcgatgtgttgacttatgagtttgagaatgttgatgcggacggtttggatgccgttgtgtcagcttgtcagctaccgcaggggaccgatctgctccgcatttcccaaaaccgtatcgttgaaaaagactttctggcaaataaggctggtgtgacagtcgctccctataaggtggtgacgtctagccttgacctaggggggcttgatttgaccaagacctatgtcctcaagacagagacaggtggttatgacggtcatgggcaaaagattatccgctcagcagaagatttgccagaggcgcagcaattagctaactcagctcagtgtgtcttggaagagtttgtcaactttgaccttgaaatctcagtcatcgtgtctggaaatggcaaggatgtgacggtctttcccgttcaggaaaatatccaccgcaacaatatcctgtcaaaaaccatcgtaccagctcgcatctcagatcaactggctgataaggctaagaaaacggcggtgcagattgccaagaaactccagctgtcaggaactctctgtgtggaaatgtttacgaccgcagatgatatcattgtcaatgaaattgccccacgcccccacaactcagggcgctattctatcgaagcctgcgacttttcacagtttgacacccacatcttgggtgtgttgggcgcaccacttcctcagattcagctccacgccccagccgtcatgctcaatgtcctaggacaacatgtccagcaggcaactgactatgttgccaaaaaccctagcgcccacctccacatgtatggtaaactagaagcgaaacataaccgcaaaatgggacatgtgacggtgtttgcaaaagatgcggatgaggtgaaggagttttaa

SEQ ID NO: 13641 - protein, 369 aa, Streptococcus pyogenes M1 GAS
MRNKEKSQRSQVVNSFKTIGIIGGGQLGQMMAIAAIYMGHKVITLDPASDSPASRVSEVIVAPYDDVEALGQLAARCDVLTYEFENVDADGLDAVVSACQLPQGTDLLRISQNRIVEKDFLANKAGVTVAPYKVVTSSLDLGGLDLTKTYVLKTETGGYDGHGQKIIRSAEDLPEAQQLANSAQCVLEEFVNFDLEISVIVSGNGKDVTVFPVQENIHRNNILSKTIVPARISDQLADKAKKTAVQIAKKLQLSGTLCVEMFTTADDIIVNEIAPRPHNSGRYSIEACDFSQFDTHILGVLGAPLPQIQLHAPAVMLNVLGQHVQQATDYVAKNPSAHLHMYGKLEAKHNRKMGHVTVFAKDADEVKEF

SEQ ID NO: 13642 - DNA, 1137 bp, Neisseria meningitidis MC58
  CDS (1)..(1137): transl_table=11
atgaaaaacatatctctttctccgcccgccatgcttggcatcctcggcggcggacaattaggcagaatgtttaccgttgccgccaaaaccatgggctacaaagtaaccgttctcgaccccgatccggacgcgccggcagcagaatttgccgaccgccatttgtgcgcgccgtttaacgaccaagctgctttggacgaattggcaaaatgcgcggcggtgaccactgaatttgaaaacgtcaatgccgatgcgatgcgctttttggcaaaacataccaatgtttcccctagcggcgattgtgtggcgattgcacaaaaccgcattcaggaaaaggcatggatacgcaaagcgggattgcaaaccgcgccgtatcaagtggtttgtaaggctgaagacatcactgaagcaagcgcgcaatttttgcccggcatcctgaaaacggctacgttgggctacgacggcaaaggtcaaatccgcgtaaaaacattggatgaactcaaagccgcgtttgccgaacacggcggcgtggattgcgttttggaaaaaatggtggatttgcgcagtgaaatttccgtaatcgtatgccgtttgaacaatgacaacgtgcaaactttcgaccctgccgaaaacatccacgaaaacggcatcttggcttattccatcgtccccgcgcgactgagtgccgacgtgcagcaacaggcgcggcagatggcgcaacgcttggcggacgaattggattatgtcggcgtattggcggtagaaatgtttgttgtcggtgacacgcatgaattggtcgtcaacgaaatcgccccgcgcccgcacaattccggacaccatacgatagatgcctgcgcagcagaccagttccagcagcaggtacgcattatgtgcaacctgccgcctgccgataccaaattactgagttcttgctgtatggcaaatattttgggcgacgtttggcaggaagacggcggcgaaccggattggctgcccttgcaaagccatccgaatgcacacctgcacctttacggcaaaaaaaccgcgcacaaagggcggaaaatgggacactttaccgttttaaccaccgattcggacaccgcatttcaagaagcaaaaaaactgcatcagtccctataa

SEQ ID NO: 13643 - protein, 378 aa, Neisseria meningitidis MC58
MKNISLSPPAMLGILGGGQLGRMFTVAAKTMGYKVTVLDPDPDAPAAEFADRHLCAPFNDQAALDELAKCAAVTTEFENVNADAMRFLAKHTNVSPSGDCVAIAQNRIQEKAWIRKAGLQTAPYQVVCKAEDITEASAQFLPGILKTATLGYDGKGQIRVKTLDELKAAFAEHGGVDCVLEKMVDLRSEISVIVCRLNNDNVQTFDPAENIHENGILAYSIVPARLSADVQQQARQMAQRLADELDYVGVLAVEMFVVGDTHELVVNEIAPRPHNSGHHTIDACAADQFQQQVRIMCNLPPADTKLLSSCCMANILGDVWQEDGGEPDWLPLQSHPNAHLHLYGKKTAHKGRKMGHFTVLTTDSDTAFQEAKKLHQSL

SEQ ID NO: 13644 - DNA, 1095 bp, Halobacterium sp. NRC-1
  CDS (1)..(1095): transl_table=11
atgctggccgacgccgccagcccgctcggcgtcgacgtgatcgtcctcgacccgacgccggactgccccgcctcacagcccgcaaccgaccacatccgcgccgacttcgacgaccccgatggcgtccgggaactcgccgcgcgcgcggacgtgctcacctacgagatcgaactcgcggaccccgacgtgctcgccgacgccgccgaggcacacgaggtggcggtccacccctcgcccgagaccctgcgcacgatccaggacaaactcgtgcagaaccgcgcgctcgccgacgccggcatccccgtgccggcgttccgcgcggtcgacgacgcggccgacctgcgcgcggccttcgaggagctcggcgcgccgctgatgttgaaacgccgcaccggcgggtacgacggcagcgggaacgcccccgtggactccgtcgccgacgcccgcgcggagttcggcggcgacctcggcgggttcgtcgccgaggaactcgtcgacttcgagcgcgaactctcggtcatcgccgcccgcggcgacgccgagacggccacgttcccggtcgccgaaaacctccacgaggcggagatcctccgggaatcggtcgtcccggcgcgcaccagcccagccgtccgcgaggacgccaccggtgtcgccgcggacgtgctcgacgccctcgacggtcgcggcgtcttcggcgtcgaactcttcgccgtcgacgggcgcgtgctcgtcaacgagatcgcaccccgcccccacaactccggccactacaccatcgaggggtgtcggacctcccagttcgaacagtgcatccgcgccgtcctcgggctcccgctgggggacacgacgctccgcgaaccgaccgtcatggcgaacctcatcggcgacccggatgtcgatccacatccggcgacgatcgccggcgtcccggccgcgttccgcgacgccggcgtggcgctgcactggtacgggaaacgacagctccgcccgcaccggaagatggcccacgtcaccgtcagcggcggcgacgaccgcctggcgagagcgcgcgccgcccgcgatgccgtctcgttcaccgacacccaccactcatga

SEQ ID NO: 13645 - protein, 364 aa, Halobacterium sp. NRC-1
MLADAASPLGVDVIVLDPTPDCPASQPATDHIRADFDDPDGVRELAARADVLTYEIELADPDVLADAAEAHEVAVHPSPETLRTIQDKLVQNRALADAGIPVPAFRAVDDAADLRAAFEELGAPLMLKRRTGGYDGSGNAPVDSVADARAEFGGDLGGFVAEELVDFERELSVIAARGDAETATFPVAENLHEAEILRESVVPARTSPAVREDATGVAADVLDALDGRGVFGVELFAVDGRVLVNEIAPRPHNSGHYTIEGCRTSQFEQCIRAVLGLPLGDTTLREPTVMANLIGDPDVDPHPATIAGVPAAFRDAGVALHWYGKRQLRPHRKMAHVTVSGGDDRLARARAARDAVSFTDTHHS

SEQ ID NO: 13646 - DNA, 1137 bp, Neisseria meningitidis Z2491
  CDS (1)..(1137): transl_table=11
atgaaaaacatatctctttctccgcccgccatgctcggcattcttggcggcggacaattaggcagaatgtttactgttgctgccaaaaccatgggctacaaagtaaccgtactcgatcccaacccgaatgcgccggcagcggaatttgccgaccgccatttgtgtgcgccgtttgacaaccaaaccgctttggaagaattggcaaaatgtgcggctgttacgaccgagttcgaaaacgtcaatgccgatgcgatgcgttttctcgccaaacataccaatgtttcccccagcggcgactgcgttgccatcgcgcaaaaccgcattcaggaaaaggcatggatacgcaaagcaggcctgcaaaccgcgccgtatcaagcaatttgcaaagccgaagacatcactgaagaaagcatacaatttctgcccggcatcctgaaaaccgctacattgggctatgacggcaaaggccaaatccgcgtcaaaacggtggatgaactcaaagccgcgtttgccgaacaccgcggcgtggattgcgttttggaaaaaatggtggacttgcgcggcgaaatttccgttatcgtatgccgtctgaacaatgacaacgtgcaaactttcgatcctgccgaaaacattcacgaaaacggtatcctcgcctactccatcgtcccagcccgactgagtgccgacattcagcaacaggcgcgacaaatggcgcagcgtttggccgatgaattgaactacgtcggcgtattggcggtagaaatgtttgttgtcggcgacacgcatgaattggtcgtcaacgaaatcgcgccgcgtccgcacaattccggccaccataccgtcgacgcctgcgcggcagaccaattccagcaacaggtccgcctgatgtgcaacctgccacctgctgacaccaaattgctgagttcttgctgtatggcgaatattttgggcgacgtttggcaggaagacggcggcgaaccggattggtttcccctgcaaagccggccggacgcgcacctgcacctttacggcaaaaaaaccgcgcacaaagggcggaaaatgggacactttaccattttaagcaccgattcggacaccgcatttcaagaagcaaaaaaactgcatcagtccctataa

SEQ ID NO: 13647 - protein, 378 aa, Neisseria meningitidis Z2491
MKNISLSPPAMLGILGGGQLGRMFTVAAKTMGYKVTVLDPNPNAPAAEFADRHLCAPFDNQTALEELAKCAAVTTEFENVNADAMRFLAKHTNVSPSGDCVAIAQNRIQEKAWIRKAGLQTAPYQAICKAEDITEESIQFLPGILKTATLGYDGKGQIRVKTVDELKAAFAEHRGVDCVLEKMVDLRGEISVIVCRLNNDNVQTFDPAENIHENGILAYSIVPARLSADIQQQARQMAQRLADELNYVGVLAVEMFVVGDTHELVVNEIAPRPHNSGHHTVDACAADQFQQQVRLMCNLPPADTKLLSSCCMANILGDVWQEDGGEPDWFPLQSRPDAHLHLYGKKTAHKGRKMGHFTILSTDSDTAFQEAKKLHQSL

SEQ ID NO: 13648 - DNA, 1068 bp, Escherichia coli O157:H7 EDL933
  CDS (1)..(1068): transl_table=11
atgaaacaggtttgcgtcctcggtaacgggcagttaggccgtatgctgcgtcaggcaggcgaaccgttaggcattgctgtctggccggtcgggctggacgctgaaccggcggcggtgccttttcaacaaagcgtgattaccgctgagatcgaacgctggccggaaacagcattaacccgcgagctggcgcgccatccggcctttgtgaaccgcgatgtgttcccgattattgctgaccgtctgactcagaagcagcttttcgataagctccacctgccgactgcaccgtggcagttacttgccgaacgcagcgagtggcctgcggtgtttgagcgtttaggtgagctggcgattgttaagcgtcgcactggtggctatgacggacgcggtcaatggcgtttacgcgccgatgaaaccgagcagttaccggctgaatgctacggcgaatgtattgtcgagcagggcataaacttctctggtgaagtgtcgctggttggcgcgcgctgctttgatggcagcaccgtgttttatccgctgacgcataacctgcatcaggacggtattttgcgcaccagcgtcgcttttccgcaggccaatgcgcagcagcaagcgcaagccgaagagatgctgtcggcgattatgcaggagctgggctatgtgggcgtgatggcgatggagtgttttgtcaccccgcaaggtctgctgatcaacgaactggcaccgcgtgtgcataacagcggtcactggacacaaaacggtgccagcatcagccagtttgagctacatctgcgggcgattaccgatctgccgttaccgcaaccagtggtgaataatccgtcggtgatgatcaatctgattggtagcgatgtgaattatgactggctgaaactgccgctggtgcatctgcactggtacgacaaagaagtccgtccgggccgtaaagtggggcatctgaatttgaccgacagcgacacatcgcgtctgtccgcgacgctggaagccttgatcccgctgctgccgccggaatatgccagcggcgtgatgtgggcgcagagtaagttctgttaa

SEQ ID NO: 13649 - protein, 355 aa, Escherichia coli O157:H7 EDL933
MKQVCVLGNGQLGRMLRQAGEPLGIAVWPVGLDAEPAAVPFQQSVITAEIERWPETALTRELARHPAFVNRDVFPIIADRLTQKQLFDKLHLPTAPWQLLAERSEWPAVFERLGELAIVKRRTGGYDGRGQWRLRADETEQLPAECYGECIVEQGINFSGEVSLVGARCFDGSTVFYPLTHNLHQDGILRTSVAFPQANAQQQAQAEEMLSAIMQELGYVGVMAMECFVTPQGLLINELAPRVHNSGHWTQNGASISQFELHLRAITDLPLPQPVVNNPSVMINLIGSDVNYDWLKLPLVHLHWYDKEVRPGRKVGHLNLTDSDTSRLSATLEALIPLLPPEYASGVMWAQSKFC

SEQ ID NO: 13650 - DNA, 1113 bp, Deinococcus radiodurans R1
  CDS (1)..(1113): transl_table=11
atgagcgaccaacctgcggccaccctcggcattctgggcggcggacaactcgctcagatgctggccctcgctgcgctgccgctgggggtgcaggtgcgggtgcttgaacctgatgcggaagccccagcccggctgtgtgccgagcatgtgcacgcgccctacaccgacccggcggggctggacgcgcttgcggcgtgcgacgcggtcacgctggaattcgaaaatgtcccggtggagtcgctggacgctctgcggggccgggtgccggtgcgtcccggagccgggctgctcgcccgctccaagcaccgcgcccgcgagaaggcggcgctgcaagaggcgggggcgcgcacggcgcccttcgtggtcatccagcgggaagcggacctggacggcgctctggaccgggtcgggggccagggcatcctcaaaacctccgaactcgggtacgacggaaaagggcaggtgcgggtggcctccgacaccgacctgcgccagggctgggccgagctggggcaagtcgcctgcatattggaaggcttcgtcacctttgagcgcgaagtcagcctcgctgtggcgcgcacggcggacgggcgcctggcctttgggccgctggtggagaacgtccaccgtgacgggattttgcggacgtccgtttaccccgctgccgtgccggacggcaccgaagcccgcgcccgcgagatggcccgcgccgtggccgagggctggggcctggaagggctgctcacgctggaattctttcaggtgccggacggcgacctgctggtgaatgaggtcgcgccccgtgtccacaactccggccacctgacccaggacggcggcggtgccagccagttcgaggcacaggtgcgcgcggtgctgggcctgccgctgtccgactggtctcccctgctgccctgcgcgatggtcaactatgtcggtgtggagggggccgcgcccgactgggccgccattgacgcccttcccggcacccgcgtccacctctatcacaaggcgcaccgcaccgggcgcaagctgggacacgtcaatctggcagcgcccgacctgcccaccttgcatcagcggctggcacagctcgaacagctcatcccctga

SEQ ID NO: 13651 - protein, 370 aa, Deinococcus radiodurans R1
MSDQPAATLGILGGGQLAQMLALAALPLGVQVRVLEPDAEAPARLCAEHVHAPYTDPAGLDALAACDAVTLEFENVPVESLDALRGRVPVRPGAGLLARSKHRAREKAALQEAGARTAPFVVIQREADLDGALDRVGGQGILKTSELGYDGKGQVRVASDTDLRQGWAELGQVACILEGFVTFEREVSLAVARTADGRLAFGPLVENVHRDGILRTSVYPAAVPDGTEARAREMARAVAEGWGLEGLLTLEFFQVPDGDLLVNEVAPRVHNSGHLTQDGGGASQFEAQVRAVLGLPLSDWSPLLPCAMVNYVGVEGAAPDWAAIDALPGTRVHLYHKAHRTGRKLGHVNLAAPDLPTLHQRLAQLEQLIP

SEQ ID NO: 13652 - DNA, 1182 bp, Xylella fastidiosa 9a5c
  CDS (1)..(1182): transl_table=11
atgaagaccctcggtattcttggcggcgggcaactggcccgtatgctggcgttggctgcacccccattgggcgtgcgggtgtgtacgtttgatcaaactgttgacgcttgtgctgggcagatgacgccgctctgggttggttgttttgatgatgtggctgcgttgcgtgactttgtcgcccgggtggatgtcatcacttttgactctgagaacctgccggttgctagtgtgcaagtactgaaagaacacgtcccggtgtatccgaatccagaggtactcgcagtggcccaggacaggctaagtgaaaagaccttgtttcgtgacttggggattccggtgcccgacttcgttgctgtcgacaatcgggctgctttggatgtggcaatcgtcaaggtggggacaccttgtatcctcaagacgcgtcggtttggttacgatggcaaaggtcaattccgcatcaagacgttgattgatgcggatgcggcttgggccatgctgggtgagcaagccggaataaccgggttgattttggaagcctttgtgccattccagcgtgagatgagcatccttgctgtgcgcggttgtaacggtcagtttcgttcttggccgttgaccgagaattggcatgttgcaggcgtgctctctgtcagtttggctccaatggccgttgatccgacgctgcaggctgcggctgaagcctatgcgcgtgtattggctgagcgattggactatgtgggcgtgttcgcactagagctgtttgtccacgatggccgattacttgccaacgagatggcaccacgcgtgcataactccggacattggacgattgaaggggccgaaacgtcccagtttgaaaatcacctgcgtgctgtatttggcttaccgctcggtagcactgcgatgcgtggttatgcctgcatggtcaattgcttaggtgtcatgcctgatcaacaggcattactggccgtgtcaggcctacattggcacgactatggcaagcagccacgccaagggcgcaaggtcggtcatgccacactacgtgcggatcaacctgcggatttaatggcttctctggagcaggtgggtgcagtactgggggatcaagaacgcgtggctgtggtgctggagcgtttgtcggaggtgtcccggagggatgccgttgcggcgtcttcttctgtctga

SEQ ID NO: 13653 - protein, 393 aa, Xylella fastidiosa 9a5c
MKTLGILGGGQLARMLALAAPPLGVRVCTFDQTVDACAGQMTPLWVGCFDDVAALRDFVARVDVITFDSENLPVASVQVLKEHVPVYPNPEVLAVAQDRLSEKTLFRDLGIPVPDFVAVDNRAALDVAIVKVGTPCILKTRRFGYDGKGQFRIKTLIDADAAWAMLGEQAGITGLILEAFVPFQREMSILAVRGCNGQFRSWPLTENWHVAGVLSVSLAPMAVDPTLQAAAEAYARVLAERLDYVGVFALELFVHDGRLLANEMAPRVHNSGHWTIEGAETSQFENHLRAVFGLPLGSTAMRGYACMVNCLGVMPDQQALLAVSGLHWHDYGKQPRQGRKVGHATLRADQPADLMASLEQVGAVLGDQERVAVVLERLSEVSRRDAVAASSSV

SEQ ID NO: 13654 - DNA, 1092 bp, Streptococcus pneumoniae TIGR4
  CDS (1)..(1092): transl_table=11
atgagctcatctaaaacaatcggaattatcggtggcggtcaactgggtcagatgatggccatttctgctatctacatgggccacaaggttatcgcgctggatcctgcggcggattgcccggtctctcgtgtggcggaaatcattgtggcaccttataacgatgtagacgccctccgtcagttggcagaccgttgcgatgtcctcacttatgagtttgaaaatgtcgacgctgacggtttggatgccgttatcaaggatggacaactccctcaaggaacagatctgctccgcatttcgcaaaatcgtatttttgaaaaggactttttgtcaaacaaggctcaagtcactgtggcaccctacaaggtcgtgacttctagcctagacttggcagatatcgacttgtcgaaaaactatgtcctcaagactgcgactggtggctacgatggtcatggacaaaaggttattcgttcagaagcagacttggaagcagcctatgcgctagcagactcagcagactgcgtcttggaagaatttgtcaactttgaccttgagatttctgtcatcgtgtcaggaaatggcaaggaggtgacgtttttcccagttcaggaaaatatccaccgcaacaatatcctgtctaagaccatcgtaccagcccgcatttctgaaagtctagtagacaaggctaaagctatggcagtgcgaatcgcagaacaactcaacttgtctggaactctctgtgtggaaatgtttgcgacagctgatgacatcattgtcaatgaaatcgccccacgaccacataactctgggcactattctattgaagcctgtgatttctctcagtttgacacccatattctgggtgttctcggagcaccattaccagtcatcaaactccatgcgccagccgttatgcttaatgtcctcggtcagcatgtcgaggctgctgaaaaatatgtcacagaaaatccaagcgcccacctccacatgtatggtaaaatagaagcaaagcataatcgtaagatgggacatgtgactttgtttagtgatgtgccggatagtgtggaagagtttggggaagggattgatttttag

SEQ ID NO: 13655 - protein, 363 aa, Streptococcus pneumoniae TIGR4
MSSSKTIGIIGGGQLGQMMAISAIYMGHKVIALDPAADCPVSRVAEIIVAPYNDVDALRQLADRCDVLTYEFENVDADGLDAVIKDGQLPQGTDLLRISQNRIFEKDFLSNKAQVTVAPYKVVTSSLDLADIDLSKNYVLKTATGGYDGHGQKVIRSEADLEAAYALADSADCVLEEFVNFDLEISVIVSGNGKEVTFFPVQENIHRNNILSKTIVPARISESLVDKAKAMAVRIAEQLNLSGTLCVEMFATADDIIVNEIAPRPHNSGHYSIEACDFSQFDTHILGVLGAPLPVIKLHAPAVMLNVLGQHVEAAEKYVTENPSAHLHMYGKIEAKHNRKMGHVTLFSDVPDSVEEFGEGIDF

SEQ ID NO: 13656 - DNA, 1092 bp, Agrobacterium tumefaciens str. C58
  CDS (1)..(1092): transl_table=11
gtgacgaaaaacgtgatggcaaagacgaataacctgaccatcggcatcatcggcggcgggcagcttggccggatgctggccatggcagcggcccgcctcaaccaccgcaccatcgtgctggagccgcaggccgattgtccggccgcgcaggtttgcaatgaccagatcgttgcggaatatgacgacgaaaaggcgcttgccgaactcgcaagccgctgcgatgtcgtgacctacgaattcgaaaacgtgcctgtcgcagccgccgaaaaactcagcgcctccgtgcccgtctacccgccggcgcaggcgctcagcgcctcgcaggaccgcttgacggaaaaacgcttcctcaatggttgcggcattccgaccgccgattttcgcgccgtggatagccaggacgagctggaagctgccttgaccgcctttggcggcaagggtgtgctgaaaacccgccgtatgggttatgacggcaagggccagcgtctcttccggggcggcgaaaacctcacaggcgcctttgcggcgctcggcggcgtgccgctgatcctcgaaagtttcgtcgccttcgagcgggaaatttcgatcatcgccgcccgtttccaggacggtaccgtcacctgttacgatccggccgaaaacgtccatctgaacggcattctgcacacatcgacggtgccggcagcactttccgatgccgcaaaggctgtcgccgtgcaatcggccgaaaagcttctcgccgcgctcgagtatgtcggcgtcatcggtattgaatttttcgtcctgccggatggttctctggttgccaatgaaatggcgccgcgtgtccacaataccggccactggacggaagcggcttgtgcgatctcgcagttcgagcagcatatccgggccgtgtcggaccttgcccctggcagcacggatcgccattccgattgtgtgatgaccaatctgatcggcgacgacatcaacgacgtgcccgcatggctgtcgaaaaaagactgtctcgtgcatctctatggcaagacggaagcaaggcctggccgcaagatgggccatgtgaccgagcttctgcacacaggaaaggcctag

SEQ ID NO: 13657 - protein, 363 aa, Agrobacterium tumefaciens str. C58
MTKNVMAKTNNLTIGIIGGGQLGRMLAMAAARLNHRTIVLEPQADCPAAQVCNDQIVAEYDDEKALAELASRCDVVTYEFENVPVAAAEKLSASVPVYPPAQALSASQDRLTEKRFLNGCGIPTADFRAVDSQDELEAALTAFGGKGVLKTRRMGYDGKGQRLFRGGENLTGAFAALGGVPLILESFVAFEREISIIAARFQDGTVTCYDPAENVHLNGILHTSTVPAALSDAAKAVAVQSAEKLLAALEYVGVIGIEFFVLPDGSLVANEMAPRVHNTGHWTEAACAISQFEQHIRAVSDLAPGSTDRHSDCVMTNLIGDDINDVPAWLSKKDCLVHLYGKTEARPGRKMGHVTELLHTGKA

SEQ ID NO: 13658 - DNA, 1152 bp, Streptococcus pneumoniae R6
  CDS (1)..(1152): transl_table=11
ttgcggatgcacttgccaactttgctgaagaacaaggaaaaatcgcagaggagtcgtcaaatgagctcatctaaaacaatcggaattatcggtggcggtcaactgggtcagatgatggccatttctgctatctacatgggccacaaggttatcgcgctggatcctgcggcggattgcccggcctctcgcgtggcggaaatcattgtggcaccttataacgatgtggacgccctccgtcagttggcagaccgttgcgatgtcctcacttacgagtttgaaaatgtcgacgctgacggtttggatgccgttatcaaggatggacaactccctcaaggaacagatctgctccgcatttcgcaaaatcgtatttttgaaaaggactttttgtcaaacaagtctcaagtcactgtggcaccctacaaggtcgtgacttctagcctagacttggcagatatcgacttgtcgaaaaactatgtcctcaagactgcgactggtggctacgatggtcatggacaaaaggttattcgttcagaagcagacttggaagcagcctatgcgctagcagactcagcagactgcgtcttggaagaatttgtcaactttgaccttgagatttctgtcatcgtgtcaggaaatggcaaggaggtgacgtttttcccagttcaggaaaatatccaccgcaacaatatcctgtctaagaccatcgtaccagcccgcatttctgaaagtctagtagataaggctaaagctatggcagtgcgaatcgcagaacaactcaacttgtctggaactctctgtgtggaaatgtttgcgactgatgatgacgttattgtcaatgaaatcgccccacgaccacataactctgggcactattctattgaagcctgtgatttctctcagtttgacacccatattctcggtgttctcggagcaccattaccagtcatcaaactccatgcgccagccgttatgcttaatgtcctcggtcagcatgtcgaggctgctgagcaatatgtgacagaaaattcaagcgcccacctccacatgtatggtaaaatagaagcgaagcacaaccgcaagatgggacatgtgaccttgtttagtgatgtaccggatagtgtggatgagcttggggaagggattgatttttag

SEQ ID NO: 13659 - protein, 383 aa, Streptococcus pneumoniae R6
MRMHLPTLLKNKEKSQRSRQMSSSKTIGIIGGGQLGQMMAISAIYMGHKVIALDPAADCPASRVAEIIVAPYNDVDALRQLADRCDVLTYEFENVDADGLDAVIKDGQLPQGTDLLRISQNRIFEKDFLSNKSQVTVAPYKVVTSSLDLADIDLSKNYVLKTATGGYDGHGQKVIRSEADLEAAYALADSADCVLEEFVNFDLEISVIVSGNGKEVTFFPVQENIHRNNILSKTIVPARISESLVDKAKAMAVRIAEQLNLSGTLCVEMFATDDDVIVNEIAPRPHNSGHYSIEACDFSQFDTHILGVLGAPLPVIKLHAPAVMLNVLGQHVEAAEQYVTENSSAHLHMYGKIEAKHNRKMGHVTLFSDVPDSVDELGEGIDF

SEQ ID NO: 13660 - DNA, 1095 bp, Sulfolobus tokodaii str. 7
  CDS (1)..(1095): transl_table=11
atgaagtccttaacacaaaactcgattaaaattggaattttaggaggaggacaattaggctggatgatgattttagaagggagaaaatatcccttcgctttttacgtaatggacgagccagaagctcctgcatgtaaagtagcggataaatgttttacgccagatgactataagaaaatgatagatgaagttgacgtagtaacttttgagttcgaacatgtcaaagaagaggcattacagtatgctgaagatcaagggaaacttttgcccaggttaaatactgttgaattaaaaagggaaagatggaaggaaaaaacatattataaggaacataatttgccaactcctagattttacattgctaacgacggagaagaggcattaagaattcttaaggacgagtttaataacgttggtgttttgaaacagagtaggggaggatatgacggtaaaggacagtattttataaagggagatgtcgaaaaatacggattcattaaggatatgaagtgtaaatttgtagttgaagaatttgttaattttaattatgaggcttctataatagctgttagagatcgaaatggaaattttaaggcatatccaccaacattcaactataacgaaaaaggaatcctggtatacaactacggtccccttaaagataacagatttgctgagattgcaaagaggttaatggattctttagaatatgtaggtacaattggtattgagttttttgtaagagatggggaaattctaataaatgagtttgctcctagagttcataatactggtcactatactctagatgcagcatttgtttcacaatttgaacaacatttgcgagcaataactggcctggaaataggtgctacagagctactctcatatggaggtatggtgaatattttaggtacagataatgttcctcttgaagttcttaaatatggtaaagtgtattggtatgggaagaaagaagttagaaagaggagaaagttggggcatgtcaatgtagttggaagtaacttagaagatgttaagcaaaaaattgatattattatgaaactaatttatcctcaaggtttagatttatga

SEQ ID NO: 13661 - protein, 364 aa, Sulfolobus tokodaii str. 7
MKSLTQNSIKIGILGGGQLGWMMILEGRKYPFAFYVMDEPEAPACKVADKCFTPDDYKKMIDEVDVVTFEFEHVKEEALQYAEDQGKLLPRLNTVELKRERWKEKTYYKEHNLPTPRFYIANDGEEALRILKDEFNNVGVLKQSRGGYDGKGQYFIKGDVEKYGFIKDMKCKFVVEEFVNFNYEASIIAVRDRNGNFKAYPPTFNYNEKGILVYNYGPLKDNRFAEIAKRLMDSLEYVGTIGIEFFVRDGEILINEFAPRVHNTGHYTLDAAFVSQFEQHLRAITGLEIGATELLSYGGMVNILGTDNVPLEVLKYGKVYWYGKKEVRKRRKLGHVNVVGSNLEDVKQKIDIIMKLIYPQGLDL

SEQ ID NO: 13662 - DNA, 1050 bp, Sinorhizobium meliloti 1021
  CDS (1)..(1050): transl_table=11
atgaagaccatcggcatcatcggtggcggccagcttggccgcatgctggccatggccgctgcccgcctgaacttccgcaccgtggtgctcgagccgcagccggactgtccggcggcgcaggtggcgaacgaccagatcgtcgccgcctatgacgatccgcgcgcgctggacgagcttgcgcgggtggcggatctcatcacttacgaattcgagaacgtcccggtctcggccgccgagcaactcgcccgttcgcggccggtctttccgccgccgaaggcgctggaagtggcacaggaccgtctcgccgagaagcgcttcatcaacggctgtggcatcgccaccgccggattccaacccgtcgacagccaggccgacctcgaggccgcccttgcggaattcggcggcgccggcgtgctcaagacccgccggctcggctacgacggcaagggccagcgcgtctttcgttccgctaccgacgatccggccggcgcctatgtcgcgctcggacaggtaccgctgatcctcgaaagcttcgtgccgttcgaccgggagatctcggtcatcgccgcacgcgcggccgacggcacgaccgcctgtttcgatcctgccgagaatgtgcatcgcaacggcattctccacacctcgaccgtgcccgcatccgtcggtccgtcagccacggaggccgcccgcaaggcggcaaccgccatcctcgacgcgctcggctatgtcggcgtcatcggtgtcgagttcttcgttctggccgacggcggcgtcgtcgcaaacgagatcgcgccgcgcgtacacaattccggccattggacggaggccgcctgcgtcgtttcgcagttcgagcagcatatccgcgcgattgcaggcctgcccctcggcgacccgtcgcgccattcggattgcgtgatgcagaacctggtcggcgacgacatcgcccgcgttccggacttgcttgccgagcgcaatgtgttccttcatctctacggcaaggccgaggcgcggcccggccgcaaaatggggcacttcacccgcctgctctga

SEQ ID NO: 13663 - protein, 349 aa, Sinorhizobium meliloti 1021
MKTIGIIGGGQLGRMLAMAAARLNFRTVVLEPQPDCPAAQVANDQIVAAYDDPRALDELARVADLITYEFENVPVSAAEQLARSRPVFPPPKALEVAQDRLAEKRFINGCGIATAGFQPVDSQADLEAALAEFGGAGVLKTRRLGYDGKGQRVFRSATDDPAGAYVALGQVPLILESFVPFDREISVIAARAADGTTACFDPAENVHRNGILHTSTVPASVGPSATEAARKAATAILDALGYVGVIGVEFFVLADGGVVANEIAPRVHNSGHWTEAACVVSQFEQHIRAIAGLPLGDPSRHSDCVMQNLVGDDIARVPDLLAERNVFLHLYGKAEARPGRKMGHFTRLL

SEQ ID NO: 13664 - DNA, 1083 bp, Thermoplasma acidophilum DSM 1728
  CDS (1)..(1083): transl_table=11
atgcgcatgaacataggcataataggcacaggacagcttggcttcatgatgataaacgaggggcgcaggctgggcaacaggtatctggtgctggattccaatggcgttggcccggcatcgctgatagctgacgctcatttcagccccgaggaatacagaaagtttgtagatcaatcggatgttgtcacattcgagtttgagcatgtaatggaagaggcgcttgaatatgcgcagtcccagggaaagctgtttcctggcatacagtctgttgaattgaagaaggatcgatcaaaggaaaaggattttcttaccgacaacggccttcctgtcgcggaataccacgttgccagcagctttgacgaggctgtgaggtacgccagggacatgggaaaggcggtcataaagaatgcgtatggcggttatgatggcaaggggcagatcgtttacgacggcggggtaagcgaaaggcttcagggagacaggttcgtggtggaagagttcatagatttcgactacgaggcctcaataattgccgttagagatcgtgacggcaacttcacctactttgatcccacatacaactataacagggaggcgatcttcatctacaatgttgcacccacagacgagctaacaatgccggctatcgcaaagaagctcatggaagcgctggattaccatggcgtgatgggcattgagttctacgtaaggaaaagaaaggtgatcataaatgaatatgccccaagggtgcacaattccggccatcacacgcttctcggctcgtcagtgtcgcagtttgaggagcacgtgagggcgataagcggccttcctgtgccgaagcctgtgctttacaggccatcctcatccgtgaatatactgggccaggacctggatcaggagaaggtgaagaggatactggaactgggggaagctgagatatactggtatggaaaggagggcatcaggcgcaggagaaaggtgggccatgtcaaccttacaggctatacgagggacaggctggatgatcgcatatccagggtgatggacatactgtacccagacggcgtccaaaactatatttga

SEQ ID NO: 13665 - protein, 360 aa, Thermoplasma acidophilum DSM 1728
MRMNIGIIGTGQLGFMMINEGRRLGNRYLVLDSNGVGPASLIADAHFSPEEYRKFVDQSDVVTFEFEHVMEEALEYAQSQGKLFPGIQSVELKKDRSKEKDFLTDNGLPVAEYHVASSFDEAVRYARDMGKAVIKNAYGGYDGKGQIVYDGGVSERLQGDRFVVEEFIDFDYEASIIAVRDRDGNFTYFDPTYNYNREAIFIYNVAPTDELTMPAIAKKLMEALDYHGVMGIEFYVRKRKVIINEYAPRVHNSGHHTLLGSSVSQFEEHVRAISGLPVPKPVLYRPSSSVNILGQDLDQEKVKRILELGEAEIYWYGKEGIRRRRKVGHVNLTGYTRDRLDDRISRVMDILYPDGVQNYI

SEQ ID NO: 13666 - DNA, 1086 bp, Caulobacter crescentus CB15
  CDS (1)..(1086): transl_table=11
atggcttcgttccccctggttcccggttccaccatcggcgtcctcggcgggggacagctaggccgcatgttggccctggccgctgcgcgcctgggtttcgatgtcgtgatccaggacccggaggagggctcgccggccggtcgcgtcgccgctcgccagatcgtcgcggcctatgacgatcgctgggccctcaagcgcctcgccgaggcctgcgacgtcgtcacctatgagttcgagaacgtcccggccgatacggtgtcggagctgacggctctgggggccatggtctcgccgggggccaaggcgctggccgccgcccaggaccgtgtggccgaaaagaccttcatggccgagatcggcgtgcccaccgtggccttcgccgccgtccacgacagccagagcctcgccgacgccgtggcccgcatcggcgccccctccctgctgaagacccgccgtgagggctatgacggcaagggccaagcctggattcagaaggtcagcgacgccgaggcggcctttgacaagatcggccgacagccggcgatcctggaggcccccgccgactttggccgtgaactgtcggtgatcgccgcgcgcggccgcgacggcgagatcgcctgctatccggtttccgagaaccaccacgagggcggcgtcctgcgccgcaccgtggcgccggccaagatcacccccgcgacgcgcgatcaggccgagtcgatcgtcgccaagatcctcaccgcgctggactatgtgggcgtcatcggcgtcgagctgttcgagctttccggcggcaagctgctggtcaacgagttcgcgccgcgcgtccacaacaccggccactggacccaggacggctgcgaggtcgaccagttcgagcagcacatccgcgccgtcgccggctggccgctgggccccaccgcgcctcaccatcatgttgagatgaccaatcttctgggcgccgatgtcgacgcctggaagaagctggccgccgagcccgagacccgcgtccacctctacggcaagggggaggcgcgccccggccgcaagatgggtcacgtcaatcggctgcggtcgctgcgcgactag

SEQ ID NO: 13667 - protein, 361 aa, Caulobacter crescentus CB15
MASFPLVPGSTIGVLGGGQLGRMLALAAARLGFDVVIQDPEEGSPAGRVAARQIVAAYDDRWALKRLAEACDVVTYEFENVPADTVSELTALGAMVSPGAKALAAAQDRVAEKTFMAEIGVPTVAFAAVHDSQSLADAVARIGAPSLLKTRREGYDGKGQAWIQKVSDAEAAFDKIGRQPAILEAPADFGRELSVIAARGRDGEIACYPVSENHHEGGVLRRTVAPAKITPATRDQAESIVAKILTALDYVGVIGVELFELSGGKLLVNEFAPRVHNTGHWTQDGCEVDQFEQHIRAVAGWPLGPTAPHHHVEMTNLLGADVDAWKKLAAEPETRVHLYGKGEARPGRKMGHVNRLRSLRD

SEQ ID NO: 13668 - DNA, 1068 bp, Salmonella enterica subsp. enterica serovar Typhi str. CT18
  CDS (1)..(1068): transl_table=11
atgaagcaagtttgcgttctcggcaacgggcaactgggccgaatgctgcgccaggcgggcgaaccgctgggtatcgccgtctggccggttggtctggatgcagagcctaccgccgtgccggtacagcagagcgtcattaccgcagagattgagcgctggccggaaaccgcgcttacccgcgagctggcgcgccacccggccttcgtcaatcgcgatgtatttccgatcatcgccgaccgtctgacacaaaaacagcttttcgataaactgggactcgcgaccgcgccgtggcagctgctgtccagcgccgacgagtggtccggcatctttgaccgtctgggcgaactggcgattattaagcgtcgcgttggcggctacgacggtcgcgggcagtggcgtctacgcgcggacgaaaccgggcaactgccggatgactgctatggcgaatgtattgttgagcgcggtatccatttttccggcgaagtgtcgttagtcggcgcgcgcgctcatgacggcagtaccgtgttttacccgctaacgcacaatttgcatcaggacggcatcttgcggaccagcgtcgcgttcccacaggcgaacgccgaacagcaggagcaggcggaatcgatgctgtcagcaattatgcaggcgttgaactacgtcggcgtaatggcgatggaatgttttatcacgccggaaggcctgttaatcaatgaactggcgccgcgcgtgcataacagcggacactggacgcaaaatggcgccagcatcagtcagtttgaattgcatttgcgcgcgattaccggcttgccgttgcccgcgccggtgattaacgccccgtcggtgatgatcaatctgatcggcagcgagctgaattacgactggctgaagctgccgctggtacatctgcactggtatgataaagcggtacgtccggggcgaaaagtcggccatctgaatctgaccgacagcgatacgtcacgtcttagcgccaccctggaagcgctctctccgctcctgccgggcgaatacgccagcggcattatctgggcgcaaagtaagcttaaataa

SEQ ID NO: 13669 - protein, 355 aa, Salmonella enterica subsp. enterica serovar Typhi str. CT18
MKQVCVLGNGQLGRMLRQAGEPLGIAVWPVGLDAEPTAVPVQQSVITAEIERWPETALTRELARHPAFVNRDVFPIIADRLTQKQLFDKLGLATAPWQLLSSADEWSGIFDRLGELAIIKRRVGGYDGRGQWRLRADETGQLPDDCYGECIVERGIHFSGEVSLVGARAHDGSTVFYPLTHNLHQDGILRTSVAFPQANAEQQEQAESMLSAIMQALNYVGVMAMECFITPEGLLINELAPRVHNSGHWTQNGASISQFELHLRAITGLPLPAPVINAPSVMINLIGSELNYDWLKLPLVHLHWYDKAVRPGRKVGHLNLTDSDTSRLSATLEALSPLLPGEYASGIIWAQSKLK

SEQ ID NO: 13670 - DNA, 1125 bp, Listeria monocytogenes EGD-e
  CDS (1)..(1125): transl_table=11
ttggataaaaaatttttactgacaaatagtactattggtatcattggtggcggacaacttggtcgtatgctagctcttgcggcgaaagcgatggggtatcgtattattgttctcgatcctaccgctgattgtccagctgctcaagtaagtgatgagcaaattattgctgactatgatgataaagtagccttacgcgaactttccgaaaaagcagatgtagttacatatgaatttgaaaatatcgactatgatgctttgaaaatgacgcaaaacttagtatctgtcccacaaggatcggaattgctttcgattacacaggataggattttggaaaaagcttatctggaatcagctaatattaacattgcaccatatgcggttatagtggaacaagatgaaatcgaaaatgaaattaaaagtattggatatcctgctgttttaaaaacggcacaaggtggatacgacgggaaaggccaagtggttattcatgatgcgagggatatcgaaacagcagcgagattattgcgttacggctcttgtgtactagaagcttggattccttttgaaaaagagatttctgtggttgtcgctcgtaatttagatgggcaaatagaaacttttccagttgcagaaaatgtacatgtaaataatattttgcatacgactatggttccagcagatgtggcggctgacgtttacgaggaagcggaagaaattgcgagaaagttagcagaagtacttcaattatgtggtgttttagcagtagaaatgtttgtgacaaaatcaggcgctatttatgtaaatgaacttgccccaagaccgcataactccggacattttacaattgaagcttgttcgatttctcagtttacgcagcatattcgagcgattgttggattaccactcgtaaaaccagaacttttaaaacccgccgtaatgattaatattttagggcaacatgttgatgctgtgaataaacaaatggtgaattatccacattggtttgtacattattatggaaaaaaagaagcgaaaatcaatcgcaaaatgggtcatgttactgtgcttgctgatgaaccaaaagcggttatacaagatttagaagaaacgcaaatttggaagtaa

SEQ ID NO: 13671 - protein, 374 aa, Listeria monocytogenes EGD-e
MDKKFLLTNSTIGIIGGGQLGRMLALAAKAMGYRIIVLDPTADCPAAQVSDEQIIADYDDKVALRELSEKADVVTYEFENIDYDALKMTQNLVSVPQGSELLSITQDRILEKAYLESANINIAPYAVIVEQDEIENEIKSIGYPAVLKTAQGGYDGKGQVVIHDARDIETAARLLRYGSCVLEAWIPFEKEISVVVARNLDGQIETFPVAENVHVNNILHTTMVPADVAADVYEEAEEIARKLAEVLQLCGVLAVEMFVTKSGAIYVNELAPRPHNSGHFTIEACSISQFTQHIRAIVGLPLVKPELLKPAVMINILGQHVDAVNKQMVNYPHWFVHYYGKKEAKINRKMGHVTVLADEPKAVIQDLEETQIWK

SEQ ID NO: 13672 - DNA, 1125 bp, Listeria innocua Clip11262
  CDS (1)..(1125): transl_table=11
ttggataaaaaatttttactgacaaatagtacaattggtatcatcggtggtggacaattaggacgtatgctagcaatagctgcaaaagcaatgggttaccgaattattgttttagatcctacagcagattgtccagctgctcaagtaagcgatgaacaaatcgtagctgattatgatgacaaagtagctttacgtgaactttcggaaaaagcagatgttgtgacatatgaatttgaaaacattgactacgatgcgcttaaaatgacacaaaacttagtatctgttccgcaaggatcggaattactttcgattacgcaagacagaattttagaaaaggcgtatttagaatctgctaacattaatattgccccatatgctgtaattgttgataaagaagaaatcgaaagtgagataagaagtattggttatccggctgtcttaaaaacagcgcaaggcggatatgatggaaagggacaagttgttattcacagtgcaagtgatattgaggatgccgcacaattgttgcgttacggttcttgtgtgttagaagcttggattccttttgaaaaagagatttctgtcattgttgctcgtaacttaaatggacaagtggaaacattccccgtagctgaaaatgttcatgtaaacaatattttgcatacgactattgcgccggccaaagtggcagcggatgtctatgaagaagcggaagaaattgccaaaaaattagccgatgtacttcaattatgtggtgttttggctgtagaaatgtttgtgactagttctggggcgatttatgtaaatgaacttgctccaagacctcataattcaggacattttacgattgaggcttgttcgatttctcagttcacacagcatattcgtgcgatagttggcttgccgctagtaaaacctgagctattgaaaccagcattaatggtcaatattttaggacaacatgtggatgcagtgaatgaacaaatgatagattacccacattggtttgtacattattatggtaaaaaagaagctaaaatcaatcgcaaaatgggtcatataactatcttgactgatgaaccaaaagcggtattgagtgatatagaagaaacgcaaatttggaagtaa

SEQ ID NO: 13673 - protein, 374 aa, Listeria innocua Clip11262
MDKKFLLTNSTIGIIGGGQLGRMLAIAAKAMGYRIIVLDPTADCPAAQVSDEQIVADYDDKVALRELSEKADVVTYEFENIDYDALKMTQNLVSVPQGSELLSITQDRILEKAYLESANINIAPYAVIVDKEEIESEIRSIGYPAVLKTAQGGYDGKGQVVIHSASDIEDAAQLLRYGSCVLEAWIPFEKEISVIVARNLNGQVETFPVAENVHVNNILHTTIAPAKVAADVYEEAEEIAKKLADVLQLCGVLAVEMFVTSSGAIYVNELAPRPHNSGHFTIEACSISQFTQHIRAIVGLPLVKPELLKPALMVNILGQHVDAVNEQMIDYPHWFVHYYGKKEAKINRKMGHITILTDEPKAVLSDIEETQIWK

SEQ ID NO: 13674 - DNA, 1143 bp, Nostoc sp. PCC 7120
  CDS (1)..(1143): transl_table=11
atgaagcgtgtaggtgtaattggtggtggacagctggcctggatgatgggaggcgcagcgaataaattagggcttgatttgatagtgcagactcctagcagtaatgatcctgccgtatctattgcccaggatattgttttggcaaatattgatgatgctcatgccacagagattttagcgaaaaagagtgacgttatcacatttgaaaacgaatttgtcaatctagaggctttatcgctgttagcaaatcaaggtgtttgtttccgtcccaagttagacgctttatcacctctattagataaatatcatcaacgttgctatttaaaaaatttaggtttacctgttccgcaattttttgccctggaaaaccaagagaatctgatatccaaaatagatgatttgggttttcctttagtgttgaaatctcgccgccacggttatgacggacaaggtacttttatcatccatgatttagcaaccttacaagagaaaatagacttaaatcacaatacaaacaccacatatttaatagaagaatttattccctttgaacgggagctagcagtaatcgcagctcgttctgtagatggagaagttgtcatctatcctgtggtagaaacacagcaagaacagcaagtctgtaggcgagttatagcacccgcccatattacacccgatcaagccgcagcagcagaagcgatcgcctctacactattaaatagtctagaagtggttggtgtgtttggaattgagttatttctcaccgccgatggtcaagtattagtcaatgaaatcgctccccgtacccacaactctgggcatttttctctagatgcgtgcgaaacatcgcaatttgaacaacacctgagagccatttgtggactaccgttaggaaacccagcattgcaatgtgctggtactgttatggtcaacctactaggctatgaaaactcccaaagtgattaccaaaaccagcgccaacaactagccgccatcccccaagctcacgttcattggtacggcaaaacagaatctcgcccagggcgtaaactcggacacgtcacagttttgttaaataatcatgaccaaaccaccgcccaggcgattgctcaaaccgtagaatccatctggtatcccacttag

SEQ ID NO: 13675 - protein, 380 aa, Nostoc sp. PCC 7120
MKRVGVIGGGQLAWMMGGAANKLGLDLIVQTPSSNDPAVSIAQDIVLANIDDAHATEILAKKSDVITFENEFVNLEALSLLANQGVCFRPKLDALSPLLDKYHQRCYLKNLGLPVPQFFALENQENLISKIDDLGFPLVLKSRRHGYDGQGTFIIHDLATLQEKIDLNHNTNTTYLIEEFIPFERELAVIAARSVDGEVVIYPVVETQQEQQVCRRVIAPAHITPDQAAAAEAIASTLLNSLEVVGVFGIELFLTADGQVLVNEIAPRTHNSGHFSLDACETSQFEQHLRAICGLPLGNPALQCAGTVMVNLLGYENSQSDYQNQRQQLAAIPQAHVHWYGKTESRPGRKLGHVTVLLNNHDQTTAQAIAQTVESIWYPT
